United States Patent 10,597,667 (STRESS TOLERANCE IN PLANTS) - sequence listing, part 5

SEQ ID NO: 12780 - DNA, 664 bp, Helianthus annuus
  misc_feature (582)..(582): n is a, c, g, or t
  Predicted polypeptide sequence is orthologous to G1512
ttcgttttcgggtagtgttttgccccgaccgtaaagtgggaccactgaggtgtgggatatttcggatttacatacgggacataacggattattatctgaatcggtctgaaaagatagccatttgtagatacacggccagcaatatagatgaccgcaaagcgtaaccacagggtctttagcaaagtcgaggcagatactgcagtcgaagcaaggtaaagatttttcgggtgatgaaatgggatttaagtcgtcggtaaaatagttttcgaattccattgtcgattcgagtgtggtttttggaagcttgcttattccaaatatgcgatgaatattcttcttcgttgatcagcgacttgagaaaggagatgagagttgggggagtacgcggtggcatgtcacaaccttgtgtccaaacatcagctaacgtttcagaaggtgatccaatgtgacgaccttccgggcctcactcacaagttgactattcaggcagcagatggtggtgtatcacatacctacgaagctgtggtttgttacaaaccactgatccaatacaagaagcttatttccttcaaactagcttanaggaactttgattgtaataccaataaagcaagtttgattaagaaatgaatgaataaactataaaaagtacctacctttaagc

SEQ ID NO: 12781 - DNA, 615 bp, Helianthus annuus
  Predicted polypeptide sequence is orthologous to G1743
ttttttttttttagttcccaactttatcttaaacaagttaaaaagagtttacatgtcataagtccagaacttctagttttcaacatttgaaataaaacacaactcccttaaactgaagcattagatcaatcactcctacaacactaaaaacctatccaacataagcaaactatcaaaaactcttagaaggcaccagcgaaagcccggagaacaccggagtccggcaaaacggacacgaagtctccttctcgtgaagcagtttaccaacacaatcagagtggaaaacatgaccacaccggctaagctgactaaccacatcatcaccattataatcttttaaacatatgaaacacatccggtctacatatctctgcctgatgttttgcaaatcttggaaccgaataatcggaagatcaaccaaacatacatgttcttcgtggagatccgaatcaactccaccgtatcgaaaaaagtatgagatggaatgtttaaggagagtgagtaactcactcttgatgcgaagaattagtaagagtgtaatgcagatgttgaagatgattatgattgacatttttgagtttggaagtgtcgatgacccagggtgaccgttcccct

SEQ ID NO: 12782 - DNA, 538 bp, Helianthus annuus
  Predicted polypeptide sequence is orthologous to G1789, G1911
gatatttcctcatcttaattacctggggtgttcaacttctctgcattgaagaaatggcttcaagttctaactggacgtgggagcaaaacaagctgttcgagaactcgttagttacgtacaatgacgaccctgatcgattccaaaagatcgctaaaatcgtaggtaagagtgtggaggaggtgaaggttcactaccaaaaccttgtccatgatgtgaatgctattgaggctggcaaaattccgctgccaaactacaaaaccgatgaagccaaaggacaacaaaacaaaaagaaatgaatttggaatatggttattcaagataaatttaagtagtgggtaaaagaatagtaatttaataaagtccccaccccctgtgtgttttctcttgtattttctatggaaatatgtatgtttagtgttcttaatccaattaagaactgcaagatatatagttatctaatggtaatatcatatgttgttgggccaaaaaataaaaatgattgtataaattaaacatgtcggccgccttggcccaatcg

SEQ ID NO: 12783 - DNA, 1437 bp, Helianthus annuus
  Predicted polypeptide sequence is orthologous to G1804
atactcttaacgagagcggaaagaatttcgggtcgatgaatatggacgagtttctgaacagcatttggaccgctgaggaaaaccaggcccacactcaagcccaccctcccacggccgccaccattggtggtggtatctccacttccgccgcgatggccactaacggtgctagtagtagtgggcagtttttgatgggaatcaacgcgaattcggctgaaccgaatatgattgctaggcaagtaagtttatctagacaagggtcgttgactctcccgggcccgttatctaggaaaacagtcgatgaggtttggtccgaaattcaaaaaactcgacaagatcaccaacagccaagcaatgacaataactcgtgtaatgaacaagttcccggtgcccaacgccaaccgacttatggagaaatgaccctcgaggatttcttagtgaaggcaggggttgttcgggaacaaaatcatccgaatgctcctcctgttccacagcaagttccggcttcttttgggctgtaccccacaaatggaaacaatcggattatcggacctccaccgagctcggcccacatggtaaggcccatgttaggccttagtacaggtggcggtgcaagtgttatcccaccatattcacccctaatcagggagacaccgggttatcccggaggaaaacgagcaggcaattatcaacaacagccgcctccatacggtggcattgggggtaatgcaggtggtgttgctggtggttatggacaggggctcgggattggatcaccaccgagtccagtatcttctgatggaattgctaccactcagctcgatagtgggaatcagtatgcgctggaaatgggaggcataagaggcggacgaaaacggataattgacggtccagttgagaaagttgtggagaggcgccaacgaaggatgataaaaaaccgcgagtctgctgcaagatctcgggctagaaaacaggcttacaccgtggaactggaggccgaattgaacatgctaaaagaggagaatgctcaactcaagcaagctctggcagaaattgagagaaaaagaaaacaacagttttcggaagaaataaggatgaaaggtgtgacaaagtgtcaaaaagtgagagacaagtcaaggatgttaaggaggacttcaagttgtccaacctgattgccagtcaaatagacatccagtaacggttttttgtatttcgtgcaaacttgaataacagatgacatattatattatatataggtggtttggttctttgttgtatgagaaaactgagggatgcaagcacgctggctagtcgggatcaccgggaaagtgatcgacgatgcgtcgatctggtcggtcgaattgtcccgtaaaagccttggcggctgcttgtcttcgtatctcgtgtgaattatagtcattatagatttgatcttgc

SEQ ID NO: 12784 - DNA, 192 bp, Helianthus annuus
  Predicted polypeptide sequence is orthologous to G1837
tgcagccatggtggtttaatagacagatttgataccacgctatattagtcggcaaatttgagccaaacaagttggtccctttatgctaacatatcattatattacttccttttgtaaatgcaatttgtatctattcatattgatacaactctttaactcgaaaaaaaaaaaaaaaaaaaaaaaaaaaaaaaa

SEQ ID NO: 12785 - DNA, 165 bp, Helianthus annuus
  Predicted polypeptide sequence is orthologous to G1837
aggttgcgtttgatgggtttctaaagatacttgccatttgattgtgcatcgcggaaacaagtgggcgtgaatgggagtttaacacgttgagaagacactaaatcagacatgaatcaattatcggaattcaatcacaaaaaaaaaaaaaaaaaaaaaaaaaaaaaa

SEQ ID NO: 12786 - DNA, 473 bp, Helianthus annuus
  Predicted polypeptide sequence is orthologous to G1927, G2184
gttttcttctgctttatgggcttttgttgactcgataccaacaacgccagcttcggcttcagaaagtagtgcacttgtaaacagggcgtttgaacgaatgtcaagctttggtaggggtaaaaacgtaaatttagcggccactgatgccagtgccgctagtggcaacacaacgaaaaggttagagaaaccaaaaccgtcgagatcaagtaggaggggtattttatatttttctgttcttggagtattgtgtgctattttatgggtatttatagggtggtgtattgaattatcgagtagattgttacggtgattggtgtagattttgaatgggttagccgtagtggtttactagtgtcttgttggtaacgatggcagccatgagctcgatcgattggaatgtgttcaaatgtggcaataaaagtcgattcttgtccgtggtttaaaaaaaaaaaaaaaaaaaaaaaaaaaaaaaa

SEQ ID NO: 12787 - DNA, 735 bp, Helianthus annuus
  Predicted polypeptide sequence is orthologous to G1928
tcggccttatggccgctagtcgggttccgaggtggttcggttgatgctgatgctcttggaaagaagggttcttgaaaagcattattataagcctcttggaaagcattaatggagccaacactttcacaagccaatgaattgggttgagaattagcaaacccaccacttaaccctagcatctcttgttgattctcatcagttgaagacaaattttcaagaccagaagcatgatgatgatgagctgtcaataatgttgtaggtgcacacatgtgatcattttggtgggacccacttagaatggactggtgctgctgttgttgctgttgctgttgtgacatgacaatgacagtattggtactagctgcaggcttgctcatggtctcacccatctgagctgccttttggggcaatgcagtggcagacgtgtgagatggagaaggtgatggaaaatcaatattattattattattacttgcattgttagggtttgagtttgagtttggttgatgacggtgatgaacaaaccatgatggtaattgattgttttgttgcaaatgatcattagacattatgttggagttgagttgtgggtattggaagagatgtggttcagttttgagtgggtagtttaatgggagatgaaggggaagctgatggtattggtgagcgtgtgtagcggtgatgtaaattcatttagggactgctatgctaaatgcttcattttttgcatgattg

SEQ ID NO: 12788 - DNA, 373 bp, Helianthus annuus
  misc_feature (14)..(16): n is a, c, g, or t
  misc_feature (18)..(18): n is a, c, g, or t
  Predicted polypeptide sequence is orthologous to G1928
tttttttttttttnnncnaagcggcaaaacggtgacataaaatttctattaattacccaaaccaaaaaaactcccaaccaaaacccttgatcttacacgaagtaagatctgatgtacaaatgattagatcgactgagttgatctatgaaatacaaagacagtaaaggaacaagaacgcatacaacctgatctacacagcaagatacaaagacgaacaaatctctcagatgagattaacaaacaagacagaaagatcttcacagttgagatcgatgtgtagtccaagagacaaactgaacttcacggctggatataatctttggaacaccacaatggagagaaaccttttagaaagaacttgtgagcggacgcg

SEQ ID NO: 12789 - DNA, 254 bp, Helianthus annuus
  Predicted polypeptide sequence is orthologous to G1928
ttttttttttttaaacaatgaccaaacagtaggttacaaacacgaaaaacttaccatctacatgaacaacagaatcttaggatgatgcttgttgtcgatgatgcacaaagtcaacaaactaaaaggaacctggtaataaatatcgcaaaacttaagtcaaaaatgcataacacttgtcgccaagacatcttttttgtcacaaaatgctgtaagtaggataggcacaaatggttaattaccatttgtggtggtgc

SEQ ID NO: 12790 - DNA, 626 bp, Helianthus annuus
  misc_feature (605)..(605): n is a, c, g, or t
  Predicted polypeptide sequence is orthologous to G2010, G2347
ccgggatagggactgatggccgcttgacgggaaagaggggttcaagtagtggtagtagtagtatgcaagctttctttcaggtggaaggttgtacaagtgatatgattaactgcaaaacgtaccatcggcgacataaagtttgcgaggttcattctagggctccaattgttttcaccggcggatgccaacaacgcttctgtcaccaatgcagcatgtttcatgacgtaacggaatttgatgatgccaaaaggagttgtcgtatgcgtttggctgggcataatgaacgcaggcgtaaaagctcgtatgagaatttcgagagaaagttcttgaatgttggagaaacaaatgttgttgatcatgatgaatgaaggtggctcaccgactagtgatatcataagacgtatatatctatatttgctatgtattgtgctctctcccttctgtcacgcataagtaaatataatgattattaagatatatatatataactaagtgaagaagcagtgtaccaatcgtactatgcgtgtttatgatcgctttctgggtgcaaaatgtaagtaaggataatattaatgttgagaatcaagctcttctgatttggcgcntactactactaccactacttg

SEQ ID NO: 12791 - DNA, 266 bp, Helianthus annuus
  Predicted polypeptide sequence is orthologous to G2057
ttttttttttttttctccggggcaaaaagaaaagcacattatctacttaattagcatagaaagagggggtccatggttgacagttcgctctcgcatcttacatgatagaccaaacaaccatactttgtggcaccacgacgaagatacactcatcggcccaaactcctcgagctcgaaaccaccagtgcccctcccccaagaatcacgcccaagcgatccccccaaattaacaaactgagcggcccatgaacacaccgcacaccacc

SEQ ID NO: 12792 - DNA, 326 bp, Helianthus annuus
  Predicted polypeptide sequence is orthologous to G2060
acgcgggggttaagatcaatggccaaagcacttcaagcaaacggaaacaaaaaaggtcaacacgcataacttaacaggtttcgtgtttatatcgtgtctttgtaagcgcgttcttattttcctgttttacatgtatgtgtcatttgttcattctttttactgaaaaactgttcgtgttgataggatagtagcttgaaagggtatttatgtaatttacgccaaccatacacaacaatagacagatatggttattttgtttgcatttgtgtattattgaatgaggtaaaattcaatatgtaagttccaaaaaaaaaaaaaaaaaaaaa

SEQ ID NO: 12793 - DNA, 566 bp, Helianthus annuus
  Predicted polypeptide sequence is orthologous to G2157
atggcctctgggcgggaagtggtgattgcggcgacatttactaacgcgacttacgagcgcctgccgttggaagatgacgtacgaagaaggggctgacatgcaaatacagcaaacttcaggggtcaatgctggaaatagtcctccatctggaggggctcctcctcatggtgataacataccatcttcttcaatggcgatttacaatcagccccctaaactattgccaaatggtcaaatgcatcaggatatgttttggactactcctccacgctcttcaccgtctaatttctagctattgtcaaaccaagttcctctcctttgtagaagaatagggtagaaactacaaaggtagaattttctttttcttggatgatattttgattagggtcgccaaccttgttttgttgtaatatcaatgtgacttatctatttagtttggtggtagtttgatggttttgaagcgccgttaaaaaaaggtaccggaaataaaatttcccggccggatgggcccaagggactatttactcgaaccaacttattggtggggcccccaatccagcacactg

SEQ ID NO: 12794 - DNA, 374 bp, Helianthus annuus
  Predicted polypeptide sequence is orthologous to G2417
ccggtctcattctgtgaagaaagcaggtcaaagttgcggatcaaagtttttgacaggatccgggatcgaaaacctccatgttcttgaagttttgctacaaatgatgtattgaagggggggtttggttggtggataaagaagtttggtgcttctttgtgtttaggttttagtccttttcttgggggtttctttttggtgaattatctccttttgaagggttcaagacaataataatgttgctggacatatattatataaaaagacaaaagggaaggggtgggggttgcatatatttatattattatatatttttgacgcacatgaaaaagagttaaccctttgatttttatatgtttaatcttttggttgatggc

SEQ ID NO: 12795 - DNA, 714 bp, Helianthus annuus
  misc_feature (689)..(689): n is a, c, g, or t
  misc_feature (696)..(696): n is a, c, g, or t
  Predicted polypeptide sequence is orthologous to G2456
acttttttttttccttttttttttatcttctcacacttcaaattttgttcatagacttaatgtttctgtgcttatctttgcttttctttccttttgcatgtatatcgaaatcagaaagtgtatgtatctatctaccccagaaaatataatggttaaaattgtttgatatataaagataatgatgatgttatgataagagagagagagagagagagagagagagagagaaaagatggttcacaaaatagtcagcagtgaaacgattttaatgtaatgtctgtttactttgtcggtttgtttgtcttctatttgcagctccagagaaacgccaaagagtgccttctgcttacaacagattcatcaaggaagagatccaacgtatcaaagcaggaaaccctgatatcagtcacagagaggcattcagtgcagctgcaaaaaattgggcccattttcctcacatccacttcggactcatgcctgatcaacccgtgaagaaacccaatgtgtgccaacaggaaggggaggatctgctcatgaaagatggatttttgaccacggccaatgtcggtgtttcgccttattaatcaagctaggggttctacgtttatcgtgtactttgcatgccttgctgttgcttaaaatgttgattaaaaccaaataattagggggttcttgtttttatcccctanaacgaanactgaaagtggtacctcg

SEQ ID NO: 12796 - DNA, 304 bp, Helianthus annuus
  Predicted polypeptide sequence is orthologous to G2592, G2713
aacttctcagccgactcaagcggagccggataaagttatcttgcagtttggaaaagtggggaaagatatgttcacaatggattatcggtacccgttatctgcgtttcaagcttttgctatctgtttaagcagctttgacaccaaattagcttgtgaatagaaggaaataaataacagtcaaagcttaaaaaacccaaaatttacgttactttgctagcagaaaaaggaaattgttgttgctgttgttatgttttgaagtgaaaaaacttgattataaactcgaaacgttttccaagttgatggt

SEQ ID NO: 12797 - DNA, 420 bp, Helianthus annuus
  Predicted polypeptide sequence is orthologous to G2592, G2713
agcaggaacgtcgcagccggctcaaccggagcatgacaaagtcatcttgcagtttggcaaagtcggtaaagacatgttcaccatggattaccggtatccattgtctgcatttcaagcttttgctatctgtttaagcagctttgataccaaactagcttgtgaataaaacaaaaaaacccactaagaggtttaaaagattttatttggaatgattaacgttgtccaggcgtgttttatgtgaaactccgaagtttagctgctattgtttgttatccaatcctttaaaactatctagtggaaacttttaatggtttttttatgtttaataaataatattttaatatggttgaaaaagatcttgtttaataaaggtggttttgttattaaaaaaaaaaaaaaaaaaaaaaaaaaaaaaaaaaa

SEQ ID NO: 12798 - DNA, 372 bp, Helianthus annuus
  Predicted polypeptide sequence is orthologous to G2639, G2640
gaggtaggtaacttcccatcagaagtgacaacacaagcagacttcagatgtgtaagagttagctccattgatgaaaccgaagaccaatttgcatatcaagctgcagtaaatattggtggacatttgttcaaaggaattctctatgatcaagggcctgaagatcagtacatgggcggcgacacctcttccggcggcagcgcaggtatcccgggtagttccaccgcagccgcaaattttatcggccattcgctatactcatctcttggcggcaacgattacatgaccagtacgcaattcttccatcaaatttcaagagattaaataaatcacataataaacgccaattcgacttgttgaaaaaaaaaaaaaaaa

SEQ ID NO: 12799 - DNA, 703 bp, Helianthus annuus
  Predicted polypeptide sequence is orthologous to G2854
gatgtttcagattacatactgcaagaaactttcaaaaatgtttattcatctgtcaaaggagcaaaagttgtcactgatagaacaaccggacgaactaagggatacggttttgttagatttggagacgagagtgaacaaattcgtgccatgtctgaaatgaatggtgttctttgttcttctaggccgatgagaatcggtcctgctgctaccaagacaggtgcaggaggtggcatgcaaaaagctccttaccagagtgctgaaggaagtcagggagagagtgatccgaacaatacaactatatttgttggagggctggatccaagtgtttccgatgaggccttgaggcaggtgtttggccagtttggtgaactaattcatgtgaagatacccatgggtaaacgttgcggctttgttcagtttgctaccaggcaaagtgcagaacaagcgttggcacatctaaacgggaccgagttaggaggccagaatgtccgcctttcgtggggtcgtagtccctcaagcaaacaggggcagcctgagcaagcccagtatggaggtggaggcggtggtggttattatggttacggacagggatatgggtatgctccaccagctcaagatccaaatgcttattatggagtctatgcaggagcaggcgggtatggtggttatcaacaacaaccacagcagtgatgtggagagtgtg

SEQ ID NO: 12800 - DNA, 461 bp, Helianthus annuus
  Predicted polypeptide sequence is orthologous to G2994
ttttttttttaaatgttgataaaaacattgaccatacattattttacaaacatgaaaatgttaccatctacatggacgactgaatcttaggatgatgcttgttggtgttgatgtccaaagtccacaaactaaaaggaagttggtagtaaatatagaaaaacttaagccgccattgcataaatcttgtggccaagacaacttggttgtcacaaaatgcttcaagtacgataggctcaaaagggtaatcaccatccgtggtggggccgtccagcagcgtgattgtctgagccatgagaattatggctatcggcgacaagaggaggctggcccgaattattgaatgagccttcagggtttgactttgacccgattccgctaggagcgcttttggcaccttcactatcatcattttgggtcactagagccgccatgaccaccgctaccactacacactgtcgctg

SEQ ID NO: 12801 - DNA, 621 bp, Helianthus annuus
  misc_feature (603)..(604): n is a, c, g, or t
  misc_feature (607)..(607): n is a, c, g, or t
  Predicted polypeptide sequence is orthologous to G3074
gcgcgggattgagctggcacccgggtaaacggccatgatggccggtgcacgggggagaggaagaggccgtggcagaggtagagtatctgcagaacgagatcctccccccactgaacctgaatctgttcatcacagcaggaagcccacaaccgacatccactcggagtccatcactgcagacgacgacgttgttccaagcagaggcttcgatctcaatgctggccttgatgagaatacagataaagtgtctgctgctgcatcagatggtgctgcgccaccacaaccaccaccaccagcagtggttgcagaacctagcgaagttgcaaataatgagtaccctgggtggtcagtttcagaaatcgacaggatggccattgaccctcatcttgcacacgccaactcaaggttggatgaggaagatgaagactatgatgaagagtaatgcttctattatttctatttgactgcttcttcgttggatatgtatgctggatgtattcatcatttctttggtgttggtgtacgcatattatcctacttcatggcacctgtaacaaaatatttaacatttatgtatgtgctttaggcttaaatatgggcgannctntacctctggcaagg

SEQ ID NO: 12802 - DNA, 473 bp, Helianthus annuus
  Predicted polypeptide sequence is orthologous to G3074
tttttttttaaaccgaaccaaatcttaaattgctttattagaatttcaagcgaattcgaatcgacttgcctcagtttgggcaggtgggtcgctttcaaatgttttttgagcatccctactacatgatcatagaaatcctcatgccgattgcaaagaagataaacagacatgcgatcaaattatactgtgaatagctacagtacaaaacattaaaaagaaacaaacggaaacaaactgagcatctttaagttcatcttttatttgcatcaaagaaatctagcagttcatcattattcttcatcataatcttcatcttcctcatccaacctggagttaatttccgccagattgcgagtgtcaattgccatcctgtccatttctgttaatgacaacccaagataatcttcattcttaagttcaccaggatttgctgatgaggaaccgccactaccaggaaccgcctgtggggtgga

SEQ ID NO: 12803 - DNA, 729 bp, Helianthus annuus
  misc_feature (681)..(681): n is a, c, g, or t
  Predicted polypeptide sequence is orthologous to G3091
aggacctgatgatgaagaacaaaagtggccgctgtggttgaagcctatgcttagagaaaagttctttgttcaatgtaaattacacgccgattcgcacaagtcggaatgcaatatgtactgtttagattgcaccaatggtgctctctgttcactctgtctcaatcaacacaaggatcatcgcgccattcagatacggaggtcatcatatcacgacgtgattagagtatccgagattcagaaatacttggacatcagttcggttcaaacttacgttatcaacagcgcaaaggttgtgttcttgaacgaacggccgcagcccaggcctggcaaaggggttacgaaaacctgcgaagtttgcgaccgaagccttcttgattctttccgattctgctcacttggttgtcagatcgttgggacgtcaaagaatttcgagaagaaaaaacatttaaccttggctatctccgattccgaggattcatacagcagcaacagccgcaacagtcggaaaaacaacaacattcgggtcaacagcttcactccgtcaacgccgccgccaaccgcaggcagcttcaggacggcgaagaggagaaaggggatacctcatagagccccaatgggtggacttgttatagaatattgaatcagtcagtcaaccccctcttcttttacttaattacacanaggtccctcattatacaacaccagtgcttttttacaaggcctgtgttt

SEQ ID NO: 12804 - DNA, 706 bp, Helianthus annuus
  Predicted polypeptide sequence is orthologous to G3095
caaaggagtcaccaaccattgcgagatctgtggccgaagcctcgttgatgcttttcggttttgttcccttggttgcaagcttggtggcatgaagcgcggtgatcgagaactgagcttcacccataggatgaaacacggccgtgacggttacgagtcatacgagccattgacaccgacaccgaagaaagtgaaaagatcgcatttgttcaatcagcttatcgacacccatatctttcagtacaatctttatggtcgaaatggtcattccgacatgtcatcttcatctacatccggtgatgaaacgaccgccatcatgtcccctgggacgccacctcttttcaaccaccggaattccagtaggagaaagggcatacctcggcgggcaccattttaatgatcgatcgatgaaaacgtcaagggtaatatggtaatttgacatgggttcaatatctacgttatagaaaggtgaatatactatatggggatatagtgtagttgtgaaaaaagatgatacataagttagtataaggtgttgtgttgatatacatacatatttatataaatatgtatttctttttgaagttaggaaaaagaaagaaaaatggtgaaaattaggttttatatgaaatgtatagaagtagatacattaatgtgtgcatgtaaatattatgtttttatatgaaaatttataatatacggatgtgta

SEQ ID NO: 12805 - DNA, 323 bp, Helianthus annuus
  Predicted polypeptide sequence is orthologous to G3967
ggggaggaagatgaaaggtaatagcaagagctatggagggggtctagatacctacaagtctcacaccctccctaaaccaactatttcaaagaaagtctcaccttttttaagggagagaagctttgcaaagtcaacgctggttcaaagtcaacataacatctaatggtgtttgaaaaattttgagctagtaaaagatcatagcatgtttgtagcagacttgagattatttcatcataattaaaggcttgtaaatattatgaagacggtccgggttggttaccggcaaattttctaaaaaaaaaaaaaaaaaaaaaaaaaaaaaa

SEQ ID NO: 12806 - DNA, 490 bp, Lactuca sativa
  Predicted polypeptide sequence is orthologous to G28, G22, G1006
aaagacaatgataccaaacattgccactgttaaatctgagccggaggtttttgtgggatcgccggagatttcaagttatgaaaatggatcgccgccgcagacggtgggagttgatgatgtgacgcaacagaaggggaaacattacaggggtgtgcgacgacggccttggggtaaattcgcggctgaaattcgggatccggcgaagaatggtgctcgggtgtggctagggacgtttgagacggcggaagatgcggcgtttgcatatgacagggcggcgtataagatgcgtggttctccggcgaactcatcggaagatcgatcgctcaagaggacaaagaaggtggaacaaatccacgtggcgaatagttagtggttgatggatgctgactgtaactgtggattaccttttttttttttttaatttcgtattttatcgtgtaaatagctgtttttttgtgcataaatgacaaatttattatttttttattct

SEQ ID NO: 12807 - DNA, 918 bp, Lactuca sativa
  Predicted polypeptide sequence is orthologous to G28, G22, G1006
cgcggggataccattaaatttgtttacataacacctaccacccaaaagcaaacccacatttcatctatggaaaccctttcttctcctttacaatctggttattccgtttttgatgccattcgcaagcatcttttggatgaccgggatgaggctcccgagatgctaccagctgtgacaagtcccagcagtgatcagtcctgttttagtaaagaaaatggtccggagtctttgaagaagataatggaacaggaatctggtgaaggtgaaaaccatacaaaatcagaaaatgttaagaaaaagaagaagaagaaaacaccggctgcaaatggtgaggatgatcctgtggaatggactcgttacagaggtgtgaggaggcggccatgggggaagtttacggcggagatcagaaatccagagaggaaaaaggcgagattatggttgggtacttttgacacgccggaggaagctgcggtggcatatgacaaagcagcatttcagttccgtggtagtcgagccaaagttaacttccctctcttgctttgccaagatgtatggaagcccgaatcgtcttcctcctcgactaatgcagatgtcggaaaatgcaagaaaaaagttgcggtggatccacccatgggcaccaccacctccgcccttgtacgtcatgatgatacccatacgttaagcacgatagaacccccagtttccacgaatattgcggttgagaaggagtcaaggagcgataaagacctggttacgaagccttgtaaaagcacagtgcattcgccaaccacctcggcctccggaactgaagagatgtgtgaccttgactcaatctgggatttcaaacatgtacattaccacctttttcaccgatggtatcggttggcgattacaccttgcagtcaagcaaatcatcct

SEQ ID NO: 12808 - DNA, 641 bp, Lactuca sativa
  Predicted polypeptide sequence is orthologous to G481, G482, G485, G1364, G2345
tactcgtttccgcagctctcaaattctccaccactttcgcctgcaccctcagcatccccggagctccggcagtctctgtctcttctagagccggagatcttcttcgcgccaaattaattcgaataattcaacggatatggcggactcggataacgaatctggaggacacaacgcgggcggtgatttgtcggcgagagagcaagacaggtttcttccgattgctaacgtgagtcggatcatgaagaaggcgctgccggcgaacgcaaagatctccaaggatgcgaaggagacggtgcaggagtgcgtgtcggagttcatcagctttataaccggcgaggcttcggataagtgccaaagggagaagaggaagacgattaacggtgacgatttgctatgggcgatgacgacgttagggtttgaggagtacgttgagcctctgaaggtgtacttagcgaagtacaggggattggaacgggagaagacgacgatgggaacgccaggggagaaggacggttcatctggaggaggtgttgatgctgcagtaggcggcggaagtactgccggagagttaatccggtggatataacgggatgtacggagggacaggatatcatcaaatgtataatttcgggtcagtatca

SEQ ID NO: 12809 - DNA, 942 bp, Lactuca sativa
  misc_feature (845)..(845): n is a, c, g, or t
  Predicted polypeptide sequence is orthologous to G867, G9, G993, G1930
catcatatttctctctccataattcataaaacctcattcatcctcctgtttctctctctttcaagaagactaattagtaatggatggaagttcaactgatgatcaaagcacaacaacagagacaacttcaacagttgcagcacctgtgactacgcctccactgatcggcagcggcggcagcatggttgtcgacatggaaggtggtttggaagccgagtcaaggaagctgccttcgtcaaggttcaaaggggtagtccctcagccaaacggccgttggggagctcagatttacgagaaacaccaacgcgtgtggcttgggacctttaacgaagaacatgaagctgctaaagcctatgatacagccgttcagcgcttccgtggtcgcgatgctgtcaccaacttcaagccgcttccagccgacacagaagaagccgggttagaagccagtttcttgaattcccattcaaaagctgagatcgtcgatatgttgaggaaacacacatacaatgatgagctacaacaaagcaaaagaagctgcaacttaaacaaaaccccttgtacaaacgggtttagatcgggtcaacagttggtcaacgcccgggaacaactctttgagaagacagtcaccccaagcgacgtcggaaaacttaaccgattagtgataccaaagcagcacgctgagaaacacttcccgttgcaaagcgaaagcacttccaaaggtgttcttttacatttcgaagacatcgggatgaaagtatggagatttcgttactcatactggaatagtagtcagagctacgttttgaccaaagggtggagccgattcgtgaaggaaaagaacttanaagccggtgacattgtgagctttcaagatccacgggttcagacaagcaactttacatcgactggaagacaaaaaacgggtcgggtagctccaatatt

SEQ ID NO: 12810 - DNA, 730 bp, Lactuca sativa
  Predicted polypeptide sequence is orthologous to G1274, G1275
gcggggatccaaatgaattattatgatcatcaaatgtctaaagcctacagttacagatcagtagactcacctgacatggactatgatgttccaaaccagcaaacttatgagtttgttgagagctttctcagctttgatgattggataactgaagataaagcatccactgttcctgagtatcaagatcatactcctgtttacccttctgccaccattgaagatggtggtctgtcgatcggaagtagcagcagcaacagccatcttcatgatggaagtagaagcagggccacaggatttgggcaggctcaaaatggcaaaaaagagaaagtcgccttcaaaacaaaatcccaagttgagatcctagatgacggttttaagtggaggaaatatggcaaaaagatggttaaaaacagtccaaacccaaggaattattatcgttgttcagcagcaggatgttcggtgaaaaagagagttgaaagggatgtagaggatgcacgatatgtaatcacaacctacgagggtattcacaaccaccaacgcccttctaactactgatagcttgtactacgatttgttaatgtatgctaaagaatagtagtttttctaagcttactccatcactagcttattgaaaagaaagttgtagttcggttacttattttcttcaaccgaccaaggttatgaatcgttttagaatataattgtttttaactgctatgaagcagtcttt

SEQ ID NO: 12811 - DNA, 416 bp, Lactuca sativa
  Predicted polypeptide sequence is orthologous to G1988
tatggccgtatcgggtggggttggctgcttccctttggctgggaatgatgagatgtacaaaggacgatgagaagaagaggataagaatgcgtagcttactgagcaagttagaggagatctccggtgtgccggcgaggtcgatagtggtggcggaatcaaaacttgcgagcatgttgaagatgatgaagcatcggcgaggccagcaacatgatgaggagtctgtggaggagggctgggctgaatgctgaattaaactggttgatagaattgccgtatatggtatacatgcgtgtaaaattgagatttggtttgtagcaagagattaatactgagttaattaattaatataccttcatcttgtagtagttgatgtttcataattcatatcatgaacggatttgtcgtagtagtattgc

SEQ ID NO: 12812 - DNA, 934 bp, Lactuca sativa
  misc_feature (872)..(872): n is a, c, g, or t
  Predicted polypeptide sequence is orthologous to G2
cttggcggggattcgcatttcatcatcaaatggctagatagaaattataagactcgaagaaggacgttgtttcagcgttgcaagtgttttggttattgggtattgactttgaaaaagagaagtaatgtgggatctaaacgggtctcccgatcggagaaggagagacgaagacgaaggtgaggggtgttcttcagcgccggtggtaggggaggaggaatataataatatcaagggtaaaagggttggaggatccgtgtctaattccagctcatcgatcatagttgtcgatcaggacgacgggtccgacgtcgatgaggattccgacgccggtggtttacagaaactcacaaccaccggcgatagcaggttattcgggttctctatggccgacaactcatcctgggactacaatccgccggtcactcatcagttcttccctttggacgactctgaagttgggtctaccaccttcgtcggagcaggtagagagacgacgtcgttgcccactacttaccctacgtctaactggtttggggttaaattctcccacccgtcatcggagccttcatgtttcagtggtggtgttgccggtgggaacaatggattttccgggaaggtcaccgatgttcctcagccactcaagaaaagccgccgtggaccccggtctagaagttctcaataccgtggtgtcaccttttaccggcgaaccggccgatgggaatcacacatatgggattgtgggaaacaggtgtatcttggtggatttgatacagcacatgcagctgcacgtgcttatgatagggcagcccatcagtttcggggtgtggaggctgacataaacttcattcttcaagattatgaagacgacctanaacagacgagcaatttaacaaaggagagtttgtgcatgtacttcgaagacaaagtactggtt

SEQ ID NO: 12813 - DNA, 876 bp, Lactuca sativa
  Predicted polypeptide sequence is orthologous to G3
tctatcgaatcggaggagaggtcatgtagatcactgtcgtctccgattgaatcagggatattaagacgtgtcgatgggccacggaggtagaaaacgtcggtgtcgtaggcacgaccggcgtcgacgggggaggagtaagaaccaaaccaaatacgagaacgtttatcgagttctcgaatctcggtgacccacttcccccacttcctcatcctgattcctctgtagtagggtttgtttgtttcaattgactgaatctcctttctcttagatgttgaacagccgccgtctgcctctatgtgtggcggttgtgattgtcgtatggttcatcttctgttgctgttcctgtaactggccggcgtaggtgccgccgttttgaagccttttctgttcttccccagtatgttgattgtggtgactgtacctgggtttgtgagttctgtggtgcttttttctggtatgtcgagagggccgttaatctatctacatctgcacatctgaggtataatcattgttgtaggggtgggagtgtagttcttccttatccttctaggtttcccccttattttgttgccctatatggctggaaacgggagagcttccacagtaccaccacacttctcttgccattgccgatgacaaacacaaagccttggttgccgttggaaccttgactttgcactaaacagacttctacaataacgaaaaaagagaaagaagaagccaaataaggatgaaataaagtttcctggcgtgaagagatcaaatttagagatgttaaactcccactaaacttggtcgatgttcccaagggacctgttgtccagatttttttaaagatccgcaagttacttaccccttgctgcccacattaaacga

SEQ ID NO: 12814 - DNA, 890 bp, Lactuca sativa
  Predicted polypeptide sequence is orthologous to G4
cgggctgacccgacctttgcggaagatgagtttgtaaagaaccctagcaaatgctactcgaagcccatacgatctgagatctttgatgttgaagatgagtttgaggctgcttttcaaggatttaaggacgaaatcgaagccgaagttgtggagcattttgttagcccttcaaatttgtctgtctccaaaggctctggctcaaaacctgtgaagtccgataatgaacctgagaaatcaagttcaaggaaaaggaaaaaccagtacagagggatccgtcaacgcccatggggcaaatgggcggcagagatccgtgacccgaggaaaggcgttcgtgtgtggcttggaacttttaatactgctgaagaagccgctagggcttatgatgaagaggcaagaaggatccgagggaagaaggcaaaggttaacttcccattagaagagaaaccagaagttaaccctattgctgctgctactactatggggattaaacccaaactatttactccatctgagagtgcagctgctgtctttcacttcaattctgatcaggggagcaactcttttggttgttctgactttggttggggggagcattgtgtaatgactcctgatattacatctgttttctcagaggttgatgatgtgaatcctgctaaaaaacctgaaaaggttgatgagtcgctctttcagatgccctgttttgaagggaactgggatgctttcctgaatggagatgcagctcaagatgatggaaatgcagtggatctttggagctttaatgatcttcctgtcattatggatggatctttctaatcaactatgtatttgttggcgaatggataaagcatgcttaagcctttgaatggtgtatcagttgcagagtatatagc

SEQ ID NO: 12815 - DNA, 882 bp, Lactuca sativa
  misc_feature (708)..(708): n is a, c, g, or t
  Predicted polypeptide sequence is orthologous to G4
gatgcctttgatattgacgatgagttcgaggctgattttcagggatttaaggatcaggttgaaatcgatcaggataacaagccttttgctttctccgcctccaaagattccgctcctgctcgtgggtcaagatctgtgaaatctgatgatcaggttgagagatctggttccaggaaaaggaagaaccagtacagaggaatccgtcagcggccatggggaaaatgggccgccgagatacgtgatccaaggaaaggcgtccgtgtatggcttggaacctttaataccgctgaagaagctgcgagggcttacgacgccgaggccagacgcatccgtggtgataaagcaaaagtcaacttcccggagaaagcttctccggcgaagcccaaatcccggaaacctgtttacaaacttggatctgtggaagagaaaccagaagctaatcctatgccggcggcgaaaccatttattccgtcggaaactgccgccttttacttcagttccgatcagggtagcaactcgtttgattgttccgatttcccatggggggagaactgtgtaagaactcccgagatcacatctgtgctttctgaagtcgatgaagctatctttatggaagatcctaatccagtgaagaagccgaaaacagagtctgtgaatttggtctcagattgtgagaataccgatgacctgttctttgagatgccatgngatgcttcttccgtcgacgctttcctcaacggcgattcaacaactcaggattgtgaaaccgtcatggatctatggagcttcgacgatctccctgtcatgatgaacggaggattctaattaaaactccaaaaaagtttcatttcatgtgtctgtaaataaggctttacatgtcag

SEQ ID NO: 12816 - DNA, 729 bp, Lactuca sativa
  Predicted polypeptide sequence is orthologous to G5, G974
ggggtgtgaggcaaaggcactggggaaaatgggtcgccgagatccgtttacccaagagccggacccggctttggttgggtacattcgactctgcggaggaagcggcgttggcatatgataaagccgcgtataagctccgtggagactacgcccggctcaactttccgcagcttcggcaaaacggctcttatgtcaccgactttaagccgttgcattcttctgtcgtcgccaagctacagacgatttgtcagtgtttggcggaggggaggtccgtggacggcactaagaaggccggttcacggcggtcatcggggaagacagcaacagcaactgttttgtcgcaagaggctgtgaaggtggaaggttgtgagagcgaagggtacgccggatcgggaaactcatcgccgtcgtctgatctgacgttcccggagttcacggaggacgacaatgcttggtcggagaatttctcactggagaagtatccgtcgtatgagatcgactggggttctatctagtgaaaccagaatcttgtaatagcgaagggcatatttgtaatttcgtaggcagatggcatatttgtaattcctaggattagtaatggtttgtttttgtaatttggtagggaggttgggagccaactgtaatggagtttttggaaattacagagctcaccacttcactctagtgggtagtttagtaaattcgtaatttatttttgtttatattttg

SEQ ID NO: 12817 - DNA, 916 bp, Lactuca sativa
  misc_feature (31)..(31): n is a, c, g, or t
  misc_feature (723)..(723): n is a, c, g, or t
  Predicted polypeptide sequence is orthologous to G5, G974
aaaacacaaaaggtgaggctgagagtcttcnttttctcacacatacacacactcaatcacactttcaagatttcttcactttcttgttttgagttcttcaattttaattacaattcccccccttctgtaactccccgcttctgttcatccctttctgcaaatcatctgtctttcaaaactgaaaaaataatattgatttgggtttgtttttgtttaatcttttcaacgattttttgagcaaaaaacaaacttgatttaaattctattttctacgagtcagagagtcaggtgtttttcagaatagagatccagcttttttcatttgggttctatttctaattttctgtaaatcttgattttttttttttcacatcaaaatcatacctttttagggtttattttagtcccttgaggttggttttattttagattttattaagtatttcgaagaaaaaagggtttaattattatttgaaaacccttgattttcctggtttttttcgtgggaaaatcttgaatttatttttcttcaattaattgattcaaaaattaaaaaaaaaaaattaagaatggcttctgctacaatggagttttggaatgttaatgatttccagcagtcaaccggtgagctcatggatgcacttgggcctttcttcaagtcaaattacgatagtacccttgctttctcttctccttctacttcttacccctacccttcttcgnctttctcttcttctccttcttcttcttcttctcctacccaacaagaatctggattttacccagatgggtacacccacggattctcgacccaagatccgtttggttatgaccaatccgtttcctctttcggattgaacagctgactccatctcagatccatcagatccaacccagatcaacttacctacctaca

SEQ ID NO: 12818 - DNA, 852 bp, Lactuca sativa
  misc_feature (809)..(809): n is a, c, g, or t
  Predicted polypeptide sequence is orthologous to G15
gcgggcagatacgttgctcacttgagaagagaagcagcggtttctctaggggagcttcaatttatagaggagtaacaagacaccatcaacatggcagatggcaagctcggattggtcgtgtggcagggaacaaagatctttacctaggcacatttagcactcaggaggacgctgcggaggcttatgatgttgctgctatcaaatttcgtggtgtaaatgcggttacaaactttgatgtgtcaaggtataatgtggaaaggatcatggagagcaatacccttctatctggggaactagcaaggcgaactaaagcacgagagcccatgaccgaggttgtggctaacgaagctcataatggtgaacacaaaaccctctcgaatgatgtcaccagtgatggtagcatgttggaatggaaaacggaagtatatgagcaaaacagtggtggtggagttgagggagatgagtcgtcgactatcaagaacaatggggactccggtgaagaatgcatgaaaaggaacaagaatcttccgatggttcttgggatgccgccggcgatgaatacatggatcccgactgtagctgcgacaacgacccaactgaggtctcatatgccgatttttgctgcatgggcagatgcgtagttgacgatggagacgagaaagaagtcttaggtcctgtaggatgtgacgaacccctaacaagctgacatggcgatgaactacggtgtttgtgttattttacttgctttatgtatgtgttagttttggttctttttgtgttttgggaaaatgcatggaatgataatttgnggactatgtaggatttttgtagacgatgggggtttgaactttc

SEQ ID NO: 12819 - DNA, 718 bp, Lactuca sativa
  Predicted polypeptide sequence is orthologous to G19
gttgctatcaagaacaaaactatttcaaagcacaaaaaaatctttaacgaagaaaaatcacaacctatcgagaagaagccaaaagcgaggaagaacaagtacagagggatcaggcagcggccatggggaaaatgggcggcggagatccgagacccacagcagggtgtccgagtctggctcggtacattcaacaccgctgaagaagctgcgcaagcctacgatgaagcagccaaacgtatcagaggtggtaaggccaagctcaactttccattaccaccggcgaagaagctgcgcactgagtcgactcagtcaaccgtccatgtaccaccatcaccacgaccccctacattactgagttacgaccagttccaaaaacaatcttactactcgaacagtgtggctgatgagcacgaattcaaggaacagatctcgaaccttgagacgttcttgggtcttgatcatgagttgactcagtttggtggactcggtggtgagtcagcaggtgatgtttggacgttggatgacttcccggttatcatctgagttgtttccgaataaactgagttgagtgagtgagaacccagtgagttgagtttaattagttcctatataaaacgtaagactcgtgttaatggggtggctggtggtaaggttgacgaaataagttgtgtcgccggcggcctacgcttgcggcacacaccatatccatatatggggg

SEQ ID NO: 12820 - DNA, 485 bp, Lactuca sativa
  Predicted polypeptide sequence is orthologous to G25
ggggggaaaggggtttgttccggcaatggtgaaagaaatagttacggagaagaaagcggaagtcgtacaggtaagttaacgaagtggagaatctgtcagaggaactcatggcgtacgaatcatatatgaaattttacgagatgccgtatctcgaaggggagccggcggagatgccggcgaatccagagggcggagttggcggtggttctcttgagctctggagcttcgatgacgatgttctggaagactgtaactagcagaacagaacagatcgaccttttcgtgtcgtagttgatttacgtgttcttgtttttagggcttaaatttgtaatttgaagataattttgtggcttcttttctttggattcacagacaaaattgtaatgttggtcgttggatgctttatttttattttgcttaatgccaacacgtaataatatgtttatgttgtaacctcagcgccaacgaatcaaattaattgttgc

SEQ ID NO: 12821 - DNA, 554 bp, Lactuca sativa
  Predicted polypeptide sequence is orthologous to G43, G46, G1419
gagatcagggatcctagcaagaaagggactagggtttggcttgggacttacgacaccgccatagatgcagcaaaagcgtatgataaagcagcgtttaagcttcgaggcaacaaagccttattgaatttcccgctcgaaattggaaattcagaggaagcggcggaaacggagacgagggtggtgacgagtaatagtcgtaaaagagctgccggaaagtctgagttggaagtgagaggaagtcggaaagaagtgaaagtagaaccagacacggcgaagtacggtggtgataaggctgatgctgcggttgggtccttaacatttgaaaaggtcccattattatcatcatcttatcctgccatggacttcacgtccggttgtatgatcaggagtaatggccctaaaagcgttgccggacagtctgtggtggaagtgagaggaagtcggaaagatgtgaaagtagaaccagagacggcggagtgcgacggtgataaggcggatgcagcggttgggtcgaccatatcgccgacaaactggacgccggacgataacagtat

SEQ ID NO: 12822 - DNA, 755 bp, Lactuca sativa
  Predicted polypeptide sequence is orthologous to G131, G135, G155
gagagagagagagagggtaatcgatcgccggaaaaatgggaagaggaagggtgacgttgaagaggatagagaacaagatcaatcggcaggtgactttctcaaaacggaggtcgggattgttgaagaaagctcatgagatctccgttctctgtgatgccgatgtcgcactcatcgtcttctctattaaaggaaagctctgcgagtactctactgattccggaatggaaaggatccttgaaagatatgaaagatactcatacgcagaaatgcaggccaatacaacccacaatgaaacacaaggaagctggtctctggaacatgcaaaactaaaagccagaatcgagcttttgcagaaaacccaaaggcatttcatgggagaagatcttgattccttgagcctcaaggaactccaaaatcttgagcagcaacttgatacagctcttaaacacgttaggttgagaaagaatcaactgatgcttgaatcaatttctgagcttcaaaagaaggatcaaaacaacaccctctctaagcaaatcaaagaactagagaaagacataccctcccaccaacaacaaaacaatgaaaccatgccctcattccaattcaacatcttcaacaaccctaatatgtgtgaaaatctttttgggagttggccttgtttggctaagattaggaaggaacaaatgggtgttattaataatcccagaattagtacttgtccctgagatagacaccttagtccatgggaaacttgt

SEQ ID NO: 12823 - DNA, 859 bp, Lactuca sativa
  Predicted polypeptide sequence is orthologous to G131, G135, G155
gcggggattaagtttgagtagaactcaaatctttcaagttattggaaaagaaaccctgtaaaagcaagctagatggggagaggaagggtgcagttaaagcggatcgagaacaagattagcagacaggtaacattttccaagagaagaacaggtttgctcaagaaagctcatgagatctctgtcttgtgcgatgctgatgttgctctcatcgttttttccacaaaaggcaaactttttgagtacgccactcactccagtatggagacgattcttgagaggtatgaaaggtattcgtatgcagagaaattgcttactgctcctgaaaccgaaacgcaggcaagctggactcttgaatcctccaagcttaaggcaaagattgaagttcttgaaaagaacataaggcactatgatggggaagatctagagcaactaaaccttagagagcttcaaaatgtggagcaacaacttgagactgctcttaagcgaatacggacaaaaaagaaccaactcatgcacgagtccatctctgagcttcataaaaaggagagggcattgcaagaaagaaacaattcactctctaagaagttgaaagagaatgagaagaccagtgagcaacaaattccaatgttgcacttacctcagcatccacctcagccatatccatgttcagttccttcttttgcaaatactagtggacctttcattggagcggccatgagggaggaggaatcagttcaagttcaacctgtctccacgaccatgatgccattgtggatgatccgccacattaaccaataagaacttaatcttccatccatcggagtgtgtgaatataattatataaagtggtcaacttttg

SEQ ID NO: 12824 - DNA, 891 bp, Lactuca sativa
  Predicted polypeptide sequence is orthologous to G133
ttctgtgttctttctcttcacaagcaactttttacgaaaacctaatgagaacaacatttcggatagatcgatagattgataaagctttgctaaaaaaggagatcaatggcgagaggaaagatccagataaagaagatagagaattcgacaaacaggcaggtgacgtattccaagaggagaaacggattgtttaagaaggcgagtgaactcactgtgctgtgctatgcaaaggtgtcgattatcatggtttcatgtactgataagcttcatgaatacatcagtccttctattacgatgaagcagttcttcgatcagtatcagaaggcaacaggaatcgatctctggaactctcattatcagaaaatgcaagaggaactgagacagcaaaaagagggaaacagaaatcttaggaagcaaattaggcaaagattgggtgattgcttggaagatctaaactttgaagaattgcttgcgcttgaaaaagattcacaagaggctgtctacattattcgtgaacgcaagctcaaagtcattggtaataaagtggggacttccaaaaagaaggtgagaagtgcccaagatgtatacaagaaactcatgcatgaatttgatttaagaggagaggatccacaatatgggatgatagaagatgggttggagtacgaaaatgtctatggatacccacaaatatctccaccaaacatcctaactctacgattacagtcagagcatcccaacaaccttcatatcgtacccggtggagctaatgcatccgacatgaccacttatggtttgcttgtgtaggacaatgcatattgctaactaatgaattgattgaattccaaaaaatttcatcgtgtgaactggttacgtttcataaagttttgcctt

SEQ ID NO: 12825 - DNA, 945 bp, Lactuca sativa
  misc_feature (740)..(740): n is a, c, g, or t
  Predicted polypeptide sequence is orthologous to G134
cggggaggaagcagtttgagagaatggggagaggaaagatagagatcaagaggatagagaacactagcaacagacaagtcacctactcaaagcgaaagaatggaatcatcaagaaagctaaagaaatcactgttctttgtgatgctaatgtctctcttgttatctgtggctcttctggaaagatgtatgaatactgtagccccaaaaccaacttgattgacatgctggatcgatatcaaaggctttctggaaataagttgtgggatgcaaaacatgagaatctgcagaatgaaattgatagaatcaagaaagagaacgaaagcatgcaaattgagctcaggcacttaaaaggggaagatataacatcgttgaactatgaagagctaattgcgtatgaagatgcacttgaaaatggactcaccaacattcgtgagaaaaaggatgaaatccctaaaatcatgaggaagcatgaacaagtactggaggaagagaataagcatctaatgtatcttgtgcaacaaagtgaaatggcaaccatgggagattaccaaggtcaagagcctttttcctttcgtgtccagccaatgcagcctaacttgcatgaaaggatgtaattgcaatgtttttatatatgcaagccttcaacttcatgaagcttgtaaacccagtgctatatggttggtaatatttcaagtatgctgatttagtagggtatcttgttaataagggttttctcttgngattgccttggtgcatgtaactgtgtttcaaacttatggtgtaggcctattgaaattgggtcaatatttcagctggtcatttgcaccgatagtgttcgaatgtgtgtatgatttatatctcatataatattagaacatcatccatacaagttatttataaacttgtatttagaaatatttataaaagtgttcgctcgtatcatgc

SEQ ID NO: 12826 - DNA, 764 bp, Lactuca sativa
  Predicted polypeptide sequence is orthologous to G137, G145
gaagagggagagtagaactgaagagaatagagaacaaaattaaccggcaggttacttttgctaagagaagaaatggacttctcaagaaagcctatgaactctcagttctctgtgatgctgaggttgctctcatcatcttctctaatcgtggaaagctttatgaattctgtagcagttctagcatggtgaaaacactggagaagtaccacagctgtagttatggatcattgaaagccacccaaccagaaaatgagagccagtataactaccatgaatatctgaggctaaaggcaagagtggaagttctgcaacggtcacaaagaaatcttctcggagaagatttgaccccattaaacaccaaggagctggagcaacttgagcaccaactggagatgtctttgaggaagatcagatcaacgaagactcaatgcatgttggatcagcttgctgaactccaaagaaaggagcaagttcttgctgaaacaaataaagccttaaggaaaaagttggaaaaaaatgctcaggaatttccagttaggcaaatgtgggaaggtggagcacaaaccattccgtataatccccttcctacacactctgacgatttcttccagcctcttggattgaactccaccatgcacaccagtttcagtggattaagatataaccctattggctccgatgagatgaacgttgctggtgtcaatggaaacaatccaaatgggttgtttccaggatggatgctgtagtagaagaattgcatcacc

SEQ ID NO: 12827 - DNA, 246 bp, Lactuca sativa
  Predicted polypeptide sequence is orthologous to G145
cccactttacaaatcggaaatgggtatcaaacggattcactaacggcaggagcaggagcagggccaagtatgaataattacatgcaaggatggttgccatgttaaaaagaataacatatataataattaattatggtatgggtttgtgggcataaaaaagatcccatgcatgtgtgcttagttaactgctatatattgtaagttatttggaacaaatttatgtcaacagaattaagatcagaaaaa

SEQ ID NO: 12828 - DNA, 859 bp, Lactuca sativa
  misc_feature (793)..(793): n is a, c, g, or t
  Predicted polypeptide sequence is orthologous to G154, G627, G1011, G1797, G1798
tatctttcttgaacaaaatcttgttgtaagagttgatagttttagctaaggattgcacctttttcgatctttttctattatggtacttgtgaaaaccttgtcttgattcaagaattgatatgggtatttgaggttggtgttttgttgatggatcttgatcgcatataaagattcatggttccatcaaacaaacctgtattttctgtaacttgaacatgcgaccataccactttcaaccacattaagaagacttgacatttgattggttatcagttctgaccttttttataacttcttttttgaatagagtgaaaccttaaattttttggaagatggtgagagggaagactcaaatgcggaggattgaaaatgctacaagtagacaagtgaccttctccaaaagaagaaatggtttgttgaagaaagcgtttgaactttctgtgctttgtgatgctgaggttgctttgatcatcttctctccaagaggcaaactttatgaatttgcaagctcaagcatgcaggagacaattgaacgatatagaagtcacgtaaaagatgttcaaacagaaaattcttcgagtatagaagatgttcagcatttgaagcatgaaacagctactatggcaaagaaggtagaactcctagaagttgcaaaaaggaaacttttgggagaagggttaggatcaagcaccattgaagagatagttcagattgagcaacagctggagaggagcgtacgcattgttcgagcaagaaagatgcaagtctacaatgaacagattgagcaactacnagcaaaggagaaactgctagcagctgaaaatgcatcacttactgagaagtgcttaatccaaacaga

SEQ ID NO: 12829 - DNA, 815 bp, Lactuca sativa
  misc_feature (734)..(734): n is a, c, g, or t
  Predicted polypeptide sequence is orthologous to G157, G859, G1759, G1842, G1843, G1844
gcgggggattttgtgagagagccggtgatcagaagttagaacttagggttagaagattgattcatccatcggccgggagagagaaaatggggcggaggaaactcgaaattaagcggatccaagataagagtagcaggttagtgacattttcaaagcggagaacaggattatttaagaaagcacgacacctgtccgtgatctgtgatgttgatgtcgccgcttttgtaatctccgatagcggcaagctctatgagttctgcagcggtggctataatagtaacagtgtggagcttatcctttccaggtatcaggcagaagagagaaccacccaagaaggagcttttgaagatatggcatttaacaagtccacaagattccgaacatgcaaagagcttctaaagtcagtgagaagggttgacgaacaaccaaatgaggtctctgtgagtgacatgacaaagttagaggaggaacttcatgctgctcttttgcatacaagatctaaaaagactcaattgatggtggagcgtatgtcgacctttcatgaacaggtaaggaaattaactgaggaaaaggaagaactgaaacagcagttacaggtggcatcagcaaagaagaaccagaaagatgatgttgatgacgatggtggtgaaggtcttgaccactctgcaaatagccatagttattaccagaccaatctatatccaccacaaccacttttaacactccctctcttncaggagtagatgatgttatgttatattaatcaactaattcaaggaatatatagatcgatgatgtctttagaaagccacgtg

SEQ ID NO: 12830 - DNA, 739 bp, Lactuca sativa
  Predicted polypeptide sequence is orthologous to G207, G227, G230, G242
gctataaccgtgggagacggcggcattagctgcatcgggattgccgttggcgtatcgctcgtttcgactccgggaagtgaaagactcaacgacgttagagggtcgttcgctggctgtggagtcggggaacgcggtgacaacgatgttggaatttcgatctgctgagggacgctggcgcagggccgagaaacagggcggaatgacatcgccggcggactggaatcgctgatatcggatcccgttgggctacccgggttgaagaaaagacctgaaacggcaaccgctgagccggcactgacagagcgtttcaacgatggttgttgaatcgcgaagtcattaaactcttcgttcgtcatcgacgaacatttccgtttcaaagtcgagttccagtggtttttaatggcgttatcggttcgaccggataaaagccgggcaatcgtagcccatttgttaccaaaccgggcatgtgcccgaaggatcgtctcatcctcctccggagtaaaagcacggtgttccacctgcggcgacagctggttacaccaccgcagccgacaagatttccctgatctaccagggatagatttgctgataagcgaccaatttctcgggccatgcttctcgacagttgctgaagcaactcatcttcatcggggctccatggacctttgattccggccatatctttcttcgaattgtttcgcataaatgcaaaaatctgttgattttcagtgagaattca

SEQ ID NO: 12831 - DNA, 933 bp, Lactuca sativa
  Predicted polypeptide sequence is orthologous to G207, G227, G230, G242
cgggactttctttcgttcatattcaaaaattctatctcataagtcataataagttcctgaaatcagtcggttttgattttgattctaaaatgtttatgggttgtaatactccgaagaaggatatggatcggatcaaaggtccatggagtcctgaagaggacgagttgcttcaacagcttgttgagaaacatggtgcgagaaattggtcgttaattgggaaatctatacctggtagatctgggaaatcgtgtaggttacggtggtgtaaccagctgtcgccgcaggtggaacaccgtgcgtttacgccggaggaagacgagacgattcttcgtgctcatgctcggtttgggaacaagtgggcgacgattgctcggttgttgtcaggtcggactgataacgccattaaaaaccattggaactcgacgttgaagaggaagtgttcttcgatgacgaatgaagagtttagtgagtttgctattcaacagccttcgttgaaaagatctgttagtgctggttcggcggtggctgtttctggtcgttatttgaatcccggtagtccgtctggatctgacgtcagtgattccagcgttccggcgatttcgtcgtcgcacgtctaccggccagtcgctagaacaggagcggttgttgctccgcaaatcgaagtagcaacgtcttctcctccgcctccgcctccgccgcttcaaacgaaagatcctccgactttattaagtctctcgcttcctggagtcgaaaatgaagagtctacagctgctccgacgccgatgcagttaatgccgccatcgccggtagcaagtcctttaccacctccgcctcccacctcgccagttcctatccatgctatgccgttgcggcaggtcccagtcgatcgttacaaaaacataaacctaaaccacgcagacctcatgtcatcga

SEQ ID NO: 12832 - DNA, 881 bp, Lactuca sativa
  Predicted polypeptide sequence is orthologous to G207, G227, G230, G242
cggggacttcatttttcccataaatctttcatggatcccactacaaaacatgttgatcgtataaagggaccatggagcagcgaagaagacgagttattatgtaagttagtaaatcaacaaggagcacgtagctggacatcgattagcaagtcgattccagggagatctggtaaatcatgtcgtctccggtggtgtaaccagctgtcgccggaggtagaacatcggccgttcacggtagaggatgatgaggttatcatgaaggcgcatggtcagttcgggaacaaatgggctacgatcgctaggttgctcaacggacgtacggataacgccgttaaaaaccactggaattcgacgttgaagcgcaagtatgcggcggcggacggcggagatggaggtgagagaaatccgcggatgatgaagatgacggagagagatgtcaatgcgaagatggttgcggttgcggttacgattacgaactctggtagtttatccggatcagatgtgtgcgatccagataataatattccggcaccgtacgccggagaaacatgtataacgtcaccgggatttcgacagaaggttgaaatggatcctccgacggcgttaactctggcgttacctggaacaggttcatattcgtatgagatctgtgatgaagtgaagaagaagatcaatgcgacatcgtttagcaatgagattctttcagtgatgcaggagatggtacgtaatgaagtgaggaaatacatggagtgtgaagaagggttgatgcaagtgtgaaacaaaagtgatgaattttgttaattaaaaaaaactaatagtgaatatatagagcttgttgttcgattcaaattattcttgagttaacatgaagagaacgagtt

SEQ ID NO: 12833 - DNA, 720 bp, Lactuca sativa
  misc_feature (678)..(678): n is a, c, g, or t
  Predicted polypeptide sequence is orthologous to G259
atggggtttgtggtttggcagccggcggagttcgccagagacttgcttccgacactgttcaaacacagcaacttctctagcttcattcgccaactcaatacttacggttttcgtaaaacttcaacaacccgttgggaattctgcaacgaaaggtttcacaaaggtcgcaaagaacaactctgtcaaatccgaagaaggaaatcatggataaacaagcctcggccaatcgcccaattaaccctgaaagaatcagatgaagatcaaagatcttcatccagtaattctttatcctcagggtacaacattctcgtggatgaaaatcataagctcaagaaggaaaataaagttttgggcttggaacttgtgagcataaaaaagaagtgcaaggagctcattgatttggttggtatgtatactagtagctcaagctcaaagaaagaagaggaggaagatgaaaggccaaagttgtttggggtgagattggaggtgcatggtgataaggagagaaagaggaaggggattgaagaggttggtgaaagtgcaagaagaattttactttcggtaaatgtaaacaaatagatatatagccacgtctttgatagaaagttgtaaagaaccgtcatgttaagatatgctatacgtctaaggtgtatgctatgttgtgcttgtcaaattcanaatttggaaacatgatcaagatttatgtttcatcgaaaaaaa

SEQ ID NO: 12834 - DNA, 275 bp, Lactuca sativa
  Predicted polypeptide sequence is orthologous to G263
aggaaaaggagaatcttttaagttgtttggggtgtttttgaaagaagaaacgaaaaagaggggctttgatgaaataaatatttcttcaggggctcaaaggaaagaattgaaaataagtggacagtcaaccaaggtctgcagttaacgaataagaatgtgacacctcatgtgattggtccaagaatttatatccaaaagaataataatgtcaatgtttacatttaattcatattaaaaagatatatattatttatgtattttttgtttaagggtga

SEQ ID NO: 12835 - DNA, 858 bp, Lactuca sativa
  Predicted polypeptide sequence is orthologous to G263
cttctagatcaaacacgttaatcatactcatcagcatcgtcatactccgttggtgttcgtgttcgtgatttgtcatcgttggacgtcgccgtcgtgagaggaaacagaattgtggcggaagttatgtccgtgtcatttctccggtgtattcgaattcaacaagtacacgctcatggaagaaactaaaaggtcatcgtcatcatcatcatctacggttacaatacacctttcgaattacgatctggctcgatctcgattgttcctttctggattttactgttggagctgggaattcctcactgctcttttgctgtttagttgttagttaattaattccttgattttagctcttcaattagcgtagaatttaggtaatttatttagagaaagagatatcgatcggaagtaggtgagattgaaaaaaaaaatgacgaatcggtctgttccggcgccgtttctgacgaagacgtatctgttggtggatgatccggcgactgatgatgtgatttcgtggaatgaaaacggatcaacgttcattgtctggaaaactgctgatttcgctagggatttgcttcctaattccttcaaacacaataatttctctagcttcgttcgtcagcttaatacttatggattccgtaaaactgtgccggataaatgggagttcgcaaatgagaactttaagcgtgggcaacgagagcttctcatcgaaatccgtcgtcggaaaaccgtacagtcgtcccaagctaagccgacgggtgacggtggtccggcacaatcgccaagtatttccggtgatgatctcggatccagctccacatcttcgccggattcgaagaatccaggatcagtcgacac

SEQ ID NO: 12836 - DNA, 759 bp, Lactuca sativa
  Predicted polypeptide sequence is orthologous to G268
cggccattatggcctgtatttcccgaatgatatatacaaagcagagtataaatattgggaaagaaataacattaagttatgctaatgtttttcgttggaggactttgaatgtacgaaatgtgatggatatgagggcaagatatggaggatttgcagcagcattgcatgatcatggggttgattgttgggttatgaatgttgttcctgttagtgatacaaatactttgcctgttatctatgatcgtgggcttgtaggtgttgtgcatgactggtgtgagccttttgacacataccctagaacatacgacatattgaatgctgctgggctcttctccatagagcaaaaaaggtgtagtatgtctagcataatgcttgagatgaatcgaatcttaaggccaaatggacatgtgtatattcgggatgttaattctgtgatttataaacttgaagaaatagcaaaggcgatgggatggatgacacatgtgtttgacaatggtgagggtcccaatgctggggtcaagcttttgacatgtgaaaaacgccttctataacacaaacagacacttctctcgtattcatattccttaaaagtatataccagatagctgctgcaacagttgtagccttaaaccttaaattgatcgttggaaaactcgagtaggaagtttgttgatgaaggaaaaaataattctaataaataggtagatttacttgtattctttatatggataaacgttgaattgaatatattaattgatt

SEQ ID NO: 12837 - DNA, 726 bp, Lactuca sativa
  Predicted polypeptide sequence is orthologous to G268
cgactcgagtttacttgagagtaaggttaacgaaagtttgggggagagtgttgtagaaagcgatcagaattgggaaaaaattgagaaatttagggtttgtgatcagggtaaaagagagtatataccttgtttggataatgtagatgtggtttctaggttaaattcaactgaaaagggcgagaagtatgaaagacattgcccagcaaaaggaaacgaattggattgtctggtgcccaatcccaaagggtacaaagaccacattccatggccaaaaagtcgagatgaggtatggtatgataatgtacctcatacacgtctggttgaagataaaggaggacaaaactggatatcaagaaacaaagacaagttcatatttccaggaggtggaacacagttcgtacatggcgcaaatctgtacttggatcaaatctctaagatggttcctgatattgcatttggtcaacatgttcgagttgcattgaatgttggttgtggtgtagcaagttttggtgcttttttacttgatcgaaatgtgactactctatctatagcaccaaaagatgttcatgagaatcagattcaatttgccctagagcgtggtgttcctgccatggtggcagtatttgcaacacacagattgttatatccaagccaagcatttgatttaatacattgctcaagatgtagaataaactggactcgtgatgatggaattttgcttctgga

SEQ ID NO: 12838 - DNA, 918 bp, Lactuca sativa
  Predicted polypeptide sequence is orthologous to G268
cggggaatctagatgcgatcttcttaatgttgatgcacccagcggattcattcgccattcttcgtcttcctggcactacacagagagctacgcagcgggatcaaaatcacatattcacagacacctatacatacattcaggcgtcgtttaaggcacttcattgaccattgacacagaaatatatatacatatattatacagaaggagagagagagagagagaaagagagggaaagcgacttcaacacttcactgaattgatggcacagtcgaagctctagattatgttgaccaaaaagcgttcatcatacgcatagatctttgagcttttagtctacgtttacatgtattaaactcacaggtaggggaggggcttagatctgaggataatgcttacaaagatgaagggatttggttcgttaaaatcgccaatttttgtgaaagctgctggatttgccttcgtcgcgctagcttttttctacttaggtaagcattggtccgatgatacttatcagcaattgatctttttcagttcgaactccaacccaaatgcaaaaatcccttcgatttcaatttcaccaaactataacaaaagctttgatatcaagtctttaatcaacgacacaaaagaggtagaaacagtagcagatcatacgttacctgcaattccaccacaaccattgctttctccgccgcctccgcctccgcctgcggtgcagaggctaggtgtagtggatgagaatggggtgatgagggatgagtttgaggtaggggagtatgatcccgatgtggtagagaaccgtaataacgaaacgaaagcggtggaagatgataatgggactgttagggttctaaaatttgagacttgtccggtgagtatgagggagtatataccatgtttggacaatgaggatgcgat

SEQ ID NO: 12839 - DNA, 751 bp, Lactuca sativa
  Predicted polypeptide sequence is orthologous to G274
tattgagaccgggtgggtattgggttctttctgggcctccaattaattggaaagttaatttcaagtcatggcaaagaccaaaagaagaattggaaaaggaacaaaggaatattgaggaaatggctaaacttctttgttgggagaagaaatatgagaaaggtgaaactgcaatttggaggaaaagagtcaatcaaggatattgtcaagaacgagactctcgtgttactttgtgtcaatccacaaatcccgatgatgtttggtacaaggaaatggaagcttgtgtgactccttacatggaaacaaacaacacagatgaagtttctggtggcgaattaaaaccgtttccagaacgacttaatgacatccctccaagaatcagtagtggctccattgatggagtctccattcagtcattccaagaagacaataaattgtggcaaaaacatcttaatgcttacaagagagtgaataagattattgactcggggcgatatcgtaatatcatggatatgaatgcagggtttggaagctttgctgctgctcttgagtctccaaagtcttgggtcataaatgtgatgccgactgttgctaaaagggatactcttggtgtggtttttgaacgtggattgattggaatctatcatgattggtgtgaagccttctcaacatacccaagaacatacgaccttatccatgcaaatggtcttttcaccttgtacaaagacaagtgtagttatgaagacattctttt

SEQ ID NO: 12840 - DNA, 945 bp, Lactuca sativa
  Predicted polypeptide sequence is orthologous to G274
ccatttctttatttctctcagatttgctttcgcattgtaatccactgatcctacaagctactttgccagattttttttgctcgctcccaatcgtcttcctccgtatatcaggcggagatctccgccattctgatctaattttcgcaacacccacctcgtaataatcaaaacaacaccctgttaatcatcagactcttatgctcggagcttcttctacgtgagcttagtttctcaaagattctgtttgtctcctgatgcgattggctgcatcatggcaacaaaagggaattcaggagaaaacagggctagaagttccataaccatattcatagttgttggtttatgttgtttcttctacctattgggagcatggcaaaggagtggatacggaaaaggagacagcatagctttagagatgaccaaaactggtgcagattgcagcattctcccaaatctaaactttgaaacacaccacagtggcgattctgtaattgttgataacccacaaaccaaagtcaaagaatataaaccatgcagtcctaaatataccgattataccccttgtcatgaccaaaaacgagccatgacatttcctagacatgatatgatttatagagaacgacattgtccccctcaagaacaaaagttgaagtgtctgattccagctccaaaaggctatgtgacaccattttcatggcctaaaagtcgtgattatgttccttttgcaaatgcaccttataaagcattgactgttgagaaggctattcaaaattggattcagtatgagggcaatgtgtttaggtttccaggtggtgggacccagtttcctcaaggggcagatgcgtacattgatcaacttgcttctgtaatcccaattgataatggaactgtgaggactgctttggatactggttgtggggttgcaagttggggggcatacctttg

SEQ ID NO: 12841 - DNA, 749 bp, Lactuca sativa
  Predicted polypeptide sequence is orthologous to G275, G837
gaaagaggtcacgtgtgatattagatgttggatgtggggttgcaagctttggaggatttctgtttgatagagatgttttgacaatgtcttttgctccaaaagatgaacatgaagctcaggttcaatttgcacttgaaagggggattcctgctctttcagctgttatggggactcaaaggcttccttttcctgctagggtttttgatattgtccattgtgcacgttgcagagttccttggcatattgaaggaggtaaacttcttttagagctgaatcgtctactacgacctggtggctactttgtttggtctgctactccaatctatcagaagcttccagaagatgttgggatttgggaagccatgacaaaattaacaaaggcaatgtgttgggaactgatagctgttaacaaagataaagtaaataaagtgggagttgctgtttatcaaaagcccatctccaatgaatgctatgaaggaagaccacaaaacgaccctccactctgcaacgaatccgatgatccaaatgctgcatggaaagtacctctacaaacatgcatgcacaaggtaccaataggtgcagaagtgcgtgggtcccagtggccagaagaatggccatcaagagtggaaaaagcaccttactggttgctgacatcacagaccggggtttacgggaaagctgcacctgaagatttcactgcagactttgaacactggaaacgtgttgttaaacaatcgtatatgaatgga

SEQ ID NO: 12842 - DNA, 771 bp, Lactuca sativa
  Predicted polypeptide sequence is orthologous to G275, G837
accagatatggtacaataacgttccacgcacaaagctggctgaggtcaaagggcatcaaaattgggtcaaagttacaggagagtatctttcttttccagggggtggaactcagttcaagaatggcgcccttcattatatcgatcatatcagaaaatcacttcctgatatcaaatggggcaaaagaacccgtgtgatacttgatgttggatgtggagtagctagttttggagggtatctttttgagcgagatgtaatcacaatgtcttttgctccaaaagatgagcatgaagctcaagttcaatttgctcttgagaggggtattcctgccatttcagcagtcatgggtacccaaagattgcccttccctagtaaaatctttgatgccattcattgtgctcgttgcagagtcccatggcacattgaaggtggaaaacttctactggagctcaaccgacttttacgacctggtggttattttatttggtctgctactccagtttaccaaaacaatacagaagattctgaaatatggaaagctatgtctaaattaacaaaggctatgtgttgggagttggtggtgatttatagtgacaaattgaaccaagttggtgcagcaatatacaaaaagccaacttctaatgaatgttatgacaacagacaacaaaacgatccacctatatgtgaaaaccatgatgatccagatgcaatctggaatgtagaacttgaagcatgcatgcataaagcccctgttgatgaaatcattagaggaa

SEQ ID NO: 12843 - DNA, 823 bp, Lactuca sativa
  misc_feature (787)..(787): n is a, c, g, or t
  Predicted polypeptide sequence is orthologous to G275, G837
tccaaataacctgaagatgtggaaatttgggaagctatgtctaaactaacaaaggcaatgtgctgggagttggtgaaggtcaacaatgacaaattgaacgaggttggtgcagcaatatacagaaagccaacaaccaacgaatgctatgaaagcagacaacaaaacgatccacctctatgtgaaagcaaagacgacccagatgcaatctggaatgtgcaacttcaagcatgtatccataaagtcccggttgactcatcagtgcgtggctcagaatggcctaaaacatggccacagaggctggagtcaccaccatattggttgaagagtagtgaggttggagtttatggaaaatcagcccctgaagacttcactgctgactatgaaaactggaaacgtgttgtctcaaaatcgtatttgaacggattaggaatcgattggtcttccgtcagaaatgtcatggatatgcgcgctatatatggaggatttgcggctgcattgagggacttgaaagtttgggtgatgaatgttgtacccgttgattcaccggatactcttccaattatatatgagcgaggactctttggcatatatcacaattggtgtgaatcattcagcacttacccacggacatacgatcttcttcacgcggatcatcttttctctgacgttaaaaagaggtgcaagttacagtcgctaatggcggaagttgacagaattttgagacccgaaggtaaactgatagtgcgtgatactgtggagacgattgctgaggtggaaagcatggcanagtctatgcaatggaaaggtaggatgacttttacac

SEQ ID NO: 12844 - DNA, 860 bp, Lactuca sativa
  Predicted polypeptide sequence is orthologous to G280
gcggggacactttgtactgtgcttcttcgaagctgacatctcctttctctcttctctgtacaatctcctgcacttccttccaatggccgccgcaaaacatacccaatccccatcactgccaccatattcagagatgattttcgctgcaattgattcgctgaaagtcaaggaaggtgcaagcgaatcctcgatttcagactacatcgaatcaacctgtgataatttgccagatgaacacgccaatatactgactgataacttgaacaaattggttgaaagcggcgagctagtggtgttgaatgacaactacatgcgaccggagcccaccgaaactccgaagcgcggccgtggtcgcccaccgaaggccaaggacccttctgtttcagaggctgtgactcaggcggagcctgggtccgaagttaagaggggaagaggacgacccaagaaagatcctaacgcgccatcttcagccaagaaagttaaggttggatctacctcgccgccgtcgtccaaaaccggccggccaagaggtcggccacgcaaggtgcagccggagttgacaagcgttgaagccaattaacctttaacttgatgcaaagaagagaacagatgttgcagactgatttccaaatcagaaatttctatgtttagagtaatgtacaattctcactgtatgatgtacaaggaactataactagcattctctggatttagaagttttatctctgcaaatttcaattacctaacaaaaagcctttttataaagggtttcttattagtttaaggtgtttttaatgtctttagggtttcttgtaatataacttctatgttaaatgcatttgtgtgttgtattttgccta

SEQ ID NO: 12845 - DNA, 885 bp, Lactuca sativa
  Predicted polypeptide sequence is orthologous to G291
cgcgggggtatgccagcgatcctatgagtatatggttgattactctcagactaataaacaggcaggaagattagaaaacgttgttgggtggtaccattcacatcctggttatggatgctggttgtccggcattgatgtttcaacacaaatgctcaaccaacagtttcaggagccgtttttggcagttgttatcgacccaacaagaactgtttctgctggaaaagttgagattggagcattcaggacatacccagagggatataagccaccagatgagcctgtatctgaatatcagacaatccctcttaacaagatagaagattttggtgtccattgcaaacagtattactcattggacatcacttatttcaagtcatctcttgattgtcacttgttggatcttctttggaataagtattgggtgaataccctttcttcttctcctttacttgggaatggtgactatgttgcaggacaaatatcagatcttgctgaaaaactggagcaagcagaaggtcaattgtcccactcacgtttcggtcctctcatagcaccacctcaaagaaagaaagaggaagaatcacagcttgcgaagattacacgcgatagtgcaaagataactgtggaacaggttcatggtttgatgtcacaggtgatcaaggacattctgtttaattcggttaggcaatcaaacaaatctcagggagagtcaacagggcccgagcctatggttcaatcttgaagatgctctctttcttgatattatgattgctttacttgagagatgctgcattacttttctttttactcatcagttttgttgcttattcatactaatgtgaatgtccttgatatttctcttctatttgggttttaaaatgtgaa

SEQ ID NO: 12846 - DNA, 733 bp, Lactuca sativa
  Predicted polypeptide sequence is orthologous to G307, G308, G309
gcgccgtcgagaaggtcttatcggcggtgaaggagatgaagccggagattttaacagtggtggagcaagaagctaatcataacggaccggtgttcttggaacgattcaccgagtctttacattactattccaccctttttgactcgcttgaaagcagtggcaacggcggcggagtggtggaaggtggtggtattccggcggcgagtaaccaagataagattatgtcggaggtgtatcttggtaaacagatctgtaacgtggttgcgtgtgaaggaccagaccgagttgaaaggcaccagacgttgagtcaatggaagactcggtttgaatcgggtgggtttgaagcggttcatctgggttccaacgcctacaaacaagctagtatgttgttagctctgttcgccggcggcgatggctacagggtggaggaaaacaacggttgtttgatgttgggttggcatacacggccgctgatcacgacatcggcgtggaagctccggtgaactcgactgggtcaactcggtgaataatacctaacgagttggttcaaactcagtgccagcctggaaaaacagaaatcgcgagttgctgagttggagaactgaaactcaataggtggggggcacttgcccacatctgggtattttgttattttaattaccaaagaaattttttttttatgcctatcttttattttctattttaaattgggagttggtgggttaaattggaa

SEQ ID NO: 12847 - DNA, 728 bp, Lactuca sativa
  misc_feature (655)..(655): n is a, c, g, or t
  Predicted polypeptide sequence is orthologous to G307, G308, G309
gggaattcggccttatggccgctagtcgggggaagaagaggggttgaagttgaagttgaggttgaggttgaggttgtgttgtgttgtccgcctgttggttcatcgattatcgcgcccacccctcacgagcgtttcttcatctctctctctcatctccacaccacttgtatttgctgtaccatttttatacttccacctatcatctttctctctctgataatcactcgcactatcatcgcttcccccaatcacaaatgctcagattcttccacccattcacagattgttaacccataccccttttcccgatccccaatcggtggatttaagttctacagaaaagactctgaagaagaaaaaagaaaaaaaagatgaaacgagaatacccacagcaggattacaccttctttaatggcggcagttccacttccgcttccgcctccaccgccgccgcctctggttctgggttttcagatgtcaccgggaaatcgaagatgtgggatgaggttgaagagcaagacgccggcgttgatgagctgttggcggtgcttgggtacaaagttaagtcgtctgatatggctgatgttgcgcaaaagatcgagcatctggagggtgttttggggaacgatgatgggttgtctcagcttgcttctgnatctgttcattataacccttcagatctatcttcgtggctttgatcaatgatttgtgagctgaaccccacaaat

SEQ ID NO: 12848 - DNA, 849 bp, Lactuca sativa
  Predicted polypeptide sequence is orthologous to G307, G308, G309
cgcggggatctacttttaccgaaccccaatcctccattcgatttcatccaagtttctttaaccaattgatatacagatcttttcatcagtctacgaatttaatcagccatgaagagggatcgtgagcgtgagcgtaagaaggaagcaaagccatcgtcgtcgtcttcaatggcggttggaattggaaaggccaaagatttgcatcagtcgttgccggattccggcggaatggatgagcttctggaagtgttgggttacaaggtgaggtcaacggatatggcggatgtagccaagaagcttgagcagcttgaaatggtgatgggtgaagatgggattttgcaactgtctgatactgttcattacaacccttctgatctatctggttgggttcagagcatgctctccgagctcaacaccaacagttctgataattcgtcttccaccaacttcggtatcgttctccccggcgaatcctcctccaccaccatgattgatttctccaacaacaaacaaattgatacccaacaaaccggtggtaagatgtacgacgatgatccatatgatttgcgtgcgattgcaggtggtgctatttacgggacaaccgcagaggagtctccggtgtctagaaacggaattaaacgaatgaaagcggcagctcctggatctgaagctgttgacgtaccgccggaatcgccgaaaccggtggttctcgtcgattctcaggaggttgggatacgattagttcacacgttgatggcctgcgcggaggcggtgcagcaggacaacctgaactagccgacgctcttgtcaaacacgtgggtctcctggcggcgtcacaggctggcgcca

SEQ ID NO: 12849 - DNA, 958 bp, Lactuca sativa
  misc_feature (776)..(776): n is a, c, g, or t
  Predicted polypeptide sequence is orthologous to G326, G1337
catttgtcgtttccaaatcctccaagatttttataaccctttatcgttttcatcacaaattcaatcttcatcatcaataccctaaaagcttcagagatcagattatgtcttgtgtctgtgatttctgtaatcagagatcggcggtgttgtactgtaaagccgattcggctaagctttgtttgttctgcgacaacgccgtacactctgcaaatgctttatctctcaagcacttccgttctcagatctgtgacaactgcggatctgatgccgtttccgtcgcctgttcaactgataatcttctcctctgcacctcttgtgatcacgatttccatggagactcctccgtttcctcttatcacagtcgtgtgcctgttgaagagttctccggttgcccttcccctcttcagctggcctcgatttggggatttaatctgaaatcttctggttctaacggcaattcgtgtgaaagtaagtattccactacgaattttcaagatttagcaacgatacatgagaaaactccttgttatgatgaggttccgagcgttgactggaaatctagaggttcgggttgcggagttcataataaagttttgtataagcagctggtggagcttgcgaaagaaagatttgacggagatggagctgaattggggcctcaaacaccgagtggatgtggtccgagggatatttcagaaggttttgagtatgaggaacaagacgataaggatctgttgcatcagcaaactccattaacgtatttgcttatgccgccncagaatcccgcgaattcaaaagcgaataatgggggtatcactgaatttagtaacatgtggagctatagccctaaacgccaaaccagtcagatatgggattttaatctagggagatcaagatcttctgaggcaggaggtgataatcttggctttgcaataaacaattgtactgaccttggtga

SEQ ID NO: 12850 - DNA, 737 bp, Lactuca sativa
  misc_feature (587)..(587): n is a, c, g, or t
  Predicted polypeptide sequence is orthologous to G374
cggcgggcaattgcccagggcaatactgtggaatttgctgaagctctctttcgatatactgctccagaagaggtgatgacttttccatcaacatgtggtgcttgtgctgtaagctgcgagactcggatgtatctcaccaaaatcccttattttcaagaagttattgtcatggcatctacttgtgatggttgtggctatcggaattctgagttgaaacctggtggtgctattcctcctaaaggaaagaaaatttctgttactgtgaaaaacatagtcgacttgagccgtgatgtcataaagtcggatactgcaagtgtagaaattccagaaattgatttggagttgacaagtggcacattgggaggtattgtgacaactattgaaggtttaattacaaaaataagtgaagctttagagagagtgcatgggtttacatttggagatagtttggaggagggtagaaaagacaaatggcaggacttcagagcaaggcttattaagcttttaagtttggaagagccgtggaccttaatcatggatgatgccttgtcaaattctttcattgctccggcttctgatgatattanagatgaccatcaattaacaattgaggaatatgagaggagttgggaacaaaatgaggagttgggtttgaacgatatggacacatcttcagctgatgcggcatataatgccacatcacaagataccatttctaatcaaggagaaaacatttt

SEQ ID NO: 12851 - DNA, 506 bp, Lactuca sativa
  Predicted polypeptide sequence is orthologous to G390, G391, G438
gagtcgttgttgaaagatctttggcagcatcaagatgctattctgtgctgttctttgaagtcgcttccggtttttatatttgggaaccaggcgggtttagacatgttggagacgagtcttgtggctttgcaagacatcacattagacaaaatgtttgatgatgcgggtcggaaggcgctatttccagaatttgccaagataatgcaacagggttttgcgtatttacctggtgggatttgtatgtcgacaatggggcgtcatatttcatatgaacaagctatagcttggaaggttcttgcagctgatgaatcgacggttcattgccttgctttctcctttgtgaattggtcgttcgtgtgaggcctcaggcatcaggcatcaatcaatcaatcaatcacttcctgagtttggtatgtaaagacgtgttgattggggcgggggaaagtgatatgatgttatttttgtgttgaattggagatttgcttaatttaatgccgtttcagttt

SEQ ID NO: 12852 - DNA, 805 bp, Lactuca sativa
  Predicted polypeptide sequence is orthologous to G390, G391, G438
cgattcatgtggatgcttactctgctgcttcggtgaaagctagcccatatgggtatcctgggatgcggcccacaaggtttactgggtcccagattataatgccacttggccagacaattgaacatgaagagatgcttgaagttattagactcgaaggtcatgcagttggtcaagaagatccatttgtgtcacgagacattcatctcttacagctatgtagtggagtcgatgagaatgcagtgggagcttgttctgaacttatatttgctccaattgacgagatgtttccggatgatgccccccttataccatccggtttccggatcattccattagacccgaaatcaggtgatttaaaggatgcattggcgacaacacatcggaccacccttgacttgacttcgagtctcgaggtggggccatcaacgaaccatggcccggccgatacattgaccacaagatcggtgttgaccatcgcgttccagtttccttttgagaataatttagctgacagcgtggcaaccatggcccgccagtatgtcagaagtgtcatcaactcggtgcagagggttgccatggcgatatctcctttaggaatgagcccatcactgtgccctaaagtatctcctggttcacccgaagcagttactctagctcaatggatctgccatagctatatgtatcatttggggtcggatttggtgagttctggttcagttgctggggagtcgttgttgaaagatctttggcagcatcaagatgctattctgtgctgttctttgaagtcgcttccggtttttatatt

SEQ ID NO: 12853 - DNA, 737 bp, Lactuca sativa
  Predicted polypeptide sequence is orthologous to G409
ttcattgttcttcttctcttaaccctgttgattccttcttcgcctcccgatcgtctcctttccagggttctcgatcaatggttagctttgaagatagagggaatggatccggtgggcaattttttcagtcatttgatcatgaagacaatggagatgatgaatacgatgaatactttcagcagcctgagaagaaaagacggctcacggttgaccaagtacggttcttggagaaaagttttgaattagataacaaactggagccagaccgaaagattcagctagccaaagaactcggtttgcagcccaggcaggttgccatctggtttcaaaaccgacgtgcacgttggaagactaaacaactagagaaagactacgacgatttgcaggaaagctacaataaactcaaagccaactatgagaatcttcttaaagagaaggaaaaactaaaatccaaggtcggtgaattaagtgataagctgatgattcaagagaaaggaacctcggatgcatcgagtactaaaagcccgtgtgagccacaactgtgtgaactggtacttgaggaagatttatcgaagaacatgaacccgacatgcgggcccgaaggagatttaaacgtggtgtttgaaagaggcgattcatcttatgtatttgaacaagaacaaagtgacgggtcgttggatgaagaaatgataactttgggaagatgtttctaccatcaatggacggttacacattgc

SEQ ID NO: 12854 - DNA, 641 bp, Lactuca sativa
  Predicted polypeptide sequence is orthologous to G419
attttccaggcccagcccctacagcccaagggttacagccggtgcatcctggtgggcccatgtcacttgatccccctccacatcctgatcaaagacaccatctttttggtccacaagctgctgtaaagaaaaagcatggaacaaaagatgtcccaaatgaaccgaaacaagagagaccctcgttgtcttctaactctgcaaaaaagaatttacaaacatccaataaaactagaagcttgaatggtgcacaccactctccctctcatctagaatttcaagattctggccaatctagtagcatgattgcagaaaagcacagattgaagcataaagaaaagaagaagctgcgtgaaaactttgtcgatgaaggtaataataataataatcataatcataatcataacaataatcctcttcaattgaagattaagaacaaaagagagactggtcaagattgttctagagattcaaagaaagtgaaaacggatgataatcatgggaccgataaagattgggcttctgaccataagaaatatgatgatcgccttaaagattcaaaatctgcctcaaaagttccgggtatgcatcccaaaaatccaaacggaaccccccatgttgtgcacaaaacgaaatctaatgaa

SEQ ID NO: 12855 - DNA, 744 bp, Lactuca sativa
  misc_feature (704)..(704): n is a, c, g, or t
  Predicted polypeptide sequence is orthologous to G419
cagttccttgcgggggcaataaggtcatttacgcaaagagtgctttatggcgagatcccgtgtgcggcaccagcaccgaaaagtctctctcctttttctccgcgccattaggaattaagaactcccgttttcgtcgccaatacttacataaatgacgatatttatccattgataattgtatcgaaacactgttgcagctgccaaatgcaaataatgctcaattaaccacccagatacttgatagcagcctgcttctggtgttgaattcccgatttcaggaataaatggctacaatctcagtaacagatattgccttccagacccatccacaccacctttttgtttcctcaggcattggtggatctaaatcgtatgtcagtcccaagaaatacacactaaactgtagaaagcactccaatagtaaaagaaaaagcttacacaaaagtcaccgcctgttcaaatcaagtaactttatgtgttgcactgtggaaatagcaatatcagaaggttcaataactgttgataatggtggaagactagctcttgtagttgatgatgattctcaaaaatcaaaattactcagtgatggaccacgtagagaaataccagactggatggcacgaaggataggttctgttcgtcctaagtttcctcctaaaaagattgacatttctgaagtcaacacatcaaaattcaagtctttnggattgcctaatccttctgaagtatggtcaattgcaaaaa

SEQ ID NO: 12856 - DNA, 723 bp, Lactuca sativa
  Predicted polypeptide sequence is orthologous to G427
aacggaaacggtaacggaaatggaggcaatcatgagagagattgggaattcgctaagtgtaaggcggatatactatcgcatccgatgtacgatcagctgttatcggcgcatgtatcgtgcttgagaattgctacgccggtggatcagttaccgaggatcgatgcgcagttggctcaatctcagcaggttatagctaagtactctgtttttggcaatcacaatcagcctcttgatgataaggacctcaatcaattcatggctcactatgttgtactcctctcttcatttaaagaacaattacagcaacatgttcgtgtccatgcaatggaagcagtcatggcttgttgggagctagaacaatctctacaaagcttaacaggggtagcacctggtgaaggtacaggggcaacaatgtcggatgatgatgaagaacaagtagacagtgacacgaatatgtttgatggaggtctagatgtttctgacagcatgggatttggtcttcctactgaaagtgaacgttctttaatggaacgtgttaggcaagagctaaaacatgagttgaaacagggttataaggagaaaattgtggacatcagagaggaaattctacgtaaaagaagagctggaaaattgcctggagacaccacctccctcctcaaagcctggtggcaatcccattccaagtggccttaccctactgaggaagacaaagcaagattggta

SEQ ID NO: 12857 - DNA, 877 bp, Lactuca sativa
  misc_feature (748)..(748): n is a, c, g, or t
  Predicted polypeptide sequence is orthologous to G427
ctgttctttgttctttcaagaaaattacaacaacacgttcgtgttcatgcaatggaagcagtaatggcgtgttgggagattgaacaatcgttacaaagcttaacaggagtgtcacctggagaaggtacaggtgcaacaatgtcagatgatgatgaagatcaagtggatgaaagtgataatgcaaatttatttgatgggagttttgatggacatgatagcatgggattcgggcctcttgttccaactgagagtgagagatcgttaatggagcgtgtaaggcaagagcttaagcacgagctcaaacagggttacaaggagaagattgtggatattagggaggaaattttacgcaaaagaagagcaggaaaacttcccggcgacaccacgtctgtgttaaaatcatggtggcaatcacatgccaaatggccataccccaccgaagaagataaggcaagattggtacaggaaacggggttacaattgaagcagataaacaattggtttattaatcaaaggaagcgaaattggcatagcaatccttcttcttctacagtcttgaagactaaacgcaaaagcaatgcaggtgataaaagcagtgatcataacatgttaaactaaacacatttatcaatggaatgatgatcttgcatgtagtttcaagaaagatctagttgaaggtttgaagagaaagatgaaaatggtgtaaggttaagaagtttgagctttgagagtcatgtatatgactaanaaactgaaatttcggatacgtttatgtatctatcagttttgtgtgaataggataaggggatgtacatgtacataataagatagcatgtggtgattagtatttagtaatgcatgtgacatatgtttctat

SEQ ID NO: 12858 - DNA, 719 bp, Lactuca sativa
  Predicted polypeptide sequence is orthologous to G431
aggcgaagtaggtatggataaaaatggatcatccgaggaagaggtggtgtagataacaatctcatagatcctcaagctggagatcaggaactgaagggtcagctgttacgcaggtatagtgcgttatttacgcagtctcaagcaatagctcctgaagaagagaacgaaaggttagttgccccaagaagcacgtcaacgattactctactggtggactaggctttacagatggccatacccttcggaggctcggaagttggcactggctgagtcaacaggactacaccggaagcagataaaccactggttcataaacctgaggaagcgacattggaagccatctgaggatatgcagattgtagtaatggatgctgctcatcctcatcactatttcatggagaacatcctcgggaacccttatcccatggacgtttcgttgctataggggctatatatatacatgcccaacgtggcatgaaatctcaacaaatgaccgtatctatgtatgattgacattgaactcgatgagggttttgcaagtttgtgtgaaccgtaagggatgaaaagaagctcgatagcgctctcatgcatgttgacctattggacttaaaagccggatgattataagacattgttatttagaacatgcacttagtgctagtaagatattcgtgtttcggatgatccatttttatccatacatactctagcggccgcct

SEQ ID NO: 12859 - DNA, 899 bp, Lactuca sativa
  misc_feature (743)..(744): n is a, c, g, or t
  Predicted polypeptide sequence is orthologous to G446
cgggctgcagtttgcccgtaatccaagacgcgggcaaactacagcctgttattattcctcaaaatgttgtaaacgagcttccggttgttaaccagttgtcgcctctcgacccgcagtttgatccgtctcttagtggggtattcccgggccaagagaataacacatcgaataacggtttttctgacctcgggcaggaaaagtgggacccatgtgatgatgtttataattgtcttaatattgagggcagtaacacgggcaatacgattgttgatccggtttcgattgcagtgttggatgagttttgcaatttaaaagatgatgattttgaagatccttcaagttatatagtcaacaacaaatttagcccgagccaagatgttcagtcacagttcacatcgtctagcctcgttgattctcgggcatactccgggcaagagctgcccgaccactcgggcgggacctcgcctggaaacggagagtttgacacgggacttatgcagacgggctcatggaaacaagtgggcccgcctccacgtgtaagaacttacacaaagattcagaaagcgggatcagtgggaagatcgattgatgtttcgggtttcaaaaactatgatgaattacgttctgaaatcgagaggatgtttgggcttgaggggctgctaaacgatgcagtatattctggttggaagttggtgtatgtggattttgagaacgatgttcttctagttggagatgatccatgnngaggatttgtgggatgtgtgcgatgtatcaggattctgtcgccttgtgaagttaggaagatgggtgaagaggggatgcagcttttgaacatagcacggcggaatgcaggctttaatggcggtttaacacctggggtgcccatttgtatgtgtgaa

SEQ ID NO: 12860 - DNA, 757 bp, Lactuca sativa
  Predicted polypeptide sequence is orthologous to G447
gtggagatgcaacttgaaaaggttgtacctgtgacggaggaggttgtgatggttgtcgagtttgctgccggggcggagatgcaacttgaaaaggttgtacctgtggcggaggaggttgtgatggctgtcgagtttgctgccggggtggagatgcaacttgaaaaggttgtgcttgagactgaaacagttgttcttgctcccggtggtgaaacagttgctcctgctcacgcttaggaggttgtagttgctgtctactttgctgatgtggtggagatgtaacttgaaaaggctgtacctgtggcggaggaggttgtggttgttgtctagcttgctgatgcggtggagatgaaacttgaaaaggttgtgcttgaggctgaaacagatgttcctgttcacgatgctgaaatagttgctcttgccttaccggactcggttgtgacagaaaattatgctgctgcaattgctgctgttgatgactctgttgaaccctagtttgaaatgtctgttgtggctcaggcaaatcctgctcatgactcgaccccatgtgattaatcgaaaaaaaattatgctgctgatgactctgctgctgttgctggtggtggaggaggaggaattggtggtgcagcagccttttcgtcagccatgaacagcggaggaatccggggtaaaggtatcatgttatttggagttagattaatggaaggtggaggaggaggatcttcattcaggaagagtgcaagcatgaataatctcgttc

SEQ ID NO: 12861 - DNA, 759 bp, Lactuca sativa
  Predicted polypeptide sequence is orthologous to G450, G456
tcggccttatggcctgtagccgggtggaggaggcagtggctgtgaggcggagaccttaaaggtcaccggaaaacgtggctacgcagagactgttgatcttatgctcaatctacaaccaaatgaccagtcctcatcttcaactaatctaaatgatatgaagttgcagaactctaagaacaacaaagatttgatcaagccaccagccaaggcacaggtggtaggatggccaccagtgcgaaactatcgcaaaaacgtgatggctcagaagagcaataatgaggaaactgagaaggtggtggcagccaccaccggtagtaacaaccatgcggcctttgtgaaggtttcaatggatggagcaccgtatcttcgcaaggtggaccttaaattgtatgagagttatcaacaattatcagatgctttagccaagatgtttagctccttcaccatgggagagtatggatcccaaggaatgattgatttcatgaatgagagcaagttgatggatctccttaacagttctgaatatgttccaagctatgaagataaagatggtgattggatgcttgttggtgacgtcccatgggcaatgtttgttgattcttgtaagcgacttcgaatcatgaagggatcagatgcaattggacttgccccaagagcaatggaaaaatgcaagaacaggtgttaaagacaagtatgaagcaaaccctaatcttgattcagttcatgacaacttcaaatcatcaaagtacatggatggat

SEQ ID NO: 12862 - DNA, 883 bp, Lactuca sativa
  Predicted polypeptide sequence is orthologous to G450, G456
cttggcggggaaacaatttaatcaatttcaattcctttccttctcaaacaaccaacttttttcaaaacagttgtatcacagaagattcaatttcaccaaacaccatgtcatcggaaacatccatgtccaacatcacgacggagccacctactaccgccgccgtcttcggtagccttacgttcaatgatacagagctgacgttaggtttaccaggtgaatctcggaattcgggagtcaaacgaaggttttccgatattattgatctgaaattgggcggagctgatcaatccgactctgaatgctccgtcgttacgaaatctcctccggcgaaggaacaaatagtaggatggccaccagttagatcttacaggaagaacatgacgatgaagagtgattacagatatgtaaaggtggcggttgatggagcaccatatttgagaaagctagatctcaaattgtacacaagctatcaacaacttctgttcgcttttcaagatctcttctcctgcttcacaatcagaaatgtattaaacgagatgaagctgatggaccctgataatggtatcgaatacgttccaacatatgaagataaagatggagattggatgttggttggtgatgttccatggaatatgtttgttgaatcatgcaagcgaataagattaatgaagaactcggagtcgttgagttgaacaagcgttgatggaagaaatagttcatagaaagattgtttttttttttttgagaataggaaaatagttgattaaataggaatattgtagaagtaaataagatccacatgatgtgtgtgtacaaaatgtttgctgagtttgtgcagaaactgacatttataaagccaggtttttagggttttgtaaaaaaa

SEQ ID NO: 12863 - DNA, 912 bp, Lactuca sativa
  misc_feature (733)..(733): n is a, c, g, or t
  misc_feature (783)..(783): n is a, c, g, or t
  Predicted polypeptide sequence is orthologous to G450, G456
aacaattttctctctcttttatctcacaccaattagaaacaaagccattcgacaacacaatcaccaataattagtgctgaacaagtcttgtttgagccatgatgaacctaaaggagactgagctctgccttggcttacctggtggcggcggtggaggcagtggtggcaacgaggcggagatgttgaaaaccactggaaaacgaggcttctctgaaaccattgatcttaagcttaatcttcaaccaaatgagtcattgtcatctaacgacaacacctccactacaactcatgtcaaaccaccaaccaaagcacaagtggtaggctggccaccagtgaggaactaccggaaaaatataatggctcaaaagagcaacacagatgaaccggagaaggtggctgccaccactgcaactttcgtgaaagtttcaatggatggtgcaccatatcttcgaaaggttgacctaaagatgtacacaagctaccaagaactagccgatgctttggccaaaatgtttagttccttcaccatgggaaattatgggagacaaggaatgatagacttcatgaacgaaagcaagttgatggatctgctgaacagttcagaatatgttcccagttacgaagataaggatggtgattggatgcttgtcggcgatgttccatggcagatgtttgtggcttcatgcaaaaggctccgaataatgaaaggatcggatgcgattgggcttgcacncagagcaatggagaaatgcaagagcaggtgctaaaaacagatcttatttncagatcttcattattgtgtttgaatttctttttttgggttttcatttgtttaaagtttgatagtatatagacttcataaaaaaatgtgacatttgtaatccacaataaagcaggagtttgtttgtgcgg

SEQ ID NO: 12864 - DNA, 892 bp, Lactuca sativa
  misc_feature (734)..(734): n is a, c, g, or t
  Predicted polypeptide sequence is orthologous to G450, G456
gcgagatagaggagagatgacgtcgttcgaggagacggagttacggctagggttgcccggcggcggcggaggaaataagaccagtgaagttggagatacagcggtgcattgcaacggaaagagaagttacgatgagacaatcatggatttgaagctgaaactgtcatcagatgatcaggaaaccaagaatgatcaagagaagaatcttttcgaagccacaggcggaggcgatggtaattgctcagttaacccaccagcgaaggcacaagtggtgggttggccaccggtgagatcttaccggaaaaacatgctatcaatccaaaaaaacataagcctccgcggccatgaagagtttaccggcggttgtggtggggtagcgtttgtgaaggtgagtatggatggagctccttaccttcgtaaagtggatctgaaaatgtacaaaagctatcaagatctctccgatgctttgggcaacatgttcagttccttcactattggtaactgtggatcgcatgggttgaaggatttcatgaacgagagcaaattaatggatcttttgaacagctctgactacgttccaacttatgaggacaaagacggggattggatgctcgttggtgatgttccttgggagatgttcgttgattcatgcaagcgtttgcgtataatgaaagggaaggaagctatcgggcttgcaccaaaagctatggagaagtgcaagaaccgcagctaanagccgcaaacgggattaactacaatctttgtgtggcatttgggatcaagaatactctatgtggattgaacaaacatttgggttaatttgtgtatgtatttattatatatttttacatcaaaattatttcaagatctggagttttctattggtgattat

SEQ ID NO: 12865 - DNA, 764 bp, Lactuca sativa
  Predicted polypeptide sequence is orthologous to G451
aaccaccgatgattgcacggaatccaaaggcagttctcaacacaaagaatccgatatcgaaacttcacctgcagccaagtaagttcaatagccatcaatcatacttctaattgattttaaacatatttatattgttatattgtgattctaattaatgggtttaatgaaaattgcagatcgcaagtggtcggatggccaccggtgagaaactaccggaggaacaactttcaggcgaaaaagatggagacggaaagtgggatgtatgtgaaagtaagcatggatggagcaccttatcttcgaaagattgacttgaaggtttataaaggttattcagagcttcttaaagctttggagaacatgtttaaactcaccattggtgcttattctgaaagagatggatacaaaggatctgagtttgcacctacttatgaagataaagatggcgattggatgcttgttggtgatgttccatgggagtaagtccctatttctttctttttttttcaacctttttatccattaaatagtatgttgttaaatgatatttgaaggaagtcaagaacattagagatttattaaaaaaggttagaaattaaagggaaaacatttttttgttacttcttattttatgttgttctttttatgttaattagaaaaacattcatatatagtttacgagattaagtaacattaagttaaacaaattggtattataagttagtattaagttacatgtcacataattgggttagaagagtgagcta

SEQ ID NO: 12866 - DNA, 843 bp, Lactuca sativa
  Predicted polypeptide sequence is orthologous to G470
cggggacagtcgatgatatcttctttgctcttggaatttccataactaagagagagaaaactcgtctgattgttgatgtagacgtgttgatgaatttgctcatttgatgctagtttgaagctgatttggcctgaaattgtgttgatctgttgtaatttttagggttttgttgagaattatgggtttttagattagagatctgtgtttggaggcgcttattgtggtgaaatgacatcttcagaggtttcaagcaaaggtaataacagcatgagaggagacagagacacgttttctttgtctggttttagcgacaaaaatgatgcggtaggtgattcaagagctgttacggcggtttccggtgccggtaaagctgaagcggatatggctctttacaaggaactctggcgagcatgtgctggtccgctcgtcactgtgcctcgcgaaaacgagctggtgttttattttcctcaaggacacatcgaacaggtcgaggcgtcaaccaatcaggtcgccgaacaacagatgccgatgtataatcttccgtcaaagatcctttgccgtgttgttaatgtgcaattgaaggctgaacaagacacggatgaggttttcgcccaaataactcttatgccggaagctgatcaagatgaaaacgctgttaagaaggaaccaccaccacctccccaatccagatttcaggtgcattctttttgcaaaacgttgactgcttctgatacaagcactcatggtggattttcagttctgagacgtcatgctgatgaatgcccttcctcattggacatgtcaagacaacccccacacaggagctagtagccaaagatttac

SEQ ID NO: 12867 - DNA, 813 bp, Lactuca sativa
  Predicted polypeptide sequence is orthologous to G470
tgctcttgttcctcctgcaatcaatccacttccagtacacagacaaaagagacctcggtcaaccatgttgccttcatcacctgattcctctgttctcacccgagaaggtccatcaaaaatggggacagcagacccttcacctgcattctcaagggtcttgcaaggtcaagaattatcgaccttgagacccacttttgtggacagcaacgaatcagattcatgtgataggttaatccaatgggcaccttctgtagtagatgatgaaaaacggcatcatgggtcagatagaattttatctgttgggagaactccagagtcatctttcacagatctgttatcaggtttcgggtctacaaacgaattgtctactacacctgcacctacacctaacgaatcaaagttcaacttacattcaaatccatggtccattatgccatccggtttatccctcagtttgttgggtggtggcatgaaaagcaatgaaatttcatatcaaagccgagatgttaggtttagtgcttttgacgagtattccggtcaacatagtcaaaggggaaacggagagcaggctggtaagtgggtgatgcctccgccatctcttacttcgtatctccagatgccttctcattccagtgatgtgaatgtgaaaccaaaagatggaaactgtaaaatatttggggtgccacttgctggtaacagaaacatatcagcagatgcagcagcaacacatcaataccacatatttgattctgatcaatccaagcgtttgaaagtcatcgatcataatccatctaaagagcaagataaagaata

SEQ ID NO: 12868 - DNA, 868 bp, Lactuca sativa
  Predicted polypeptide sequence is orthologous to G489, G714
cgtcttactccttcctttttcgatcagttcgctgtcccacttccaaccctagctgatccatctctctcatacttcgctacgaattaaatatcagacaagagaattttctctgaatttcgtccactggattagctttttttagggtttgatccgagtagcttgaagcaactaaatagaacacgaggtattccgaaaatggatcaacaaggccacgggcaggcccaagggatgaacacagtgaacacctctgcccaaatgccctacaccatgcccccatacccacctccaaaccaaatgatgggcattgtcccccctgcccccgggcagccctcccaaacctcgggtctcccttccccccctgcccaacttgcccaacaacaactcgcctaccaacacatcgatgaacttattaaacaacaactccaccaacaactccaaaacttttgggcaaatcaataccaagaaatcgaacaaacaaccgatttcaaaaaccactctcttcctttagcccgaatcaagaaaatcatgaaagcagatgaagatgttcgcatgatatctgcagaagcacctgtgatttttgcacgtgcttgtgagatgttcattcttgagttgactttaaggtcatggaatcatactgaagagaataaaaggaggacacttcagaagaatgatattgctgctgctattacacgaactgatatttttgactttttggttgatattgttccacgtgaggatttgaaagatgaggtgattgcttccacgattcctagaggtgggccacttccggttggggggcccactgagggtctaccgtattactatatgccgccaccacaggttggtggttcagggatgtatatgggga

SEQ ID NO: 12869 - DNA, 738 bp, Lactuca sativa
  Predicted polypeptide sequence is orthologous to G509
gtttaggttttaccctagtgatgaggagttggtttgccactatctttacaagaagatagctaatgaagatgttcttaagggtactttagtggaaattgatcttcatacttgtgagccacggcagcttcctgagatggcgaaactcaattcaagcgagtggtacttcttcagctttcgtgatcgtaagtatgcaactggatatcgaacaaacagggccaccatatccggatactggaaggctactggaaaagataggacagtggtggatacgagaactggtgccatcgtggggatgaggaagactttagtgttttataaaaaccgagcaccaaatgggattaaaaccggttggataatgcatgaacttcgtcttgaaaaccctaatattccgcccaaggaagactgggttttatgtcgagtgttttacaaagcaaagggagacaatagcaacgaacgcagcccacaagacatgtatcacaatacatgtgatgccacttcactaaatctggaatgatgcatgtcccaccctcccaccaccgccttgtgtccaccaccaccaccatatctgcaccaccacccccaacctctccaatcaaaatccaacaccaccggtccaccaccaccgtcaccacaaaaattacttggacatatcaccacagcaatacaacctcccaaatcttctccagttatcgcaagaggctaccttgaaggaatgtatggaccaaatgattgtaagct

SEQ ID NO: 12870 - DNA, 901 bp, Lactuca sativa
  Predicted polypeptide sequence is orthologous to G536
cggggatcatacttgtctcctcaaatttctaccctctcctctctctaaaaactcctaccagatcttctcgtgttcttccgatttccgatcctactgaaactatggcatcatcggcgcgtgaagagaatgtctacatggccaagctcgccgagcaggctgagcgctacgaagaaatggttgaattcatggagaaagtctccggcgcactatctggttccgatgaactcagcgtcgaggagcgcaacctcctctccgtcgcttacaagaatgtcatcggcgctcgccgcgcttcctggcgtattatctcctcgatcgagcagaaggaggagtcacgcggtaacgaggatcatgtctctgtgatcaagggttacagatccaagatcgagaaggagctttctgacatttgcgacggtattttgaaaatgcttgataccaaactcgttccttctgcatcctccggtgattccaaggtgttttacctcaagatgaaaggagattatcaccgttaccttgccgagtttaagagcggcggtgaacgtaaagaggccgccgagagcactctcaatgcttataaggccgctcaggatattgcaaactctgaacttgctccaacacatccaattcgtcttggacttgctcttaacttctcagttttttactatgagattttaaactctccagatcgtgcatgcaatcttgccaaacaggcttttgatgaagcaattgctgagctggatacattgggggaggattcttataaggatagcactttgatcatgcaacttcttcgtgataatcttactttgtggacatctgatatgcaggatgagggggctgatgaaatcaaggaagcagggggggctgcaaagcaaagtgaggagcaaaggaatgagttgatttt

SEQ ID NO: 12871 - DNA, 925 bp, Lactuca sativa
  Predicted polypeptide sequence is orthologous to G536
atcaagagaatcacacacaaacacctacctacacacactcgctgctgcttgccctatcaatcgaggtatatactaattaaaaatggcatctgaagcttcgcgtgaggaaaatgtgtacatggccaagcttgcagagcaagccgaaaggtacgaagaaatggtggagttcatggagaaggtcgcaaagactgtagatgttgaagaactcacagtggaagaaagaaaccttctttctgtcgcttacaagaacgtgattggagcaagaagggcatcatggaggatcatatcttcaattgaacagaaagaagaaagtcgtgggaatgaagatcatgttaagctaatcaaggagtacaggagtacaatcgagattgaattaagcaaaatctgtgatgggattttgggtctccttgaatcacatcttgtcccttctgcttcttctgctgaatcaaagatcttttacttgaagatgaaaggtgattattttagatacttggctgaattcaaaacaggtgctgaaaggaaagaagctgctgaaagcactttgttagcttacaaatctgcccaagacattgctttatctgatttggctcctactcatccaattcgacttggacttgctcttaacttctcagtgttttattatgagatcctcaattcacctgatcgtgcttgcaaccttgccaaacaggcttttgatgaagcgattgctgagctggacacattaggtgaggattcatacaaggacagcacacttatcatgcagcttctccgtgacaatctgactttgtggacatcagatattgcggatgagggtggggatgagatcaaggagtcttcaaaacctgaagaaacacagtgacattgacatacacaaatgggattttggtagaagataatagtttgtgtactactattactattacta

SEQ ID NO: 12872 - DNA, 867 bp, Lactuca sativa
  Predicted polypeptide sequence is orthologous to G536
ccatcaccatgccggagaatttaacgagagagcagtatgtgtacatggcgaagcttgcggagcaagccgagaggtacgaagagatggtgaaatccatggaaaagctcgtcgttgcgacgacgccggcggctgagctgactgtcgaggagcgtaaccttttatcagttgcctacaagaacgttatcggctctcttcgagcggcttggcgaatcgtctcatcgatcgaacaaaaggaggagtcccgaaaaaacgatgaccacgtcatgcttgtcaaggactacagatctaaggtcgaggatgagctatcggatgtgtgctcgggaatattgaagctcatggattcgcatctggtgccatcggcatccaccggtgaatcgaaggtgttttatttgaagatgaaaggagattatcatcgttatttggctgaatttaaagctggagatgagcgaaaggcatcagcagaggctactatgaactcctataaagctgctcaggatattgcactggtggatttggctccaacacatccaataagattgggtctggcacttaattactcggtgttctactatgagattctgaattcatctgacaaggcatgtagcatggcaaaacaggcatttgaggaagccattgctgagctggacactctgggtgaagactcgtacaaggatagcactctgattatgcaactattgagggacaatctcactctttggacttcagatgcacaggacttggatgagccctaaatacttatgctgttgaagactggaacatgtatgtcattgactctttctatgatgctaactaattctgtcaacattatctgttttatatgctgaaaatgtttgctaaatgcaagaa

SEQ ID NO: 12873 - DNA, 848 bp, Lactuca sativa
  Predicted polypeptide sequence is orthologous to G536
cgggggctggacacatttcgctgttcgcttctcttgtatttcttcctcctctcttcgaaaaccctcctccgtcaatggcggcgacgacagcgttccctgacaacctaacgagagaacagtatgtctacatggcaaagctggcagagcaagccgaacggtacgaagagatggtgaaattcatggaaaagctcgtcatcggactaacgccggtgtctgagctcactgtcgaggagcgtaacctactctccgtggcgtacaagaacgtcatcggctcactccgggcggcttggcgcatcgtctcatcgatcgaacaaaaagaggagtcacggaagaatgatgatcatgtagtgttagtgaaggactaccgatctaaggtcgaggacgaactttccgatgtttgctggggaatactgaaaattttggagtcaaatctggtgccgtcggcttcttctgcggaatcgaaggtgttttatctgaagatgaagggagattatcataggtatttggctgagtttaaaattggagatgagcgaaaggaagcagcagagcagactatgaactcgtataaatctgctcaggatattgccgaggcagatctggctccaactcatccaataagattgggtctggcattgaatttctctgtgttctattacgagattctcaattcatctgacaaggcttgcagcatggcgaaacaagcatttgaggatgcgatagctgagctggacactttaggtgaagactcgtacaaggatagcactctcattatgcaactactgagggacaatctcactctttggacctcagatgcacaggatcagctggatgagccatagattgtatag

SEQ ID NO: 12874 - DNA, 894 bp, Lactuca sativa
  Predicted polypeptide sequence is orthologous to G536
gcgggggctttccctcatttcgacaagtagagagagaaattagtcggtgtgcttgagatcggcggccatggcttcttcaactgaacgtgaaaacttcatctatgtcgccaagcttgccgagcaagccgaacgctacgacgaaatggtggatgctatgaagaaggtagcaaagttggatgtggaactaactgttgaagaaaggaacttgctctcagttgggtacaagaatgtggtggggtcacgaagggcatcatggagaattttgtcttccattgaacaaaaagaggaatcaagaggcaatgaagtgaatgtaaaacggattaaggaatacagacaaaaagttgaaacagagttatctgacatttgtagtgatatcatggttgtgattgatgaacatctcattccatcttcttctgctggtgaatccactgttttctactacaaaatgaaaggtgattattataggtatcttgcagagttcaaatctggtaatgataagaaagaagcagctgatcagtctttgaaggcttatcaattggcttcaactacttcagaagctgatttatctcctactcatcctattcgattgggtttggctttgaacttttcagtgttttattatgagattatgaactctcctgaaagggcatgccacctggcgaaacaagcttttgatgaagctatatcagagcttgattccctgagtgaggaatcctacaaagacagcactttaattatgcagcttctgagagacaatctcactttatggacttctgatattcctgaagatggagatgaccaaaaaatggaatcaccaaatctggtgcagaagatgctgagtaaattcatcgattggtgatggggtgaaaagaaagtatgatgtaattttatttt

SEQ ID NO: 12875 - DNA, 878 bp, Lactuca sativa
  misc_feature (852)..(852): n is a, c, g, or t
  Predicted polypeptide sequence is orthologous to G536
cgggggatggctgtgacgataccgccttctccttccccatttcgcattctctctcttcacacacaaacagagcaatggccgccgcatcatctcctcgcgaagacaatgtgtacatggcaaaactcgccgaacaagctgaacgctacgaggaaatggttgaattcatggaaaaagtcgtcgccgccgcggacggcagcgaagaactcaccatagaggagcgcaaccttctctccgttgcttacaagaacgtgatcggagcacggagggcttcctggcgtatcatctcctccatcgagcagaaagaagagagcagaggcaacgagggacacgttgcgacgatccgtgattacagatctaagatcgagacggagctatcgtcgatctgcgacggtatcctcaagcttctcgattcgaagctcatcggatccgcgtctagcggtgattccaaggttttctatctgaaaatgaagggagattattacaggtatttggctgaatttaagactggatctgagaggaaagaagctgctgagaatacactctctgcttacaaggcggctcaggatattgcaaatggagaacttgctcccacccatcctatccgacttggacttgcactcaacttctcagtcttctactatgagatcctaaattcaccagatcgcgcatgcaatcttgcaaagcaggcttttgatgaagctattgcagaattggataccttaggagaagattcctacaaggacagcaccctgatcatgcaacttcttcgtgataatctcactttatggacttcagacatgcaggatgacagtgctgaagaaattaaggagcaccaaggcagatgagtaacanaatccctactcaagactgtttatggt

SEQ ID NO: 12876 - DNA, 891 bp, Lactuca sativa
  misc_feature (121)..(121): n is a, c, g, or t
  Predicted polypeptide sequence is orthologous to G536
acgcatctttccgggtttctctatttttaaaaaaaaaaaaaaaaaaacagcacgagagagaaagtagtgggttgagcctctaagaatcggcatactatggcggcatacggctgaacgcgangaatttcatctatgttgccaagctcgcagagcaagctgaacgctatgatgaaatggtggacgcgatgaagaaggtagcaaagttggatatcgaattgactgttgaagagaggaatctgctgtcagttggatacaagaatgtggtgggatcacgaagggcatcatggaggattttatcttcaattgagcaaaaagaggaatccagaggcaatgaagtgaatgtcaaaaggattaaagaatacagacagaaggtggaaacagagctttccaacatctgtggtgatatcatgactgtgattgatgagcatctcattccatcttcatctgctggagaatccactgttttctactacaaaatgaaaggagactattataggtatcttgcagagttcaagtttggtaatgataaaaaagaggcagctgatcagtcactgaaggcttatcaattggcatctactgctgcagaggatttatctcctactcatccaatccgattgggtttggctttgaacttttctgttttctattatgagattatgaattctcccgaaagagcctgccacctggcgaaacaagcatttgatgaagctatctcagagcttgactccttgagtgaggaatcatacaaagatagcactttaattatgcagcttctcagggacaatctcactttgtggacttctgatattccagaagatggagatgaccaaaagatggagatcacaaaatctggtgcagaagatgagtaaaatatggaaaggccaaagggga

SEQ ID NO: 12877 - DNA, 918 bp, Lactuca sativa
  Predicted polypeptide sequence is orthologous to G536
gcttcggcggggaaacaaactatattgaaatttagggtccgacgacaactgttctctcccttgatctcatctctataatctctctttctctctcacacacaagcacacaccaatggccgccgcatcgtctccacgcgatgagaacgtttacatggcaaaacttgcggaacaagcagaacgctacgaagaaatggttgaattcatggaaaaagtcgtcgccgccgctgacggcggagaggaactaaccatcgaagagcgaaatctcctatccgtcgcctacaagaacgtcatcggagcacggagggcctcatggcgcatcatctcctcgatcgagcagaaagaagagagccgaggcaacgaaggacacgtgtctacgatccgtgactacagatctaagatcgagacggagttgtcgtcgatttgcgacggtattctcaagcttctcgattcgaaacttatcggatccgcatctaatggtgattcgaaggtcttttatctgaagatgaaaggcgattgctatcggtatttggctgaatttaagaccggatctgagaggaaggaagctgccgagaacactctctccgcttacaaggcggctcaggatattgcaaatggagaactagctcccactcacccaatccgactagggttggcactcaacttctctgtgttttattatgagatcctgaattcaccggatcgtgcgtgtaatcttgcaaaacaggcttttgatgaagcaattgctgaattggatactttgggagaggactcttacaaggacagcactcttattatgcagcttcttcgtgataacctcactttgtggacttctgatatgcaggatgacagtgctgaggaaattaaagaagcaccaaggccgatgagtagtgaaagacattctacccctgtctgtttatg

SEQ ID NO: 12878 - DNA, 471 bp, Lactuca sativa
  misc_feature (464)..(464): n is a, c, g, or t
  misc_feature (466)..(467): n is a, c, g, or t
  misc_feature (469)..(469): n is a, c, g, or t
  Predicted polypeptide sequence is orthologous to G557
agaggaagaaggcatacttgaatgaattggaagtgcgagtaaaagaaattgaaaagaagaactccgagcttgaagagcgactttcaactctccaaaatgagaatcaaatgcttagacatatcttgaaaaacactacagccggtatgcaagaaaagaagtagacatatgattagaagaggaaaagcattacatgtgcaatccgaatcatagcttgaaaatcgaagggtttggtttaggatcgagacttgttattgtggttatttcttttcctagcaaacataatgagaatccaaccatctttacgtacgattcgattaaagatctttaagtcatgtaggtggtaatgggctgtgtttctaaatgaccaaaaaagatgtaaagtattgcatatgatatgggttttaatttgtagcacaagtaacgtgtctgttaaacaatggtattggaaccgttttacacagaanannancg

SEQ ID NO: 12879 - DNA, 780 bp, Lactuca sativa
  misc_feature (661)..(661): n is a, c, g, or t
  Predicted polypeptide sequence is orthologous to G558, G578, G629, G1198, G1806
attgctacattcgaaatggagtatgaattgtggattggggaacaaaggaagaaggacgatgatcttcggaaagtgttgttgactcatactagtgatgtcgagcttcgtatgttcgtcgacactggattgaaccattactacgatcttttccgaatgaaggcggacgccgcgaaggccgacgtgttttatttgttgaacgggttgtggagaactccggtagagcggttcttccagtggatcggcggattccggccatctgagctcttatacgtaagcttccgccttccgctttcaatttcaattaaacaaataacattttagggtttgcattggtggcagatactgataccacaaatcgagctaacggatacgcaactggtgaaggcggggggtctccggcaatcatgcgagcaagcggaggaggcactgagtcaaggaatggaaaagcttcaacagacattagctcagagcatcacaatcgacataaccggagccggaagttacaccacacagatgaattgtgcactcgaaaggctcgaagcgcttgaaattttcttgaatcaggcggatcacctccggcaacagactctgcaacaaatgtatcagattttaacacttcgtcaagcagcaaaagcattgcttgcacttggtgaatactttncacgtcttcgtgtactgagttcaatctggtctggtcgtcctcatgatcgtggaactttactttcatgaatcaatctacttttttcgagttttcattagccgccattagctaatctagag

SEQ ID NO: 12880 - DNA, 825 bp, Lactuca sativa
  Predicted polypeptide sequence is orthologous to G558, G578, G629, G1198, G1806
cggcggggtatcgtgaggcctggttagaatctaatattatgggagatggaagcccacacacagatacttccactgaaatggaccctgatgacaacaatcaaagctttgatattgttccatctaatccgtttatggcttctggttctagtgacaaacaaaaagaaaaatttccagaacaaaagacattaaggcgattagctcagaatcgtgaggcagccagaaagagcaggttgaggaaaaaggcatatgtgcaacaattggaaaatagtcgattgaagctaactcaactagagcaagaggtccaacgagctcgaaagcagggtgttgtgatttctaattcaagtgatcaaacgcaaccaaatgggtcattggcatttgtagcagaatattctcggtggttggaagagcaaagcaaacacataagtgagctaaggacagctgtcacttcacatagaagtgacaatgagcttcgttctttagtggaaaatgccacctcacatttcaatggtatttttaggctcaaaagaactgcagcaaaagccgatgtttttcatatcatttatggaatgtggacatcgcctgcagaacgttgttttctatggattggtggcttccgttcttccgaattactcaagctacttgtgagtcacttagagccactaacagaacaacaattggcaagcattgatcatttacaacaaacatcacttcaagcagaagaagctctatcacaaggaatggatgcattgcagcaatctctagcccaaacattggctagtgatgcacccgttgtgccagctggatcttcgggtatggctaactaca

SEQ ID NO: 12881 - DNA, 928 bp, Lactuca sativa
  misc_feature (798)..(798): n is a, c, g, or t
  Predicted polypeptide sequence is orthologous to G561, G562
cggcgggggagtggagtgttgctttcttcctcccttgttttagtgagagaaagttctagagagagaaaatgcagcagtgaatttgttcgaacttagctgagtgagcaagagcaagtatctgtagaaaggatttcccatatcttcattgatacagttttaggtgctttcccatggggatcagtgaagaggcacaagattgtaagcctgaaaaatcttcttcacctccaccacagcaacaacagacgagtgttcatgtatatccagattgggcagccatgcaggcatattatggccctagaatggctgtgccaccatactacaatcctgctgttgcatctggtcatgcccctcccccttatatgtggggtcctccacagcatatgatgccaccctatgctgctttctatccacatggaggtgtttatgcacatcctgcagttcatcttgcaaatagtcctctgaacattgattcacctgccaagtcatcagggggttctgatagaggcttgatgaagaaattaaaaggatttgatgggttggcaatgtcaataggcaatccatcaaatggtgaaggtggaaacaatgatgggaactcacacagtggggagactgaaggaacaagtgaaggaagtgatgggaatacaactgagcgaggtaaaaatggtgggaaaagaagcagtgaagggtcgcttattctttctgaagttgagaaggctgagccacaaagagcagatggagcttccagtaaaatgatgacaggtgtcgggattctttctcccaatcctgtctccgcattanatctcaagaattttccgaatacagctgctgacatcactttcaccatttgtacattgatgccaatgaagcactttttcagaatgaccgagaactaaaagggaaaagagaagcagtctacccgagatctgct

SEQ ID NO: 12882 - DNA, 884 bp, Lactuca sativa
  Predicted polypeptide sequence is orthologous to G565
cggccgggggagagcaagtgacatcatacgcattacgcaatgcaagatccatcaaatcccattcccaatcccgatccaaatccaatgaatgcggctccatttccgttcagggcatctcaccaccgccgagcacactccgaggtcaacttccggctaccggacgacctagatctggtatcagacaccttcgatgcaccctctggaagcttcgaagagcttggatctgaggacgatttgttttgtacttatatggacattgagaagctcggatccaacttgactgacggcggtggcggcggcagcggtggaggaggtccagacatcggtcggatcagcaattccggtggtggtggtggtggagcttcggaggataacaatggtgacggtgaaaagagcagttccagacctcgacatcggcatagcaattcaatggatagttccagtctttatagtgaaagtattgaagctaagaaagcaatggctcctgataagcttgctgaattatggactattgatcctaaacgagctaagaggattttagccaatcgacaatctgctgctcgatcaaaagagaggaaagcacgctatatatctgaacttgagagaaaagttcagaccctacaaacggaagcaaccaccctttcagcacagttaactctgtttcagagagatacaaccggcctttcatctgaaaacacggagcttaagctccgattacaggctatggaacaacaagctcagttacgtgatgctttgaatgaggcactgaagcaagaagtggaaggctgagagttgcaaccggagaaattgcaagctgttcagacggatacaatctagggatgcatcatgtttcttataaccaaccaaactttttcacaaaccaa

SEQ ID NO: 12883 - DNA, 737 bp, Lactuca sativa
  misc_feature (610)..(610): n is a, c, g, or t
  Predicted polypeptide sequence is orthologous to G583
agcggttattggcgtcgcagtgcgagcgtgcacggcaaggtgagggtttcggattgcagacgatcgtctgtattccgtctacaaacggagttcttgaattaggttcaacggagttgatttttcaaagttcagatctcatgaatgaggccagagtactatttaatttcagttatagccctccagatttgacgccaatgaacccgaatcagacacccggaggtgatactactgatccatcgtcgttgtggctaaccgatccagtatcttctgccgccgccaccaccaccaccaccaccgtagaaatgaaagattctgttgatgtcaccgcagtagcccctccgacgactgtaatcccatcaaataactcagtctcaaagcaaatctccatcgacaaccctagctgcagctcgttaactgaaaaccctagctctgtgattcacaattccaatcgtgaatccatccaaaatcaaggattgttcgggagcagagaattaaatttctcagaattcggatcttacgacggaagcagaaacgggaatacttctcattcttgtaagcctgaatctgtcgaactcctgaattttggtgaaagcaagaagacgttcgccgngagagaagataacagcaacaaaaagaagaaaccccacgatgggatgctctcgttcacctccggcacggttatttcaccatcggagactgtaaaatcccgtggagcagagctagatccatcaatcgga

SEQ ID NO: 12884 - DNA, 889 bp, Lactuca sativa
  Predicted polypeptide sequence is orthologous to G597
cggggagagtatagaaatcgtgtacaaaatgaacggatctgaatctggaagactctttgagtcatcgatgactccagtaacgtctcagccgccggtgaacaacgtccgcgtgggatacactcccggcgttactagttcgtacagcgatgtaatgtttagcagcggtggaggcggcggtggtagtgggggtgcaagcttccatcataacattaacattaacgagcacggcggtggtgagtcgatgatgaaaaagagagggaggccggcgaagtaccatcctgaaggctctatgtcaccgtcacccgttactacagccaggcccgcaaagttaacacctgtcggtgtcacggtcagcgcttcgttgaacgggtcttttgaacagcagcaaccacaatcagctcctcctatctccgccgttcctcctcctatctccgccgctcctgttagttccattcctctggatgaaggatttccatcacaaaagaaggtcagaggtagacctcgtggttcatcgaacaggaaaaaggaaagggaatctctaggatcacctggattcggttttactccacatatcattgtggtgcagcctggagaggatgtgttaaacaagatcatgtccttttctcaaaatggaccaagggctgtctgcatcatgtctggcattggtgtcatatcaaatgtcacacttcgtcaagctgcgacttctggtggaactgcaacttatgaggggcgatttgacatattagccctttcgggttcatttgtcctctcagaaatatatggtcaacgcacaagaacaggcggtctaagcatcacattatccggacccgatggtcgtgtttttggcggtgttgtagccggacttttaatcgccacatctcctgttcag

SEQ ID NO: 12885 - DNA, 736 bp, Lactuca sativa
  misc_feature (10)..(10): n is a, c, g, or t
  Predicted polypeptide sequence is orthologous to G598
ggagaaactntgggaaacaaccagccacagatcatcaaatctctccataggcagcacggaaaccgaaaactttaccaccatgagtagggagtttaacgccttggtacttgcaggaaacgacatagatgttaatgaacacaacgagccaattagtaacttgcagaggatcagggaggaagaaattctggtggaaaacaatcctttagcgattgttgcggataataatccaagggtggcttctccggcaagacttggtaacggtggcggcggcgctggtggtggtgggatgagtttgataagtagtagcagtgggggtacccatggcgatgtgtcttctgtgcaacgggtgaagaaagaggaggtggaatctaagatatcggcatggcagaacgccaaaattgcgaagatcaacaaccgtttcaagcgggatgatgcgatcatcactggttgggagagcgaacaggttcagaagtccacttcgtggatgaagaaaatcgagagaaaattggaggaaaaacgagcaaaagcaatggagaagatgcaaaacgatgtagcaaaagctagaaggaaagcagaggaaaaacgagcaaccgcagaggccaagagaggaaccaaagtggccagggttttggaaatagccaacttgatgagagctgttggacgaggtcctacaaaacgatctttcttttagcttcttatataagaaaatgtgtaaaaagatagaaagggaaaaaaa

SEQ ID NO: 12886 - DNA, 788 bp, Lactuca sativa
  Predicted polypeptide sequence is orthologous to G602
ggcgggaacaccgccgataaatactcactcaccactaacagttagagccagatattttgctcaattattatttatggcaaccgagctacctgcaaaggtcgaaccggaattggcaccggcgaaggtcgacgctcctgttgacgtcgcaccggagaaacctgtggattctccaactgtacctgaaacaaaggccgatgattccaaggcagtcgccgttgctgaaaagactccaattcctgaggtgaagaaaagttcaaagaactcccttgatagagatatcgcattggctggggttgataaggagaagaaattgtctttcatcaaagcatgggaggaaagtgaaaagtcaaaggtggaaaacaaatcacagaaggagctatccgctataacttcatgggaaaacacaaagaaagcagatgtagaagctaagttgaaacagatcgaggagaaatttgacaagaagaaagcagaatatgcagaaaagatgaaaaacaaagtgggtttaattcacaaacaagctgaagaaaaaagagccatggttgaggcaaagaaaagtgaagatcacttgaaaacagaggagttggctgccaaatatcgtgctactggtaccattccaaaaaaggcccttggttgttttggtggctaaactattcccctaaaacctacaactttgtaagttgatgttgttttatttatcatccttttgtttgttgtgttgtataggaagaacatagctctgtaatttgtgaacgaattgcataatcatttatatatatatatatgaagtt

SEQ ID NO: 12887 - DNA, 909 bp, Lactuca sativa
  misc_feature (823)..(823): n is a, c, g, or t
  Predicted polypeptide sequence is orthologous to G616
cgggggctctctctctccaatatataccactactttctctctctaaaactgcactaatttctctctctagataagatatagttggattgatttcaaggtatgaaagctgggtatggaggtggatgaaattcaaagacaggtgcgtaaatttcaaagggtttcgtctaatggtagtactacaactactgacaattcttcaaatccgcaaaagatagctacccataaagggaatttggagttgcagaagtttgatgatggtggtggtggtggcggcggaggaggaggaatagatgttgttgtaggtggaggtggtggtggtggtgtggcgaggctttgtggatggccttcctcccggattgttagggtttctagggcgtccggagggaaggatagacacagcaaggttttgacatcgaaaggactcagagatcgtcgtgtccggttgtctgttagtaccgctatccagttttatgatctgcaagaccgattggggtatgatcagccgagcaaggcggtagaatggttgctcaaggcggcatctacttccattgacgagcttccttctcttgacccttcgttttccggtgccatctctcacacccaccaccatcaccagaatgaagacaagaagtcgacgggaaacagtcccgattttgaagatccaaattaccaacaacaaaacagtaataataataataataataataatgtttctaaggcgaaatctccggcgtgtagtagtacatctgaaacaagcaaggggtcggggctttcgttatctcgatcggagaatcgggtgaaagctcgagaacgagcgagaganatggcttcaaagaagggacgagagaaggaactgattcacgagggctgctgttttgaatcaggtcaatagtatttcggaaaactcgt

SEQ ID NO: 12888 - DNA, 915 bp, Lactuca sativa
  Predicted polypeptide sequence is orthologous to G616
gcggggggactggtggtggtgttggtggaaacaagggatgattgaagaagggtatggaggtggatgaaattgaacgacaggtgagtaagtttcaaaggattggttctaatggtgataattcttcaaatcctcataaaatagcaactctgagagggaatttggatttacgaaaccatgagcatcggtttcccgatgagaatggtggcgttggcgggaggctttgtgggtggccggcgtctcgaatcgttagggtttctagggcttcgggtgggaaggatagacatagtaaggttttgacatcgaaagggttgagagaccgccgtgtacggctgtcggtaacgacagccatccagttttacgatctacaggaccgattaggttatgatcagccgagtaaagcggtggagtggttgattaaggcggcgtcgggttctatcgctgagcttccatctcttgatccgtcgtttaccggtgccgacggccataaccagcaccaccacaacgaccataacaaccagcatcagaagcagctgagcgacgagaagaaatccacgggacacgacgccgaatttgaagatccgaactaccagaaccaccacgagcagaataacaataataataataataacaatgtttcgttatcgaaatcgtcggcttgtagtagcacatcggagaccagtaaaggttctggactttcgttatctcgatctgaaaatcgggtcagagctcgagaacgagctcgagaaatggcggcgaagaaggaaaaggaaaaggacactgatcccgttagggcttctgttgtgactcaagttaacggtattgctcataactcatcgtttacggatctcctcaccggcgggattaacagcaacaccgttagtccgaacccagcggcgactcccgaatccagaatgc

SEQ ID NO: 12889 - DNA, 748 bp, Lactuca sativa
  Predicted polypeptide sequence is orthologous to G618
aggaatgggaggaatgcgagacctttggaagtttgtggtttacttatgggctaagctatggaactcttggacttggattgcaaggaagaaaaaattgggcttattatcaacatgatgatggagaaagttggacttaatcttggttgaagaatgatgatgatgtgaagagaatttaagctataaaagatcaaaggagtaatggatcatcttgagagagttaagaacatataattgagttatcaagaacttatacatatgggccggaccaagaataaaaggagtaatctagaagtgcctattaaatgggccaaacagcccattcagcgagacccacgcggtccgcgtggatccacaaacgatccgcatggattgtgctgtgaagaaaccagatttttgcattgagcttctaattggtgaaagttggtgagaaccttttggctaacttttgcatccgagttttgactacttttactatagttttgaaggaaagaaaggaggagaactcttgaaggaagaacacattttcctctctaagaagattttgaagcttaatgcattttctatcatctttcaatcttgaacagtgtttggtatctctaaacaactttttatttctttaatcttagccatgttaggctaaatttatgtttggttgattttggtttaacccatggatgattagtttctttgaagacttcatattaccttgtgtttgaaatttatggacatgttttctagcaaaaaaaaa

SEQ ID NO: 12890 - DNA, 751 bp, Lactuca sativa
  misc_feature (661)..(661): n is a, c, g, or t
  Predicted polypeptide sequence is orthologous to G618, G2057
gctgctagtctcgagcatcaaactgataagtttcaaagaaagtggacgtgtggtggagtatgaaggtgagtacgctgcttgccatccggagttgtcgttgtttctgagacaggggcactcaactccttatctgcgacctgtgatctatatcatcattgactatctgttattctgcaagtctctgaggggaacccttgtatccttgaacacgccatcttttcgggctatggagtcgacccggccggcctacgctactccggagtcaccgtctagtctccgccccaccctatctttccatcaccatcattctcatggccagtttcacctccggatcacgtgggttttccgggtttcgtattccagcacgaattcaaggtgaagaggaggaacacgacggcatctccgataagccgtcctctgcatcctccgattctcgccattgaatcatcttcatcctccataatccctctcaaacaggaaaatttacgtcaatcaatgtacttcaaagcaaagagaggaggggagaagcttcaatggctgctacacagtgggaaaaagaaaccgaatccattcacaggttcttcagtcatcactggtgtttttacgatttagctttcatgtttgaatagagctctttgtttagctctaaaccctgttttanattatctggatttaatgtttttagaccatgtatgtgactgtgccaattgccttcttttgctatataattatcaaaaatactctgctaaaa

SEQ ID NO: 12891 - DNA, 506 bp, Lactuca sativa
  Predicted polypeptide sequence is orthologous to G624
gtggtagcaaacctatgttttagaaggcctcagagattttatgttttcacgcaaattacaagcaggggatacagtgtcgttttatcgtgtggaaccggggggaaagatggccattggatttagaaagacttcagttgcgaaaccagctcatcagtgaaaaagcacattcatccctgcagcaaatccctgcaagtctgcattttatgtgtctatgctagcgaagaagatcttcactcaagtacttgctgtcttcttaaaatcataatcttcagttcttgtgaaagcatttttgatcttaaactttaaatggttaccctttgaaagtagagtgtaacatagacaaattgatgctctcttattttggtgagataatactaatagtttcccttgttgggtttataagaatttcttaatcaagatacttttgatctctgaaaatggaagatttggttctgtataagtttacaagtccatttatatgaaaaggggcaatataagttgtatcc

SEQ ID NO: 12892 - DNA, 754 bp, Lactuca sativa
  Predicted polypeptide sequence is orthologous to G635
gaatctagagtgatgaaaatgatgaatcgattatctgaaattgggcccacaatagtcatgggtaaaaatgaacaactacacacatctggtcatgcctatcgtgaagaattggaagaagtgctgaggattgtgaaaccacaacattttttacctattcatggggaactcttattcctcaaagaacatgaattgcttggaaaatccactgggattcatcacactgctgtcataaagaatggagaaatgcttggggtttctcatttgaggaacagaagagttttgtctaatggtttcatagccctaggaaaagaaaatttacagttgatgtacagtgatggtgacaaagcatttggtacatctgctgatctttgtgtagatgaaaggatgaaaattgcaacagatggaataataattgtcagcattgaaatcatgcgtcctcaatcaaccgaaaatactgcattattgaaagaaacaattaaaggaaaaataagaataactacacgttgcttatggaatgacaatgggaagcttctagatgctcttcatagtgctgcacatgcagccctatccagctgtccaataaaaagccccttacctcatatggaaagaactgtttctgaagttttaaggaaaatggtaagaaaatatagtggaaaaaggcctgaagtcatcacacatgctattgaaaatcctattgctgttattgctgatgaaattagtgaaaaagtatctggtgtgaatgtgaatgtgaaag

SEQ ID NO: 12893 - DNA, 330 bp, Lactuca sativa
  Predicted polypeptide sequence is orthologous to G652, G1335
ggggaagaggaggaggaggaggaggaagaggaggcggaagagggcggggtgatgctgtatcatcaagaggaggaggaggagggcgttatggtggtggcaggggcaatggctttcgttaaaagatgatcacaccacaatgatggtttgaccagcttctttttttacaatgatggtttgagttgtgattgatttttgtgttgctaatcttgtttaacatcttttatgtctttatcctagagagtcatggatgtcgcgcaagtgatatctatctcttgagtgtattctagcttccatgtttcaatttatgagatgcatgtgttttttttatac

SEQ ID NO: 12894 - DNA, 340 bp, Lactuca sativa
  Predicted polypeptide sequence is orthologous to G652, G1335
aggaggtggtgggggcggcggcggccgtggtttctctagatctggtggaggcggcggtggctttaggtctggtggcggtggtggtaactgctaccattgtggagaacctggacactttgctagagaatgcccgaccaatgcttgatcaataaactaacaaaagtgtatcctcgacattactatcggcttaagatttttgaggtacatttggttaattagttcttagcttttcttttttcttgttaattgaacgatacattggaagtcacattctagatcttgtgtcttaatcctatgaatatatttggagggctggtccttaatctcagttttgttcgtg

SEQ ID NO: 12895 - DNA, 625 bp, Lactuca sativa
  Predicted polypeptide sequence is orthologous to G652, G1335
aagcacacgcggtggtggtggcggaggcggccgtggaggtggtggtggtggtgatcgttatggaggaggaggttataatggaggtggccgtggaggaggccgcggtggtggtggatatggaggcggtggaggttacggaggaggtggaggtagttatggtggcggaggcggttatggaggcggaggtggaggtgggaacgcatgtttcaagtgtggcgagtctggacacatggctagggattgctttcagagcggtggaggtggaggtggcggttgctacaactgtggtgaagatgggcattttgctcgtgaatgtcccaacgccaacaaccgttgatctgccagaggatgaatggtaaatgtgtattcccacatttactttttatctcctctgtatcttgtttactcttttgctgtctatgttgaagaagaatcaatggggtgatccaaatgttttgatatcacttttttagttgcttcatcttgatgatgatcatctttaaatctagggtttcggatatggtgtcttactaaatatatatattgatacaaaagttaggttttttagtctgtgttaatgggaatccaaagatggttgaatggaatgatatctattttctcttta

SEQ ID NO: 12896 - DNA, 554 bp, Lactuca sativa
  Predicted polypeptide sequence is orthologous to G652, G1335
ttgtgttggtacccgggaattccgactgatggcctctgtgcggggacgtggttggtggttggatactggaggtggaggcggcgaggaacgcatgttttatgtgcggcgaggctggacatatggctagggattgtgatcagaacggtggaggcggaggtggtggtggctacggtggtggaccgtggaggatacggcggaggtcgtggtggcggaggttacagtggcgggggtcgcggaggcggaggtggtggcggttgttacaactgtggagaagatggtcactttgctcgtgaatgtccgactgctattaaccgttgatctgaaatctgaatggaactggtatattacatctgtgttttctaccattaatgttgcttcttatttttctgtttttttttgggttttttgtgatttctaatttctatgtttaagaatcccttgttgaaccatttggcaaatgtttttaggtctcttatatgatagattgttccgtttttggtcctccacctccgtatccaccaccaccaagcttcgcggccgactcggtccaggcg

SEQ ID NO: 12897 - DNA, 730 bp, Lactuca sativa
  Predicted polypeptide sequence is orthologous to G652, G1335
gatcccaagtttctagagagagactagggtttgctctcttgattttgggggttttcgatttctagggtttgtgagtttctcttcaattcaaaaatggacgttgacggcgctaggaaatcaggaaccgtcaaatggttcaacgatactaagggatttgggttcatcactcctgaagatggcggcgaggagctttttgttcaccagtcgtccatcagaactgagggattccgcagccttggtgacggtgagaccgtggagtacgtgattgagaacggatctgatggccgtactaaagctgctgatgttactggtcccaatgaaggtcctgtccaggggagtacccgtggtggtggtggtggtggaggccgtggaggcggcggtggtgatcgttatggaggcggcggtggtgatcgttatggaggcggtggtggtgggtacaacggtggtagccgtggaggacgtggaggtggaggttatggaggtggcggaggtcgcggaggtggtggcggtggcggcggcggctgctacaactgtggtgaagatggacacttcgccagagaatgccctacatctaacaaccgttgatctgctaccatggatgatggaggataaagggtaaatgtgtttcttcacatttgctttgcatccatacatcattctatttacttttttgctttttctgtgttgatgaatccatgggtgacccatagtttaatatgccttgcttttg

SEQ ID NO: 12898 - DNA, 938 bp, Lactuca sativa
  Predicted polypeptide sequence is orthologous to G653
gcggggagcttgcaagccatctcttccccgcattggttgatatatatatataaatatcacacagttccccaaaaaaacccatttctttccgctgcgtctatccttctcagacattccctacaatttgacctctgaaaacagaaggattttgacttcgatcgacaaatccaactcaaatttcaacaaaactatctgaatttatcacaggtgttggttcagattgaattgaattgaaaagggtataaaggtttcacatctgattggttgttgacagtagggaggtagaggaaaagatcgagatcagatccataggggaaaagggcaattatgtcttttaccggaacacagcaaaaatgcaaggcttgtgggaagactgtttacccagtggagcttttgtctgctgatggtattgattatcacaaatcttgcttcaagtgtagccattgcaaaggtacccttaagttgagcaattactcatcaatggaaggtgtgctctactgcaagcctcactttgagcagctcttcaaggagagtggaaatttcaacaaaaacttccaatcacctgcaaaggcggctgagaagttatctccaatgctgacaaagtcaccaagcaaagctgctggcatgttttcggggactcaagagaaatgtgctacttgtggcaaaactgcttatcctctcgagaaggtaacagtggagaatgaatcataccacaagtcttgtttcaagtgctcccatggaggctgttctttatctccatcaaactatgcagcattggaggggattttgtattgcaagcatcatttctcacagctcttcaaggagaaggggagctacaatcatctcatcaagtctgcatccattaagcgagcatcagcagcatcagcagcagcagcaacagcagctgcagcttctatcccagaagtttgaagtttgaa

SEQ ID NO: 12899 - DNA, 732 bp, Lactuca sativa
  Predicted polypeptide sequence is orthologous to G715, G1646
gagagaaagagagggggagagagaaccgtcgcaatggagaacaccaccaccacctccgccgccaaccaccgaccctccgccgctaccgcaacgccaccgcaaccctccccattcccaccaccacaacaaccctatcaacacctcctccaacagcaacaccaacagctacaaatgttctggaattaccaacgccaagaaatcgaacaagttaatgatttcaagaaccaccagctccctcttgcacgcataaagaatcatgaaagccgatgaagatgtacggatgatctctgcggaagcaccgatcctgtttgcgaaagcatgtgagcttttcatcctcgaactcacaatccgttcatggctccacgccgaagagaacaaacgcagaaccctacagaaaaacgacatcgccgccgcaatcacgcgaaccgacattttcgatttcctcgtcgacattgtgccgcgcgatgagattaaggatgatgtttccgccgccggtactgggttgggagggattgtgggcaccgccggtggtcttccatattattaccctccgatggggcagcctgcaccgccgcctccaggtgtcacgatgggacgaccggctatggatcctaccggaatgtatggtcctccgtcgcaagcatggcagtctgtgtggcagaccaccgatgatgggtcatatggaagcggagggagtgctggacaaggggcatcgacggccaaggggacgct

SEQ ID NO: 12900 - DNA, 698 bp, Lactuca sativa
  misc_feature (240)..(240): n is a, c, g, or t
  misc_feature (529)..(529): n is a, c, g, or t
  Predicted polypeptide sequence is orthologous to G718
gaggaggaaactatcttttttttgttgttttgaagggaagaccaaatctattttccacctacctttatatttcaatgctcaaataaaagacttccagtaatcttggatcattccatgatctccagctgaaggctggattcagtgtttaaaaatggaactcttagcatttccgatattattggtgaggtttgtttctctcatggactggaacttgaatactccttcagaatgggactgggnaaaacttagccatgtacagcagcaaggagattgaagttgccaagaatttgcaattttccagccatgaaagccaagaaaatgtcgtcgtcgataatgtggatttctccttctcagcttctgcagattcttcgtctaaagagacaattcaagagtacttttagagggtttgatgatttaccaagagatttcttagacaaggatgattcttcttggataggggagaatgggagcttctctaacatggtagaagaagcatcagtgttatccggtgaagccatgattggtttanagcttggaaggcatgcaagcacttctatcagtagtagcaagacggctacaacctctgtctccttgtttcctacctcgtctccccatgataagagatctagagcatcttacctaagctctcagtccccacgttgtcaagtcgaaggatgcaacctttgactttcatcttc

SEQ ID NO: 12901 - DNA, 883 bp, Lactuca sativa
  Predicted polypeptide sequence is orthologous to G718
tctctctcctttcttcattcggtatggtaaaaatctcctgattttccctcattttctgagatgttgcaggctctaactgcgatcggtaagatataaaaggtatttgcattccatgaaatattcagagggacaagtaaaaacagaggaattagtttccagacatggagtggaatacaaagtgggactgggaaaaccatgaaatattcagctcaaaagttatggcaagccctaaaaagctaaacaccaactacgaagaggacatggatggatcttttaatctctccggtgttgttggtggcagcggagggtccgcctctgacatggggaatagctccatatcagcttcaaccgaatcatcattcaaggacggaaatggaaatggaaatggaaatggaaacggaaacggaaacggaatcggagtcagagtttccaaattcccattccagggtttcgcaggctttccaaactcttcgaagaaagaatttgaatcgcctccgccatcagttagctccggcgaaccgttcatcggtttaaaactcgggaaaaggacttactttgagaacaacaactcaaaaacatcatctttctcggatatacctatttcatcggtttctacagtcaagaaagtcaaatcatcatcatattcccaagctacccctaccccacgctgtcaggttgaaggatgcaatcttgatctctcatctgccaaagaatatcatcggaaacatcgggtttgtgaaagccattccaaatctcccagagttgtagtcggtacccttgaacgccgcttttgccaacagtgtagcagatttcatggtttgtcggaatttgatgagaggaagcgaagctgtcgcaggcgtctttcggatcacaatgcaaggcg

SEQ ID NO: 12902 - DNA, 915 bp, Lactuca sativa
  Predicted polypeptide sequence is orthologous to G720
cttcggcggggggattccttctatatttacttcattcgacgaatcaagtagtttataaatgagaaaattaatgatgatttgagagatctgatgatataaacgatgccagacagctatggtttgcactgcaaatgatttattagggtggaaagattttccgaagggtcttagagtcttgctccttgatgaagatatcgattctgcaaatgtaataaaatcaaaacttgaagaaatggattatgttgtttctgctttctatagtgagaatgatgcattgtcggcgatttcagacaaatctaaaggcttccatgtagctatagtagaggtgagagcaggtaacgaagatggaaggtttaagtttcttgaaagggcgaaagatttgcctacaatcatgacttcagatgtgaattgcatcagtaccatgatgaagtgcatagcacttggtgcagtcgagttccttgagaaaccattgtccgaagataaactccgaaacatatggcaacatgtggctcacaaggcgttcaatgcaggagctaaggatgaaaatgaactgttgaaatccgaggaagctttgattcgtttggaaaaagtaggtataaagcaagaaatcattcaaaataaagaacataatgaggaggtatcggttgaaagcgataaatatcatgctccatcgaccccacagttgaagcaaggaatgaggcatgttgataatgaagatcaaacgaatctctcaactgagaaagagtgtgtagaacatgatggtgagtccaaattcgtcgaaattacttgtgatgatcatttagtcgttgataatgttatggagacaaacttctcaaagagtttggaagagggaatcaacaagcccttccagtaatgaatgttgccccgatccaaaagatggtaagaagcaaaatg

SEQ ID NO: 12903 - DNA, 708 bp, Lactuca sativa
  Predicted polypeptide sequence is orthologous to G729, G730, G1040
tgttggacccgggattcggactgatggcccgaatgcgggccgtttaaattctatccttctcaagatatagtttgtttccttcggaatctctatgttctccatgcaaccaagcctcccttgaagaattgctccatagaccatactgacaatctttctcttgatgaacactagaccttcctccatgttccgttgataactgatctgtcggccttgggttacgaatatcaaacatgatatcgtccagaattatccccagatgacccattctcgtaaatatcagattgccctgaagacacaggagctcgatcagtctgtctttactgttcggtacatctgcaagtgagatttaacatgtgacaaagctaaatctttcacatccattaactcaagaactgacttgggtgttgctctttcatggccgcctaaaagctcaacagcatggacaaagcgagcatgaagggtagtcgtccagcgcatcctcggagccctcatactgcgtttggaggggaacctcgatgataaaaatcttgatcggacaatattgataatattattgctatgaattatagaactggtggtcgtataattagtgcaagaatctaacgaaggctggttcttatgatgcggattgcgcattatcgcgaaattgggaggggtattctggtaatcaactcgaattcctcttataggactccagaaacctaattt

SEQ ID NO: 12904 - DNA, 987 bp, Lactuca sativa
  Predicted polypeptide sequence is orthologous to G729, G730, G1040
gcggggcttccgtttcatctctccctatcaaaaaaaaaccctctttcttttctcactacattttcccttccttcctattctgcaaaaccaatcctactcctactttatactctctcagtccagaataccatgcaaagattaatgcaatcataagtcactcaaccagcatataatcagaactacatcccctttcactgacacccactctttatccatcgaaatgtttctgagctcaaatttttctccaatgacaaataacgaagctacaactttcccagatctatccttacagatcagtcctccatttgcagcggatgagtataacatgacaggttgtatcatcaaaaggccaccctccacctcaagcagcagcagcgatttaagccaagaaaacaccttcaaccatcaccactaccaacagcttatagcagcagatatggatggttttgttaaccatggtttgcagtttgatcagcagcagcctcagctgaccttggggcctgagatgggagctttgaatgattgtcatcccaaccaccattatcatccgcgtggaccacgtcaaatctactcctacgatttcaagagaagctcgaggatggttaacagtgtcagaaggggcgctagagctcctcgtatgagatggacctcgtccttacacgcccacttcatacatgccgttcagctccttggtggtcatgaaagagcaaccccaaaatcagtgcaagagttgatgaatgtgaaggatctaaccctagctcatgtgaagagtcacttgcagatgtacaggacagtgaagagcactgacagaggaggagcagttgcactgacagatactcaagtaattaatcccagggctccaatctcatttgttgaagtagagggagatatatcaccatctactacactgcatatatctcaaaggagatcctttgaatcgtctttggaaacgaatgatttgagtttacacatgaaaaaaaatgtatc

SEQ ID NO: 12905 - DNA, 849 bp, Lactuca sativa
  Predicted polypeptide sequence is orthologous to G744
gcgggggtattggaggtgctgaaggagagattagggtttattatttcattcccagattgatctccggcgctatctccggcgcccttactggtctcttcgcattcggtggggccttcacgggtgccatcactggtgctgtggcgggtagagcttctgattgtggggccctccgtggagctggactcggtgctcttgctggagctgttctttctgttgaggttctagaagcttcacgtgcttattggtctcaagaactctcttccaatagaaactcatcaatggctgattttatggaggagcttcttcgtggaaggttttcagaggaacgttttccacctgaacttttaacagcgtatcattttcaggtgagtatgagtcctgttgatgtacttgattttaatgatgacgtggcacacaaagggttgtcagatgattcattgagacgcttaccatggcacaagatttcagatgaaagtaaaccgaatcaaaccatttgttgcacaatatgtttgcaggatgttaaagttggtgaaattgctcgaagtttgcctcattgtcaacacatgtttcaccagatttgtgtggataagtggttatctagacatggatcatgccctatatgtcgacaacatgtgtaagtttttgttaaataaattatgtataaaattattggtgtatatatatatatgtttatgtatacatgtgtgtgtgtttgtgttgattgttgtaagatgatgatgtcattgggatgtgtatagcttcttgtaagatgggttgtgttttgttacaaatatgcaatttagggtatgtatatggagactatttgaaataaagtgttattgaaaaaaa

SEQ ID NO: 12906 - DNA, 875 bp, Lactuca sativa
  misc_feature (821)..(821): n is a, c, g, or t
  Predicted polypeptide sequence is orthologous to G760
cgcttttctttctctggatcaaatgcctcaaattgagaaaccctaatcaacacaattcctcaattcaccccacttttttctctctaaattcttcttcaaatcttattcgtatatggcagtggtgcttgattcggtaacaccggctccaacaacggcttcctctctcgctcctgggtttaggtttcatccaacggatgaagaacttgtacggtattatctgaggcgtaagatttgcggcaaacccttccgatttgacgctatttctgatgttgatgtctacaaagtcgaaccttgggatcttccaggtctgtccaggcttaagagcagagatctggaatggtactttttcagtgtcctggataagaagtatgggaatgggtcacgtacaaatcgagcaactgataaagggtactggaagacaactgggaaagacaggtctgtttaccataggtctcaactggttggcatgaaaaaaactctggtgtatcatattggtcgggctccaaagggagagaggacaaactgggttatgcatgaatacagactcattgatcaggagttggaaaaagctggaattatccaggactcatttgtcctttgtagaatcttccggaagagtggttctggacctaaaaatggtgaacagtatggggcaccatttgttgaggaggaatgggaggatgatgaactggtaatggtccccaagcaggagtttgctgaagattttcctgttgatgatgatgatgcctacttagatgcaaatgaccttgaacagattcttggctcagacacaccagacaaagttgctcctcttccattgnacttgcatgatggtgataatctcagcagtgctgacgtgtctacagaaatgatcg

SEQ ID NO: 12907 - DNA, 873 bp, Lactuca sativa
  Predicted polypeptide sequence is orthologous to G760
gaacacggcgatcagatttttgacaaagtaaaaaattttggtttttcccaaatggagctccttcaatggcgaaacccgcactgaaaccagtaatcaagacttctcttgttatctatatttggttcaaaagctcgattttctctctctaaattacaaccaagaaccctagcatcattcatatatggcattatcgattgattccacaccagtagcttcttcactcgctcctgggtttaggtttcatccaacagacgaggaactcgtacggtactatctcaggcgcaagatttgcggtaaacccttccgatttgacgcgatttctgacgttgatgtctacaaagtcgagccatgggatcttccagatttgtccaaactgaaaagcagagacctggaatggtactttttcagtgccctcgacaagaaatatgggaatggatcgaggacaaatcgagccactgaaaagggctactggaagactactgggaaagaccgagtggttcaccataggtctcaacaggtagggatgaagaaaactctggtgtatcacagtggtcgtgctccaaaaggtgagaggacaaattgggttatgcatgaatacagactcatcgatcaggagctggaaaaggctggaattatacaggatgcatttgtcctctgtaggatcttcaggaagagtggttctggacccaagaatggtgaaaaatatggggcaccatttattgaggaggaatgggaagatgaagatgagtctgtagttgttcccaaacaggaagattgtactcaggaattgcctgttgatgaggattcgtatctagatgctaatgatattgagcagattcttaacacagacatgccagtggaagatgttcctct

SEQ ID NO: 12908 - DNA, 735 bp, Lactuca sativa
  Predicted polypeptide sequence is orthologous to G773, G1412
gggaaaaaaaaggagaattttctttaatattctctctctctctctctctctctctctctctctctctctctctctgatcaagaacaatgggtttaccggtgactgatccgatgactcaattaagtttaccaccagggtttcggtttttccctaccgacgaggagctgctagtgcaatacctttgccggaaagttgccggacatgatttctctcttcagatcattgcagatattgatttatacaagtttgatccatgggagcttccaagtaaggcgatgtttggggagaaagaatggtacttttttagtccaagagatcgaaagtatccaaatgggtctcgacccaatagagtagccgggtcgggttactggaaggctaccggaactgataaagtgatcaccaccggtggacggagagttgggatcaagaaagctttggtgttttacgtgggtaaagctccgaaaggaaacaaaactaactggatcatgcatgagtataggctgtcggagccacaaagaaaaaacggtagctcaaggttggatgattgggtgctttgtcggatatacaagaagaattcaagtgcacagaaacacatttccggtggcgctccgaccaccgaacagagccacggttcttcttcatcttcctcctctcagttcgacgacgttctcgaatcactgccggagattgaagacaggttcttcaacttaccaaggatcgactccttgaagacct

SEQ ID NO: 12909 - DNA, 697 bp, Lactuca sativa
  Predicted polypeptide sequence is orthologous to G777
ggggggcgggggttgttactgtgtgtatgtatgttatttgtatccgctaggtggtcatacaagtcgattgagttggccatgcatttgtattgtgtgtacataatgttgattgcatcttcatatagccattagcggtttttcaggttgaagacaaataatggatctatgattcacaaaggtataaaagttggttgctatttgacgccatcagcatcttgcaaagcttggagtcctaattcgtatatttcctaaaccgaaatgaaatcttaaaatatggactaaaatgaaaaaaaatatatacttttttacctaaaccaaaaaaaaatcatcagccacatggagtaaagtggagtttaaaagttttttttaatcttgattgctgattgaattaaccagttgtaaccttgaatttttatttccgatgctacctatggttcttttttgtagacatggaggaactttgcttgatggaaaaaataaagttcgctgctatattggtgttttttctctcatgatgcttactgatgctatgagtttcatttgatgttggtaatttcgcatggtgatgtcataattgaccttaagtgttggttttttttctcttgtaaagctttttgtttgatactctttggaacttgttggaagttggcttttatttgttttatataggttggcatagttcaaaaaaaatataact

SEQ ID NO: 12910 - DNA, 767 bp, Lactuca sativa
  misc_feature (641)..(641): n is a, c, g, or t
  Predicted polypeptide sequence is orthologous to G791
gaccaaacaccgagtaatacaccggctcccccaatctactcaccggagaataacgaacgtcggcgagatactgagatccttctcagctttttctacttcacagtgcattcccgccgggtattccttggctgtgtattgtttcttcgatggtttctccggagaacactaattggatctacgattacgggttgatcgatgatatctcggttcccgtaggtaatttccttacgccggtatgtggatccagctggcctatgcagaccgctttgaatggttcatcatccatccctagtgtggaacttgatagcttacctgcagatacagatggcattaaagaaagtggttcaaaaagcggggtaggaatgaacaatgcagtggtactggtacaacctccaaagcttgccgagagaagttgagaagggataagctaaatgacaagtttgttgaattggcttcaattcttgagcctgggaggaaccctaaaactgataagtctgctattttggttgatgctgtgggaatggtgactcaattaagaagtgaagcacagaagctaaaagactcgaattcagatctccaggagaaaattaaagaccttaagtctgaaaagaacgaactacgagatgaaaagcagagactanaggctgaaaaagagaagcttgaagaagaagtgaacatgatcaacagccaaccgaggtttatgggtgtgccacctggcatcccagctggataccctcctcaagtccaatcagcgtcattagcatcaa

SEQ ID NO: 12911 - DNA, 774 bp, Lactuca sativa
  Predicted polypeptide sequence is orthologous to G802
atgttgattcttgggatgaaatggagtggtgcttgcagtgtgtttccgccgccgacagcttgggcagtcgggaatggccacatttgctggtggtggtggtgttgcgactccgatgcggctccggcgagatgagagtgttggccgctgctgctactgacgctggtggataccggtagcatccacaaggtgtttccggtggcagtggtgggtgctggagcaaccgcccacatggctgttgccggcatcatattagcatggtgccggagaatattgttaccggaagaaggtcctccggcttcttgttgttgttttggcatttccatggctcctttgaattgtttgttggatggtgacgtagatccaactgttacttccccttgattttgattactctcgtctttgaacaaatcttctctgtacctttttctcatataattatcggtagaatcgccaccggttccgccgttgcctccggtggaaattgcatcggcaatttggtcagctgttaaaatatgaggattttgatggtgatggtgttgctgttgttgttgctggtggtgatgttgatgaaaccccatcatttgagagaacccttcttgatcaaaggggtggtgagcaagtgccaaagcgccgtgatattgatgaggcgcggacttcgacggcggagcagagagagtggatccggtgctacgaagagagacgttcaaggtggaaaagttagccggaatggtgccggtgccggttgcggcaataatggccgtctccgcctgctgt

SEQ ID NO: 12912 - DNA, 740 bp, Lactuca sativa
  misc_feature (664)..(664): n is a, c, g, or t
  Predicted polypeptide sequence is orthologous to G807
ggcatttcagacaattcatctgatggaaggattgttaaatatcaaccaatgatgaatgatgctgcacaagcaatgcttaaacagatcatgaaactagacgctggatctccacgtttaggtcctttcacttcaggggtaacccttcaagaagtcaacccaccaccagcctccggtcaaccctatctaccatcagtcaccggtgtattatccgcacctctacaagcaaattccaatgtcattgcaacaaatcagagtccgctagcggagggtcaacagctgcccgaactgcccgaactacccgaactgcccgagctctcacagttacaagatatggtgcccgaactgtatcctgaaacacagaacttggtggatgagaagcttcagttagaaattggggggttttcgcctgatgtagatgtagaatgggacaataatttgctgaccgaaatggagaaatatctgaccgcgtatgacccgtcatgggagcagtacattgagggaagcccggaggttgacacggctgatgacatggacgcgggcccaggcccgggggatgatgtcatgaatggagttgatagcaaatcttcagaaagcagtgagtgttcgaggtctcaagtgcaacagcttactacacaaatggggcttctttcttcaatactagaanatcttgaagccatatatacaaaacatgtgaggtagagtatggaggagaagtagcaaggaatgttgagccaatgaaa

SEQ ID NO: 12913 - DNA, 650 bp, Lactuca sativa
  Predicted polypeptide sequence is orthologous to G846
tgtggtcccgggattccgactgatggcccgaatgcggggagggaaatgaagttgccatccctgatactacaccaaataccacccaaacttcataaacaactccctgaagggggatctgatgtggaaggtattgacatggacaaagaagctgacattgacaactcggagactgatcgcaagaataccgaaaatacccctgggtctactccaataaggagaggcacacgtgagagggctacaaaggtgaagccctcagctgcccctttgcctgcccgatcttcaacacggctaaaaggggtgaagccacatactaaaaccgacacgccattggatggaaacgataacggggcaggggtagatgtggaaaaacaaggtaatgaagagcaacttgactaccaacttgaggacgattctagttggaccgatcagtttgactttgcagtgaagacacttgtgggtgaatttccacccgatgaaaatggcggtgtggggaatggaagtgctgcaaaggtcaactgaggagcggtgggtttcactttgtcaggggcgaaaaggaaatttgacttttttaaattattatccatatttgaacttcgacttatggatggatcatggatgtgtagtttaagtttaacttaagtagtagtttg

SEQ ID NO: 12914 - DNA, 726 bp, Lactuca sativa
  Predicted polypeptide sequence is orthologous to G849
gatggtgaatgactacaaaaccacatccccaaatatataagaggggtttaaagcactccatctcactgcaattctccatttcttgagttgtttggaaaaattctccgtaattatcgaaatcgaactgtacagttacgtgttacatacgaatcaatcggatcaatcaatttctcttcggacagcagacacaattggtgcgtgattatagttgatggtctttcattagcatgcattcctaagatatggtggtgaagaagagaatatattatggaggatttcatggtttgataccccctgtgatacctaaagctcctagatccttgaggaggaggaggggttcacaaatcaaaccatcagaaggtggtgaaatctgtgcttttgagcttttagcagctgtagctggcaagttgttacaggagagtgaaagttctatttccagcactgataaacacgaaccacatgaagtcaaagtcaaacctgcaacatcagaacatgagcatcatgatcaaggaagtggtacagaaagtcaacccactaatcttgacccaaccgtgaacgaattcccacattccgataatgattctggtttagaacgcgcttctgtttctacaacttgtgatgtcatacagaaaaccgatactaatttgggaatggaagcttctgaagacaaaacatagtcaacgagactcctatagagagtcaactagctagtcaacccactgatct

SEQ ID NO: 12915 - DNA, 403 bp, Lactuca sativa
  Predicted polypeptide sequence is orthologous to G852, G2633
gatgatgatcggcggtgttctacggcaagtaccacgattagtgtgagtgtgaatgattcgattcgcgagctgataaaaatgtatagtgataggtataagatgaaagtggagacgaatgcgatacattttgggtgggaagataaagtattaattgttgcttctgcttggaggtaagatttaggatgtgatcatccataagtgacaggttcatgttgtcattgtagcgaaggtaagtttgtttgaggttacatttttttttaactgatgtttattgttgcaagttatttttcttgtattatgtacttattggagctagagataactactgaaaacttatatttttaaatttgatttttgcttgtttgacattcgttttcaattgatgtttccgatttgattgtct

SEQ ID NO: 12916 - DNA, 768 bp, Lactuca sativa
  Predicted polypeptide sequence is orthologous to G852, G2633
ggatggaagcatcatctaaccaaccctattactggaggcctacgcagaacctaaatctatactcgggtgacgtaagccaaggaagccagttttccaacaattctacttcttcagtcagcttctccacaaatggcagccccgtatcggtatcactgcaggagtctcacccggacactgactataactctcaggccgtggacgatttgcagttgaggctcagagaactagaaactgttatgctgggaaccgatgaggattttcaagacttatttgatgtttcttctgctttgactgctgctactgcttggcgtgatgatgattgcaggacgatgaaagagatgatcgatagaggagacctgaagcaagtgcttcttgcttgtgctaaagcaatagcagaaaatgagtcgataaccgcggagtggctgatatcgatggtacgtcctttggtgtctgtttccggggagcccacacagagattaggagcttacctgatggaagggctggtggcgagactatctgcttcaggcagctttatctacaaatctctgaggtgcaaagagccaacggggcctgagctcttctcttacatgcacatgttatacgaagcatgtccttacttcaagtttggttatttgtctgcaaacggagccattgcagaagcaatgaagaacgaggacagaatccatataatcgactttcagattgcacaggggcggacagtgggcgactcttatccaggctcatgcagctctgccgggtcccccaagc

SEQ ID NO: 12917 - DNA, 469 bp, Lactuca sativa
  Predicted polypeptide sequence is orthologous to G852, G2633
cggccttatggccgttgcacgggatcacctacagaggattaatgttgaacaacattgtcttgcgcgtgatattgtgaatataatcgcgtgtgagggtgcggagagagtggagagacatgaacttcttgggaaatggaaatcaaggtttacaatggcgggatttaaaccgtatcctttgagcacgcttgtgaattcgactattaaggctttgcttgaaagctattcgcataaatatagacttgaagaacgtgatggggctttgtttcttggttggttgaatcgagatttggtggcttcatgtgcctggaaatgataatgaacctgaatggaatcgggtgaagtttgtaataagttttgaatgttaacccttggaatatcttttcttcttgttaaatatgtatcatatgtaaaattcgtggtaataaatgtttcaaattttaggtacattaaatggtaaatatgtgttacc

SEQ ID NO: 12918 - DNA, 925 bp, Lactuca sativa
  misc_feature (847)..(847): n is a, c, g, or t
  Predicted polypeptide sequence is orthologous to G852, G2633
cagtagatgcttcgtacacggttttcagctcagagcatcatattctcatccaaatcagattaaaaaaaccctagaaattgaagtccaaaacagaattcaacagaagtttttcgatgaaaagccaactctagaagcagatgttacccaaattctagagggaaaaatctcgatgcagaactattaccaaacacctgttgaaaacatggatcggaacctatacccatccgatttaaaccaagggatccgtttttctgttcaaacatctgaattcggtaacaactcttcttctacggcaagcttctcctcaaatggcagctctatttcacaacaagattctcactcctacattccagacacataccattcccctgactatacttacacctcacatgtaagtagggttggtttcacagataccaacacagatgatctagagtacagactaagagaactagaaaccgccatgcttggaaccgatcaagatttcttggaatcttacaatggttcatcttcttggggtgaaaccaatcaaacaatttcagacaccatgtcagagatgatatcaagaggaaacttcaaagaattgctcctcgcgtgtgccaaatcagttgcagaaaacgattcaatcaccgccaactggctaatgtctgtgttacgccctatggtgtcggtttccggcgagccagctcatcgtttaggagcttacatgcttgaagggctagttgcaagactatcttcttcaggcagctcaatctacaaaaccctaaattgcaaagaaccaacaggaaacgaactcttttcctacatgcgtgtactctatgaagcatgtccttacttcaaattcggntacctatccgccaatggcgcgatagcagaagccatgaaaaacgaaaacaaaatccacataatcgatttccaatcgctc

SEQ ID NO: 12919 - DNA, 952 bp, Lactuca sativa
  Predicted polypeptide sequence is orthologous to G861, G1140
actcttcatcactgttgtctccaagaatccaccccaaatccatcttcttccttccagaaaagaagggttatccatggcgagagagaagataaaaataagaaagatcgataatataactgcaaggcaggtgactttttccaaaagaagaagagggcttctgaagaaagctgaagaacttgcggtactttgtgacgccgacgtcgctttggtcatcttctccgccaccggaaaactgtttgagtatgctagttccagtatgcaagagttactcgggaaatataaactccactcgactaataacgtcaataaagttgacgcaccttctctcaatctacagctcctggaaagcgaagagtcaaggatgagcaaagaggtacttgacaagaatcgagaattgagccacctacgtggcgaggaccttaatgggttaactctagaggaacttcaacgtttggagagcttgcttgaaggaggcctcaaccgtgtgctccagacaaaggatgaacggattgcaaacgagatagcaagtcttcaacaaaagggttttcagttgatggaagagaacaagctcttgaaacaacaaatgatgagtttgacttccgtaggcaagaggccacggacaacggctgccgagttggacaatattgtaattaacccagaagatcaagtgcagtcatcggaatctgttgctaccaacgtatacagttgcaacagtggacctcctcctgatcaggatgattggtctgatacatcgcttaaacaagcgttaccctttaattgacaatggcaaaccgtcgaggaaaaggagaagggcgatggatggttgtggtatttgaagggaataagaagtgatgtattgaaataagtgtgtaattgccatgcttggttttgtgcttgttctatgaaaacaaaatgaagactttaactcgtattttgaaggtatctatctagt

SEQ ID NO: 12920 - DNA, 556 bp, Lactuca sativa
  Predicted polypeptide sequence is orthologous to G869
gaacctgtggagcggaaggattcggcggatcaaaccggaaagaagaaattaaccggagttcgattgcgaaagtggggtaaatgggcggctgagatccgtgatccatttagcagaaaaagaatttggttgggtacatataacaccgcggaagaagcatcgaaagcgtatacgaccaagaagcaggagtttcaagcaagattgtcggcttctgccccaattcgacccaaatccgatggcgaatcgtcgacacaggtttctcaggaggcagatcattactctacggagggggaggagaaggagacgcgtttgtcgggtcgggtcgttccggatcacgccccaattgcgaaatcgaaagtggttcattggaagaagtgggatagatggggtgccaatgttcataacccggtaatcaattcaaacatccagtctgatgatacatgtgatgctgaagaagaggcttcaaatacactccaatcgatgaagatgggtttgaggccgggttacatggccccattcggatcagaaagtggctcatctcgtaaatcctcaaagaccg

SEQ ID NO: 12921 - DNA, 712 bp, Lactuca sativa
  Predicted polypeptide sequence is orthologous to G869
agagagagaaaggagaagaagagctgggttttatgtcggcaggttcattgaatctgattggggctccattgaagctctgtatttcttttgcgttgttcatctgttcttatctctgctgtttcacccagcagagtcttcttctctgtgttccgactgtttcgatgcgtttgaggccaaaaaggacttgttctggagtcgagtgtttcggtggttttcacataaataggttgtttgatcttttcttgttcttgagagggcctttgacataaaccctaaatcaattttggtttattttccggcttttatttttgttttgaaagttttgtttagttttgggtatgttttgaggctgcaaaagccgccggagttttgaaaacgataacacaaccgccgatgaatcaagagaagaagtcgagaaacagagcgaagataatggaaccaaacaaactcatgcggaagatccgggttatctgttgcgacccggatttgaccgattcatcagatgacgatgagcccaacaaaaaaccctttgggtcaaagcggattgtccgagaaataaagattccggtcggcgacggtggcttttccggtggctgtacgacggtgatgacagcgactaaagaacaggagactgaaagttcatgtcaagatagcaacaacggtgagaaaagttgtgggaagagaaaaagagtttcgaccaaaacccccggtc

SEQ ID NO: 12922 - DNA, 762 bp, Lactuca sativa
  Predicted polypeptide sequence is orthologous to G878, G884
cagtcatttgatgggcatataagtgacattgtgtataaaggtcaacacaatcatgacccaccattggtgaataagagaggtaaagaaagcgctgatgtcagcaaaccgaataattatcaatttgagacacgggtagttgaggctgctgcccaacctgcccgtgatattcctcggtcaaatgagttgattagaatcgatgagtcggacgatgaacctaatccaaaaagaaggaacacggaagtggggcctgtggctgcgcccgtggaatcgaatttttctcataataagatggtggcagaaccaaaaatagtggtgcaaacaagaagtgaagttgatcttttagatgatggatttaagtggagaaaatatggtcagaaagtggtcaaagggaatactaatccaaggagttattataaatgtacgtatgcaggatgcaatgtgcgaaagcatgtagagcgggccccatcggacccgaaatcagtggtgacaacatacgaaggcaaacataatcatgatatacctgtatctaggcatcgagcctacaacactgaaaagggtacaaatgtaaaatcatcatcacaacgtaaagaaaccaaatttggaaacaatgaaagacctgttcttttacagatgaaagaagagaaaatcactgcgtaaaacttaaactatcgtttttttataaaacttgtaatgaaaatatcaaataggggttgttatttatgggtcatattataacagaagaatactatagtagtacatttt

SEQ ID NO: 12923 - DNA, 891 bp, Lactuca sativa
  Predicted polypeptide sequence is orthologous to G878, G884
cgcatttgtgatcggttctggcgtgatttgagagagatatcgtgtgagatagtgaaaactgaaggcggcggcggcagctactggcagaattaccgggaacaacacaatggcgcttttattaagttttcacaggctgtatagtagaaagatagtcatggcggagacaaacggagggtcagcagctgcagcaccaccaccacaacaacaacggcgagttcctccaatgattgcgcttccaccacaaacttcgttcgaaaccctattcaccggcggacctggaccagggttcagccctggaccgatgaccctcatctcgaatttcttctccgatcataacactgacatcgattgccgctcgttttctcagcttctcgctggagccatggcgtcccctgcatctcaaatcccacctacttctatgtttgacgattgttcttcctcgaaacaacctgattcagaaaagaaacaagggggattcaagcaaaatcgacccatggatttggtaatcgcccaatccccatctgggttcatgttcccatctacgtttagtccttctggattactcaattctccagggttcttctcacctcttcagagtccattcggaatgtctcaccaacaagcattagctcacgtgacagcacaagccgcattatcccaatcttatttcaatcaaatccaacccgaaaaccaaaacaaatcatcacaatcacacgaagaaccacaaatagtcaacacaaagtcagacctctcagattcccaaatcgggtcacccgatgacgtgtcgttttcccaatctgacatcagcgaaccccgccacgtcatcaccgcacctaccgacaccaatgatggctacaattggagaaaatacgggcaaaaacaggtcaaagc

SEQ ID NO: 12924 - DNA, 947 bp, Lactuca sativa
  misc_feature (856)..(856): n is a, c, g, or t
  Predicted polypeptide sequence is orthologous to G881
gcggggtcatcagttgacaattaattcttcagaccagcaataatggtggcgtcatcatttgccatagacctcaatcttttccccttccacaaaaccgatgacacaccaattagagaagttcacaccgatgatgattatgatgacgatgatgatgatggggaggaagaagacgattgttcgtttggaaaagaggttgatgatcatatgatcagcggggatcatttaagcaggataaacaacgaaaacaagaagctaaaggagatgcttaagatcgtatgggagaactacaactctcttcaaacgcatgtcaagaaactaatgcaagaaaaacaagtacctgaatcgaatccaaagaaaagaaagctggatgagacagttcaacaaagcttgtggaagagacagaattggaacttggaatcaccaaggaatactggggttcaaagagtttatataccaacagatccgtctgataaaagcctggtagtcaaggatggatatcaatggaggaaatatggacaaaaggtgactagagacaacccatctcctagagcttattataagtgctcttcttcaccaacatgcccagtcaagaagaaggtgcaaagaagtgtggatgatcctggtgtagtagttgcgacctatgaaggtgagcacaaccacagacgcacaaaggaagaggctgcgtatgccctagccaatgaacataagatttcaagtagtgaaagaaggtcaaactccccaagatttgatgaggttttggtggaaaaaatggctacttttttaggaaaagatcctgatttcactgcagaacttgctgctgccatttcctccaagattttggaagtcgatttgttcntagcatgctaatcgattcgtattcatctcttttgtatatgatatgtggtttgaacaagaacacaaagagttttataacgggtatttgatcg

SEQ ID NO: 12925 - DNA, 700 bp, Lactuca sativa
  Predicted polypeptide sequence is orthologous to G896
agctacatcgataagatgcgccatatgtcaagccatcacccaccttaacgatcctcgtgtcggagctccgcggcctcataccggtggttatccgggaccttctccatcctcttatgctcctcatcaaccctcgccttacaaccacgctccgccagggcctccgccgtctgcacatggcaggaagaaggcggtgatcgtaggcatatcgtataaattctcgaggcatgaacttaaaggatgcattaatgatgctaactgcatgaaatatcttctgattaataagtttaaatttcctgaagcttctattataatgcttaccgaggaacaaacagacccttacaaaattccaacaaaacaaaacatgaggatggcacttttctggttagttcaaggatgtcaaccaggcgactcacttgtttttcattattctggtcatggttcacgacaaaggaactacaatggtgacgaggttgatggatatgatgaaaccttatgccctctggattttgagacacagggtatgattgttgatgatgaaatcaatgcaagtattgttaaacctcttccatttggggttaaacttcatgcaattattgatgcttgccatagtggcactgtattggatcttccattcctttgcagaatgaacaggagtgggcaatatgtatgggaagatcatcgacctcggtcaggtatatat

SEQ ID NO: 12926 - DNA, 734 bp, Lactuca sativa
  Predicted polypeptide sequence is orthologous to G896
gatgcaaattctcgtaacaaacaaatatggaaactcaacaactctgcaaagggtgctacaattacgtgacagtagcacctgggagacgttgtcccatctgcaatacaatcgccaagcccaacaaaagaactagtcaacgtattgtccctgggatactccagtttatcgatggctatgccaacacacgttcaaacagcaactactacaatagcgtccatggacagcttccacaaccaccagcatatggaggttattacgctccaccggtgtatggttctggtacctacagcccacagccaccgccatcaatctacagtggaggttataataaccctccaccacagtctccggctgtgtatggttacggttatggccaccccgaaccgcagacgtggtctcctttgatgcataacaactacctccaacaatcaccggaggttcatgagaagaagaaggcggtgctgtgtggcgtgacctacaaaggtcacccgaagtcactggctgccagtataaataacgtcaagagcatgcatcaattattgctgaaattgggtttcccaaatggttccatccgcatcctcacagaagaagaaccagaccccaccaggacaccaacaagacgcaacatattgatggcaatggagtggctcacaacagattgctgttccggggattcattggtattctattatgcaggacatggctctcatgtgcctgataccatggagatgaaa

SEQ ID NO: 12927 - DNA, 907 bp, Lactuca sativa
  Predicted polypeptide sequence is orthologous to G896
gccttcccgtcgcatttgagctattccccgccgtcggtatatggtaggaagaaggcggtgatcgtcggcgtatcgtataagaacactagtcacgagcttaaaggatgccttaatgatgctaaatacatgaaataccttctgattaagacatttcagtttcccgaatcttctattcgtatgctcaccgaagaagaaacagagtctaacaggatcccaacagcacgtaacataaggactgcactctcttggctaatcgaaggatgtcaaccaggagactctctcgtctttcacttttccggccacggttcacggcagaggaacctcaacggcgacgagcttgatgggtatgacgaaaccttgtgccccttggattttgaaacagcaggtatgatcattgacgacgaaatcaacgcaacaatcgtcagacctcttcctctgggagccaaacttcatgcaatcatcgattcttgccatagtgggactgttctagatctcccattcctctgcagaatgaacagttctgggcattacgaatgggaggatcatcgtcctacagcaccaggcatatataagggtagtaatggaggcgaagtcatttcgatcagcggatgtgacgatgatcaaacatctgctgatacatcggcgttatcaaaaatcacatcaacaggagcaatgacgttctgttttatagaagctatagaacatggaaacgcgtctacttatggaagcttgttaagttcaatgcgtaacaccatccgtaatgcatcaagagggtttggttctgcgaattctgtgcatgatatgctttcaagtaatcgtgggttcactcaggaaacacaattgacttcatgtgagcctttcgatgtgtatgcaaaaccattctccttctgatcttcatatatgatga

SEQ ID NO: 12928 - DNA, 929 bp, Lactuca sativa
  misc_feature (729)..(729): n is a, c, g, or t
  misc_feature (817)..(817): n is a, c, g, or t
  misc_feature (862)..(862): n is a, c, g, or t
  Predicted polypeptide sequence is orthologous to G922
cgggggactctctttattccactgcatctttgaacaaagaacaaccgcctgactgactagcttttaattcattgaaatcccaactgttcctcactttctctctctacaaaatctcccaaaattcttatttaatgttgttatctgagttcaattgaggggattgcttcgagattttgaggtgggtttttgatgaatttcagaacccagtaaagaatttttgttcttttggttgttgtaggttttaactcaacccccaactgttcgtccttactttctccatctagaaacccctaaacccacttcaaggcccttatattcttccaattcagagtggtttcatgagattcgaattgggattttgatgaatttcagaaacccagtaaggaattgctcttcgcttgattgtttcagcttctaattcctcccgcaaagtcatttacacgacaacgcgtgattgaattgagggaattttcatgggatttgaaaggggtatttgatgattttggaatcctaacaagcaattactgttctttcgatttcttgggtagttcttctccacgaaaactctccctggtactactctttctctcttctttttcttctgagttatttctctgttctaattaccaaaaccccatccattatctgtaacttaaaccaatttagcttcgcttgttcatagaattgaattctagtttcaaacagaacccaacatccgatttctgaganacaaaaaaccagattcatatagaaatccaatgtttcaagatgatgggtcatcatctgtgacttcaacacccgtccaaaccttcccatncatgtcaatctcacctctcacaggatcgccatatccatggctcanagaactcaaatcagaagaacgaggtttatgcctaatccatctactcctcacttgtgcaaacacgtag

SEQ ID NO: 12929 - DNA, 723 bp, Lactuca sativa
  misc_feature (613)..(613): n is a, c, g, or t
  Predicted polypeptide sequence is orthologous to G927, G1334
tcgaataatgttgcctttaaacttgagcaatgatgatgaaccggtttttgtgaatgcaaagcaatatcatggaataataagacgtagaagatcacgtgctaaggcagaaatggcaaataaagttttgaaaaatcgtaagccatatatgcaccactcacgtcatctccatgcaatgcgtcgaccaagaggaaacgggggtcgtttcttgaacaccaaaaaggaaaacaactgcaaagatgaaaataccgatcaagaaaaagacaaaaaccttttaaagtctcctaattatacaattttcatgtccaatcatcacaacttcacttctcatcgtgaaccaaataacatgttctcaacgggagacgttaaaagtcttccgattggaaacctttcggtggtctctttttcagaaatgatgtccgggaacacagctcccagacatagttttggcatgcatggcaaatgggttgcagcgactggtggtggtgatggtcgctgcaattttacagtctaatgtcagagatgaggtcctgatgtgttgtatgtatatcagcatatcgggacctcatatctttacaaccagatgaaatatttgaaatatttatctggttgtctntggcaactcatccttggcttattgtgttgaggttgtctctaacctttctcacgttgcatttcatagtgtgcaatgttttgagagttgtatgagatggtcatagccttaat

SEQ ID NO: 12930 - DNA, 946 bp, Lactuca sativa
  misc_feature (889)..(889): n is a, c, g, or t
  Predicted polypeptide sequence is orthologous to G928, G931
cggggggggaggatggttgttcgatggcataggtgtctgtctttattattccatttagcattaaaaattagcaggaaatatttaaagctatttctgggaggaagaagtatagagatttagatatattagatagatacatcaaacctagatgacagggaaagagagagaagatttctagagggtttcaagggaggagacatgcccaatttcccccaacaactctgtttcttgcttccttcttcaagatctcaaagcttgaagatggttcctgcaccccacctacctggagacccgaatgagttgactcagcaatcttacaatcaagattcatccacgtgtctttcatctgatcaatctcaaaaggatgatgatgttgctacacatggggttcattctcaagatcaatgcatctcatcatctggttcagatgaaactcaaatgaagccatttttatttatgggcaatccaagttttggcatgacaggtggtcttcaagctgaaaagacaacaccaatagttgaaaatgtttatgctgataattacttcaatggactctataccccctatggaccacaccctattattcaacctcatatcatacaaatagctcctgcccgagttccactccccatagatctctcagaagatggccctatttatgtcaatgcaaaacaatatcatggtattctcagaaggagacagattcgagccaaacttgaagctcaaaacaaacttgtcaaaaaccgaaggccttaccttcatgaatctagacataaacatgctttgaatagggttagaggttcaggtgggaggtttcttcccaccaagaaacctcaacaacaatcaaaacctgcaagattcttgaccctccatttccccttcagctatncagaagctaatcaatctggaatggaacatgaacattatcatgggtatagtggcattt

SEQ ID NO: 12931 - DNA, 275 bp, Lactuca sativa
  Predicted polypeptide sequence is orthologous to G929
ggccttatggcctctgtgcgggagtatgggcgagagcatatactgatataatacaagaattgagtgtttttgtttatgaatgattctttgtggatttttgcaaacatggtaattgtgtggtatgtaatatggtttttgtagactataaagttttttttgactccctggttgtgggacgggagcatacaaagataggaaaataagttatgtaatggagtacatacactcttattatgattcgtttagccgaaaattttggaaataggttgtccaac

SEQ ID NO: 12932 - DNA, 894 bp, Lactuca sativa
  misc_feature (846)..(847): n is a, c, g, or t
  Predicted polypeptide sequence is orthologous to G938
cggggaaactacagaataccccttttctttctctctcatctataaactttggaaaggggtttccaggagaaaaaaagaaatcaaacccaccattcagattggctgagaatctggagatgcatatgtttgatgaaatgggattttgcgaggaacttaacgttttctgtgctcaaaatgcgcaaggagagattagttctcttccaactgaaaccgggacgatggtggatgacgatttcaccgatgaagaaatcgaagttgatgagctagaaagacgaatgtggagagataaaatgaaacttaaaaagctcaaagaatcatgcaacactaaagaaaacatggatacagcaaaacaacgccagtcccaagagcaggcgaggaggaagaagatgtccagagctcaagatgggatattaaaatacatgttgaagatgatggaagtctgcaaagctcaaggtttcgtttacgggattataccagaaaaaggaaagccagtgagtggcgcatccgataacctccgtgaatggtggaaagataaagtccgattcgacaggaacgggccggcagccgccgccaagtttcaagcagataactcgatcgccggcgagaacgagaagacgagttcaattgggtcgacaccacactcattacaggaacttcaggacacaactctcggctccttgctatcggctctcatgcagcattgcgacccgccgcagcgacggtttccgttggaaaaaggtgtaccgccgccatggtggccgaccggaaacgaagactggtggccggagttgggtttacagaaggaccaaccgggcccgccgccttacaagaagcctcacgatttannaaaagcgtggaaagtcggcgttttgacggcggttatcaagcatatgt

SEQ ID NO: 12933 - DNA, 726 bp, Lactuca sativa
  Predicted polypeptide sequence is orthologous to G987
cggtggagcacatcgacggatgatttacagaattaaaacgaaaagggtaagaatcgcattgaagggatgcagaaggaaaatgaaacggtggaagctctacgaaacaatggcggtgggaagaggtacaattgagggtgagtaagaaaggagacgaagaagagaaagaaaaaaaaatagaaaagaagccaagtatctgttgtgatgttagtgattacgattcccctctcgtcccaaatgtttctatcaatcttgattcacaatccagatctcaatcatcttactgttcatcaagctgtaatagtaatggcatcgacagttttacggattcgcccctgagtatccaaagtgtttctgatatacttggcagtagcagatctgatctgcagtttcaaaaagatattggaggattgagtaggttccttctcagcaatgaaaacaaggaagaagccaatgatttggttatcaaagcagagaataaacaggaaaccaattccatcccagaaagaacaagaggaaagaaaaatccttaccctaaagatgttgatgatgatgggaggacttccaagcaatctgcagtttacacagagccaactgtaaggtccaaaatgtttgatgatgttctactttgtaatggaggaaaaaaccatcttcattgtgatgttgtccctaatggggtgaatggagtacaacaaaagggtaatgggggaaagggtggtcgtggtaaaa

SEQ ID NO: 12934 - DNA, 440 bp, Lactuca sativa
  Predicted polypeptide sequence is orthologous to G987
tcggccttatggccgctagtcgggaggtgatgaatgtggtggcgtgtgaggggacaacgagggtggagaggccggagacttataagcagtggcagtcgaggaatgtcagggcgggattccggcaggtgggattgttcagggagaaggtggaggaggtgaagagtaaagtgaggttggagtatcataaggattttcttgttgatgaagatgggaaatggatgttgcaaggatggaaagggagagttctttacgcttgttctttatggaaacctgcttaagttatagaatcctagtccctagatagatgattagaagattcccatatgcatttttactattctttttcatgtctttctttatttttcgatttctaatgtaaccatcttttgcaagtatttcccacttaaatcgatgcttaattttcaaaattttgtctataa

SEQ ID NO: 12935 - DNA, 772 bp, Lactuca sativa
  misc_feature (634)..(634): n is a, c, g, or t
  Predicted polypeptide sequence is orthologous to G1020
acttggtgttagtgttggtgcgaaagagccgcattttagaggagttaggaagcggccatggggggggtacgccgctgagatccgtgatccggggaagaaaagccgtgtgtggttgggaacttttgatacggcggaggaggctgctagggcttacgacgcggcggcgcgtgcgtttcgtggtgctaaagccaagactaattttccgacacatgatgatcttggtttgttgaagctacaaacttgtccgaatcagcggagcccgagtcagaccagtacggttgagtcgtcgagtcgtgaccctgaaccggtggttccgcttttggatctcaacctgtcgtacggtagccctcctcccttcgtagtccagtttccctacaacccccaccataatcataaccaaccccggttctccaccgtccccggtgccggcttttattcgccgccggcgaatcagatgttttatttcgacggaggatccaaaccatctgctcgccacatcaccaattgcgacagatcgtcgatcattttccggcagtctgctagtgttgcgaagagcgacgactctgcgtcatcatcagttgttgacttgaagccgtcgcctccaactcgacgcgtcggcgtcacaatcgatctncacttcccgccgccagtggaatcttgaaattcatattcatcttgaattcgtaaatctgaaaccgtaattaggaatattacgtttttacataaccgggtaggaatacggcaacgtcgtttagcggtggtgatcatgtat

SEQ ID NO: 12936 - DNA, 745 bp, Lactuca sativa
  misc_feature (565)..(565): n is a, c, g, or t
  misc_feature (624)..(624): n is a, c, g, or t
  misc_feature (695)..(695): n is a, c, g, or t
  Predicted polypeptide sequence is orthologous to G1020
aaacctgacggcaacaccggcggcggcaatggcggctccgagactcgctaccgcggtgtcagaaagaggccatggggacgttacgcagctgagatcagagatcctggaaagaagagccgtgtttggctaggcacatttgatactgcggaggaggcggcgcgtgcttacgattccgccgcacgggagttccgtggcgataaggcgaagaccaactttcctacctccaccgaattgtcgctcccgatggtcgccgttggtgggaagcctaaggctgtgactaaaagccctagcggtgagagcagcaccgttgagtcgggtaactccgccgttccgatcgccgccgctcctcttccaccgtcggctctcgatctcaccctgtcgcactttcctgttggtttcccgatggctcattccttgttcctctaccattctcagatcaacaacaccgtcaaacacaacaaccgtttggacatgttcagattggacggatccgttcttcctgcacccaacctgactatcgccgccggcaacaacgcacaaagcgactccgactcctcttccgtcngtcatttcagtcatcctaccgatcgtccacaaccaagaaaaaaccttcgctcttgattntgatcttaatttccccccgtcggaagttgcctgatgtaattttctttttttagcaatctccggtcctccgncaccctccgcccctggtttccctttttttttttcatcgcagagcagatca

SEQ ID NO: 12937 - DNA, 829 bp, Lactuca sativa
  Predicted polypeptide sequence is orthologous to G1033
ttctgttctcttcacttcccgatcacagatcgtttctcacttctcgctctagatatgaagggtgccaagggtaaaggggcagcaaagagggacaccttgaagcctgttgatgacaaaaaagtagggaagagaaaggcacctcctgctaaggctgttggcaaaagcaaagccaagactgcgaaagcagctaaagatcccaacaagccaaagagacctccaagtgctttctttgtcttccttgaggaattccgaaagacattcaagaaagaaaaccctgatgtgaaagctgtttcagctgttgggaaagctgggggagagaagtggaaatcccttactgcagctgaaaaagcaccatatgaggccaaagctgcaaaaaggaagattgattatgagaaactaatgactgcatacaacaagaaacaggatagcattgctgatgatgatgaagaatctgaaaagtcaaagtctgaagtagatgaggaaagtggacaggaaggtggtgatgatgatgaagatgatgaggatgatgatgaagatgatgattgagatcaatgcttttttttttcagcaaaatctgtctgaattcattttcagaccaaacaaatatttgctggaaatttgcatgttcatgttcatagattatggtcatgtcttatctatgtgtactttgcattttacacttcagctcttgcagagtgtttagcttagattttattaatgatcttttattttatgtactttatctatgatttctcttttattttgacttgagtgttaaattttacgttgttgttaagtgagtttcctttcaaacctttgtaggtaaact

SEQ ID NO: 12938 - DNA, 693 bp, Lactuca sativa
  Predicted polypeptide sequence is orthologous to G1033
cggggctctttcgttcttcagaatcatactgtttttggctcgttttcacttcaacgatcacagatcctcctcatctttctctcaagatatgaagggtgcaaaaggtaaaggtgcaacaaaaagagacgcattgaagcctgttgatgacaaaaaggtagggaagaaaaaggctgtaggaaaaggcaaggctaaaggagggaaagcagaaaaagatccaaataaaccaaaaaggcctccaagtgctttctttgttttccttgaggagttcagggtgacattcaagaaagaaaaccccaacataaaggctgtttcagctgttgggaaagctggtggagagaaatggaaatctatgagtgcatctgaaaaagctccatttgaagctaaagctgcaaaaagaaaatctgagtatgaaaaacagatgaatgcgtacaacaataaacaggacgatgatgctgatgaggaatctgacaagtcaaagtctgaagtagatgaggaaagtggacaggaaaatgctgatgttgatgatgatgaagatgatgatgaagatgatgattgaaatttgtaatacatgaaaaacttgtgtgtttttatttcagtcttcttttgcaaatgtaaccctcaaaactttttccctcttcagcctaatgtaaactcttaactaagttcttgcaatgctagtttaacttaaaatta

SEQ ID NO: 12939 - DNA, 721 bp, Lactuca sativa
  Predicted polypeptide sequence is orthologous to G1033
gcggggatcgcaacgaatcaaccctaaccctagattttttgctaagtaggatcaaacgatgaaaggaggcaaatcaagcggtgctacgaggaaagccgataccaagttggctgtaaagaaaactgcagccaaggggaaagcagctaaggatcccaataaacccaagagacccgctagcgccttctttgtgttcatggaggactttagaaagcagttcaaagaagatcaccctgacaacaaatctgttgctgctgttggtaaagctggtggggcaaaatggaagtcaatgtccgactctgaaaaggcaccttttcaagccaaagctgacaaaagaaagaaggaatatgagaagaacttggacacctacaacaaaaaacttgctggaggtggtaatgatgatgatgatgaggattctgacaaatccaagtctgaagtcaatgatgaagcagatgagggtgaaagtgatgatgaggaagatgatgactgaatcaagaaagtggaagttgattctgtgttgatggtttgataagttacttgctttgtagtttcatgttactgattagaatagatttggtttttatggtgcacaggaaaaaggaaatgtaactttggttggctctaatgttagcttttgtatcttccaaatttacccttttggggtggttttctgtttagaacaaatatcctttgctaatgcatctttatctttttcgggtaaaaa

SEQ ID NO: 12940 - DNA, 798 bp, Lactuca sativa
  Predicted polypeptide sequence is orthologous to G1033
gcggggggccttatctcaacgaaaaaccctaaccctaaaatcctcaattcattcggatctaacaatgaaaggagcaaaatcgacgaagaaggctgatagcaagctcacagtgaagaaaactgcggctaagggaaaggctgccaaggatccgaacaagcctaagagacctgctagtgccttcttcgtcttcatggaggacttcaggaagcagtacaaggaggagcatcccgacaataaatctgttgctgcggtgagtatttctagccaatttcttcgaatctataattgtttagaaattccgtttgttatacttctgcttatttgattgtataaacaacgaacaggttgggaaagcaggtggaacaaaatggaaatcgatgtctgaatctgacaaggcaccttttgttgccaaagctgacaaacgaaagaaggaatacgagaaaaacattgatgtttacaacaaaaaaaaggctgctggtggtaatgatgaggatgatgattctgataagtcaaagtctgaagtaaataacgaggaagacgaggaaggaagtgacgaggatgaagatgatgattgaagtgggttttatatgatgtagaatcagaagttaaatctgttttgtagtttcatgatgataatattagcataatgtagatctttagctatggataattttggcttggttattatggtcataaaatagtattgattagatgttagctatcatggtgcacagagagatctgaatagttttgtttgcttttgtgttcttggtagtttttaatgaaatgcatcatgtt

SEQ ID NO: 12941 - DNA, 820 bp, Lactuca sativa
  Predicted polypeptide sequence is orthologous to G1033
cgggggtgtgtgcattcacacagcaacacgaatacactagactacacccaaccaaagcatatctcttcacgcatttcctctcctcttatattattctcccttcgcctctctttcccttatctccataccttcccttccttcaactcaccgagttcactcccatttccaaacgagttacgtcatgaagggagccaaatccaagtccgacaccaaaaaagccgatagcaggcttgctgtgaagaagaaagcagcgccggctccgaagaaagctccggcgaagaaggctaaggaagcgaaggatcctaacaaaccgaagaggcctgctagtgctttcttcatcttcatggaggatttccggacacagtacaaggaaaagcaccctaacaacaaatccgtgtctgttgtcgggaaagctggtggtgataaatggaaatccctttctgctgctgagaaagccccatttgcagctaaagcagagaagaggaaggccgaatacgagaaaacactccaggcatacaacaagaaactggctgaaggaaaggacgctgaagaggaagaagacgaggaatctgacaagtcaaagtcggaagtccatgacgatgaagaagatgatgatgatagtgcagatgatgatgatgatgaagacgatgagtgaaaagaaaagaagaatatgtaaaacaagaatttgggatcttaaattaaaagtttttgtaagccttctttttaagagaaggttaatttggaagtgaaaaatatcctcaatcttatgtgtacttttaatccgtaatttcatctcaatgataattgtagcttttagatt

SEQ ID NO: 12942 - DNA, 920 bp, Lactuca sativa
  Predicted polypeptide sequence is orthologous to G1043
gagttccatgttgcccatagagtttaccaagcaaccggatcaaagccattcaaaaactcacacaaggtcaacacttaaccagtaagctccgggagatgctccgacgatcgaaaaagactgagcctgacatcaatcctcaggtctgtatgatgtgagtgggggagatcttgtgaatgtttgataacacccgtttcgatcttgaactcttctagctttgaagaagttcctgatatgccgattggtgatattagatctccgggcagttgggatgaccaaaagtcagaaaattacggcgaaagtaccaagaccctaacaccattgaaagttaaaagggggtgttacaaaaggagaaaagattcatggacatctataaagataactccgaggttgattgatgatgggcatgcttggagaaaatatggtcaaaaagtcatcctcaacgctaaacatcaaaggaactattataggtgcacacacaaaaccgaccaagggtgccgtgcaaccaaacaagttcaaatgactgaagatgagccaccacagtataagataacctacagtggacaccatacttgcaacaacttgctaagatcccctttaatcattttggattctccagatcataaggataactcattcgttcttagttttgaaggaacgggacttaataacaacaaacaagtcgactcttgtttcccctcagcaaaacaagatccaaaggagggttttccatctttagttttcaggcacaacgaagcttcttcatccgataattaccttccatgggatttgaccacacaagttccatcagaacctatgtctatgatgtcatccgggctagaccatgaggacatgatatcttcagaggtatattcgtctacatgcagtacccatggctatgagatagataatatcatttggaa

SEQ ID NO: 12943 - DNA, 893 bp, Lactuca sativa
  Predicted polypeptide sequence is orthologous to G1043
gcggggactactatttctcaaacccgagaatatagtatggatcagactgcaacctggccggagagtttgccaagcgacaggataaaagcttttcacgagctgatccaaggcaaggagttgaccaataatctgcgggagatgcttcagtggccgagaaagatcgagtgtaatcccacatatgaagatggccttgtgatgcaaatcatagcgatgtttatgaatacactcttaatcttgggctcttgcacttcgaaccagcatcttgagattccgacaagtgatatgtgtttatcatatagttcggatgggcagaaatccgaaaattcaggcaaaaatgagggaaatatcatcccggcaaaacgtaaaaagggatgccacaaaagaagaaaaaattcatggacgtcatcacaagtgacctctactttggttgatgatgggcatgcatggagaaaatatggtcaaaagcatattaacaatacaaaccatcaaaggagttattataggtgtacctataagtttgaccaaggatgcctcgcagcaaaacaagtccaaaagatccaagacaagccaccaaaatataaaacaacctacatgagaaaccatacttgtcagaatctacaaagagctcctgaaatcattttggattctttaaattctaaagatacatcaatcctttttaactttgaaacaaaggggctcatagcgaggacacgagttggcacctttttcccctctataaagcatgaacaaaaggagagttacccttctcatgggaatttgaggaatgaggaatattcgtttgccaatgacctacattgtgctctaaacgcatgtgtttcaaataaatccgttcgaaccaaatatctaagactaaaacgttataagcattcgat

SEQ ID NO: 12944 - DNA, 895 bp, Lactuca sativa
  Predicted polypeptide sequence is orthologous to G1047, G1808
gcgggggtcttaatccgccttccactcatcgtttcttccctttcctcctcctaccttcctccaccgtctaaaacgcttttccgatcatgttgtcttctgttttccccaccgacggcgaccatattccgtccgacgactttcttggaactgggtttaccccttgggacactgacactcatgaaagtccctttctttatccacctcaagagcctgtcttttcgttttccggctccgacgactccacgccaaaaaccaacagctccaactccggctccgacgagggagacgctgaccggaatcctattgaagtcaccctgattgatgaacgtaagaggagacgcatgatatcaaaccgggagtctgcacggagatctcgcatgagaaaacaaaagcacttggagaacctgaggaaccaggtgaaccggcataagactgtgaaccgagaaataatgaaccggttacggtttgtaagccatcatgcacaagttataaggcaagaaaacgagaggctccgatcggaatcagtgatgctccggcaaaaactatgggacatgcgtcaagtactgctcgtccggcagcttcagaaccagttattatcgtctgcatggccatgcaataataacgtgacaaccatcaatgaacaaaacccacaatcgttaattacataaagctttatatatatatttcatatgaaattaaatcgtaactaagtgcatgagaacaatagcaactcaccctatatatatatttgtaaaggaatcgatcaagtagttggaggaaggtaattatcaagtaatggtaattttaagtcgttatttttgtcttggttttcgtttcttttttagttggtttttggaaaatgaaggttttggtagaacggatggttgtttttgtc

SEQ ID NO: 12945 - DNA, 945 bp, Lactuca sativa
  Predicted polypeptide sequence is orthologous to G1048
cggggttcatatacataacctccctcaaaagcttcttcaaaaaaacccctctccatgtaaatctttctatggaagagcaaatcgattgggataacctctttgactttgatgccagtttctccgatccctcccctaaccctatccttccaatttcatcaccaaatcacgccaacagccagtctcctttgtctgtcgatgatatcgaacagctgcttttaaacgatgacgacgaaactcacaacgctgatgcgttgaactcggttcaggatgcggtcgatgtgttcttccatgatattttgcttgattcgcctttagacgtagaaaaatccggtgaagttgtcgatatttctgatggagataattcggtggaggatcagaacaacgaagctatcgttgatcacaaagaagaaaaggagaattccgatgatgatcccaatgatcccctcgacaagaagcgtaaaaggcaactgaggaacaaagatgcggctctaagatctcgagagaggaaaaagatgtacgtaaaagatctagagatgaaaagtagatactatgaagcggaatgcaagagattaggttcgatgctccaatgtttcatagcagaaaatcaagcactacgtttttcattacatagtagtaaggcatacaatgcttccacaaccaagcaggagtctgctgtgctcttcttggaatccctgctgttgggttccctgctttggttggtgtgcatagtttgccagctcgttcttcccggcctgcacctgcaaaaactaggggcagctcaactggaaaccgtggtagaagaaagctactaccaaatctggttgtaaggaaggagggaaagtaaatctgtagagagcctctttcccttttggttggaaaaagattcaaatcttcaaggtcaagaatgagatcaagcctttgttctctagaatttgtaagcaaaat

SEQ ID NO: 12946 - DNA, 907 bp, Lactuca sativa
  Predicted polypeptide sequence is orthologous to G1051, G1052
catattacatcccctatttacattcaccccgaaatctcaatcgatcaatcattacttgttgatgatatatgtattccaacatatagatcgtttttcaaggttttttttttgagcttttagttttggaatctgttgatttgaagtgtttttgaaggtggaatttgattttgcatggcgcaattgccgccaaaagcgccaacaatggcgcagaagtggccgtcattttcctatcagacgatgcagccgatgatgccgatgtcagcctcgcaaccgccgagctggatggacgatttccttgatttttcttcagctaggaggaacgctcaccggagatccgccagcgatccgattgcattcgttgaaactccgtttattaacgaatgtcgtaactctaatagcaatgatccctcgatgataccttgctcaaataataacggatttgagcgtttggatgatgagcagcttagctccatgttttccgacgacgtcgccgcgaatcttcactcgacgaggtcatcgtcttcgccatcggaacaaaatagcgacaatgacgaacgtagaccatcgccgcctcaggaacaaccgccgtcgcaactgaagagtgagccgggagaggtagaagacggtggcggatacgaacacgactcagattccggtaagcttccgtttactttctccagcgacggcggcaccatcgttgatccaaaaagggttaaaaggatattagcaaatcgtcaatctgcccagagatcaagagtcaggaagttgcattacatttctgaactcgaacgcagtgtaacaactctacagacggaagtatcaacattgtcaccacgtgtcgcatttctagatcatcaaaggttgattctaaaacgtgataacagctcgcttaaacaacgaattgctg

SEQ ID NO: 12947 - DNA, 761 bp, Lactuca sativa
  Predicted polypeptide sequence is orthologous to G1062
ggtggtggtagtgatgggatgagtgagaagaagaggaagagcagcggtggcagttgggatgatgtggataacctgagtttggatggctccggtttgaattacgattccgatgatatcacgatgaacaccaccacaaattttgaagaaaatgggatcaaaattaacggtgggaatagctctaatgcaaacagtactgtcactggcggcatcgggagcaatcaaaaggggaaaaagaaagggttgccggcgaagaatttaatggcggaaagacgtcggagaaagaagctaaacgaccggctttacatgctcagatctgtagtccccaaaatcagcaagatggacagagcttcaattcttggcgatgcgatagagtacctgaaagagcttcttcagaagatcaacgaccttaactatgaactcgaatcaaccccatcaacctcatcattgacacccaccaccaccataaccacccccggcagcggcacccccaccggtttctaccctctaaccccaactccgaccagtctcccttcaagaatcaaggaagaactttgccccaccgcgatccctagcccaactggccagcctgcaagagttgaagtaagacagagagaaggaagagcagtgaatatccatatgttttgcagtaggaggcctggtttgcttctatcaaccatgagagctcttgataatcttggtttagatattcaacaagctgtcataagttgcttcaatggcttcgctcttgatgtttttcgagc

SEQ ID NO: 12948 - DNA, 711 bp, Lactuca sativa
  Predicted polypeptide sequence is orthologous to G1062
gatgttttaattagtcaaaattcttagctccgatcatggtggccactggtgagaatcgaaaagaagctacctttgcgggatggtttttggggctggggacggcggtcggacatagttcttctttcacatgttgatgaaacgccggcggtgtgggtgtcaatggatggaatcttggtgaattttgaattaaagacccttgtggtgatgcctctacttcgatatgaagatcgttgattctttgcagaagctccttcacgtaatcaatggcgtcaccaagaattgaagctctatccatactgaaacacaattcaaatgttataataactagaaaagaatagatattttacatgaaagttaaccagataccttgctgattttgaggacgacggacctaagcatgtaaagtctgtcgttgagcttcttcctccgacgtctctccgtcattaaatttttatcaagtagacccttcttcttccctttctgatccccggcgccgatcgtaacagagctcattgcattcgaattgcttccgattccgtttccatttggatgttcactggtgggttcgatttcgtcggaatcgtaattacatcccgatatatccatggtagctgtttcctcaagctcgtcctcctctgctaagctcctcttcctcttcttatcgatttccactgccaccgctattactctctgctctcttcccccaatttg

SEQ ID NO: 12949 - DNA, 742 bp, Lactuca sativa
  Predicted polypeptide sequence is orthologous to G1062
gacacacagtcgatgttcgttatcagtaacaacactctcctctcctctccactctgcattcaatcatacatttaaaccctaaatttttcatttgaatcttcaaccaggtgatgatgcccgacggtggtgctgtttggatggaaggaggaggaaaccaggatgaaattggaacatcttcatggacgccggccaccaccaccaccacaaccgccaatcaccatcatgttcttggaattgaagctgctgcaacatcatgcaacgaagaaaccacagccgccaacacttacgcttctctcaccaccttgaaatcaatgcttgaatccgagtggtatcaacacaacaatctcaatctctctacgaatccttctgataacaattcaatcttcttacctatggattcttcttcttcgtgttcgccgtcgcattcccaccacccgttctctctccccgacccttcgccgtcacactcatatcccttctttccccccaaattcaacaacccttatgacattgggtttgatttcggatgcgaccctggcttcttacctaatcacacttccaatttgatgaatttttctgggttatgttcgcaaacccacatcgccatcccggagctttcttccagttccgactttccggccaccaacaatagcaacgacacgagcgacattggaggacctgggttcaatccgcagttaacggcgtttgatggttttcatggcgctgcacccatgaatcctct

SEQ ID NO: 12950 - DNA, 746 bp, Lactuca sativa
  Predicted polypeptide sequence is orthologous to G1068
gcccttgttgtgaaaatgccataattgttgaggctatatcctctcctgctttaacaataatgacatgaggcgtaaacccaacaccaggtgcacctaaagcatccaattgcctcttcccagaacccgctggccttcctctgtttttcttagcagatgaatccgcatttggggttccaccgctgccatcgtttgaagaatccaaattcccaccaccaccagcagaagtaggaatagcagcgatcggagcaggggccaaaccgagggcaatgttgccatcaggagacggtgaatacttcctcggtcgacctctcttcttcctgacgggctctatgctgtatccatccgccctaaacccaccggacggagacgatccgtcaccgtattggttagaaggagaattaaaggggaagcgttgttgcatcgaattgggactcatcatgttggcatttttattgttgttggctgaagcggtgtttgagttgttggataggtggtggtgggtagagaaagagtttggtggcatcatcatgttcataccgggcggtggctgttgctgctggtgatgggcgtggtgttgctgtagtgacgacggtggtgcaaccgattccgccgctaggagacgacaccatgccgcttaaagaagtcgattcgttttatgatttttggtatggatttagaagttggagggagtttcacatgatgaagagttgaccttgacaagccgagtcacgagatcataaaagatg

SEQ ID NO: 12951 - DNA, 368 bp, Lactuca sativa
  Predicted polypeptide sequence is orthologous to G1089
tcggccttatggcctgccatcgggctgagctgccttaaccccagttggcagttaacaagattgaggaggattggaattgcgattattgcaagtggcagtggactgattcgtcggaggaggtagcgggcggttgccggagagattagcgggaattggaaaagatcgctgctaattttctttaggaagatgatggtctagggacccacgtctggtttttgtcttttcttctagctcattaaggctattgtacaatggttggagccagctatagtttttgttactttgtactcattaataattagacaagatgtacacacccaatacatgactaatacacgaccggtggggcccgactatccttttttccc

SEQ ID NO: 12952 - DNA, 735 bp, Lactuca sativa
  Predicted polypeptide sequence is orthologous to G1108, G2394
ggaacgattgatcttcacaacttcgccgcaaatccctccgattctttgctagtttaatcgcatactcactggttagtctttcctctttgttcgcgtatgattcttcccataaaatcagctcaaatacgcaagaagttgatgttttgcactactagggtttttcaattgtgagttctgatgacaccagttgtttcattgatccgttgtttacttacttggacgttttctctgaatacgtattagaaagatcagaattccgaagctaggttttgcgtgttgattagggtttacattaggagaatgttcatctgaaaatttctctgctaagttgtagttggtagatgggcgtttgtgtgttgggactacattgtaaagttgaaacaaagaaggaacaagacgtaatggagcgagcagaaaccagggaggacaatgggcatgtgattgatataacaactgaaccttcttcttcctctacctcaacacaagatagacaagtgaacaggtcaaacgcacagcagaatgaaaacctcccttcaaccagtgtaagcgatcctgtttttcagcattctttctctactaccaatgtgacaaatccaagaaatacaccatttgctaggagggcaaatgggacaaatggtcgtcgtaggagttcattgaattctggatattggatatgttttgaaatggttataacaatgagccaaataatagcagccattgtggttctgtccatgt

SEQ ID NO: 12953 - DNA, 915 bp, Lactuca sativa
  Predicted polypeptide sequence is orthologous to G1108, G2394
cggggacgatttcctgtatcctaacaaaattgatgcgatattgaagatttcgatgatggataagtatagttttagttcgatttttctagcttcgttgctgaatatgattaaattgatggcttaaaatcgaagccgtgatgtttgttcagctgaattcaagttgcgtgtgtctgtgttttaccctttcatgaaatttatcatcgaaggagaaggtataacattctatccagcttacatattgcaggaatcgtgaaggagactaaagcatctgttcttgataacgccaattatgcgattgtttcctccctaactttcaccaaactagaatggctgtaactgtaacccccgaagaacagaacatagaccatgcaacagacagtttccccttgctcatcgagagccgagtacaccatgaaaatgaacatataatcgatttggaaagaggtgatgatgatgatgatgatgatgcttcttcctcatcaaacgcatcaactaattctctttctcatggcttatcaaacagccctagagcttccacttctcaactgattcgatcatcatccagtggttcaacttcaaatggagttggaaggagaggagaagggtttgggaggcgaagatggagcccattcgacacactgctatggatttcaatcgaattagtgttcactttggggcaaatcattgcatccattgttgtcttatgtatatcacaaaaggagaacccacagactccattgtttgcttggattgtggggtatgcagctggatgttttgcaagtcttccatttttatactggcgatatctccatagaaatcaatctactgaaccagggtcaagtcaagctagacaaccaccttctgaagctaaccatacaccagaaacaaattcttatatcacaatctcctttgctc

SEQ ID NO: 12954 - DNA, 740 bp, Lactuca sativa
  Predicted polypeptide sequence is orthologous to G1129
tgtgacgagttattctcaccattaatggcggatcaaagaatcatgcagttgcagaagaactcaagttcagtcttgttgtcacccaagaaaagaaaaacccatgagaatcagaagaactttcaggtggtttcagaagtgaatggcatcaaagagaagaagttaaaagggtgttcagaagaaaactcttcagaaacttcatcaaaagaaaaatcaaagcctacagaagctcaaaaacaagattatattcatgttcgagctcgtcgagggcaagctactgatagccatagtttagccgaaagagtaagaagggagaaaatcagtgaaagaatgaagtatttgcaagatttagtacctggatgcaacaagatcactggaaaagctggaatgcttgatgaaatcatcaattatgttcaatctcttcaaaaacaagtagaattcttgtccatgaagctttctacagttcatccaagactagacttagacgttgataacttaatcatgaaagagatgtttgaagtttcaacagctggatatacctcagagatggctaattccccatattttcaattgaactcgttgcttgaaatggggattaacccaattgacatggtgttaagaagaagcattagtggtggtgctccagtttcgatccctgaaacattcgtggtttcatcatgttttaaatcaatccatcccgatgtggcatgggatagtgatctacagaatctatacagaatgga

SEQ ID NO: 12955 - DNA, 931 bp, Lactuca sativa
  Predicted polypeptide sequence is orthologous to G1134, G2555
cggcgggggttgcagagcatttactcctgtgaagcggtgacgtagcagttgtttcctccaatccacctcttttcactcatcttttttatcgtaaataaattaaaaatctgtagtagcaagataaacacgagttgcttaaccaaaaggtaatccaacagaggagtaaagatgcaaccgacaggcagtggcggtggtggaggactatccagattccggtcagctccggcgacatggctggaagcactgctagaatcagaagaagaagatgtaatcattgacccaccaaaaccacctccacatcagcaagcttccattgcaggcacccccaccccctccagacctacttacgttgatcccaatatcttcttacctagccgacagaacagctctcccgccgaattcttttctgagatcaacaatcctgatgcctatctctccaattacgacgactacctctcatcgtcctaccacaacgttaaaccatccagggctgtcgatgtagacgaccaacaacccaagttcaccacacagctcagcggagatcagagcgcgttgttggatgttgagatggataagcttctgggggattcggtgccgtgtcgagtacgagcaaagcgcggatgtgccactcatcctcggagtatcgccgagagggttagaaggactcggattagtgacagaataaggaagctccaagaactggttccgaatatggataagcaaaccaatacggcagacatgctagaagaggcggttgaatatgtcaagtttctgcaaagacagattcaggaactaaaggagcaccgagacaaatgcacatgtgtggttgacgattgataacagaaaagaagctaacctttttttgatcgtggttcaagggatcataatggaggactatggtgcttatccaaaatctcagatcaaatatatt

SEQ ID NO: 12956 - DNA, 697 bp, Lactuca sativa
  Predicted polypeptide sequence is orthologous to G1146
gatggagtgagcgaggggcagttctatcaagttttactttatgagcttgatgcgattcgaaaggcatgtgcatcgttggagccagattatcagcctccagtgacatttgtggtggttcaaaaacgtcatcacacgcgattgtttgctaacaaccatcgtgaccgcaatgctaccgacaggagtgggaatatactgccaggcaccgttgtcgactccaagatatgtcatccaaccgagtttgatttctatctatgcagccatgctgggattcaagggacaagccgtccggcccattaccatgtgctgcgggatgagaacaagttcgcagctgatgctttgcaatcactcacaaacaatctctgttacacgtatgcaaggtgcactcgttctgtgtccattgtgccacctgcatactatgctcatctggctgccttccgtgcacggttctatatggagccagacacatctgacagtggctccatgacaagcggccgtggtgcagggacaaggagcacccgtgtgccaggggcaaatgttgctgcggtcagacccctacctgctctcaaggagaatgtcaagcgggttatgttctactgctagaataccctaccctacccttccatttcatgtatgtttttgtgtctactactactactactacctttgtgctggataaattacaacacactatgtgtgt

SEQ ID NO: 12957 - DNA, 905 bp, Lactuca sativa
  Predicted polypeptide sequence is orthologous to G1146
cgggggacatgatgaacaaaaaaatggttaatggtggaacagtcgccagctggatttgcataaatttcgcacgaaatgttcaagataatattgctaaagctttctgtcaagagcttgcacagatgtgcaatacctctggcatggcatttaatcctgaacccgtgcttcctgcatttactggtcgtcctgatcaggttgaaagagtcctgaaagctcgtttccatgatgcaatgactaaacttcaaccccacaaaaaagaacttgatttgcttgttgtcattctcccagataacaatggctcactttatggtgatttgaagaggatctgcgagactgatcttgggattgtttcacaatgctgtctaacaaagcatgtgttcaggatgagtaaacagtaccttgcaaatgtagccttaaagatcaatgtgaaagttggaggaaggaatactgttcttgctgatgcattgtcaagaagaatccctaatgtcagtgatgtcccaacaatcatatttggtgctgatgtcactcaccctcaccctggagaagattccagcccctcaattgctgctgttgttgcttctcaagattggcctgagattacaaagtatgcgggattagtctgtgctcaagctcatcgccaagaactgattcaagatctgttcaaggaatggcaggatcctaatagaggcaaagtctctggtggcatgatcaaggagcttctcatatccttcagaagagcaactggccaaaaaccacagcgcatcatcttctatagagatggtgtgagtgaagggcagttttatcaagtgcttctttatgagcttgatgcaatccgaaaagcgtgtgcatcattggagccaaactatcagcctccagtgacattttgtgtggttcaaaaacgtcat

SEQ ID NO: 12958 - DNA, 772 bp, Lactuca sativa
  Predicted polypeptide sequence is orthologous to G1190
agagatcacttctcttctcagttctcaccaatcacaacacccaccacccccaactttctctctccttcagtgagatttgtcaccatttttgttggattttgttcctgaaaccactgaatcccgtggtttcgtatgcttcactaatctgtcccaaaaagataggaaattctccacattacacgagatagtaggtgtgaaagatttcttagaagaagggaaaaatgaagctaaaagatgatgataagccctataggccaaatgataaaagttcaagggttgtaccaatggggataatgttcattgtattgtgtggattttcgttctatcttggtgggatcttttgttctgaaaagaactcatttgtcactgaagaagttgtgaaatcggttgaatctcccaaaaagactgtttctactccaattcaagtgaaatcggtttcgttttctcaatgtagtgctgatttacaagactacacaccttgcacggatcctaagagatggaataaatacggacgtcacaggcttacattcatggagcgacactgtccaccagctttcgacaggaaagaatgccttgtgccaccacctgatggctacaaggagcccataagatggccgaagagcaaaaacgaatgttggtacaggaacgtcccatatgattggatcaacaaacagaagtctaaccagcattggttaaggaaagagggggagaaattctacttccctggaggtgggactatgttccctaatggcgtcagtgcttatgttgattt

SEQ ID NO: 12959 - DNA, 824 bp, Lactuca sativa
  misc_feature (714)..(714): n is a, c, g, or t
  Predicted polypeptide sequence is orthologous to G1190
tgcttgatcgtggcattctaacggtgtctcttgctccgagagataaccatgaagctcaagttcagttcgcgttagaacgtgggattccggcgattcttggaattatatcaacacaacgtctcccattcccatcaaattcattcgacatggctcattgctcaagatgcctcataccatgggcagaattcggtgggatttaccttcttgaagtacacaggatcctgcgtccgggaggattttgggtgctctcgggtccacccataaactacaaacgtcggtggagaggttggaacacgacgattgaagatcaaaagtccgattatgacaagttggaagaacttctgacttcgatgtgctttaaattgtacaacaaaaaagacgatattgctgtttggcagaaaaccaccaataacgattgctacaaacagctcgatgctcccgataactatccaccaaaatgcgacgacgggactgagcctgattccgcctggtacaccccgttgaggccgtgtgtggtggtgccgaaccctaatttgaagaaattggggttgggatcgatctcaaattggccggagcgattgcacgaggctccggatcggatcggtgatgttcgtggtagcagcgccggagacttcaatcgggatgataagaaatggaagaatagagtgaagcattacaaaacgttgcttccggttcttggaactgataaaatancgaacgtgatggacatgaacacgcgatatggaggttttgccgccagtttgattgatgatccgcttttggtcatgaacgtggtgtcgtcttatgctcccaatacacttccg

SEQ ID NO: 12960 - DNA, 686 bp, Lactuca sativa
  Predicted polypeptide sequence is orthologous to G1242
gaggctagaatttctcgtaaagatgaaataatgaaagcaattggaaagaaattagaccgttacaaaaatccttggctggagctcaaaatccaatacggtcagaacaaaggcaagctctacaatgaggaatgtgatcggttcatgatttgcatggttcacaaacttgggtatggaaactgggacgaattgaaggctgcatttagaacatcacctttgttcagatttgattggtttgttaagtcacgaaccactcaagaacttgcaaggagatgtgatactctcattcgattggtggagagggaaaatcaagagtatgatgagagagagagacaggctcgtaaagaaaagaaactttccaagaactcaacgccatcaaagcgggccatagcaaggcaaacagagagtccaccttctactataaagaagcgaaagcaatcatcaatggatgactatgttaactcgggaaagaagggcaaatgaaaatgaggtgcttactaatattttgatttttgagacattggaggcattgatgtagtcgtaatagtaatagtagaatgactgtatgtatatgaatcggcatttatagtagccattgccatttgtctctattctcttagttttgtgtctgaattccaaatagtgtttctggatgtttggcttctatatcaaccaactctctctaatca

SEQ ID NO: 12961 - DNA, 668 bp, Lactuca sativa
  Predicted polypeptide sequence is orthologous to G1246
tatgcattggataatctaccggtgtaataagagaggagttgtactttgtgcttaaagtgttggacgttgtgcagtttctggtgtacataggttgacttatatccaaatcaccggctatcaactgccaagataacaagatcttgaaattccggttgcttttttatatatatatatatttaatatatattgctgttgtgaatatgattgctgctgctgctgatgatgatgatgatgatgatgatgatagagctcgagagcacgatatgcaaaggcatagacgtgtggaaatttttgactgctttaggtagcctacaaaagacccgaaaaagcaagcaatttcctaggattgtgaatctgaagatttactataattctctttaattagtctttggaataataatacgtagttttgtgcttgtttttaaggtttttaacgtaaatcttatttgttaggatatatggtcgtagtgtgcatagtaattgagtattattgcttaatgaaagatcaaacatgttttatatgttttcatcgttgaaatcgatgaagtgaacgattcaatattctaaatgagagtaccgattgaatcttgtgaatgggggaaagtgaagatttcatctttttccatgtaaccaacatttgtttgaaaaaaaatcatgttttccaaaaa

SEQ ID NO: 12962 - DNA, 699 bp, Lactuca sativa
  misc_feature (632)..(632): n is a, c, g, or t
  Predicted polypeptide sequence is orthologous to G1255
cgagatggtattgtgctgctgatgacgctttcctttgccaaagttgtgatgcctcagtacactcggctaatcagttggctggtcggcatgagagggtccttctcgagactgcttcctctaagctctttgggtcaggcatagcttcgcctgaaccaacctggcaccaaggtctcacccgtcgtgctcgcaccccacgactccggactaaatcctctctcaaactagatagaaagagcgatttagtgaactcttctgctcccttagttccggaaataggcgttttagacccatcatcacttgatgaagaagaagaggaagaagaactattgtatcgtgtgcctgtctttgatccttttgaaactgaattatttaatacttctgatgaaataggcaggagcttgacttttgtagtggaaaacaaacaagaagagacatgtgatttggatgatcttcaagggtttgatctgccaactgatgatatggagctactggaatttgctgccgatgttgaaagcttattagggaagggttatgatgatacatcgtgtaggattgaagaattggggttaactaattatgattttaaggatgaagataatactaacattattataggaacttgcttcgacganaatagggtgaagttgaagatgatgaaagagaagcattttaggttttgatttggatacaactagggaa

SEQ ID NO: 12963 - DNA, 916 bp, Lactuca sativa
  Predicted polypeptide sequence is orthologous to G1272
tttattttgggctcttctcctccttgttgcctctgcgtggccggaccacgccttctcgtgtgcacatccatatttctcaacatgggttctcccgtgagtttcagcatccacaactgcatccagagaaaggaaatggtgatgcattgtccaccatctctccactctgtcgccatgaagtatgttgttcccatgaacgcagagcctgcacaataagaaggtgatgagggtgcccatggagaggcgtgttctggccaccagaggcaacaaagatcaactgttgacccaccatttcaaagtccacgtctctaatgttgatggacacttcttccaacacatgccgcgcttatttatgaggatggacgcccaatagatgggaaaggcattggaagaaaagtgcttgatagagtccacgaaacatatggttctgaattagcaggaaaggagtttgcttatgatggtgaaaaaagtttgtttactgttggagctcttccaaggaacaaacttgaattcactgttgttcttgaaaatgtcacttcaaaccgtaacaatggaaatgcaagccctggaagccctgacaatgacaagaagagaatcaggcgttcgtatcaaccaaagactttcaaagtggagctgagttttgcagccaaaatcccaatgcaggcaattgcacaggctctcagaggacaggaatctgaaaactccatggaagccttgagggtgcttgatatcatcttaagacaacatgcagctaaacaaggctgtctacttgttcgccaatcttttttccacaacgatgtgaagatttttgctgatgtcggaggtggcgttctcggatgcagaggattccattccagtttccgcacatccccaggtggtctatccctcaacattgatgtgtctactaccatgatcatcc

SEQ ID NO: 12964 - DNA, 740 bp, Lactuca sativa
  Predicted polypeptide sequence is orthologous to G1361
attcggccattatggccgcttgacgggggcgaaacaaggtggcacaaaacaggaaagactaggccagtcttaatttcgggttcagttgaagggtacaaaaagatactcgtgctttatacaaattatggagggggaaagaaaccagagaaaacgaattgggtgatgcaccaataccaccttggtaacaatgaggaagagaaagatggtgagatagttctctcaaaagtgttctatcaaacacaaccaaggaattgtgcgtcgaacctcaaggagtccacgttacttgatgagaaaactgaaagaaaccctaacgttaggaacatgagcttcattgaaaactatagcatttcacctttcataccatatgacattaatcgaaggcaactcagtagggaaattccttctcacgtcatccctagttttgttctacaagatgatacatcaccttttattcatctaccaagtggatcaagcaaagaataagatattataggtaaaaaaaaaaaagatatattgattctttcctagtatccgaaaggttaacttttgaaattctcataaggacctcatttattttgggggttcaaatttcaagttcagaagaatgtgtaaattttactacatgagttataatattgtagtcattttggattacgagagagacaataatatggttcccttaataatagggtttatataactttggttttacgagtttatataatttaaattaatattgg

SEQ ID NO: 12965 - DNA, 769 bp, Lactuca sativa
  Predicted polypeptide sequence is orthologous to G1380
ttcgtcggctccctcaggagagagagagagagagaaacaaaagataaggtagaagagagagaaaccgatcggaaaatcaagaaaccttgaaaaaccgacgaagttacggaatgatttctgatttcaatcaaaggaggtggtgattacgataaccctccggaaaaaaaaattcgcgatcagagaaaagatacgatcagcatctccgatcctgtttgatccaccggaaaaatggtcatgcgacgaggcagcagagcgaaggccgccgtcggagaaccgatcggatcgagaccggaagagatggtggctcagcaaccggagaccaacgagccacggtatcgtggtgttcgaaagagaccatggggtcgattcgccgccgagatccgtgacccatggaagaaagctcgtgtctggttaggcactttcgattccgccgaagacgctgcacgagcctacgacgccgccgcacgctccctccgtggctcaaaagccaaaaccaattttccattttttccgtcgaacgaaatccacgatcatcccgaagatgatcaaacaaaacaccaccaacaaaccttctatcagtctcggccgacgatgagtagtctgagcagcaccgtcgagtcgacgagcggtccacggccgtcgaatcccgttaaaacccaccaccgattaaaaccgccgccggttccccaagacgatgacgattgccacagcaattgcgactcctcctccctcgtggtcgacgattattattacgacggcgatctgtctt

SEQ ID NO: 12966 - DNA, 846 bp, Lactuca sativa
  Predicted polypeptide sequence is orthologous to G1382
cggggaccattttccgcctggatgaccaacattctcctcactctcactcctccaccaccgccacctccaatgtcgatgttaccggtcatcgcagacagggaggaggagatgttttcggactcagatccgccggtgccggtggtggtgctaaatacaagctaatgtcaccagctaaactccctatctcaaggtctaactccatcaacgtccctcctggtctcagccctacctccttccttgaatcgcctgtcctcctgactaacatgaaggccgaaccttctcctaccacaggttctttctttaattcctcactgatgcaaaggtcaatcaccactgctgcattctctttagatgcaaattgttcttcaagaaagcccttggatgatagtaactctggtttctttgagtttaaaccacacacccaaattacatcagttccacaaagttcttctgcaggatatcaggtttctacaggttcaaatcttcaaagaggagaaccaagtgggcaatatcaaaaccaaagtgagcctcaatcatacgcatctgcatcttcatctgcttacatgtctcatgaggaaacaaacggattggggaagcataaagatgcgggacccacgatccaagttgacaggtcatcagatgatggatacaattggagaaaatacggacagaaagttgtgaaaggaagtgaacatccaagaagctattacaaatgtacacatccaaattgtgaagtgaaaaagatttttgaaagatcttatactggacaaataactgagattgtgtataaagggacacatgatcatcctaaaccccaacctagtcgccgatttagtgctggtgctc

SEQ ID NO: 12967 - DNA, 412 bp, Lactuca sativa
  Predicted polypeptide sequence is orthologous to G1451
aggtgagggtagatgtttggtgtgtgtgtgttttgtaggtttataaatcggggtgtgtagggaggtcattggacatgagccgattcaacagctaccatgagctgcgtgaggaattgggtgaaatgtttgggatcgagggtttgcttgaagaccctcaaagatcaggctggcagcttgtattcgttgacagggagaatgatgttcttctccttggagacgacccttgggaggcatttgtaaatagtgtctggtatatcaagatactatctcctgaggatgtgcaacaactcgggaagcaagaagtggaatctttaggaggaggccaaaactcgggtgaaagaatccacagagaccatctgtctctttcgggacttcctccatcgatggggtccgggtcacttgatttttgacc

SEQ ID NO: 12968 - DNA, 734 bp, Lactuca sativa
  misc_feature (103)..(105): n is a, c, g, or t
  misc_feature (269)..(271): n is a, c, g, or t
  misc_feature (438)..(440): n is a, c, g, or t
  misc_feature (517)..(517): n is a, c, g, or t
  misc_feature (611)..(614): n is a, c, g, or t
  Predicted polypeptide sequence is orthologous to G1451
tcgttattattcggttcttgatcgatggagcactctcgacccggaaacggaggtaaagaaaccgcggtttgtgaaaggtttgtgttttgggcgagacccgtannnggtgggccgagttgctcgacttggtgaagaagagattgtgaagctccagatacaagtaacgggtcaaccgcgacccgtttcgcgggccaacccgtggaagtcaacaaggaagcagagcgagggatgttaagaagttgtgaagtttcatcgtgtgaaaacgggcnnnaaaggtttccgtttgaatccgagaagtttgactgagaagttgacccgaattgacccattgtgaatgggttttggggttgaagttgggggagaagtgacacgtgttggttttcaggaatgaaagcgggttgactcattgacccggttggaatcggttggtgttggaannntagaagtgatgggtttgactgtttgaccgaatcaatactcctcatttcttggagggcggccgccgccatggcttggntagatatccgtggtggtttgcataccgagcatgccaatgccaccaccaccgccgccatcaaaccgtggctgcaaccacggcgaacccccgagtnnnntaaagttgagagattgaccaagatcaccgccaccaccaccgccaccaccaccacgaagccacattatcggcgagtatcaatggccactcttctttcatcctctctcgtcttctcaatctc

SEQ ID NO: 12969 - DNA, 923 bp, Lactuca sativa
  Predicted polypeptide sequence is orthologous to G1451
cttctgatccatttttcctccattatcacttccacttctctctactctactctctgcttcaggtcgactatggtcggtcggatcgggatccaatatccaccccctatataaccccttccatgctccactctctctcctttcttttcactatttttttcaactttttcgatagcgatcggggacaaaagttcactcatggcgatgtttcagaacaaccactggttttctgagctcggttagttagggttttgctttttagctatgggaggggggatttttagctttggaataatgcatgtgaaggttaggtgttttagactttggaggaagcgattgagctgataattaaaaggagtgaatgttgattcagcagtttttaggggtttaggattcgacgatcgttaagccccgagaagctgctgcactgaggattcgtttagctcatgcttatgaaattagttaattaatagtaatacacatatttatataataaggtaagatttagataaaataatatgaagctttcaacatcagggtctggtcagcagcctcaagaaggagaaaagaaaagcttgaattcggagctatggcatgcttgtgcaggcccgcttgtttccctaccgacagtaggctcccgtgtaatttatttccctcagggtcatagtgaacaggttgctgcaactacaaataaagaaatcgattctcacattcccaactacccaagccttcctcctcaattgatctgccaactccacaatgtcacaatgcatgcagatgttgagacagatgaagtgtatgctcaaatgacattgcagccattgacaccccaagagcagaaggatacatttcttcccctgtgagtgggtattccagtagacaacaactaattacttctgcaagacattaacagctagtgacacaag

SEQ ID NO: 12970 - DNA, 717 bp, Lactuca sativa
  misc_feature (705)..(705): n is a, c, g, or t
  Predicted polypeptide sequence is orthologous to G1451
ggcgggcaggatcttctgagctgctgcatgcgacgacaggagcacaaattgacccatcaaaccctaatcgtacgtttgtcaaggtatacaaatcaggttcggtggggaggtcactggacatcagccggtttcacagctacccagagctgaaggaggaactggaacagatgttcaatgttgaggggctgcttcaagaccctcaaagatcaggctggcagcttgtattcgttgacagggagaatgatgttcttctccttggagacggaccctgggaggcatttgtaaatagtgtgtggtatatcaagatactttctcctgaagacgtgttgaaacttgggaagcaagagttggagtccttcactcaaaactcaggaggagaaagaattgggaatgatgggcatgggcatggacatggggggagagagctttctggattgcctccttccatgggttcgcatgatttttgagaaaaaaacccaaacccaaaaccaagactttgtatttgtcgtcttctatttgatgcgctctctctactctactctactctactttatgtttatgaagattgacactcctatttatttattttctaggtcggttgttattagttttgtgtatcctggttggttatttagtaaaatgtttagacaagacaagactctactattattgtgattccaaggaaactttatcaaatcatcaatncatcatcaatgt

SEQ ID NO: 12971 - DNA, 898 bp, Lactuca sativa
  Predicted polypeptide sequence is orthologous to G1451
cattcggccgggggcagaattctcattggagatctgtaaaggttggatgggatgaatcaactgcaggtgagaggcagccacgtgtctcattatgggaaattgaaccactaactacttttcccatgtatccatcactttttccacttcgcctaaaacgcccctggtatcccggagcttcatcttttcaagatagtagagatgatggggttaatgggatgacatggctgagaggggaaccaggggaacaaggattgaattctctaaacttccaatctgttggcatgtttccatggatgcaacaaagggtagatccgtcttttcttcaaagtaatctgaatcagcaataccaagctgcattagctgcaggtttacagaatcttggaagtggagatgctttgaagcaacaaatactccaattccaacaacaacagcaacagcaacaacaacaaatccagtatagtccttcaggcacttctaatccacttttccaacaatcacaacaactaatccctcaacaattcgtccatggtcaaacccaaatccaacaagtcaacactcaaccagaagaacacccacaaccacaacaacaacaacagagttcgtatccggaatcttacttgcttcaacaccatgagaggccacaatcccatgcttttatggacccgaataccaaatttgcccctccttcaatgcaaaacatgttgggttctttaataacatctgaaggaagtgggaatcttttgagtttttctagggcggggcccactttgactgagcagcatccatcgaaccagaaccaaaaccaacagtcttgggtttcgaggtttgctcagtcacaaccgaatttgtcgtcttcttcacctgctccatcattgtcatatcaagagaagaatgttga

SEQ ID NO: 12972 - DNA, 937 bp, Lactuca sativa
  misc_feature (821)..(821): n is a, c, g, or t
  misc_feature (845)..(845): n is a, c, g, or t
  misc_feature (871)..(871): n is a, c, g, or t
  Predicted polypeptide sequence is orthologous to G1480
gcggggaagaactggacatggctgcgaccctttgtgattcctgcaaacaacgtcggcagctttgttctgtagagcagactccgccttcctctgtataccatgcgacggcaaggtccacgcggcgaacaagctcgcgtctcgccacgcgcgtgtgtggatgtgtgatgtttgtgagcgagctccggcgagcttcacctgtaaggcggacgctgccaccctctgtgttacctgtgaccgcgaaatccactcagcaaaccccctcgcccgccgtcacgagcggtttccggtggtgccattttatgatcctgcaactgccgtgtcgaaggtaggtggtggaggtgataatgataatgataacaacgaccaccatttcctattggattttgatgttaacgtcgccggaactgaagctgaagaagcggaagctgcttcgtggcttatcccagatccaaatataaacaaaatcgttgatggatctgaggatgataataaatcggagtacttgtttaacgagatcgatccataccttgatatagatctgaaaacgccggatcaaaaggctaatcagatcattcgcagatacaattccccaaccgatggagttgttccggtgcaaaacaagatcgaaaatcgccattaccagatgccaccacatgcacatgcttcttctccagatgtagtggagggattacctgcatatgacgtcgattacaccggatctaagcctttcatgtacaacttcacctctcaatccgtcagccaaagcgtatcatcatcttcactggaaatcgaagtaggcgtcgtaccggaccacaacgcanacgcaaccatggcggatgtatcanacaaccaccaccacccatcattaccnggagtatatccgactcctgtgtcgggtttcgatcgtgaagcccaggttttaagatacaagaaaaga

SEQ ID NO: 12973 - DNA, 883 bp, Lactuca sativa
  misc_feature (851)..(851): n is a, c, g, or t
  Predicted polypeptide sequence is orthologous to G1480
ctccggcttcctgttgatcaatgcaataaaagattccacagagagcaaaactgttcaacacttcaactaccaaaattcgaagaacatatatatcatgaggatgcagttggaaaccggtggtggcctcaagtgttttccggcgggctggaacgcgccggcgaagccgtgtgattcgtgtaagaccgccgtggcgttgctgttctgccgtaaggacaccgtgttcttgtgtcttgcgtgtgatgtgaagatgcatggcgacgtatgacacgaacgtgtgtggatgtgtgaggtgtgtgaacaggcgccggcgagtgtgacgtgtaaagcggacgccgccgcgctatgtgtgacgtgcgacagagatatacattcggctaatccgctttctcgccgacatgaccgggttccggtggttccgttttatgattgtgctgatatcctgatgaagtcctccgcctgtaacttcctcgaacttagctccgggaacgggaatgatgatatgaacagttctgtaacaaacgacgacgatattaattggggaattccggcggatacaatcaatatcgatgttaaatttcctagcgacgatagttctccggtggatatcaaatcaatcgaaatgttatttccggaatccgatcacctccttgatttcgatttccctgttccaacggacacaaaattccacagccacttccataatcatgattcagtgaacgacagtgtagttccgttccacgtgtcgccgccggcgaagcattttccaccgccaccggaaaatcaaaatcgatacgagattgatttcaccagatctaatatcaattcccttcacaaaaacagttatctctctncatcgctcagccatagtgtaaacatctaatcc

SEQ ID NO: 12974 - DNA, 724 bp, Lactuca sativa
  Predicted polypeptide sequence is orthologous to G1493
gaataagacatggggcatgtgattacttaatcaagcctatacgtgaagaacaactaaagaacatatggcaacatgttataagaaaaaaatggaatgaaaataaagaacatgaaaattcagggagcatggagcacaaaagaggaggaggaggaggtgatgataatcatgatagtgagtatggttcttctgttaatgaaggaggagaaaatgggttgctgacgtgtcataaaaaaagaagaagtattaaagaagaagatgattgtgaacttgaaagtgatgatccatctgcttcaaaaaaagccacgtgttgtttggtctgtggagttgcatcagcaattcgttagtgctgtgaatcaacttggaattgacaaggctgttccaaagagaattcttgaattgatgaatgttccaggtttgactagagaaaacgttgcaagtcatttgcagaagtttagattatacttaaagagattaagtggtgtgggaggtcaacaaggagggggtcaaaattcattttgtgggcccattgaacaaaataaaaaactaggtttatacggaagattcgagatccaagcactggcggcttccggccaaatcccgccggagacactggcggcacttcacgctgaactttttgggcggccaaccggaaatgtcaacttgccgctagttgaccaccaaccgatattacaatcatctaattacggtcaacccctcccatcaa

SEQ ID NO: 12975 - DNA, 893 bp, Lactuca sativa
  Predicted polypeptide sequence is orthologous to G1504
cggcgggggactctctgttttcaaagcttttaacttcttatggatatctgccagaatatccccgtttccggtggacttccgaccaactatccgcctgagcaacaccttatttgcagccttgacgagcttctttccggtcattccatggaagaagatgatgttaacatggaatggctgtcaatttttgtggaggattgtttatctagcagtgggagttgtatgccaccagcagcaaaaccccaaagtacaacttccactgcagaaggtacaaacacatcagcagaacctcaacctaaggtgaacgaaacttattccatttccacgcataaaatacttgtaccttgcaaggcaagaagcaagaggaagagaagccaaacatgctggtctcagcagtaccttaactcccttcaaccgccttgttggttagctgagagtgagctgatgattttccctaagaaatgtacaagtcctaacagcagaggttccgggcaggaggaagggagcagcgggcaggggcaaggaaggaaatgcacacattgtctctcacaaagaaccccgcaatggagggcaggaccacttggaccaaaaacactgtgtaatgcattggggtgaggtacaagtcgggcaggctgctgcccgaatataggccagccaagagtcctacttttgtgagcgataaacattctaattctcataggaaagtgttggagatgagaatgtcttttttgccctccccctctaccaattcatcttcttcttcctagtgagagtgagggcttagttgtaattttccatcttaacccatcatgtagaaatcaatgaagatggatagttttgctaaaacttaattttaattaattagtagttactagttagtaataatatacaaatga

SEQ ID NO: 12976 - DNA, 905 bp, Lactuca sativa
  misc_feature (717)..(717): n is a, c, g, or t
  Predicted polypeptide sequence is orthologous to G1504
ttaacctatctttcccattgcttacgtcttttctaccaaaaacgtctctgagccttttgcgatgagatatagtgattcgcctcgcagtcacaggataagagaatgtgcaagaccgaatctgcgttttgtgctgtgagcgttgattataatcaatgtcaacattatcgagtgtacgatgaggattgttttggtgacattctaaacatgtttgatttcccgatggagggtttggaaggcgatggatttgcagaggattgggcctctaaactcggccctataccttctgaagtcttcaaagaactcggtgtcagcaatacattcgtcccttccacagatttgccctttgagtatcccgtgcttaataatagagctttgcattctcaaccaaaagaagcctttgaagcaccaagccctaattcagtcctggaaaatcggtcttccagctcaaacagtaaacccatctccttaggaatcgagcattccattccggttagatctcgaagcaaacgattccgacccacctccaatccatggttgctgtcacctctgatatccaaagaaaagaagagaaaaacagcatccgagattccggttttcataaaaagatcgaatgtcacgggaaacggaatcaagaaatgtgctcattgtgagataacaaaaaccccacaatggagggagggaccaatgggccccaaaacactttgcaatgcgtgtggngtccggtatcggtccggtcgcctcttcccggagtaccgccctgctgccagtccgacatttgttccggcactgcactccaattctcacagggaggtgatagagatgaggaataagactgttgagtaagagtgtaacagaagcatatcaaggttagaggctttttctgttttgctttttttttttttttt

SEQ ID NO: 12977 - DNA, 902 bp, Lactuca sativa
  Predicted polypeptide sequence is orthologous to G1512
tcggcgggggattctttgggtttgggacgatacccaaaaatcctctttttatcacacctacttcctcttatcgtaacttcgaatcgcgaatcaaaaatatctgcttcatacaagtttctcttctaaaggaattcagcgttaatggccttagaagaaacaccatttgattcttcaggaaacgtgtcactaaacaagaactcaaaaccagtttctgaaaactcaacaggattttgcgaatgcaatatatgtttagattctgcaagagaccctgtggttaccctatgtggccacctctactgttggccttgcatttacaaatggctccatgtccaagcaacatccactcttgaatccgataaacaacccaaatgccctgtttgtaaagctcacatctccaactcatctttagttccactctacggacgtggcaattccaatcccaatcccaattccaattccgattcaccatcatcggaattggaatcgaaaagcgaacaccaatcggagttagtcatacctagtagaccatcagcacctggcggggcgattttgcatctgaatcagcaaatcaatccccatccggtgccttttcagtcacagtcacagtttcagcctcagcagcatattgtgaatcactcacacccgtttggagggtatacgtttgggccatctaattttaatgggccaatgacacccactaccggcttttcaaacccgtttgtgggaatggttggggagatggtttgtgcaatgatattccggagttctgattccgggtttttggcggcttatccatatgggtcgtaccagaatccgtatccggcttcgggtaccacgagtccacgggttagaaggcaagtaatgcaggtggagaaatcggtgaaccgattaaccatcttttt

SEQ ID NO: 12978 - DNA, 802 bp, Lactuca sativa
  Predicted polypeptide sequence is orthologous to G1641
gcggggcttctattttttactacaactgcctttttcccctttcctaaacgatatgtcaagaacttccctgttttccaattttagaaatcatcccccaatttctgttatcagttcagacttcagatcatgttcaatgtttctagggttttcttgatgtttatcaatctaatttcgggaatatattgtggttaagtttcaaaaaggtgtgtcttttaaagattcctcaggtggttgggtggttgcccatagcaaacagaaaaaaaaaaaaaaactattctgattcctttaaaatgcgtcttgatttttaaccttctgttacataaccttcctacatttgctcccctgttttttctctactcctagttttctaatataaacttctaaaaatccgatcttgattgtttggggtgctttaattaagcttcaatgaagtgggaaacagatatcctttcgaattcgtcaagctggatgatggaagatagcttaaagagcagaatatggactcctcttgagaacagattgttcgagaatgcgcttgcaaagtttgataaagacacccctgatcggtggcagagggtggcggagatggtcccggggaagacggtggtggatgtgatgcgacagtataaggaattggaagatgacgtgagcagtattgaagcagggctatatcccaagtctccgccgtatggcggcggaggaaagaggtctccggtggatgtgatcgctgccggtcgccctgttgaacaagaaaggaaaagggagttccgtggacagaagaagagcacaaattgtttctatt

SEQ ID NO: 12979 - DNA, 609 bp, Lactuca sativa
  Predicted polypeptide sequence is orthologous to G1743
gaacacaacaaagaaaatcacagacccaaagaagacgtatcaaatatgttgatgaacttcatcttctacctctgtattctcttcccagtcttccgtatcaagcacgagttgctcagtttaatcaaggacttcttcttctacttgtttcgatgcgaaaactctactccatacccaagtcttgtcgatcttccggttatcaggttcgaagatctgctggaaaggcgacagagatccgtggaagagatgtgcttcgtatgctctgctgattaccatcttgatgacgttgtttgtcagctcagcaggtgtcgacacgtcttccactccgactgcgtcggtcaattgcttcaccggaaacagccctcttgcccgttctgccgctctccgattttctccggcctttcgccgacggcttgtaaaaccttttgaccgtagctaggttgtgtagaagaagataaagactccgaatcagtcccttgtcgttcttctacatttttgtaaagcgtgtgcttatcttgattgcatggtttaggatgattagttatagttacatttaacatttgatattgttggctgttttttactaaataattgtcattgaaaagttaactt

SEQ ID NO: 12980 - DNA, 748 bp, Lactuca sativa
  Predicted polypeptide sequence is orthologous to G1777
agcaccatgcacgtacactacttatacattatcgttgggatgttgagaagatatttgcagtgcttgtagagaagggaaaagatcgtttatttaaagaggctggcttacctatgcttcactctcatgaccttgatccttcagtgtctacttgtacaacaatgtgtgatatatgcatggaggacttgccatctagtgagcagacaaaaatggattgtggccactgcttttgtaacaattgttggacagagcatttcattgtaaaaataaacgagggacagagtaaacgtatccgatgcatggcccacaaatgctatgcaatatgtgacgaatccataatccggaatctagttggcaaaaggcatccggatttggtagaaaaattcgatcggtttcttctcgagtcatatatcgaggacaataagatggtgaaatggtgtccaagcactcctcattgtgggaatgcaatccgtgttgaagaagatgagttttgtgaagtggaatgttcatgtgggaatcaattctgtttcagttgcttatgtgaagcccattccccttgctcatgtgcaatgtgggcactctggactaaaaaatgtaaggatgaatcagaagcagttaattggattacagttcatacaaaaccatgtccaaagtgtcacaaaccagttgagaaaaacggtggctgcaatttagttagctgcatctgtggacaagccttttgctggctatgtggtggtgcacggggcgcgat

SEQ ID NO: 12981 - DNA, 420 bp, Lactuca sativa
  Predicted polypeptide sequence is orthologous to G1835
gaagacagaagtgatcaaatacccagcaaaagtaagaaagcattaatcaatgtctaggcatgccattaatgggggcagtcggcaaacggttgagtctgcaccaccaagactaattcgggtagagaggcggccaagcatggagaagaagttagctaccattaaagaagatgaatgcagcagtggtgatcagcttcaaaatttccatggaaatcgtgctgtagcatttgcatcttcttcctcgaagacccttaacactacaaaacactatgcttgtaattagtctagttgtttacgatcaataaggattttccattcgtacgtacgttctcaatcatggagtgaatgcatggtaaatatgtgataactcaaagcaactttgtaactgttgtttgaaaccttaaggacatgattaattatctc

SEQ ID NO: 12982 - DNA, 728 bp, Lactuca sativa
  Predicted polypeptide sequence is orthologous to G1835
aattagggtttaacgcgaaggtagttcagttccaaaatctacaagtgaaagtaactcatttgaattctaacctcaagagttaaaaaaaacaacaatggagggccaaacttacaatgaagagatcgattgtggaagtttctttgatcaaattgacgatttcatcgaattccctccagtcaacgacaccacactcaataattcaatagattgcaatgatttcgccgacatttggactaacaactccgacgaactccaagtctccgatcccatcttctccgatagtaatcccgcccccgccctttcagcagaactttccgttccgtatgaagatatcatccagcttgaatggctttcaaactttgtggaagactcgttttccggtgggggaatgacaatgaacaaagagaatattccggcgaagacaatgaacaaagagaatattccggcgaaaacagagccagtggtggtggcaaactaccacttccagatgtcaagtccggtctccgttctcgaaagcagtagcagctcctccagctcctcctcttgctccgggagtggcactggcgggatgatgatcccgctcagcccaactcaccggggcccgcagcgggcccgaagcaaacggtctcgacccgccaccttcaaccctcgtgccgccatcgaactcctttcccctccaaaccctgattccgattccgattccgattccaggttcgatggaatcggcg

SEQ ID NO: 12983 - DNA, 915 bp, Lactuca sativa
  misc_feature (804)..(804): n is a, c, g, or t
  Predicted polypeptide sequence is orthologous to G1880
cggcgggggagcaccaagtataccaacttaaccatctgtacagaataaaaaggattcttgaaagcttcggagcttcttgtaagacatattcagcaaaacccactacataaatctacccatatgttcgacaaccatctccaccaccatcacttcactgcaactcatggcccaggtccgggcccttcttcctcttccgatctcttctcttccccagataatggccttcctagcaaaaggaaaaggcgtcctgctggaaccccagatccagatgcggaagtggtgtccttgtctccgaagatcttacttgagtcagaccaatacgtgtgcgagatctgtaaccaaggcttccagagagatcagaatcttcagatgcatcggaggcgacacaaggtgccatggaagttgttgaaaagggattcaccggaggtgaagaaaagggttttcgtgtgccctgaacccagctgtttacaccatgacccttgccacgcgcttggagatctcgtcgggatcaaaaagcactttcggaggaaacacagcaataataagcagtgggtttgtgagaagtgctcaaagggttacgctgtacaatctgattataaagctcatcttaaaacatgtggaacaagaggccattcttgtgactgtggtcgagttttttccagagtcgagagtttcatcgagcaccaagatgcctgtactatccggcgaatccattcagacttgccaacatttcagccggcatgttcatctcgtacagcatcaagtacaagtccatcgaatgacaagattctcacctccattccnacaatggcaagatcacaccatcgtcaacctcctccgcagactgtattttcacatcccaagaagacatgcaaaacaactgggaactcagctccttccatcactatcactcta

SEQ ID NO: 12984 - DNA, 816 bp, Lactuca sativa
  Predicted polypeptide sequence is orthologous to G1927, G2184
tttagtatgagtaaatgaccattttacccttgttgcatttatggatgatatgctaacattttaagagctcatgaccagatggcaatggcatgagcactctgagctttgctcggggagttcaagaccaagctttttaagagcttctcttccggcatattatacatataatatatacatgtaatcgttagctgattacagaagttttttttttttattttttcgcgtgatttttctaggtgtattaatggaagaaaatcctgaattttacacaaatcaatgtcctgaaaatgatgtggataatggcaacggaacgggttcatggttctcaacagctttatggtcgtttgtggattcaataccaacaactccagcttctgcttcagaagggagtgctcttgtaaacaaggcatttgaaagaatgtctagctttagcaggggtagaaacgtaaatttagcagctgccgccgcttctgccgccaatgggtcggggttgaaaaggttagagaaaccgagtagtaggggtaggggtattgtatttttctctgttcttggagtattgtttgctatattatgggtgtttgtagggtcatctatggagttattgggtaggtgtatatggtaattaatagtgattatgggtagcttgcttgttggtaaaaatggcgatgttagctgtttgctaacgtgcaccggtccatgcggtgttgtttgctaacgtgcaccggtttgttcggtgttttagttaacacggtatgctacgagggtgtaatcatgtgggtctaatttgcaaataaatgtcatttttgtatgcaaaaa

SEQ ID NO: 12985 - DNA, 764 bp, Lactuca sativa
  Predicted polypeptide sequence is orthologous to G1928
atggcctgtgagccgggcacacacacacacatacacacacacagagtattgatgaacttgttttcttaacctgtacggattggatttttgtttttgttttggtaactcaatttgtacttgagcgtatggattcttgtgttggatcatcttggagagttggcttataactatatatctcggacaagaagaagtttggtaactgcctgccaggtccagacttttggcgtttgaattttagttgtatcttaacttatcttagattcgtcaagaacaaaaagctcttctaatgttttgtttcttatttaggcttaatttcttgtcattcagatccgtagaacatgggtttcaaagaagataaaagtatcatcagtcaatctttctgatatatcgagtcaaagcgaaagctaaaaggaatttttgtttaatccagttcatttaataacctagagagagagaggaaaaaaaaaaaaaaaaaagagagaggagagagatgaagggtatgtttttggatgacagtatgtcaaacttaacatcagcatcaaatgaagcaagcctatcttcatcaagtaacaagaatgaagttggtactatgtaccctccaccacagcagatgcaacagtcctccttagcttctgtgccaattaattccgacaatcaaacgcaaaccaacaagaaaaagagaaatcttccaggcaatccagacccagaggctgaggtgatagctatgtctcaaaaatcactgatgggcacaaacagatttgtat

SEQ ID NO: 12986 - DNA, 741 bp, Lactuca sativa
  Predicted polypeptide sequence is orthologous to G1948
gaagctgttggtggagtttggggcggatccggaggcgggagatgacaagggacggacaccgttagatttggcgcgtgaggttttaaaggcaacacctaaggggaacccagtgcaatttgctagaagattagggttagaaagtgtaattaggattttagagggggcaatatttgaatacgcggaagttgaggagattttagagaaaagagggaaaggtaataacgttgagtacttggtgaaatggaaagatggtgaagataacgagtggattaaagctgcattgatcgccgatgacttggttaaagattttgaagatggattggaatacgctgtggcggagcttgtggtgggaaagagggattccggcgaggaagggaaaaaggagtatttagtaaaatgggcagactttgaagaagcaacatgggaaccagaagaaaatgttgatcccgagttggtaaaggaatttgagagtgggaatgggaatgggaatgggggagtttgagacatggatttgattttgatggagcattgtatttttgaaattagaagaattaaaagattgttgaatattagttttagttgcaaggtaatgaaagttttggtgtttttttaatcaaaaaaaattagttttatagttccaactagccaaattttaatagcaccaagcaaaattttagtattaatggaatttaattgtagtggttataacttaatcaagtttctatgagttttcaactttct

SEQ ID NO: 12987 - DNA, 709 bp, Lactuca sativa
  Predicted polypeptide sequence is orthologous to G1950
ggccgacagaaatggagattgatccacaatatccagaacctgaagcagacaaaactgaaatcattaatgacgacgatctcttcagagccgccgacaacggcgacgtttcatttttcaaatccctctctcagccgcagctgttccgttgtctcgcgcttcgcaacgaagacggacgatcgctacttcatgtcgccgtttcttcagcccgcaccgaggtggtgaagatacttgcagcttttgatcactcaatcagtggcattaacagtgctgatgaagaaggttgggcaccacttcattctgcatcaagcagtggaaatgttgagatcgtcaagattttgctggatagaggagctgatgtaaacttgaaaaacaatggaggtcgcactgctcttcactatgctgcaagcaagggttggttaaaagtagctgaaattcttctttcaaatggcgcaaagatcaattcaaaagacaaggtagggtgcaccccattacaccgggctgcaagtacagggaagtcagagttatgtgagcttttgattgaagaaggtgcagatattgatgctgttgatagagcaggacaaactcctattatgagtgcagttatatgttataacaaagagatagctcttttactcatcagacatggtgcagatgttgatgttgaagataaggaaggatacactgttcttggtagcgcatcagatgaatt

SEQ ID NO: 12988 - DNA, 613 bp, Lactuca sativa
  Predicted polypeptide sequence is orthologous to G1950
ggttgttaataagctctttttatcttgcgaataattcttaaaggaatctaaatcatcaaaaggaaccgaaagagacttcatgctagcttttgctccatgaccgattaacagcatcgccacctgaacatgccctccctccaccgccctatgaagcggcgtgtacccactaccatccaccacatccacccgaccaccatgattcagcaataccttcaccccttcaaaacaacccttaaaagccgttttatgcaacgccgtccacccattctgatcccttccgttcaccttcgcaccttctgctaaacaattcttcattccattcacatctccttttcttgctgatcgatgtaaaacatctcccaaatgtaacatatcgtaaagatctgtatgctcgttttcaactgcaagatcgaatgcagtctttccttctttagttaccgcatatttcacataactgatacagtttagccggaattcaaccgcttctgaatgaccttccatagaacagcaatggagggcagtccagccgttgtgatcggctaaatcggggtcgcttcctagagtaatcaagaactcaagtactttcatatagccatgacatgcagcaacatga

SEQ ID NO: 12989 - DNA, 966 bp, Lactuca sativa
  Predicted polypeptide sequence is orthologous to G1958
ggatggggagttcaatttgctttcgctgctccgtacgtccccgttgcttacgacaatctttgtttgactcttcgcggaaatcaagaaagaactacttaacacagaaagttaagaaaaagtgaagctggttttatgaatggacaaaaatggacatacacccctgtatgcttaaaacaatctggtgaaaagcagctgaatgatcatatgggtgtttcaagagccatgtcatcttctaatccagttatccctggtttcgaaggaaaatacaaaaaaatatccgattccattataaacacaaacactttattccctgatcaaaaccaaatagtggtttcagctgacacaatgtcatcattccaaacatccaatttcgtaaattcacaatcaatgtcattaattggttacaccagtcaaaccgatgatatctcatggactgcagaatcacttaaagatctcattgacttcccggaaaatgtcgccggaaataatgtcgccggaagttctttgattccagccagcgaccatggtggtggaagggggacagatcggcagaactgggctgaccaattaatgagtgttgatgacacaattgacccaaattggaatgacatcatggctgatgttgatgtcccaacactagatacaacaaagcaaatgcaaataattcctaggcctcaagtgccaagtatagaagtgtgtcctgtgagtagtccatcatctaatggagcttcttcttcaattaaacctcgcatgcgttggactccagaactccatgaatcctttgttgaaagcagtaatcagcttggtggtagtgaaagagctacaccaaaaggagttttgaagctcatgaatattgaaaagttgactatttatcatgtgaaaaagccatctgcagaaatatagaacagccaggtacaagcagagttatctgaaggaacatcagacaaaaaggctacttctattgat

SEQ ID NO: 12990 - DNA, 303 bp, Lactuca sativa
  Predicted polypeptide sequence is orthologous to G1990
cacccattgttgaggtaatccgagcttactccatactctaaaaaacatttataaaactgacccaagaagaagaaagaagaagaagatttggatcatctactctacttgaattgaagtaggttttttcatgttcttcttcgtgttctctctcgtatgtaaagtgttgattttttttttctttgtaatttattacatgttggatgctatgcatttgtaaaaaactcaaggacagttggcgtgttttgattcgtcggtgtcacgtaaataaaattcaacaggaatattttttctgttttttagtac

SEQ ID NO: 12991 - DNA, 696 bp, Lactuca sativa
  Predicted polypeptide sequence is orthologous to G2010, G2347
gagtcagaagcatgaacgatatgttgaaaaatgagatgattgaatatggggaagaagaagaagaagaaggaggagaagaagaagatgatgatgagaacttcggagagggtagtaggaagaagaaggtaatgagaaagacgggttctggtagcggaggaggttccgtacaaccttgttgtcaggtggaaggttgcactgctgatatgagtaactgcaagacataccaccggcggcataaagtctgtgagcttcattccaaggctccagttgttataactggtggatatcaacagcggttttgtcagcaatgcagcaggttccatgacctaatagaatttgataatgccaagagaagttgtcgtaggcgtttagctgggcataatgagcgccgacgtaaaagctcctttgaaacttatggagacggttcctgatcatttaaggaaaagcggattgttagtccctcatcaactcctaataaaataagacttatataactatattgatggctatgatgctctctctcttctgtcattctgtaaactttattatcaagaagtgttgtagtataagtaaatatatatgaggaattcataaggtaattagtaaatgaattgtgatgttgtactagcaaatcatacgctatttatgataactttctaatgaaagtaaatatatgattctatatgctaataattt

SEQ ID NO: 12992 - DNA, 916 bp, Lactuca sativa
  Predicted polypeptide sequence is orthologous to G2035
atttgagaggtttttctttttcgatcatccatagatgattatggaatcatcatcatccaaatcactgcgattcatctcgcatcaatcgttcttctcatcagtccgatcaggcgaccttgaatcactgaaactgatcgtaaacgatgacgattccgactcagcttcctcttctactctaatggcgatgcagaatgacgccggcgagacggcgttgtacatcgccgccgagaacaacttccaggaagtgtttaattacttactcaagttctgtgatcttgaaacagtgaagattaggtctaaatcagatttcaacgcgtttcacatcgcagccaaactaggtcatttaggaatcgtgaacgaacttctgcggttatggccggagctctgtaaagtatgcgatacgagaaacacaagccctctgtattccgccgccgtgaatgaccatctcgacgtcgtgaacgccatgttagatgccgacgccacctgcatcagaatagttcggaaaaacggaaaaaccgcattacacacagtagctcgatatggcaaaacaaacatggtaaaaacattaatcgaaagagatcgagatatcgtttctatcaaagacaaaaaaggtcaaactgcacttcacatggcggtcaaaggccaggacaccaccgtggtggaagatctactcctcgctgatcactccattctcaacgaacgtgacaagatgggtaataccgccatccatatagccactagaaaatgccgatctcagatcgtgagcttactgctgagcttcacaacaatcagtgtaaatgtgatcaataatcaacgagaaactgcgatggatatagcggataaactaaactacgggccctcaaagttagaaatcatggaagcattaagcgaagcaggagcgaaacacgctcgacac

SEQ ID NO: 12993 - DNA, 715 bp, Lactuca sativa
  misc_feature (630)..(630): n is a, c, g, or t
  Predicted polypeptide sequence is orthologous to G2041
gggattatctgtagattatgtggtcatgttagatctgaaataaaagacatctcaccttcctttttaccaggtgtagtctggacgccaagcaaagaaatccaaacagaagaagatgattcagagcaaaacacacaagatgcagacacacgtcttgaaattgcatgtcttcctgcttcatccatcatgtctgtatcagatcagaacgaaaatgtgtgggccctgattccaaaccttagatacaaactacgttttcaccaaaaaagagctttcgaatttctgtggagaaatctagctggcgatatcataccttcagaaatggaagcagccagcaagagaagaggcggctgtgtcatctcccacactccaggagccgggaagacattgcttataatatcgtttctggttagctacttgaagctgtttcccgggtcccgcccgttggttccggctccaaaaacaactttatacacgtggtacaaagaaatcattaaatgggagattccgattcctgtgtaccaaatccacggtgggcagacatacagagaacaagttttaaaaaacaaactggaactggctcccggccttccccgaaaccaagacgtgatgcatgtgttagactgtttagagaanatacaaaaatggctcacaactccaagcgtcctcttaatgggctacacttcctttctacacttactcgtgaagattcagctatgct

SEQ ID NO: 12994 - DNA, 878 bp, Lactuca sativa
  Predicted polypeptide sequence is orthologous to G2124
gcacattctgaaactctctctactcatttctgtcatgaattctatctaaactcatgtcctctacagttaggttttctcttttaagcaactacttttgaagttatagactttctctctagattcggctagaacaagcttgttttcaactataatagcaagctagtgaagttttgttcaagaaatatagctgaattttggaaaaaagtacctgaaatctatgtccaaagacttcttcttgaatcttgaaccaaaaaaggggtagcttctgcatcagttatgagtcaagaaagatgaatatttcaaatttaagagaatcaaaccacgaaaccaagcaagaaggatctagtgatgcctgcaagattgtacctaaaccaaacttaaccacatcgtcatggtcgagattgaaagatccaagaattgttcgagtttctagggcttttggtggaaaagatcgacatagtaaagtttgtacagttagagggttaagagatcggcgagttagactctcagttcccactgctatccaattgtatgatcttcaagatcgtttaggactcaatcaaccgagtaaagttgtcgattggttacttgatgcagctaaacatgaaatcgacgaactcccccctctccaaatcccaccaggaagcttcggacaaaatcttcaagcaatgctaagtgcttgttcacaatccgaagaggttaaaagtaatgttaatggtctgaattgggaggattactggaaccctgataaatcaaaagcaactgcacgagacaccagtgaagatggagaaaatcttgatcgagaagatgaaagaaacaagcatgatcatcatgggacatttgttcaacctagtaatttcttcggaagaaaccctaat

SEQ ID NO: 12995 - DNA, 956 bp, Lactuca sativa
  Predicted polypeptide sequence is orthologous to G2144
gcggggatcttcattattgtgtactttgatggagaaacatgaagaaatgggggttgaatcgtttcaattcggcgaagatgatattcagagcctcatgtcggtggtgccaccgcctgagcccggcaattctttcacggctctccttgaactcccaccgaaccaggctgtcaagctcttacactcccccgaagaaaccacaccccccgctattttccccccttcggtgtttccggccatggaaaccgacaattcactggagacgacgagctcaattctcccaaattcgagccctaattactgcaatttggtgaaacaagaaccgattgattctgattctctgcataattcatcacctatacagtcagatccgattatcccgaaattaacgaagcgcaaggagcgagagaagaaggtaaaaccatcggtgaagaagatcaaaaacgtcgcaaatgagaccgacagtgagaagcttccgtacgttcatgtccgtgctcggcgaggtcaagcaacagatagccatagcttagctgaacgagcaagaagagagaagattaatgctaggatgaagctccttcaagagctggttcctggatgcaacaagatttcaggtacggcgatggtgcttgacgagatcatcaatcatgtacaaaccctgcaacgccaagtggagttcttatcaatgagactggctgcagtgcacccttgtatcgatatcaacctagacaacatcttctctgcagagagtgggtcacttatggactgtagttttgctggcatggtttcactagatggacaaatgaatggaaacagccacaaccaccaccaccaccaccagcagttatggcagcagcagcagcctgatgggatgccactccaggaactgtggggtgggaaagacctccactgcaccctaatttcttgacaccgatgactcccttttaggtatgactcatctg

SEQ ID NO: 12996 - DNA, 766 bp, Lactuca sativa
  misc_feature (720)..(720): n is a, c, g, or t
  Predicted polypeptide sequence is orthologous to G2192
gaagaaataggggaagatggtagaatggttgaaattattaaagcatgtgaagaaggcgatgctcttgattcgggggttcagtcgattagattatcggaatctttaatatcaaatggcggcccagtgggttgtgttgatgctttggtgaggcccaatgcgttgaatgtaaattgtgggaaatcagagaatgtggaaattaccaaaaagtccgagagaaaacgagggaaagctgagaaatcgattagcttggaagtccttcagcaacactttgcaggaagtcttaaagatgctgcaaagaatcttggtgtttgtcccactacaatgaaaagaatatgcagacaacatgggatttcaaggtggccttcaagaaagatcaacaaagtcaaccgttcacttacaaagctaaaacgggtgattgaatcagttcaaggaggtgaaggaacattcaccattccttctttagcaaccaccccactccccattggtgttgactccacatcatggcccacagctccaaacgggtcgcccgggtcaaaaccatctccaaagaacgatcaaggtcaaacccatcaaacatcgggcagcagagaagcaagcacgggcagcccgacttcccacaggtcgtgtcaagaaagtcaactgtttgaagtcaaagcaccgaatcttgaagggcttatagcaccacaaactgaagaaccgtttagaggaatgctaattgangatgctggaagctcacatgatctcacgaatctttgtcaacccactg

SEQ ID NO: 12997 - DNA, 735 bp, Lactuca sativa
  misc_feature (103)..(104): n is a, c, g, or t
  misc_feature (430)..(430): n is a, c, g, or t
  misc_feature (435)..(437): n is a, c, g, or t
  misc_feature (609)..(610): n is a, c, g, or t
  misc_feature (648)..(648): n is a, c, g, or t
  Predicted polypeptide sequence is orthologous to G2207
ggagaaaaaactcgaggatgaaatcggtgggacccgtgtaggtgctacggagacgtattgccatggcagcattcagcccataataagaacttatcggataggnnaggcctacaaaaatcattaatgtcagtaaagcaaggttggtttgtacccaacgctttaccagcaataccttctccagatacaagctgctggctggaggtcgcctcaaagaaccctaaaatctccggatcgaacacatacgaagcggattcgatcacggaaaggggacgaatctgccttcacatcggccccatgtttgagccaatggcaaatttagagtattgcatatgcttctcaaaacatcttgaatctccgaaagtacagcatcgtatggttcaatgaaatccttttgctttggatggatcaagaattccgaactccttagatnacgannncgcaagcaaaagtaatatcagaaagatgaaccaattaagaagtcaactcctttaataaaaaaataaaaatcaccattgatacatataaagggtgttttgagtcatagagagtaaaaacatgatgtaaatcaagtaaacctaacacgatcgagccacaaacacagactaaaannccatcaagaaaatagaaagagacctcaagagctttacnaatgttttcgaattcatcccggaggttgattttctgggaaggtgtcaccacctcaacaacacccaagcaagtgtcaccatctaattc

SEQ ID NO: 12998 - DNA, 714 bp, Lactuca sativa
  misc_feature (617)..(617): n is a, c, g, or t
  Predicted polypeptide sequence is orthologous to G2226
ggctggaaattcttaaaatcccatctcaattcaacaattccaaccacaatccgcttcaaagttaagcaacgaaatggggctctcgccatactcaaacccatcggatgcaggagtgttgtgcgtaattctggttaacacagctatgtcgatatcaatcatgaaggaaatagtttgttcgattcttcatgtggtggggttacgtgtagcgtcatcaccgtcatcatccaatcaaggctcgccggaagcttctgagcgccggggaagtccgtcggagacgtacatggaggagttcagaagccggacgccgtcgctccgttacatctccctccgtcgtcccaccaaacaagaatgctccgtttgcttaacggagtttaaaccagattcagagataaataagctttcgtgtgggcatgtttttcataaatcctgccttgaaaaatggctaaaatgctggaacattacttgccctctctgtagaaaccacatgatgatttctaaagaaatggaagaaaacaacacttgcccgatgtgaagaattgaaatcaaaacttacactttttgtagatatcatcaattgtgtaaggtttccggtggtttattcatctgagaaactgatnaactttggttatttttttctcgtttatcgagttttctttgacgaaacagatatattctgtttctttcatcatttatgccacaatattgaatgatcat

SEQ ID NO: 12999 - DNA, 937 bp, Lactuca sativa
  Predicted polypeptide sequence is orthologous to G2227
gcggcggcgaaacgaccaagccccaacccgagtcttagctctagtcctttccctaacctcaccccgccggtgcttcaacgggccagaagaaacaccggtgaacgatctcccttcaacccggtcatcgtcctccgtggacccacaagcaatttaagcacaccggaagcgtctgatgaagcgaccaccggaacaggtggatttgagttgtactacgacgacggagctgggtctgggttgaggccattaccggcaagtatgtcggagtttttattgggctctggttttgatcgttttctggatcaattatctcaaattgacgctaacggatttgggagaatcagcaacaatccaccagcatcaaagtccgcgattgaatcaataccaacaatcgaaatccatgaaaatcacatctccactgaatcccattgtgctgtatgtaaagaaccatttgatttaggaacagacgctaaagaaatgccgtgtaagcatatataccatccagattgcattcttccatggctagctttacgtaactcctgccctgtctgccgccatgaactaccaccggataatcaagattctatagaatccaacagatcacaaatcaatgataatcacaataacaatcaaccggaagaagcagttgggctgaccatatggcggctccctggtggtgggtttgctgtggggaggttttccggtgggatgagaggaggtaatagagagtttccggtggtttttacagagatggacggtggtttcaacaaccacaacaacaatggtggtgctccaaggaggatttcatgggctttaagaggtaacaacaatgggggtagagagagtggtagattccggcgacttttgcatagttttttttcttgttttaatggtggtgggagggcaatagggtcaagttctatgtcaaattctcatcgac

SEQ ID NO: 13000 - DNA, 598 bp, Lactuca sativa
  Predicted polypeptide sequence is orthologous to G2251
gcggggatttgataactccactgtttctcttttctcaatcaaatcaaaaaccttcaaaaacatgggagcactttctcgattcatagctcatgtctacacccttttcttagtattcttcactgtcctcttcctggagctcgtaatcttggttcgctcagtcgccggaagtattggttacacgacggcagccgacgaccacccaatgaccaccgcccagtacctcaaattgattgacgaaaaaaacccagcgagtcggtacaaaaccgccggattagaacgtaaagagtgttcggtttgcctttctgtattcgacgacggcgatgaaatcaggagattgaaatgcaagcacacgtttcacaagggttgcgttgataagtggctggagcaagatagagccacatgtccgatttgccggagtttggtgttgccggaggcgatcgtggttaaatacagtcaacgacatcagattcctctgcatcgccgccgcagggagttttacggtggtagcgatgaggagctcatactcttgttgacttctttacatggtaattatatgcgtagattcatgtaattagtttgtatttctaactttagtgat

SEQ ID NO: 13001 - DNA, 602 bp, Lactuca sativa
  Predicted polypeptide sequence is orthologous to G2379
ggccttatggcccgaatgcgggtggggaaggagtgaggaaggaaggaggaggggattccgagtgcatgaagcggttggcaagggctattgagagattcggagagatatacgagagggtcgagggagagaaacagaaacagatgattgaattggagaaacagaggatgcaattcaccaaagatttggaagttcagaggatgcaattgttcatggatacacaggttcagctggagaagataaagcaagcaaagaggacagtttctgatgatgatgtttacagttaacctccctgttttggcatgcgttaagaaaaaggttagctttgcatctgatggtgtttatcgttgagtgatgattctgactgacaatggtgagcattacctatttgcgtttctcccatttatgcatgctgaaaaaagaaagtatatataaacataatatcttgatgatttccatggaagaggaagaggatgtttttaactgtaagagtaattattattagataagagtatgaatgttgtagttacttctattcaatgtctttgccttagaaaaacaatttggtggtagaccatgataattgatactctttcttgaaaacc

SEQ ID NO: 13002 - DNA, 922 bp, Lactuca sativa
  Predicted polypeptide sequence is orthologous to G2456
cttatttgtagcttccttctctcttgtctttgagaacgcacacacataaacacaaggaggtcagatcccaaaggtggttaatctgtccatcaatcaatccatatacattgttcagtcaatcttatcaatcaatcaaatcaaactgtgagagagtatcaaacaggagagagagagagtagaaagggcaaaggtgaggaaaaacatgtcatcttcagctgctttttcaccggaccaccaccaccaccacctctctcctccctccgaacagctctgctatgtccaatgcaacttctgtgatactgtactcgcggtgagcgttccttgcagcagtttgttcactaccgttactgttcgatgtggccactgcactaatctcttgtctgtcaacatgcgagctcttctctttcctgcttccgccgcagctgttgccgccaacgccgcagctaatcaactccatcttggccataatttcttctctcctcaaaaccttatggatgagatgagaaacgccccatccaatttgttcatcaaccatccaaatccaaatgagccggttactcctgttcgaattgatgagcttcccaaacctccagtggcaaacagacctccagagaagcgccaaagagtgccttctgcttacaacagattcatcaaggaagagatccaacgtatcaaagcaggaaaccctgatatcagtcacagagaggccttcagtgcagctgcaaagaattgggcccattttcctcacatccacttcggacttatgcctgatcaacccgtgaagaaacccaatgtgtgccaacaggaaggagatgatctgctcatgaaagatggatttctgaccactgccaatgtgggtgtttcgccttactgagtgaataaagcgctaagatcggattgatataaatagctagctagggtt

SEQ ID NO: 13003 - DNA, 833 bp, Lactuca sativa
  Predicted polypeptide sequence is orthologous to G2525
gcaaaacgcccaaaatcaaatattaacaaaaaaacccctcatcatcaacctttgtcttttgcttaaaaaatggatactatttggcaggaacagaatcatggtggcggcggttttcagctgccggagagtccaaggaggccgatggagttcttgtcgagatcatggagtgctgctgctctccaggtctctaaaactctacactctccgctatctccattgattccaaaatctggtattaatactgataataccggtgcaaactctgttgccgccgcggcggaaaacaacaaccgtttctccggtgtcgaggcagcggaggagtcggcctcagccgcagccgcattactgtctggaaacacgttctcgtttgcgtcctccgccacttctcagctagtgcttgaacgcatcatgtctcagtccgatatatcgccattagcatcagggaggctgtcacacagcagtggacctttaaatgcgacgttgacggaggaaaccgatagtcctccgatctccccttccgatgactacgacgatgtcgtcaagtatcttcgagcaaacaactcgttacaacccctgtttgccaacgcacgtagcggtggttacacaggcggcagcagcacccctgccggaaaaacagttggaaggtggttaaaagagcggcgagagaagaaaaaggaagagaccagagctcacaacgcgcaacttcacgcagcggtttctgttgccggcgtggcggcagctgtggccaccatcgcagccgccaccgctgcagcttcagcctccagaaaagacgaacaaatggcgaaaaccgacatggctgtggcctctgccgc

SEQ ID NO: 13004 - DNA, 950 bp, Lactuca sativa
  Predicted polypeptide sequence is orthologous to G2550
ggagaatttatttctgctgctttggttctgtcttcgtctttgctccacttcacaggtattaccgcccacttctaaagggattatccaccagccattgaaatcagagatggctacttattatccaagttcctatctttcgacccaacaacaagcttgattctaatcaagaatcgccttgtcctccaatcgatataatgtaccagaatcataatatcaacagatgcctctttcttggagcttttgactactaatccgcagtcaaacccccaaaatctttcaagagttgaaaatcatcaaaacttgcaatatcaagaattgtccctcagtcttggaatgcaaataacttcttccatggatttgccttcgttccaatacaattacttgaatccccatcttcaagattctagtggccatggctctcgaagcaataaaatggagaacattgactatttgtcattcgatagggctgtgaacaatcaaattccatctggggttgtggcaagaatttatagttcaagatatctgaaaccatcacaggagttgcttgaagaagtagcgaatcttcatgaagctataaagcaattaaagatgaacaaacgtaataattttcagaagattggcgttgataggtacgatgaaaatggttcaagaattgactttcaatcagttcctcttgagtcagccaccagttcctctggcgagctttcggcttctgagaaacaggaccttcagaacaagattgtgaaactcttttcgttattagatgaggtagataggaaatacagagaatactgtcaacaattacgaatcgttgagggatcattagatatggtggctggttgtggagctgcaagatcatacaccgcgcttgctaaatcaacatatcgcgacactttcgttgtttgcgtgatggaattaacgaccaaattcaggtgatccgtcaaaagctc

SEQ ID NO: 13005 - DNA, 747 bp, Lactuca sativa
  Predicted polypeptide sequence is orthologous to G2557
gtggcggatgtggaatcagggggtaagaggttaagaaaagagaaagtgagggagactataagtgttcttcagaatctgattcctggtggtgggaggaatgggaaggatgccatggtaattcttgatgaagccattaattacctgagaattttgaaggtgaaagctaaagccttggggcttgattctctctaaatgcatcgtgcattaagagttgcacgttgatctagctaagctagctttggttggggataattaaaaaaaaaaaatctttactttattcaaattgtgtctactggtgtgttttgcgtgtaaaaaagagaataagacgagggaaaattgcagttggaatggaatggaatttgaaatcttttgtgaagataagttttggtttcctgaaatcctgatgatgatgatggttgatggtaaaaaaagatttaggctttatgtaaaatctcttgcttccggtgagtgtacaacttttactccgtgaagtacacaattcagtcgttgcaaaatcattgtcatcgatttttgcttaaaaagaaaagcgagatgtgtatagctttttctgagattgtgtgaaagaacgggtaatttggtaaaattggtacttgggatttgactggttgtggggttgggatgagaaaattgaaagcaggtttgaattgatacccatccatcaaggcgttctcaagtattaactaggattgttggtagtgattctccctgggcctataaaaaggttaa

SEQ ID NO: 13006 - DNA, 668 bp, Lactuca sativa
  Predicted polypeptide sequence is orthologous to G2592, G2713
ggccttatggcctgtagccggggcctcgggataccacgattcaatgcttcatcaagagagataaatctaattcgacgtattatctttatctttgcctaagcagtgcattggtggtagagaacgggaaatttcttttttcagcaaaacgaagtaggaaaagtacatgcacagagtacatcatttcactgaatgctgataacatatcgaggtcaaaccgtggatacattggaaaagtgagatcaaactttcttggtacaaagttcataatttatgactcccaaccgccacataacaccgccaacgtggtcccaccgggtcgtttaggatcaagccgccgtttttctagaagggtttcaccaaaggttccttccggaagcttcaacatagctcaaattgtatacgagctaaacgtattggggacacggggtccacgtaggatgaactgcataatgcactcaatacccatgtccgccatggaacctggcggcaccaccctcgaccaccaccctaacctggcggcacattccttcaaagactcattcagaagcatctcgttttccaaatcaatcgatagtttaaacgaattcagtagctcccgattttccgatatcatgggcacaaatgaggtacaaaatggagaacaaatgaagaacatgcctttgattcta

SEQ ID NO: 13007 - DNA, 807 bp, Lactuca sativa
  Predicted polypeptide sequence is orthologous to G2592, G2713
ttcggccttatggcctgtagccgggaatgaaggtgatgccggtgtatctatatagacctgtttttgtgtagaatcgagtagttgaagatgtcgtttaagagtataattcaggacatgaagggagagtttggtagtatttctagaaaagggtttggtttgaggtcgagatcactaaaattggtcgaggacgaatctatgagcattgttgatgcgttgaagcagagttgttgggccaacatgccgccggagttgttgcgggacgtgttgatgaggattgaggcatccgagtgtacctggcctcctcggaagaatgtggtgtcttgtgccggtgtttgtaggaattggagagaaatcatgaaagaaattgttaagaacccagaactttctggcaaattgactttccccatatcactgaaacagcctggttcaagaggatctctgatacaatgctatataaagcggaaccaaagcgctcaaacatatcatctctacctcagtttgaatcaagcatcaaacgatgatgggaagttccttcttgctgcaaaaaagtgtagacgtgccacatgcacagattatattatctctctcaatccagaagatgcatcaaaagggagcagcacttacatcggaaaattaagatcaaacttccttgggacaaaattcacaatctatgatgcacagccttcaaatggtggagttttggcaacaaaatgtcgttcattcagaccagggagtatgaaaagagtgtcgcccagagttcctgttggaaactacccggttttccacatttcatacgagctgaatgtc

SEQ ID NO: 13008 - DNA, 791 bp, Lactuca sativa
  Predicted polypeptide sequence is orthologous to G2592, G2713
ggagagagaatgtgtgggttttagagagagaaatgtatatcctcttctgggtctgacccgactttccttttctttctgatctgtttggtgccttccatctgtttgtagaaagtccacagtgaaaattttcatctgaatcattacaaacgcgcataactcaccctttctgttgaagggtttcatggttttcttttttcacaagctctagtaccctaaaatgctgattttgatggatttttaacctctcatcaacagccaatctacatcaaagcgtgagttcacgtgttcatcaatttaaaaaaaagaaaaagaaaatgtcttttcgtagcatagttcgtgacatgagggacggattcggaagtttatcaaggcgtagttttgacgtgaggctttcagggcatcacaacagaggaaaatctcaaggttcaattaatgatttaaatgataatggaccttccttaattgtccaaaatagtagatgggcgaatctacccccggagcttctttttgatgtaataaaaagattagaagaaagtgaaagcacatggccttcaagaaaacatgttgttgcttgtgctgctgtttgtagatcatggagaagtatgtgtaaggaaattgttagaactcctgaatcttgtgggaagctcacttttccagtttcattaaaacagccgggcccacgtgatgttacgattcaatgtttcatcaaaagggataaatccaatttgacatatcatctttatctgtgtctaagtccagctgctttactagtggaaaatgggaaattcctg

SEQ ID NO: 13009 - DNA, 765 bp, Lactuca sativa
  misc_feature (729)..(729): n is a, c, g, or t
  Predicted polypeptide sequence is orthologous to G2592, G2713
gggacaaagttcataatatacgacacacaaccaccacatttcaacaccaatacacaaccgccacctggcagatcaagccgaagattccactccaaaaaagtctccccaaaagtgccaagtggcagctacaacatcgcccacatcacctacgagctcaacgtgttaggaacgcggggcccacggaggatgcactgcatcatgcagtcaatccccgcctcatcactcgacccgggcggctcagtccccggtcaaccggagctcctccttccttcctcctcctccttagaagactccttccggtcaatttctttctcaaaatcccttgaccggtcaaccgaattcagctcttcaagattctccgagatcatcggagctgccacctcatccgatgtccccgagagtgaaaagtcgaaaatgcccctggtgttaaaaaacaaagcgcctaggtggcacgaacagttgcagtgctggtgtttgaatttcaggggacgagtgacgattgcttccgtcaagaactttcaactcatcgccgcccaaccaccgccagtgccgccgccaccggcggcagcggcagctggtggctcgggttctcatccagagcatgataaagtaatcttgcagtttgggaaagttggtaaagatatgttcactatggattatcggtaccctttatctgcatttcaagcatttgcaatatgtttaagcagctttgataccaattagcttgtngataaaaaaaaagacgaaagaacctgaaaagtttac

SEQ ID NO: 13010 - DNA, 829 bp, Lactuca sativa
  misc_feature (773)..(774): n is a, c, g, or t
  Predicted polypeptide sequence is orthologous to G2592, G2713
aaaccaactcccctttctttccaatgtcgttccggagtataatgcgtgatgtgagagatggatttgggagcatatcaaggaggagttttgatgtaagaggaaaatctcaaggatctgtaaatgattcaaattcaagtgataatcaagcctccattgttgtccaaaacagtaggtgggctaatctcccacctgagcttctctgtgatgtgattaaaagattagaagagagtgaaagtacttggcctcaaagaaaacatgtggtcgcttgtgctgctgtttgtagatcttggagaaccatgtgtaaagaaattgtcagaacccctgaatcctctgggaagctcactttccctatttccttaaaacagccgggcccacgtgacaccactatccaatgtttcattaagagggacaaatccaatctgacatatcatctttacctttgccttacccctgcagcgttgctagttgaaaatggtaaatttttactatctgctaaaagaactcgaagaactacttgcactgaatatgtcatatccatggatgctgaaaatatttcaagatcaagtagcacttatattggaaaactcagatctaattttcttggaacaaagtttataatatacgacacgcagcccccgcattccggggcttcaatcccgccacctggcagatcgagtcgaagattttaccccaaaaaagtctcaccgaaagtcccaaatggaaattacaatattgcccatatcaaatacgaactcaatgtactcggtacgcgnngtccacgtaggatgcactgcatcatgcactcgatacccacgtcagcactcgtgcc

SEQ ID NO: 13011 - DNA, 864 bp, Lactuca sativa
  misc_feature (681)..(681): n is a, c, g, or t
  Predicted polypeptide sequence is orthologous to G2719
gacgtcccccaaaacactttgcctcgcaactcatttcacctgttcgtcaatcttcccctgtcacacactccagcagttgaaaccagtcaacttcgctgcgaatggacaaagatcaagatcaagaccaagacgccgccaaaattgaggatttcacagcaccccaagacgatggcgcccacataactaccgctgccactgaaaaccatgacgccgatgactctgacccagttactgtcggagatggagttggggccagcggtgctagtggcggtggtggtcgcgccggcaagaggaccggcgatagagtgaagggtccttggtcgcctgaagaggacgccatactgagtcgattagtgagcaatttcggtgcgaggaattggagtttgattgcccgaggaattcccggcagatcggggaaatcatgtcgtttgaggtggtgtaatcagcttgatcctgctgtcaagcgcaaaccctttactgatgaagaagaccgaattatactctcggctcacgcaattcacggaaacaaatgggcatcaattgcaagactcttaccaggaagaaccgacaacgcaataaaaaaccattggaattcaaccctaagaagacgaggtcacgaactcggtaaattcaacatcgggtcgggtaacaccattgaagacccgagcttagaaagatcanaagcatcatcagaagaaaccttatcatgtggggacatcaattccttcaaaccccacgaaggacccgacatcacaagtgaccctaacaatgaccaaactacccttttccgtccgaaaccccgcgtaagcgcgttcaacgtttacaactcacaaaccggttctgaaacatacgggcccaaactgt

SEQ ID NO: 13012 - DNA, 910 bp, Lactuca sativa
  misc_feature (867)..(867): n is a, c, g, or t
  Predicted polypeptide sequence is orthologous to G2754
cggggatgaaacctttcctgccactctccattgtcatcggacttctccaccgctcctcttcacgcttcctgcagagatccaaggttttgactgcgagatggtgcctaaaaacgaagtcatggaagaaccagtagcagattctccgacttcggtgcttgaagacgaggatgtctgcaaggataaatctgctgtgaagatggaagatgtactattaggtgaggcaaaaaatggggacgcagctctcatctcagctgtaatggcagaagaggaagtaaaacttgaacaacaaaggaatcaggaagaagaaagtgtggcaaaggaacctcctaccttgaatgacacacagtttactaaactggatgagcttcttactcaaactcagctttactctgaatttttactggaaaaaatggacgatataactaaaaatggggtggctgaagatgttcaagaagtagtaaggggcgaagaagaaaggccgtggtgctaaaagaaaatctgcctcaaattacaacacaaggaaggccaaaacagctgtagcagccatgcttacacgatctaatgaaggtaccccttttgatgacaccaatattagtaaagaagagagagctgcaatagagcaggctgagcttgttcctttgttgactggtggaaagttgaaaccttatcaagtcaaaggtgtgaaatggatgatctcattgtggcaaaatggtcttaatggtattcttgctgaccaaatgggacttgggaaaacaatacaaactattggttttcttgcacatttaaaagggaatggcttagatgggccctacttggttattgcccctttgtctactttgtcaaattgggcaaatgagattgcaaggnttgtcccatctatgaatgcaatcatctaccatggagatagatc

SEQ ID NO: 13013 - DNA, 746 bp, Lactuca sativa
  Predicted polypeptide sequence is orthologous to G2777
tcccgatgcaccgttttggacttgtggttgatcaacaaaaccttctgttactcgttggttatggttccatggcatgattgttggtggttcattattccatccccgacatgaatcctcaaacttgttcaccttctcttgtagaaattgaatgtattcaataacctctaataaaaatgatgccttatctctcttttgatctccatgagggatgagttctctcaacatagaaaatctgtcattgattttgcttcttctacgttgctcagtagctgaatgcttggaacgcggggtgttgggcttttgatcattatgtgctgcgtccactttaacagacaaaacacctttgtagtgtgaagatggctctttcttgataacaaactcttcttcttcatcatcctcatcttcttgtgtattcttaccagacttcaacatctcaacaaaactatgattcttctgtgttgacgatggacgagaagatgagagagaactgatagtcgtgctctgatggttatgcgcagatgacgactgggatggtcgctccactgacgtcatccatggcgatggcactcctccgatcttcatccccccatctcttacgacatgcctatttcctgcaatattctccttccctgtctttcccttttttactgtagattcttcccacagtgaaaaaccactccctgtgtaagaactgcagtttgaagtttcatcgtttttatcactgccgctagattgtgcggcggcga

SEQ ID NO: 13014 - DNA, 852 bp, Lactuca sativa
  Predicted polypeptide sequence is orthologous to G2779
cggggaaatgattttttccatgtgcttatgttttaatgtagaaaccgattgttttcagaacaaaaccaaaaacatttcaaattcaacaatcatgatgaagcaataaatggatggttttagtgatgatagttgagtagtagacatgatgcatgggatgcacaataaacacttgataaagcgtgcaagtattgtcgggtttgtatgcgggttataatctgggttatgggtgtatccatggagtgtatgatagcttcattttatttaattctttttatagtttattttagcacatttcattcacattttagttaatttccatgcatattttcctttttgttattttatgaccatttttgggtactttctagtttcttgagcattattgtagattttctgggagactagtggagcgggactctttggaggcgattgggcttgaagggaaatggggatttcgtacttgatggctgtggaggtgattcagggagtaggcttgtcgactgcttgaaggcgcggaagtgttgaactttaaatttgaaagggcgcgggagaattcttgagtgtgcaagatcgatgtctaggagtttgcggaagttttgagtgatgtggagagacaaattgggctctaattgaagaaatattgaagaaaaatgggctagaagctgattggattcgaactgggccaatggattagctgtgggggcccaagacttgaagaagcccataaattccgtcacaatcacgcggcccgcgtaagattccctatggcccacgtggatttctgacaagggcaatttcgagattttacttgaagctctatattggaaggttggtgtgcctcttcagccttat

SEQ ID NO: 13015 - DNA, 820 bp, Lactuca sativa
  Predicted polypeptide sequence is orthologous to G2802
cgcgggggtgctcgcacacggtggcttccaccatttcttttccccaatcatattactccaccatatcttctctaaaccgatttgtgtcccctctaacgtctcacccctgatacttcaaaccaccatcgatttatccactttagttcaacagggaagcaacaagaaccaagaacgcattctggcgttgttggtgttggtggtgcgacgacgtgggttgctggtggcggtgacgggaggcgttgtggtcttcaggtgtcgcaaattgattgcttggtggcagttatgttccaccgctatgagttccgatcaatttagtccaggtaacgtcgctcgccaccatggtccaagccaccgtcgttctccaccaccgattatccctgcaggaacacatggtgtgcgaatatagcttcatcgcctgatttccttcttatattccttcactgatcgagccttgattgcttcgtcgatgactacaacccagaaatcagtttcgttatgttctatgcctttgttaatggcaagagttgcgtccgatgttcctcgaaaatcagaagaaaaaattcagatgcatatccccatatgctcgaaaagaaataaattcagattcatatccccatatgctcgaaaatcaaaggcatacattcatatcgtcgaaaacaagaaggtaatattgaattgtggaaattgaaatatgttctacttttgtgattgttatgtagtatctcattattctctactgatactgtaaaatccagtggaattgtatacagataccaatttgttggcatgaaatcctgatgatatcatcgttctttttaca

SEQ ID NO: 13016 - DNA, 618 bp, Lactuca sativa
  Predicted polypeptide sequence is orthologous to G2854
gtcggagcgacccaaacaacacaactatatttgttggtggtttggatccaagtgtttctgatgaaaccctaaggggggtgtttggtcaatttggtgaactaattcatgtgaagattcccgtaggcaagcgatgtggatttgttcagtttgccaacagagggtgtgcagaacaagctttatcgattctaaatggaactgaattaggaggccaaaatatccggctttcttggggtcgtagtccttcaagcaaacaggggcaatcggagcagccacattatggtggtggaggtggcggtggtggtggtggtgcttattatgggtatgctcaagggtatgaggcgtatgggtatgctcctccgcctcaagatccaaatgcttattatggagtctatgcaggggctgcagggtatggtggttaccaacaaccacagcagtgatgattagcattgaaggttgggggtgtgagctgttatatgaagttggtctggtctgtactatatatggtgcgtggagtttgatatatgtgcccaagagaaacaaacatctccctattgtggatgtcgatgttactttttttttttttctgatattatgtttgctgatctaactgtgggtttg

SEQ ID NO: 13017 - DNA, 741 bp, Lactuca sativa
  Predicted polypeptide sequence is orthologous to G2854
agggttcttatcgatcaaccctatacttcaattttaccgatagattctatattattgttctaccctatacatagtttgatttgtcaaatcaattaggtttcctttcacaagatgatgcaaccaggaaacggcatggcaccagtaccaatggctccgatgcagccgccaccacaacaacagcagtaccaacaagcaccaccgcaacagcagtggatgatgcctccaccggctcaacaacaacaccaacaaccgctgccgccccatatgtgggcccagcaacaggcaccgcctcagcagcagcaacaagcacaacatatgatgcaagcaaatcagcagtcgcagcagtattcttctgctccggcgagttccgatgagattcggtctctttggatcggagacttgcagtattggatggatgaaacatatgttactaattgcttctacaacaccggagaggttctcacggtgaagattattcgcaacaaacaaactggacaacctgaaggctatggttttattgagttcaggagtcgtgctggtgcagaaaatgctttacagacctacaatgggacactgatgccatctactgagcagaattttcgccttaactgggcaacccttggtgctggtgagagacgcaatgatgacactcctgactacacaatctttgttggtgatcttgctgctgatgtttcggattacatattgcaagaaacgttcaaaactgtttacccgccagtc

SEQ ID NO: 13018 - DNA, 668 bp, Lactuca sativa
  misc_feature (595)..(595): n is a, c, g, or t
  Predicted polypeptide sequence is orthologous to G2969
aagaacccgatgatttaccgggtcatgaagatccacaacagtcccaagatacttacccggttcgaagaataccgcgagatcgtaaaatctagggcggctagacacggtggaggacgacggagagacgaacgttgtatcgccgacggcaacgagcttctccggtttcactgcgccacgttcttgtgtgacctggggcaaaatggtaattccagcatctgcagccatcagtactgcagtgtgtgtgggatcattcgggtcgggttctcatccaaattggatggcatatcaacgttatcaactagttggaaaggacacatggcactcccggaagacctcgaggaggaattccggttcatgcacgtgaaacgggctatgctcgtgtgccgggtgatagcgggtcggaccgggtgtgacccggaaatgggggacaaggatgacccgggatatgattcattggtcgggggtgaacccggtgggacacatacctgcaggttggacgaagaggatgaattgattgtttttaatccaagggctgtgcttccttgttttgtgattgcgtatacagtttgattatgatcgtgtggctattgattangatctggaacaggcttttgcaacaagatccccagaacttgttgcttttttgtgcgaggatgattgcgcccgct

SEQ ID NO: 13019 - DNA, 666 bp, Lactuca sativa
  Predicted polypeptide sequence is orthologous to G2989, G2990
gaggtggacatcgtgaagaaagaaaaggaagccaaggggaagattgtatagatcgattcggtggcggtgcctcctccgacggaagatgatgtggatgaattttttgctattctgcgacggatgcgagaggcggtgaaatacttcgagaaaggtaacggtgggaataaattatcggatccatcacgagaacctgatgatggtttagcttctgtgaacaaaggaacgaacgttgcactcttggatctgaatactgttcctgacgagagagaatagcatcttctacggtggcgcgtggggtttgtctttgttaactgcgctcgtggcgcgtcttaggttaagccttgctgcctggcatcgttggctatcttgcgctcatgtaactcacctggtcgggtcatccggctgggttttgacccagaatgttaaaaaatatgaaatattttggtttctttgctaatttttctacacatggctgatgtatgtgtaatttgattgaaaaaaaaggtacccatcaacgggcccggaaggcaaattattttgctttggaagatgataattgaacgatgattatagctgagtctttatgtatgtatttttatatttgaaatggtacaacgagatagcaaggaaaagatgatcggagcttcttttctttcttccgatgtc

SEQ ID NO: 13020 - DNA, 671 bp, Lactuca sativa
  Predicted polypeptide sequence is orthologous to G2993, G2994
aggtatatgtacagcagctgcgggaggtggttgattatgtgtcaaaggtatttgagaagtagtctcgccttctacctctctccggtggaaactccggtggcattcacaggcagcacattttaatgcttctggcgtgccatcttctccgctaggcataaactctccacacccatcgagaacatgagcgcccatattggcagcatggttccttaagcatccacgataccggaccaccaccactgcaaccggcgctatagaggttgttgaaggtggtggtgctagtggtagtggctgcgagggagcttgagagaccagtccagaaagatttggatccggatccgagtttgaattccttccgggtgtttctgcagcttccggttgttctttatgtaacctgaatccgcgatactggtctccctgatgaagatgatttggggtttcatttcttttggtgtttgaggtagaagatgattcttgagtggattgaggtggaatatgataattaatggagtttctctctctagtttccattaggtttgacatgtgaacacatgatccctcaccctaaacaccaattcaagtatttaaaatttcgcaaatcctgctggaaatctggaacttgaggatcaaggaatatagagattaaacagtgtctcctaccacccaccctg

SEQ ID NO: 13021 - DNA, 467 bp, Lactuca sativa
  Predicted polypeptide sequence is orthologous to G3060
agctattattggaaaaagcggagtcaactctaagcaaattagtcggttgactggagctaaattgtcaataagagatcatgaatcggatccgaatttgagaaatattgaattggaagggacttttgatcagattaaacatgcgagtcaaatggtgcgtgagttgattgtgaatataagttcggcttctggaccactgccgccacaaaagggatttggaaaggcggcgggtggtggtggtggtggtggtccggcggggaattttaagacaaagctttgtgagaattttgctaaagggacttgtacttttggggagaggtgtcattttgctcatggtgctgaagaattgcgtagttctggagcttgattttgagggttattttttttagttttggagtatctgagatgttgattgttgaggacagttgtgagtttgttggtactaggtttttttttgtttcagattttta

SEQ ID NO: 13022 - DNA, 845 bp, Lactuca sativa
  Predicted polypeptide sequence is orthologous to G3074
gcgggggacctttacggatctgtgaaatttctggatatcgtaactcgaatctgatccaaactacgaaccagatctgcaacgccgatagttctccgccactgtgattcttagagatcagatctcgtctggcgcgctcttttgttgatttctctcttgagttaattcttcaaattgtgtttgttggtgtatcaacgccatgaagaagaagctcgatacgcgtttccctgctgctcggatcaaaaagataatgcaagcggatgaagatgttggaaaaatcgccatggctgttccagttttacaaaagctttggaattgtttctgcaagatctttgtgatagaacatatgatataactctacgcagaggtgcaaaaactgttaactcactgcatttaaagcactgtgtacaaagctacaatgtatttgattttctgagggaagttgtgagcaaggtccctgactatggccattctgatgctgctgctggtggtgctgttggttctggtgatgatcgtaccatggtaaagaggaagaaagctgctgctggtgaaacaaatgaaagtgatgaagagttgaaaagaaacaggatgaatgaagcagggcaaacgggcagcaatggtagggggagagggcggggcagaggaaggggcaggggccggggcagaagctcagcagatagagaggctccccaaacagatattgaactcgaatcctgcacgccattgattccatcaaccaccaccaccgccgccactgccgccgctgctgccaccaccgcgatcagtgatggtggtcgggactttgatttgaatgccgggggttgatgagaatatggagaaagcatccg

SEQ ID NO: 13023 - DNA, 767 bp, Lactuca sativa
  misc_feature (614)..(614): n is a, c, g, or t
  misc_feature (680)..(680): n is a, c, g, or t
  Predicted polypeptide sequence is orthologous to G3086
gcaacaaactatgaactctggtttgacgcgatacagatcagcaccgagttcgtatttctcgaatttgataaacagtggcatgtatgaagacgaagacgttgacccattcttcaaccctcggtcttcaagccctgaaactgaacgcattttatcgagattaatctccggggatggtgataattcaagctctcatcagaatataggtcaaattcggggaaacgaccccccatttatggatcctatgaagcaggaacgagcgaattttacatatcagtctcaacagcaacagatgatgtaccaaaaccaccagcaagccgatcataatcataactcggttgtttctggttctagctccgccttggttgacccgttagcggccatgaatcctccaacgaaccttcttcgtcagagtagttcaccagctggattcttcgaacacgttaatatgggcaatggttactccgcgatgagatccatggataaatttcgaactgatgatggcagtgtaccagatttatcaaaggggtttgaaaatcgaatggctttctcatcagtttcacattcatcttctagaccactgtctcttatccctgaaaacgaaggcaaaaccatgnggaatgagtggtgctggtgcacacaacaatggaggttttgggtcaactcatccaagatctagtggntatggcttccctggtggttcttgggatgaacagcaatgttaactgatgaattcatgaaagagcttggggaaagcgatcaaataagtc

SEQ ID NO: 13024 - DNA, 935 bp, Lactuca sativa
  Predicted polypeptide sequence is orthologous to G3086
cattacttcaatttcccctgctttcttcccctcctcatcttcttcttcctcaaaacccctttctttatccattcataattttatctccttcttattgtaattccacactcaacatcatgtgatgctattttaagcagttttctttttctatttttgtacattttttttatggtgtggacagcgatgattcgagtctacatcactatagttgtttcaactttcaattgaaggattgaagtcaagttaggtttatttatttaagaagcagctttgactttctgcttgtttgttctaccagaaattatccaagatttactgtttttagggctataatggattcagatctccatcaccatcatcatcagcaacagctgcagcaacctcaacaacagaacatgaactctggtttgacccgataccgatccgcaccgagttcgtatttctccaatttgattagcaatggaatatatggagacgacgatagtgacccgtttttcaatcctcgggtctcaaccaccgaaacggatcagattttatcgagattcacgtcctccaccaccgctgttgttgctggtagtggtggtgattcaacatctcaacaaattatgaatcaaattgggggatatgaatcgcagttcatagattccgtgaagcaagaacaagaaggggtttattcagaatcactccagcagcagcagcagcaacaaccaatgatttatcaaaaccaatttcaacctcaaacggatcatattaaccggcctgtgtctacccgtagctccgccatggatgactccttaacgacgatgcatctccccaccaatctcctccgtcagagtagctctcccgccggtttttcgctcaccctgatatcgacaacggttaccctgtgatgagatccatggatgactttagatctagtaggagcaatgtacaaa

SEQ ID NO: 13025 - DNA, 712 bp, Lactuca sativa
  Predicted polypeptide sequence is orthologous to G3091
gtgaagctgtgggtccggccgttgttatggttactctgacgtccatggctgctgctgctgtaagaatcctctgaatcggagattgccatcattaaatgcttcttctccggcgaaatcttcctcttcctctcgaaattcgtcgacgttccaacaatcttacaaccaagagaacagaatcggaaggaatcaagaaggcttcgctcacaaacttcacaggtattggtgacgccttttccgggcctcggctgtggacgttcgttcaagaacacaacctttgcgctgttgataatgtaagtctgcactgaactgatgtccaagtatttctgaatctcggacactctgatcacatcgtgatacgatgaccttcgaatctgaatagcacgatgatccttgtggtgattgagacagagagaacaaagagggccattcatgcaatccaagcagtacatattgcattcagacttgtgcgaatctgcgtgtaatttgcattgaacaaagaagctttctcgaagcatcggtttcaaccatggcggccacttttgttcttcttcatcaggtcctccggcacccataatccggcggttcttgggtttgatttcacgaacgatggttgcttcttgattaacgatcgccagtttgagaataacaacggcggtggtggtggcggtgtgagtttaaagagagagagagagagagagagagagagagagag

SEQ ID NO: 13026 - DNA, 928 bp, Lactuca sativa
  Predicted polypeptide sequence is orthologous to G3091
actcctctctctaattctccaccccgccgcccctatttcctccggccaccactcttctcagccgtcgaactggcgattgaaaacgcaagaagcctccgtcgttcctgtgaaatcaagcctaagacaccgccgtatcatggtgtgttggaggacctgatgaagaagagaacaaatggcctccatggttgaagccattgcttcgtgaaagcttctttgttcaatgcaaattacacgcggattcgcacaagtctgaatgtaatatgtactgcttggattgcatgaatggtcctctctgttctctctgtcttaatcaccataaggaccaccgcgccattcagattcgaaggtcgtcatatcacgatgtgattagggtaaatgagattcagaaacacttggacataacttcagtacagacgtacgtaatcaacagtgcgaaggtggtgttcttgaatgaacggccgcagccgcggccgggaaaaggcgttacgaatacttgtgaagtatgtgagcgtagtcttctcgattccttccgtttctgctcacttgggtgtaagattgcagggacatcgagtaatttcgagaggaagaggaagatttcgccggagaataaacatttgataacggcaatgtcggattcggaggattcttacagcagtagcagccacggacggcggaggagtaactataatggaagaattcacattcagagctttactccgtcaacgccaccgccgacggcggccagcttcaggacggcaaagagaagaaagggtattcctcacagagcaccaatgggaggactaatcatagaatactaaatactcccctagacttttgataaattactctaaagtccatatagtctccacatcctacagaatgcaccccctcccccacttctcttaggaaataccctgtatacccttta

SEQ ID NO: 13027 - DNA, 909 bp, Lactuca sativa
  Predicted polypeptide sequence is orthologous to G3967
ggaggataatgagtttcccattcaatgcttcagagttagccaacattctcacaatggatagacacattgggtttaattgtagtgcacgtgttcttttgagatcagttttaacagaaaaacaagaattatgtttttctgttgtttccttgttgtggcataagatgatcgcatcacctgaaacacaacttaatgcagtaagcacatccgctcagcaaggatggagacaggtggttgatgcactgtgtaatgtggtggcagcatcgccaacaacagctgcaactgcggttgttcttcaggtccagattttgtttaactttttttttaaaaaccattttgtgacatttgataatttgtttattggttaagtcactttcctggttttgtatatttgcttgtcaggcggagagggaattgcagccatggatcgcgaaggacgatgatgtgggtcaaaaaatgtggagaatcaatcaacggattgtgaagctgattgtggagttaatgagaaatcatgaaaatctcgagtcattagtgattctcgccactgccttagacctcctcctacgtgccactgatggcatgcttgttgatggtgaagcatgcactttaccacaacttgagcttctggaagcaacagctagagcagttcagccggtgttagagtggggagaatccggattggcggttgcagatggcctctcgaatcttctcaagtgtcgagtgccagctactgtaaggtgtttatctcacgcgagtgctcatgtacgcacactgagtgtgtcggttcttagagccatttttgatgttggttgtataaaagtgaaacaaagtggtgaacaagtaatataggtagtagcagacatgttgcgtacatgagtggtgatgtcatcgattgggaagctgacctggcaa

SEQ ID NO: 13028 - DNA, 603 bp, Populus tremula x Populus tremuloides
  Predicted polypeptide sequence is orthologous to G481, G482, G485, G1364, G2345
ttttttttttttttttttgattggaatcggcttggattttgggattttacaaaataatcttagaatcaggctctacatcagttattaatcttgtaactcaagaaactgatagggcttatgctggttctattatcatcgcttgagttaaaagaactactggcaagagaatgggtgggtggtccaagctcatcatatttattaggaagctaatgcagcagcatagcaaactagttggtaagctatgatttgatcaatacaagtccttgtgacttgattaggtcgacttttccacgcttagtttaattctctggggcggtcgttggcccttgaattaccttgatgatgaaacccgccagcaccgtacacgtgtccttgatggtgatgacccatcatcatcatcccgccatacatcccttggcccccaccaccattaaaccctccacctccaccgccggtggaattagccccgcctccacctcccgcagcaccactcccaccagacccacctccaggaccttccttctcccctgctggtcttcccatggaactcttctctccttccatctccctatacttctgcaagtaaatcttcaggggctccac

SEQ ID NO: 13029 - DNA, 574 bp, Populus tremula x Populus tremuloides
  Predicted polypeptide sequence is orthologous to G867, G9, G993, G1930
cagatcttcagcaaagtgttgacagatgatgatgttcgttttcggttctcgttcccagctcattgcttgcagcatttagattttgctggaaataattctgttgatttgcatgttaaagatagctgtggtgagcttcgagttattcgttgcctgaagagagatggagattatgacaagcctgtgctttctaagggctggcgtcaatttgttaaatattatgaactgagagttggtgacatggttgttcttcatcgtgaggatgaccagaacctggggtcacagttcaggattgaagctaagaggagtatccagctgtttggtgaggaggattggggtgaagtgccaagagctaactagctattatatatttgcaggatgttcggccatatccagatatatatagaagaatgaatttatgtatgtgtttatgtttgagtgtttgtagtgatcataatcaatgttatctgcgtcagtctaattaaataaatatgttgctgttcttagtttcttgaatatgtattacgtgcatgtaattctcagcaataatggatttaattaattatatgtgatcaga

SEQ ID NO: 13030 - DNA, 869 bp, Populus tremula x Populus tremuloides
  Predicted polypeptide sequence is orthologous to G1274, G1275
gactgaacattcggttgattgctttggtgatcagagaattatgatctgattttttttatactaagatgtccagtcctaagtttagcacacaggaggatacacccgagcaaagtgactacgctcacgaccagctgtccaattttgagctctcagagttcttgaccttcgatgaatggatagcgctagaagatgctccgtcgtccatagcttccagttatgcctgcaacccggtttatagagcacgtgtcgttggcgagtcaggtggaagtagcagccctcgtgaagagctaagtggtggagagggtgaagaagggcgagagaagaaggaagccaaagaaagggttgctttcaaaacaaaatcagagatcgaaatactagatgatgggtacaagtggaggaaatatgggaaaaagatggtgaagaatagtccaaacccgaggaattactacaggtgctcggttgaaggttgccctgtgaagaagagagtagaaagagacagggatgatccaagatatgtaataacaacctacgagggcattcactctcaccagagcttttcctagttctcaggcgaagttgcactggctcatggtttcagatcctcgggcacgcttgatattgatgaacttgttaaggataacgtattgcatcgatcttggtttcactttgctgcaatctttaagagttggaaagctcatggacgacttgcaagaatatcagacaaagtcagctttgccagctttttgactagctataatataggaccttgagtggttttttggtactaattagtcgggatcccctcaatatatgcaatattaattgtgtctgatacaatttcagctgtaattaattatggttcttataaa

SEQ ID NO: 13031 - DNA, 652 bp, Populus tremula x Populus tremuloides
  Predicted polypeptide sequence is orthologous to G2
gcttaacctttgtacaagtgacaatgatggacatggaagagatgggtatggagagactgaaacgactcagcttcttagcaaaatccacattcaatctccagcatcactcaagtccagtgaaatgccaagatatgagcagttcaggagatcactcggagatagtcagatgcatccttttcttcccccacagtttaactcaccaaattatcaagtgagcttccatataattaaagctcgtgcaaacaaaaaaagtacaggtctttttactagttgaattgttgtgtttcaattcttctttagactcagcatccaagcagcagcaatggaggccgaattggaagtgatctttctctctctccatctgagcttcattatcaccatcattatcagcaatggcaagcaggtcctccccggtttgcaaatgctgcagcatcatcaggattccaacagcagattaggactccacaaaactggctgcagaacaatgggttcaactctctcatgagaccttcttaacccatacataaagtagccgttccatcttcctcgctatgcaatctcaatcctcaccttgtttgctagctgggtaaacatgtaaagagcaaggcttttaactacgaggcaggttgtttttctatccactgtccaccca

SEQ ID NO: 13032 - DNA, 730 bp, Populus tremula x Populus tremuloides
  misc_feature (613)..(613): n is a, c, g, or t
  Predicted polypeptide sequence is orthologous to G4
ggggtacgtgtctggttgggaacattcaataccgcagaagaagctgctagagcatatgattctgaggcacgtagaattcgtggcaagaaagcgaaggtgaacttccctgatgaagctccatgtgcttcagcaaggcatccaattaaggaaaactcacagaaacgacttacaaaggcaaatataagccaggattttagttacttgagcaacccagaaacggattataataatatgggctttgtggaagagaaaccacaagtgagccagtttggaataatgaattctatcccggtcaatggagattctggggtgacgcccttaactccttctgacaatgcttctatgtatttcaattctgacaaggggagcaactcatttgattgtgactttgggtggggagaacaaggcgctgaaatcttgtccgttcttgcagcaactccagaagttgatgaatccgtctttgtggcttttgacaatcagttgatgaaccttcaggtgccagatcttgtggtaactgggaggcttctcttgatagcttccttaatggagacacaactcaggatggcacaaacgcattggacttgtggagtttcgaagacttcccctccatggnttgggggagtttattgagccacttttttctgtgcttgctaggttttgtaaataataaggctacatgttagaatggttgtttatctgagatgggaatggagtgcaacacagatgaaca

SEQ ID NO: 13033 - DNA, 812 bp, Populus tremula x Populus tremuloides
  Predicted polypeptide sequence is orthologous to G4
gactcccgaaccccaaaaatattttcacagaagaaaaggaaaatcacaatttgaccactctctctcaaaaaaatctcatttacacccctgtgaagcaaaccaccagcatcatcaacctcaagcagcagcatgtgtggcggtgctatcatctctgacttcatacctccgaccaccaccgctcgatcttctcggcggttggcggagggattcgaatggcttggtacgaagaaacccttcaacaacaagaagtactcgaagccagttgttactaatcttgacgatgatttcgaggctgacttccaagagtttaaggatgagtctgatgtcgatgagaattatgatgtttttgttgatgccgagcctttttctttctctgctcctgcttctgcccctgctaagaaacgttctgcacctgttaaatctgctgaattcagtgggcaagctgaaaagtcagcaaagaggaagagaaagaatcagtatagaggaatccggcagcgcccatggggaaaatgggctgctgagattcgtgaccccaggaaaggggtgcgtgtctggctgggaacattcaatactgcagaggaagctgcaagggcgtatgatgccgaggcgcgtagaattcgtggcaagaaagctaaggtgaactttcctgatgaagctccacttgcttcatcaaagcagtcaattaaggaaaactacggaaaccactcccaaagacaaattcaagccagtcattcagttacttgagcaacccagaactgaattataataatatgggctttgtggaagagaaaccaatggttaatcagtttgga

SEQ ID NO: 13034 - DNA, 842 bp, Populus tremula x Populus tremuloides
  Predicted polypeptide sequence is orthologous to G4
actagttctctcattctctcttagaggaaaagtgaaaatcaccatctaaccactctctctcaaaaatcttttcaattacacccccgtgaagcaacccaccggtataatcaccatcaatcaacatgtgtggcggtgctatcatctcaggcttcatcgctccgacaaccaccgctcgatcttctcggcggttgacctcgggctttgagtggcttgagccgaagaaacccttcaacaacaagcacttgaagccagttgttgctgatcccgaagatgattttgagggctgattttcaagagtttaaggacgagtctgatgtcgacgagggattatgatgtctttgctgatgccaagccttttactttctctgccagtgcttctgaacctgctaaaaaacgtgggctccctcgtggttctactgctgttaaatctgctggattcagtggacttgctgaaaaatcagcaaagaggaagagaaagaaccagtttagaggaattaggcagcgtccatggggaaaatgggctgctgagattcgtgatcccaggaaaggggtacgtgtctggttgggaacattcaatactgcagaagaagctgctagagcatatgattctgaggcacgtagaattcgtggcaagaaagcgaaggtgaacttccctgatgaagctccatgtgcttcagcaaggcatccattaaggaaaactcacagaacgacttacaaggcaaatataagccaggattttagttacttgagcacccaaaacggattataatatatgggcttgtggagagaaccacagtgagccagtttggaataatgaatctatccggtcatggagatctggg

SEQ ID NO: 13035 - DNA, 644 bp, Populus tremula x Populus tremuloides
  Predicted polypeptide sequence is orthologous to G19
atccttcaacttaaaaatccttcttaaattcttttcaactgttcttcgtcataaaccctcgtctactttacttccctatcaacagacctcttgtagttttattgtttagctaatttaagaaatatgtgtggcggtgcttttttatccgaaatcatccctcgtaaccgcggccgccgcgaagcagcttcacagttctggccaaactcatgcttcgataaactcggtccctttgagtcctgtctgagccaagctagcaatcaggaggagtcgtttactctcaaacgaccccaaccccaacccgcttcaggggatcatgagcaagtggagaagcccaatgccaagaggcagaggaagaatctatacagaggtataaggcaacgaccttggggtaaatgggcagctgagattcgtgacccaagaaaaggagtccgtgtttggctcggtaccttcaatactgttgaggaagcagctcgagcctacgacagagaggctcgcataatccgcggcaagaaagccaaagtcaattttcctaacgaagatgaacattactcctctcaaaattcaaataccaagcctcctatgtaccaaacccccacttgtcatttctcaaaagggtatgattttgggtacggttctggaatgaa

SEQ ID NO: 13036 - DNA, 834 bp, Populus tremula x Populus tremuloides
  Predicted polypeptide sequence is orthologous to G19
gacaccatttcttccttctctttctctaaagaactggacagacaaaaacatgtgtggaggtgccatcatttccgatttcgtacccgttaaacgtggccggaaaccgaccactgaggatctctggtctgaacttgactccttatctgattttcttggacttgatcatcgttctatgaacaatattaataatggtagcaaaaaagaaaacctatcaaatctcaagctcgctcaaaagccacgccagcccaaccaagtgataacagagagagttgagaagccaagccaagcaacagagcaagaagccggtaaaacgaaggttcagagaaccagaaagaatgtgtacagaggaataaggcaaaggccatggggtaaatgggcagctgaaataagagacccacacaaaggtgttagagtttggctgggcacttacaacacagctgatgaagccgctaaagcttatgatgaagccgccaagcgcatccgtggtgataaagccaagctcaacttcccccctcagccaccaccaacgtccgaggcggcgccgccaccaacctcggaggcggcaccaccacctgccaagaagcgttgcatcttgggtcctgaaacggctgctatggctagttttgagcaaatcttgaactcggagccgtttcatggactggaaccgaatcagacggcggcccagctgacttgtgacggaggtggaagtggtgattataattgtgaccctgtggacccttggatgcttgatgatcttatcaacgtcagcttaattattagtaatataattaattaactcctaatctggctagtgatgcatgcatgtccactgct

SEQ ID NO: 13037 - DNA, 765 bp, Populus tremula x Populus tremuloides
  Predicted polypeptide sequence is orthologous to G43, G46, G1419
ccggggaaggaaatcaaaccttcacttctctcccattctttgaattcaatttccagttttgcagcttcagctctttgtttctgatcttcaatttcaatcctcctccaataagtaccccagaaagcaaaagaaaattagaagagaaattaacccctcttatcaattatggcatcttttgatgaagcttcagctttggaactcattagggagcacctcttgactgactttgcttccatggacagcttaatcaccaatcttgatgatctttgcagtacttccagctcctgtattactgctgactacatcaagactgaatcaacagaattcgatccctttgatcaatcagagcagccacaacccaagctgcagagtcaatctagcatcgaacccaagcctcaagcctcaccaaagtctccaagcactctaagccagagaaaaccatccatgatcaagaacatcgcaatccctccaccagcaaccttgaacatgaccccaaaagcagtacagccggtggtgaacaaggcagatgtttcaagtgaacaagaaaggcattacaggggcgttaggcgtaggccatggggcaaatatgcagctgagatccgtgaccctaacaaaaagggagctcgtgtatggcttggaacatttgatacagccattgaagctgcaaaagcttatgacagtgctgctttcaggctacgtggaagtaaagcaatcttgaatttccctcttgaagctggaaagtctaattctcagcaacctgaacaa

SEQ ID NO: 13038 - DNA, 362 bp, Populus tremula x Populus tremuloides
  Predicted polypeptide sequence is orthologous to G137
caatgtttgcaaattcagaaaagtgttgatgcataatttgtaatttccagaaaccattatataaaatgatggggatccctccctctctcatccttgtaaagcttaataactttttacatgcagttgtccagcttctctcttgtatacaatcttttacatgcatcgatccaccttcttcactaagctgtggtggggtaaccctcggtttctcttgatatttgtgaaagttgtaaccttttgcaattgttggtttgcaggaaagttcggcataagaacctttttcatgttgttttacatggtcataccttggaatgtgattgggacatatgatctcgtaaaaaaaaaaaaaaaaaaaaaaaaaa

SEQ ID NO: 13039 - DNA, 728 bp, Populus tremula x Populus tremuloides
  Predicted polypeptide sequence is orthologous to G147
ttttttttttttttttttaaatagaaaaccactattattatgttaatattgtaatcaaacaaaaacattgtctactaataagaaaatactcaccatataattgataataaatacgtaacaatctctcaagtttgttacttatgcaacacacatgattatgtaaccaatcattgcttacaatctaaacataacccatgatctattcttaatattgaaatatttcattttgtatagttagtgggtatggaatattagtggttattggtgcaaagttagtaatcacaatgttctcctctaccttatcttgaagatattgatttgcagccttcaatattccttccttgttccttagctgttcaatctctttaaacatgatgtccatcttggtcgaacgaatttgataaatccaaatttcaagatgtttctcaagtttagtcaattcatctaaggtcatttcagcagcacaccctccaaacatgtacctcaatcctttttgcaatatttcaatctcttgcttcaacatgttgatctcctccttcgcatccatatcaggctgggtctcaatggcagctggttcgggttgggtcccccggctggacttcatgtacctctcaataagcccttgcatgtttcctttggtggctagttcatagagctttccatgggcgggaaaaaatgaaactccaatttcagcatcacacagcacagagagcttcttggccttctta

SEQ ID NO: 13040 - DNA, 753 bp, Populus tremula x Populus tremuloides
  misc_feature (694)..(694): n is a, c, g, or t
  Predicted polypeptide sequence is orthologous to G154, G627, G1011, G1797, G1798
gccggggagacaaaacggggagagggaaagtggagctaataagaatagagaattcagctagtaggcaagtaaccttctcaaagagaagaaatgggcttctaaagaaagctttcgagctttcaattctctgcgaagctgaagtttccctcattattttctctccaactggcaagttttaccagttttcaagtcatgacatggagaggagcgttgctcggtaccggagtgaagtcggcctgcctggaacaaatgaccaacgctctagatccttggagttttggagatgtgagattgaagagttaaggagaacaataaataaaacagaagcacaacttaggcactttattggagaagatatagcaccgctggggttgaaagagttgaagcaactggagcgacagttaaagacaggggttgaacgtatccgctgtaagaagaaacgagccatctcagagcacatcaaattgttgaagagcgagcaaagagcccttcaagaggagaatgctcgtcttcagaaaagattgcaagagctgcctgatgccaatgtaagctcgaggattccggaaccaaatgcatgcaatgcttttcatcagcaaaggatttttcttgatggatctcaccattaaacaggcggtgaatggtcctttacaagaagctataatcttcaaaaatgaacctcaagtgtggtggttgnggttcgtggtgacaataaattgcctctctttatttgcataaagctttggaggctgatga

SEQ ID NO: 13041 - DNA, 739 bp, Populus tremula x Populus tremuloides
  Predicted polypeptide sequence is orthologous to G154, G627, G1011, G1797, G1798
gggctttttacatatgtattattccctcttttcttatttgggaggcgtctgtgttttttcctgaatttaccaaaagaagaaagagatcagggtttgtgtgatcctttcaattctccgtattgggtctcttgagatttgaaagttcacaagcaatattttccttgtcttcctgcttcttaactgttgcccataaaggtataataatggtgagagggaagactcagatgaagagaatagagaatgcaacaagcaggcaagtgaccttttcaaagagaaggaacggactgcttaaaaaggcctttgagttatcagttctttgcgatgctgaagttgcactcattcttttctccactagagggaagctctatgagttttccagctctagtattaatagaacaatagaacggtatcagaagagagccaaggacgtaggaatcagcggcaagatggttcaagacaatatacagcctgtgaaggaagatgcatttactctggccaagaagatcgagcttcttgaagtctctaaaaggaagttcttaggagagggattggaaacatgttccactgatgatttacaacagttggagaaccagttggagcgaagcttaacaagaattagggcaagaaagaaccagttatttagggagcggattgagaagctaaaaggcgaggagaaaatcctgttggaagaaacacgaggttacgggagaagtgtgggatgcaacaacttgacctctca

SEQ ID NO: 13042 - DNA, 811 bp, Populus tremula x Populus tremuloides
  Predicted polypeptide sequence is orthologous to G154, G627, G1011, G1797, G1798
ttttttttttttttttttaagtctaatgatacgtcaaatatatacccaaattacagtatttaagtacccctgtttacagttgatctcaatcaataatgggtagcttttttaacagacagcatatatatttctcttaaaataatactattgccttaattattgcttgcgcagttgcaatatagcattagcaagagtctaagaatatgaaaaagtttggcctcacagtacgatgggcattcaccgctagtttcttggtgggatgcgctttgttcttgtttctggtggtccaatgaaacaattccgtctccacatccgaaattgaactgctttctctctgctcttcacggggtaaaatcatctctctgttcccatgagactgggccatgactggtgcaccacactcgtcagacagtcttgcattttcagctgccagtagcttctccttttgttttagtagctcaatctgttctttgaaaacctgattctttctcgcacggatgggtgcttacactcctctctaactgttgttcgatctgttgtagttcttcaatagtgcatgatcccaaacattctcccagtagctttcgtttcgaaacttcaagaagctctatcttctttatcatgcttgctgcttcttcctttattgcagcatggttctgttcaacaggctgcttggttggggttgttttcttttcacgtgccttcgataccgttcaagggtctcctggcatactgggagctttgcaaattcattagagctttcctctaggagagaagacaataggggcaaccctcagcatcacaaagaact

SEQ ID NO: 13043 - DNA, 724 bp, Populus tremula x Populus tremuloides
  Predicted polypeptide sequence is orthologous to G158
ttttttttttttttttttagctcaaactacatattcatatgaaaaatatagcctgttaaaatccctcgaaacatacttgttaacttttgacaagcctcgtgctatcatattttcccaaactgttaaatattgcttataaagattcagagccaagctggaggtcaatgaatgctatgttgaagatgatagttagatgaaaataattccagaaaatgcagtaaattgtctctctgcagcttctcgatgcattctagcccaaaagaaacagagcctgagagaaacaaaatccaaattaaaagttttccaagttgattgcaaagtcaacacgtccctgcaatggaaagagggggtgacaaagttgacaggcagatgcaatcagagattggcaaacgaaatagagcctgagtaaaaatattatccgaattatctacctcaagagaaaactagtcgtaaagctaagactcagcaaacactacattaccattggtcattgaatctaactatctgacaaggtgagttgtaaggttgaaaagactgggaaaaaacctaaagcgcatgctgcatagacctgctcctcggggtgcaagaatgatcaccttcaagctgcaaagtagtgaagagctttgcgcacgacgcaggagagcatttttttttcttaaactcatggtctggatacaaggaagtcgagacagaccctccataagaattacttccttgatccttg

SEQ ID NO: 13044 - DNA, 729 bp, Populus tremula x Populus tremuloides
  Predicted polypeptide sequence is orthologous to G162
tttttttttttttttttttacacaacgcgcatctggataaatatatttatttttatatatctttatctgtaatccaacaaccacactttggcataaacaaaattagatatataaaactaaataaacaaagcttaaaactaaacaaaacaatagatttaaaattcattgtaaacataaaccctaaaaaggtaacaggccttttcaacaaagttgttcagaactacacacgccccaattacttccatgagaggcaacgtttgcatcatttgcatgagatgctgacgggttgcctacttctggagcatgtgaagaggacgcaccattgctgctgtctttcatcttgccgtgtaaggtcattcggaagccttcgaacttcttctccaattcaatcaattcttggaggttgagctcttcgactggagcattccaccattaatctctctcattaccttgtattttatccttcaacttgctgcctttttccttattgtcatccagctgctgttgcatttcattatgcttttgtgttagctcttcgatcctcgccctcctatactcctccaagagctcgtgggcgccatagatatctgtgtctgatggattttccagaaaacgatcgagcatattttcaattgaagggtggccgaagaaaacggcttacccccaggtgaaaagacgagaaacgcagcttccgtccccgttaaagtgataagctcgctcagttttttg

SEQ ID NO: 13045 - DNA, 777 bp, Populus tremula x Populus tremuloides
  Predicted polypeptide sequence is orthologous to G175, G877
ttttttttttttttttttgcaacaaaagtaaaataattataacaacaataaataaacgtttgagaatacaaggaaatggaaaattttacatttgaggcccaagaggcagcctactcatgatttgctgatacagtgttggattgttggagaggttcagacaaggttctgtcacaggctccacctttcgttcttctttgggcatcatgaaccccatttcattcccaggatgttgctgcgccaagtatggatgaaggggcataacaggcatctttgggtggccctgacccaagccagccattgcaagattggccaagccaggttgattcattccaaatgagaagccaggcgagggccccagctgctgccttccaggcaggctgaaggatccaaatgcagggggccgctcaaacctagccatgctgttgtgaacctgtgatggctcgtgtctgtgaacatgggtttgaacagcaacagcagcttggcctggggtggcattggaggtgccggagttcatgtggctgctattgcgagcagcgggaacatcgtgattgtgcttcccctcatacgtagtgatcaccgacttgaggtcatgtgatgccctctccacatgctttctaaccgtgcagcctgcactagtgcacttgtagtaactcctaagatttggatttcctttcacaactttctgcccatactttcgccagcgatatccatcatcaagtatatccacctcactggttggctggaccacaactctaagctcgcgaatagctctggtgg

SEQ ID NO: 13046 - DNA, 807 bp, Populus tremula x Populus tremuloides
  misc_feature (652)..(652): n is a, c, g, or t
  Predicted polypeptide sequence is orthologous to G180
tggagaaagagagttccaattacagctacatgtctctttctcaacaccacaagcaatccatgagatgggttttgttcaatttgaagaaaaccaggtcttgagcttcttggccccttcacaatcttctcagatatctcagcctctcaatgctaatactaccacaaccaacaatactcacatggggtttagtcataatgaacagcaggttggggcattggatccaaaggcttctagtgatgagaactgcactggtaatgctagcaacgatggcaacaattcatggtggaggagctcatccgcagacaagaacaagttgaaagtgaggagaaagcttagagaaccaagattttgttttcaaacaaggagtgaagtggatgttcttgatgatggttataaatggaggaaatatggccagaaagttgtcaaaaacagccttcatccaaggtaaatttattaataatctctatggtaattccaatgttaattaatgtcctcactcttacacagattccatgcacacttgaaccaatatttgctatggatggttgttacaattgaatctttatttcatgcatcaccttcaagtttcaatataattagcattacataacaagtactaatttaatttcttgatgcatgctatgcttaattnttttcttactttccctttttctcagagaaagttacgcataatgttttgatttattaacctaggttaactattttagaaacataataatggcattattatagaatatcatagcaaaactcacgaacaaactgaagcaatgatggtcaataatttca

SEQ ID NO: 13047 - DNA, 440 bp, Populus tremula x Populus tremuloides
  Predicted polypeptide sequence is orthologous to G183
ggatggtgattatgaatatgagcaggctgatgaaggagagtacaattacgaagagggtgaaaacatagatgaagaggaatatgaaaacgaagatggagatgactttgccaagaaaattggtgtcgtgttctcatgaaggatgaaagatagttaaggagcagccctactgccttttgctctagttgtgggtcattgacgcccatggtgggttctttggatttgagtaaggggtagttgccacgggtttatttttccttgtagaagtaaaagtagggatatcaagttcctttcttgtattaattgcaagaatctcgttttattgtattttaaactctctgattgaatgagaattttgcttgtgcttggagcatttcactttgcttgcaaagccataacttgtaacagtataaaattaataagaaaactgttactcgtttctc

SEQ ID NO: 13048 - DNA, 594 bp, Populus tremula x Populus tremuloides
  Predicted polypeptide sequence is orthologous to G189
tggtgagggttccagcaatcagtttgaagatgtctgatattccacctgatgactactcatggagaaagtacggtcaaaagcccattaaagggtctccacatccaagaggttactacaagtgcagcagtgtaagaggatgtccagctcgtaagcatgtggagagagctctagatgatccatcaatgctagtagttacctatgaaggagagcacaaccacaccatctcagttgcagagacatccaatctcatcttagaatccctgcttaactagatcatccctaccaacaagaagccaacgaaagaagtgccaacaaacatagctgtgggaaccaatcagatgatcaactcggcttttttctcaaaggagattagtgggtcagttcatttgttcatttgcctgtaaattatgggattcttgcagccctccttttcccccactcttgaacagctttgaacccatccgatgattatttaaaatctgaaagaggaagggatcaagatggtggatttggtatattagatttcaatcgatgtaaaagaaatcgaggtagtggggggggttctattctctctgaatttttatttttttaaaa

SEQ ID NO: 13049 - DNA, 813 bp, Populus tremula x Populus tremuloides
  Predicted polypeptide sequence is orthologous to G197, G255, G664
atgggaaggtctccttgctgtgaaaaagcccatacaaacaagggtgcgtggaccaaggaggaagacgatcgccttgttgcttacattagagctcatggtgaaggttgctggcgttcacttcctaaagccgctggccttcttagatgtggcaagagttgcagacttcgctggatcaactacttacgacctgaccttaaacgtggcaatttcaccgaagcagaagatgagctcattatcaaactccatagcctccttggaaacagtagatggtcactcatagctggaagattaccagggagaacagataatgagataaagaattattggaacacacatataagaaggaagcttttgaacagaggcatagatcccgcaactcataggccactcaacgaaccggtacaggaagccacaacgacaatatctttcaccacaaccactacttcagttgaagaagagtctcggggttctataattaaagaggaaattaaagagaagttaattagcgcaactgctttcgtatgcacagaagcgaaaacccaagttcaagaaaggtgtccagacttgaatctcgaacttggaattagccttccttcccaaaaccagcctgatcatcaccagccattcaagaccggaggaagtagaagtctttgttttgcttgcagtttggggctacaaaacagcaaggattgcagctgcaatgttattgtgagcactgttgggagcagtggcagcactagcacaaagaatggctatgacttcttgggcatgaaaagtggtgttttggattatagaagtttagagatgaaataa

SEQ ID NO: 13050 - DNA, 781 bp, Populus tremula x Populus tremuloides
  Predicted polypeptide sequence is orthologous to G208
gacatcgagtagctaggagtgagatacagcaagagatgggaagaaagccgaggtgctcagcggatggtatgaacaaaggagcatggacacctcctgaagatgaaatgcttgtggattatgtcaagatccatggtgaaggtaaatggagcaatattgtcaaagaaacaggacttaagagatgtgggaagagttgcaggcttcgctggatgaattacctgagacctgatattaagagaggcaacatctcagatgatgaagaagacctcattatcaggctgcataagctcttaggcaacagatggtctctgatagcaggacggcttccgggacgaacagataacgaaataaagaattattggcacaccaatatcgcaaagaaggcacaacactcgcaatctcggaagcagcctagagttgataggaaacaaatagcatcaggatctgaaaatagggcagcagtatcaaatgtcaagaatcagaccattgaatcacagaactgcactactggggtggttgttcccagtactactgcattacaagaaaacaatatggctcaagatcatctagttagtactcttgcaatggcaccatccaacacacatcatgaaaatgaatcatcaagcaaggggttagcatctggggataatgacaatttgtccagcattttgatggattttcattatatgggagacttcttcaagattcttgattcagacttcccaaagttaagtggcctcaatgatataactagtactgctaatcattccactaataccataca

SEQ ID NO: 13051 - DNA, 779 bp, Populus tremula x Populus tremuloides
  Predicted polypeptide sequence is orthologous to G208
gggacttcttgtttcctctttcccaatttgttcttgtctctctcaatctcctcctgctataattcttggagccggtgaagggagggtactggagctatgagaaaaccttgctgtgataaacaaggaaataacaacgggagcttggtccgtgcaagaagatcagaagctcattgattatattaaaactcatggtgaaggttgttggcgatctctccctgtggctgcaggtttgcaccgctgtggcaaaagctgtaggctcagatggataaactatcttaggccagacataaaacgtggtaactttggccaggatgaagaggacctcattatcaagctacatgccctccttggaaataggtggtcattgatagcaggaagattaccaggaagaactgataatgaggtgaagaactactggaactccatttaaagaaaaagctgataaacatgggaatagacccaaataatcatcggttgagccaaattcttcctcgtcctcaaactgagcctgctcctgttcttgctacatcaactactacggggtctaagaatactattaccacaagcaaaccaaagaaatcatcaaatgatgacaatgatagggtttctgacacagccagttgccttgaagatgattgtaagtctttggtgaaacagcaagttgctacttctggttcctcgaacattaatcttgatctcaccatcgcagttccagcttctcctggtcaaaagaccagtttttgggaacgagcaacaaaattgcaatggggggcaaaact

SEQ ID NO: 13052 - DNA, 754 bp, Populus tremula x Populus tremuloides
  Predicted polypeptide sequence is orthologous to G211
ttatggccggggtatttgatgttgttgcaaagcctcctcatttatgagtgaattgaggaacgaaaacacatcgtcggtgccggaattgatatcttgatcggcttctccaataccaagcctttgatcgcctctcaaatccatcccagaagtaccatcataattcagcaaacttgtatagccatgacttgcaataaaatggtctgcatgatactgatcatccaggtgggcattaatgttgttttgaaaatactcattctctctgttgattatgcgaggactgccactagtagcttcttccaaaccagaagaaacaacattcttaataggttcttttaggcgtgcttggtgcagattcgcctccggcaaagaaggttttgattgatcaaaagattgaggattgagaggcttatgggttcttggatcaattccttggcttatcagcttcttactcaggtgcgtgttccagtaattctttatttcattatctgtacgccctggaattctcccagctatcaatgaccacctaaagaaacaacccattgaccaaatcaacacaagtagctagtccaagctaagatcgatctagctaaaatttgttcaaagtaaagtgatatacatttcctttctagctcaaatcttcaacgaagaagaaggtgaaatttaagaacacagatcgtttacaagattcaagcacatgatcattcattgtgaaccagattcatgcaggtttcgagctaaactagctataaactaa

SEQ ID NO: 13053 - DNA, 573 bp, Populus tremula x Populus tremuloides
  Predicted polypeptide sequence is orthologous to G214, G680
ggagaaaagaaagatgcagaggagaaagatggagatgcatcactgataaatctcaacagcaaaacgtgggagtgctgctctggtcatcaagaaggggagaaaaatgctttgtctagatgtgaaaactatggggaggaggggctgctgacgattgggcttggaaatggaaagcttaaggttcgtcgaaccggatttaaaccttacaaaaggtgttcactggaggccaaagaaagcaggaccggaaccggcagctgccagggcgaggagaaaggccccaagaggttacgtttggaaggagaagcttcagtttgatacttgatattgcttgcttgaacaagggaaaacctttgtttttgcatgtaatttataatttcctcgcttgcctatcattccttttatgtttaaattagagtatctgcaacccacaagacttgtcgtgtaagtgtgtgtactatatgtcgacagtggcttatttactttcttgaacccattaccgctgttaagaactcccgttaaatagacgtagataagaacttaagaaccattaagtattgaataggccttccttggccc

SEQ ID NO: 13054 - DNA, 392 bp, Populus tremula x Populus tremuloides
  Predicted polypeptide sequence is orthologous to G225, G226, G682, G1816, G2718, G3930
tgttcatcacaagtttctttcaacttaattatggctgacttggatcactcctctagtgatgacaactctgttgattctagagaggaaaccagccaagattccaagcttgaattctcagaagatgaggaaactcttatcaccaggatgtacaatctggttggtgagaggtggccattaattgctgggaggattccaggaagaacagcagaagaaattgagaagtactggacttcaagatactctacgagtcagtaaatcagggttgtccaagatgattgccctaactgatgtactagagtagcaaaattttgggtggttttgtagcgttcttctaagagcctgcaatatgggtgggtttaggttgtgatcaagatatttgtacaatggttgct

SEQ ID NO: 13055 - DNA, 524 bp, Populus tremula x Populus tremuloides
  Predicted polypeptide sequence is orthologous to G225, G226, G682, G1816, G2718, G3930
ggatgtcccttcaatttcaacacagttaccctccatagactcgaaagattttttttttttcgctcttaattatggctgactcggatcactcctctagtgatgatctctctgttgattctagagataccagccaagattccaagcttgaattctcagaagacgaggaaactcttattactaggatgtacaatctggttggtgagaggtggactttaattgctgggaggattcctggaagaacagcagaggaaattgagaagtactggacttcaagatactctacaagtcagtaaattagggatctaagtccaagatcctgtctgatgtcctagagttggcaaaattttggctggtttgtaacaaaatctggttctacttaggaactgcaatatgggggtttagctgtgatcaaaatatcagtacaatggtttttcaatgcggtaatggtagttaattaatgtttgggaccttagattgtaagatgaaatctgcttgttaatatggtaaattgagaaatttttaca

SEQ ID NO: 13056 - DNA, 647 bp, Populus tremula x Populus tremuloides
  Predicted polypeptide sequence is orthologous to G225, G226, G682, G1816, G2718, G3930
aatataaaaaaagaaaacgtgccatgctttgctattaatatatcggtactccaatcccttcaatactatcccagaagctttacttctattgttttctcactaaattcctattggcaactttgcaatcttcgaagtatttcctccttttcgctatggctgactctgaacattcttcttctgatgaaacttttgcgtattcgagaggtactgtactgttgacactcacttttgtggtctcttcttctttacctacacagcttgttggtaaaaatattaacggtattttgtcccttctaagttttgttaccttttgctgcttatacttgaagtgtttgttcacgacaagggcgggtgtttctttgttggactatttgttcaatactatgtttgggttcattgattttgggatgttttgttcagaggaaacaagtcaggaaacaagtcaggaatcaaggcttgaattctctgaggatgaggagacacttataattaggatgtttaatctagttggagagaggtttgtctgttgctcttttgtttctctatttcaatgactttgttagccttcagattcaaaatatttaacctaaagttttaataatttgatcaggtggtctctgattgctggaaggattcctggaagaaca

SEQ ID NO: 13057 - DNA, 737 bp, Populus tremula x Populus tremuloides
  Predicted polypeptide sequence is orthologous to G225, G226, G682, G1816, G2718, G3930
ggagcaccatccttatttgttttgtgttgttttttttttttaatataaaaaaagaaaacgtgccatgctttgctattaatatatcggtactccaatcccttcaatactatcccagaagctttacttctattgttttctcactaaattcctattggcaactttgcaatcttcgaagtatttcctccttttcgctatggctgactctgaacattcttcttctgatgaaacttttgcgtattcgagagaggaaacaagtcaggaaacaagtcaggaatcaaggcttgaattctctgaggatgaggagacacttataattaggatgtttaatctagttggagagaggtggtctctgattgctggaaggattcctggaagaacagctgaggaaatagagaagtactggaacactagatactctacaagtgaatgaagctgtaaaagcacaagttatgctttctttacctctgctagagcaagttctgggtctgtcattcataagcagaagatgatgggttaagttgattctagctgttctgtagctatgctgtgtttcatgcaactgttgtctttgattgctgaaggaactgcaatctttttcttttttttactgcctctatgttctttcttgtgcatcggtaagtcttgatgtaccaaatcttgttacaagaagtggcttgattcattggccatttcttgattttcagataagacttcactcctcctcaaaaaaaaaaaaa

SEQ ID NO: 13058 - DNA, 800 bp, Populus tremula x Populus tremuloides
  Predicted polypeptide sequence is orthologous to G231, G2007
gacaggtagcaatatttgacgagacttactttgtttatttatttgtgtaagcttagctacagtcagctagctagctactccgtgcactatgggaaggcaaccttgctgtgacaaactcggggtcaagaaaggtccatggacagctgaagaggataaaaaactcattaacttcattctcaccaatggccaatgttgttggagagctgtccctaagctcgcaggactccgacgatgcggcaagagttgccggcttcgttggactaattatcttcgccctgacttgaagagagggcttcttacagaagcagaagaacagctggttattgatctccatgctcgtcttggcaataggtggtccaagattgctgctagattgccaggaaggacagacaatgagattaagaaccactggaacactcatataaagaagaagcttctgaagaggggaatcgatcctgttacacatgaacccttacacaaagaagccaagcccgaggaaagctcatcatctcctgctgatcttttgccagaatccagcaacaacaatgatatgcaagaaaacgatggtatcgttattaattcggatgataattcaagatcaccgactgaaaattcttgcagtaccgaggattcgctcttgttagatagtatttgcaatgatgaaatgttactgaatagcttgtggatggatgagcctccgctagctgatgcatcatggaacaaaattattcctccggccgcagaaaatactaacaatgacatgggttatccatcatgggaggataactacaccgggttat

SEQ ID NO: 13059 - DNA, 798 bp, Populus tremula x Populus tremuloides
  Predicted polypeptide sequence is orthologous to G234
ggatatcattaccattcttcccaaggagatataagaaagggaagctaaagctttaacacaaaaacaagagagcaagaatcatggggagagctccttgctgtgacaaagccaacgtgaagaaaggtccatggtctcccgaggaagatgccatactcaaggcctatattgagcagcatggaaccggtggcaatcggattgccttgccacagaagataggcctgaaaaggtgtggcaagagttgtcgacttagatggttgaattatctccgtccaaacattaaacatggagggttttcagaggaagaagataacattatttgcagtctctatataagtattggaagcaggtggtctatcattgctgctcagttacctggaaggaccgataatgatataaaaaactactggaacacaaggcttaagaagaagctcttaggaaaacagcgcaaggaacaagcagcccggcgagctagtctcaagcaagaaatcatgacaaagagagaaataaacgagagcttcatggttcctggggctatccctcatcaacaaagcccttactggccagaggtaccagctctagtcatgaatcaaaaccaagattctcatttgatggatcaagaatccattaggaacttgctgatcaaacttggtgggagattttctgacaataatcaagagtcagccctattcactacagtcaacaattaccctctcgacggttcaagcagacaagatcaagtaccatacacaaactccatagatgtgctttcttcttcggcacccatgcgatcaatggata

SEQ ID NO: 13060 - DNA, 641 bp, Populus tremula x Populus tremuloides
  Predicted polypeptide sequence is orthologous to G259
ggttccaaccatttctttcttcttgaaaagagagagaaaagagaaaggaaaggaccttgcatttctcatgaactgtggagtcgtcttgctgggtttttattgttggggttgggagttcttaacagcccttcttctcttctctgcctcttctccttagaaatcttgtaatatcatccaataatctccttttctctttgttttttttttcatttctcctttttctttgaataaattcatggcaaatgacaagggtttattaaattatgttagaaaatcaaccccgccaccttttttattaaaaacctacatgttagtggaggatctggcgaccgatgatgtgatatcatggaacggggaggggaccggatttgtggtgtggcaaccggcaaagttctctcgtgatctcctaccaacactcttcaagcatagcaatttctctagctttgtccggcaactcaatacttatgtatgtattaaagtttatactaccctttaattttttggttcttgattctgcatggtatatattttatctattcaatattcttaattgtttttggtttagttgacttagttcttaattaaaaattcgaatcgatcatcttcttggttttatttttttctccttcttgaatcttttt

SEQ ID NO: 13061 - DNA, 888 bp, Populus tremula x Populus tremuloides
  Predicted polypeptide sequence is orthologous to G261
gtttaataactgtatggttactactgttaacaaggaggcaaagctacacaggagtctgcgactctgtaaccatgcaagctataatacaacttaatattgacaagggaaacgtgatatgaaacaagagatcacaaatataatgcaacctcattgaaccaatcattcctaatttattacatgtgtgtccctgaggcatcagaagttgagaaaattatcaaccaaagtcaagttctttcagcaggagtaagatgccccatctgctctgtaagattatttacattcctcatatcccaccaaaattttctgggatcaccaggttttatttcattttttctaccatcagaatcctttctttcagattgaacttcctgtgtgtcagttgaaccaggattctcagttaaaaaccgttcccagaatacatcgttgactccagttgccacggcgggagcagtcccagcaggttgttctttcggtgaaacaggctctggcacaacagctatagaaggttcagaattcatgtcaataccaggtgttttagggcgaaaatcaaaaatgagttgtgcacaagatatagctggactctctgcaccacttgtagactcatccatctctatcgttttagtgttatgactgtgggtttgaacaacatcatttaccatattctcccagagtgtcaggggatgtttccaactgctcaaactgctccatgtttaacagggcaaaagaattaccatctgcattttctctaaacagagcttgggaagtcaccgtctgattatcctcattactactggcttcaatgtgtagacaaccaattctcggcagccttctctttctatcatgaccttccaactgcggcattagatttaaggcaggacctggcttagg

SEQ ID NO: 13062 - DNA, 604 bp, Populus tremula x Populus tremuloides
  Predicted polypeptide sequence is orthologous to G263
ttgcagacccattttgccttcggtcttcaacccccacctagattatacattaccattccatccttattattacactaataacaattacaacgacgaactactacttgctataataataacagtgaagtagatccttctgtctactccttttacggctaaaaacgatcagcttcgggcgggcgggcgggcgggcgggccttgaccatgcacaccaccgatttcttcaattacagatcttgatttcctttgcacggggccccccaagccccattttctcatcacggcccctctttttcttggttcgacacttcaacaaaaccccaaacaatttcaagccccccccttccccaccgtaaccatcatgatcgggatgggcatgatcagtgtcatcactcgtattttcatcatcatcatcatcatcataatcttcactttgattatcgccagcatcggcctcaccattacaagtggaccgaccacatccaatgatgcgattgatttgatcagggctcaccttaacatactccgtcaaaaaattagtcaactcccggcattgtttcttaggttgctcgagttcactgctcaggacgtcggtgtctttctt

SEQ ID NO: 13063 - DNA, 790 bp, Populus tremula x Populus tremuloides
  Predicted polypeptide sequence is orthologous to G274
tttttttttttttttttttataacaaaccattaaattacattaatccaaagatgtgaatgtcattaatgaatctaggtggaactctcttgatgctctttaaagcaaaagatgtgataatcacactgcaaaatcactttttaaacatggtaacagcatgtttaaaagccaagaaagattttttattaatcgagaaaataatgatgcaattggtaggtgaagctaacttatctacattctataactatatcaaatgaagaacgtaaatcggtaaactaacaattctgcagaaactgcattccttagctggctggctggctggaagctagatgacccatctgcagtaatctgtaggatctgactaggaaaggttgagctcttcctgttacaatcacctccctgatataatccaaaaacacttgttcactgtgatgaagtgctattgttttcgcctgcaacccagtattgtttgacggtgaacaacactttttctgacagaagcggtccgtcctcatgatccaccattttcgctttccatctcattcctcccacaattctcctcaccttgataagcacatcaactttatcacggaatatgactgctccttcaggccttaaaatgcgatccatctctagaagaatgtcttccatattgcacttgtctttatacaagctgaaaacaccatttgcatgaataagatcgtatgtccttgggtaagtggagaatgcttcacaccaatcatgatatatgccaatcaagccacgctcatatataacacccaaagtgtcttt

SEQ ID NO: 13064 - DNA, 678 bp, Populus tremula x Populus tremuloides
  Predicted polypeptide sequence is orthologous to G274
ggaggatttgctgctgctcttgagtctccaaaattgtgggttatgaatgtggtgccaaccatagctgagaaaagtactctgggtgtgatatatgggagaggattgattggaatctatcatgactggtgtgaagctttctccacatacccaaggacttatgaccttatccatgccagtggagttttcagtttgtacagggacaagtgtgacatggaggacattcttctggagatggatcggattttgcgaccagaaggtgcagttatattccgtgatgaagttgatgttcttgttaaggtgaggaagatggtaggaggaatgaaatgggatactaaaatggtagaccatgaagatggccccctagttcctgagaagattttggttgctgtcaagcagtattgggttggaaactcaacctccgctcagtgaatgatgaatggcaattggtgaaaccttctctcgtctttagctggcaatgcttcgttgtacaagacatgacatgtatggatatgtttaagcatgggtttttgattccttggggagtacggcggagcataggagggggggggttctacacgatttaaccgtataatgttttactagccattaatagcccatgctgtattctagtggtaatttatggatgcctccgaacctgtaaggtttttgacatcaata

SEQ ID NO: 13065 - DNA, 780 bp, Populus tremula x Populus tremuloides
  Predicted polypeptide sequence is orthologous to G274
agttttggtatccatgatttataatattattttttagggtaaaatggatccatggtccttcaagttccagagaattgtggtatttgctcctctaattcaactttaatcacaccatcctttgttggtgctaagctacagtgctgcaacctcggacaacaatgaacccagagattctttgacatttaaagtcttggcaaaatggaataaactgaatattgtctgtggttgaccaagaaatataatcttcgatggtgaaggacattcttcttgtcatcagtattgcattcgtgaagcttgatactttaactgatcaagccactaagttgtgcacatgctccacatcaacaacaacagattaataacttaaatcagaattcttcagttcagcaatttaatcacttgcttggcattgtaattgctggcataattttgccctgaaaacaatgactaccggattatggatcgcttgatgtgctgtttcccgtgccaccgacccagtactgtttaaccaccaccagtatcttctcaggtacaaggggaccatcctcatgatccatcatttttgtatcccatctcattcctccagcaattttcttaaccttgttcatacatcaacctcatctcggaagatcacgatcccttcaggacgcaaaatgcggtccatttcgagaaggatgtcttccagagtacacttgttctggtacaaactaaatacaccattggcatggataaagtcatatgtccttgggtatgttgagaccccctccaccagtcatgata

SEQ ID NO: 13066 - DNA, 564 bp, Populus tremula x Populus tremuloides
  Predicted polypeptide sequence is orthologous to G274
ctgttcagaactgggttcaatttcagggtgatgtattcaaatttcctggaggagggaccatgttccctcaaggtgcagatgcatacattgatgaacttgcatcggtgatccctatagcagatggctctgtcagaactgcactagatactggttgtggggtagccagctggggagcatacctgatgaaaagaaatgtgttggccatgtcatttgcaccacgagacaatcatgaagcgcaggtacaatttgcattggagcggggagtacctgctgttattggggttctaggttcaatacatcttccatacccatcgagagcctttgatatggcccagtgctctcgatgtctaattccatgggccgcaaatgatggaatgttcttgatggaagttgaccgtgtcctcagacctggtggatactggatcctttctggcccgccaatcaattggaagacctactaccagacatggaaacggtcaaaggctgatctccaagctgagcaagaagcgattgaagagctggctgaaaggtctttgctgggagaagaagtatgagaagggagat

SEQ ID NO: 13067 - DNA, 826 bp, Populus tremula x Populus tremuloides
  Predicted polypeptide sequence is orthologous to G275, G837
ttttttttttttttttttttaccattaagcaatttgattgatttggaaaaaaatatccatgacaagtatacagccaacatccctagcaaaagaattagcgagggatgattaaaacaacattaacgatcattaggagaattttaagaataacaaactaattaactataattttacaattgctcgtggagaaatacagctaattgatactaaccctcgaatgcctaaagatggcagaaaaatacctggacgacatcaacacaagcagctaggcaccctcaaatggaaggtacaagctgaagcttcaggtttatataatggctgactttattgtttctggctctgtaggacgccacattgtcttgtgaacacaaagcagtccctcattgtcttttgagtaaatcatccggatatcccagttcagagatttggccaggctctcaatctcaccaatgatttcaacattgtcacgcacgatcagatttccttctggcctcagtatcctgtcaacttctgctattactgccactaagttgcacctcttcgtgagactggaaaagagatgatcggcatggagaagatcgtaagttctaggataggtgttgaatgattcgcaccaatcatgatacattccaaataaaccacgctcgtaaattattggaagcgtgtctgcagagtcaattgggactacattcataacccacactttccaatctttcagtgccgcagcgaaccctccgtatacagctctcatgtccatgatatttctcacagaaggacagttgattcccattccattcaaataagatgggggaaacaacatttttcc

SEQ ID NO: 13068 - DNA, 776 bp, Populus tremula x Populus tremuloides
  Predicted polypeptide sequence is orthologous to G275, G837
ttttttttttttttttttacttgtttcaatatgatattccaaaactttgattttcgtccagactactaacaattggactttacacttaaagaatgtatcgtcttttagtaacagtattacaacgaaaactgtgacaggaattttgggacaggaatcataaaaccaaaagataagtgaaaatgttggatggtgacgagcctaattatcattggacatcagctaacatggagatacagacagttacaagaattgtatttagcaaccggagcaaaatgaatacctaagctcactggcaacagtaataccaagaatggaagtgccggcaaccgggctggaagcatgcttaagcaatagcatacgtgatcgtctctgactccttgggtcgccacatggatttctgaacacacagcaatccttccttgtccttagagtaggtcatactaaccttccactgcatagaccttgccatgttctccagctcgttaatgatctccaccttgtcccggacaatgagcttcccttctggcctgagtattctatcaacttcagcaaatacagccgccagattgcacctctttttaaccttggagaagagatggtctgcatggagaagatcataagatcttggataagtgttaaatgattcacaccaatcatgataaattccaaaaagcccacgttcataaattataggtagagtatctggtgaatctgctgtgaccacattcatgacccacacattcaagtccttcagagctgcagcaaaacctccataa

SEQ ID NO: 13069 - DNA, 796 bp, Populus tremula x Populus tremuloides
  Predicted polypeptide sequence is orthologous to G278, G1290
tggtcgttaattaggaaatagctgtttagtgtttctaccaagttcgaaagggagaaactaaaaactatttccctttctttctggataaccaacccctgatgtgtgtttacaattcggaagatacagaattcaaggtattattatcaaggtaaacattaaaaccatatcatacaggagaacaggattgggcctaatgaccaccacccttgtcactaagcttcccattagacctcgccgtgccaattgacttggtggatgatgaagatgatatgacagacctgtcgaactcttgtttatcttcatcgaatgccttgcttagagcttcctggagttcaaggtgtctctgtctcttcacaagtcgttcctctgaagtttcattccctaaataagctatctgtgataggtcatcagcatccatgatcttgttgagtacgtctgagcaacgcgggaaaaaccgtttcccaagttccactgttctagagagtgctctcatcctatttagatgctcctcgtgcattctgaaaggtgcctcgttcaagtccacagctcccctttgtgcaccagacaagatgctgggcctgatgccagctaatggtaactcagaagtaccatcaacttgagcaatatccatcgcaacttttgcttccatgggaaaaaggagttttgccagtccaactgaaagaacaataacatcaatcttcatattctgcgttttgctttcattcatcgtagtcattaagcaatggaaacaggatttaaaaccatttcaagatagataactgattaccccggccat

SEQ ID NO: 13070 - DNA, 706 bp, Populus tremula x Populus tremuloides
  Predicted polypeptide sequence is orthologous to G291
gtttttttttttttttttttttttttgaagggcgataattttttttttcttgagctacatagcagggaccaagccagaacaggaatccaaatggttaatgcaaacccaatttaataaatgttcaaaagagatagtaatcccaagcaaccattcttcaaagaattaacatcaatcatgtttcaaccattggctcagggccggatgtctctgcacgagatctatttgattgacgaacagagttgaaaaggatgtccttgataacctgtgacatgagaccatggacctgctccacagttatcttagcactatcacgagtaatttttgcaagttgagattcttcatctttctttctttgaggagccattaatggtcccaatcgagaatgtgacaattgattctctgcatgctccagcttctcagctagatcagaaatttgccccgcaacatagtctccattgcccaagagaggtgaagatgaaagtgtatttacccagtatttgttccacaaaagatccagaggtggcaatcaagagaagacttgaaataagttatatccaaagcataatactgtttgcaatgactccaagtcctcatcttattagaggatagtttggtatcagaacaggatctctgaggctggatcctctggaatgtctgatgcccatctcacttccgctgacagtctggtgatcatacactgcaaacc

SEQ ID NO: 13071 - DNA, 364 bp, Populus tremula x Populus tremuloides
  Predicted polypeptide sequence is orthologous to G312
gcaagagtcttttgcctccgtacgtctttccaaagcttgaagatggtgattactcttacccgccagcaagttttgaagatcatgccttttggtgctggtcatactaagttgcacttggtttataacatggtttctgtgtctttcttcttgtttacagcttgttaatcattaagcaataatcccaatccaaatgcggtgttgggtactggttgtagttggaaatgatggtctttgcccctcctgtaatcttgtttttgctggggtactctttgtttgagttagatggagcttttccgaaccgattgtaaatgaatttcccttgcaatttgtatgggaaggtaatgcatttcttgtattcgaaata

SEQ ID NO: 13072 - DNA, 257 bp, Populus tremula x Populus tremuloides
  Predicted polypeptide sequence is orthologous to G326, G1337
aacgttacaaggagaagaagaaaacccgaagatatgataagcacatacggtatgaatcaagaaaagcgagagctgataccaggaagcgagtgaagggtcgatttgtgaagacaactgaagttcctgactgttgaattcatgcttagttagaggtccttgatatcactgtaaatattctttacgttcgtctcgtagagaatgtataatttagtggtgcttgtctccgcatcaggaaaaaaaaaaaaaaaaaaaaaaaa

SEQ ID NO: 13073 - DNA, 672 bp, Populus tremula x Populus tremuloides
  Predicted polypeptide sequence is orthologous to G328, G2436, G2443
ttttttttttttttttttacaaaatagtagcagctttactgcatttagtgaaactactaagggcatcatatctcattgatcaagaccaattagatttagaaacataagagtatgatcagtactagatcattagtaataactaatacaatcctcatctaaggagatttttcttcttcttcttcttccttctctctggattcagaatgatgggacaatgccatatcctgtttccgccattagtgtggaggagaacatttggtcatcttcgacttctgcatcttttctctttgcaaatcggccttttatccggggtctggtctctgcataggccttccttgaggcatacctgattgtcttctcaaacttccttgtcttctttttctctctgtatctcaggactcttgcctccctatccattggactaagttgaggtggcatctggatagcagtgctggagaaaagttcgagtgtcccttttggagttctatgttgcgagattgagatctcgctcactgttgattctggcaccactccaacatccatggatgacatggatacactttgactgatcgaaccattgtagctgtaagcagcttttgagggctcatactccaatcccaactgaaaattgtgatactgccgttgctgttgatgatcctttccttctccata

SEQ ID NO: 13074 - DNA, 375 bp, Populus tremula x Populus tremuloides
  Predicted polypeptide sequence is orthologous to G343
acccggaatatgtcttcgaaagaaattaaagccagattcaattactaacaggctgcactactaatctgcctattttgcagggttttttaacaataaaaaaagagaattctgataacaataaccaccagtatactgtactactgactaccttgagaccgctaagatcattacacgttagcaaacttcataaccttgataaccgtgctgttgctgctgcctcagcatcatctctttctgtctacggagctccaacacttgacggtgcgagttcgaatgctgagtgggcacaaaagtcgggctcgctgcgggtcggtattcgggtacgagccgacccgacttgtacctcactccacaagcattacatagcgttttcgg

SEQ ID NO: 13075 - DNA, 743 bp, Populus tremula x Populus tremuloides
  misc_feature (680)..(680): n is a, c, g, or t
  Predicted polypeptide sequence is orthologous to G351, G545
tccctcctccctgtctctctcaatacctttcttcctctccttggaaatcttgttcgtttgtacccctcgttgcccactcacacaagaaaaactcagtatcaagaatccaaatcatggctcttgaagctctgaactctcctacaacagccgctcctttaaattatgaagaaacatggattaagaggaaacgctctaagagacctcgtagtgagtccccttcgaccgaggaagaatacctcgctttttgccttatcatgcttgctcgtggcggctccactgccgcaaccgccaaaaaaaccgcttccgcctcccctgcaccaccccaaccaccaactttggatctttcttacaagtgtacggtttgcaacaaggctttctcttcttaccaggctctcggcgggcacaaagccagtcacaggaaatcctcctccgagtcaaccgtcgccacagccgctgaaaacccatcagcctccaccacaactaacacaaccaccacgaccaccaatggtaggactcatgagtgttctatctgccacaagactttccttactggacaggccttaggcggacacaaacgttgtcactatgagggcacaattggaggcaacaacagcagcagtgctagcgctgcaatcaccacctcagacggtggtgctgttggaggcggtggcgtgagccanagtaagagtcaaagaagcggtggtggatttgactttgacctgaacttgcctgctttgcctgaa

SEQ ID NO: 13076 - DNA, 644 bp, Populus tremula x Populus tremuloides
  Predicted polypeptide sequence is orthologous to G351, G545
cccctgcgcgggagagccatgggtaaagcgcaagcgctctaagcgtccacgactcgaccaccagcctactgaagaagaatatctcgctctctgtcttatcatgctagctcgaggctccaccaatctccaattctccacttcaggtcaccagaagtccctcaccccatcaacagtattcacatcttcagagctaaaaaatagttacaagtgttccgtatgcaacaaggagtttccttcataccaagccctaggcggtcacaaggcaagtcacagaaaactcgctggaggcggcgaagaccaaactacttccagtacaactacttctgtcataacagcaacaaaaaccgtatctaacggaagcggtaaggctcacgagtgctccatctgccacaagactcttcccaccggacaggccttggggggtcacaagaggtgtcactatgaaggcatcataggaggcggcgaaaagagtggtgtcacttcaacttctgaaagtgctggatctactaacactcgcactcatagccacaacgaatttgacctcaatgttcctgccttgccagagttcccttcatttttctctgtatctggtgaagatgaagttatgagccctctaccggcagcgaaaaagcttcgtatttcga

SEQ ID NO: 13077 - DNA, 576 bp, Populus tremula x Populus tremuloides
  Predicted polypeptide sequence is orthologous to G353, G354, G2839
gtttacatgcaaaacatgtaacaggagtttctcttcatttcaagcgttaggaggccaccgtgcaagtcacaagaaaccaaagcttgcgggatcaactgggaacttgttaatgaagttgcccagttcgcctccaaagccaaagaatcaccggtgctccatttgcgggcttgaatttcctatcgggcaagcgctcggaggtcatatgaggaggcatagggctgataatattgatgctaccagtaacagtggtgataatgaactggcattgacttatccacctttcttaccggccgtcccagttttgaagaaatcgaatagcagcaagagagtcctgtgcttggatttgagcttggcactgcctatggaccagaatgagtcggagttgcaattaaggaaggccagcactcaacctgtgttgaaatgttttatctaggctttaattcttaatagattttttattttttttattttttttgttcatatacgccttctagctagtacgactacgtagtcgggattatttactaatcagattcattcagttcttttccaaaaaaaaaaaaaaaaaaaaaaaaa

SEQ ID NO: 13078 - DNA, 693 bp, Populus tremula x Populus tremuloides
  Predicted polypeptide sequence is orthologous to G353, G354, G2839
gattccatcttctaagcaaatccaacatcctctccacatttgaaaccaaagaataacaaaacccttactgttcatattcttataccatgaagagaggtctgcatgagagagagattgatagcataaccatggctaattgcttgatgtttctatctaaaggaagggaatcatattcttttccttcatttgatcataccatgagcaatctttctcctgctcgtgtttttgagtgcaaaacatgcaataggcaattcccgtcgtttcaagccctaggcggtcaccgtgcaagtcacaagaagccacggttgatgggaggagaagggagcttcgagactcaatcgccagcaaagcctaaaacgcacgagtgctctatttgcgggctagagtttgctattggacaagctttgggtggtcacatgaggagacatagagctgccttgaatgatcaaaaccaggtggatcctctgaaccctcctatcactgatgatcaaaaagcagttcctgtcgtgaagagatctaatagcaggagggttttgtgtttggatttgaatttgactccttatgagaatgatatggagctgtttaagctcggaacgacagctcctatggtcaattgtttcttttagatcttacgtgtactctcatgaaactatctatagcctaggtttttcccctttcctttcgttcttcctg

SEQ ID NO: 13079 - DNA, 654 bp, Populus tremula x Populus tremuloides
  Predicted polypeptide sequence is orthologous to G355
atcgatgataccctaattttacaggaaaaagaatagaaatacaacaaaacaaataaatgaatgtgattggtacaaaatcccaactacatagtagtggaatttggtaatcattaaggagagaaaaaaataaatgaatgtccaaactccgaattaaggttagataaaacatctcaacatgggatgagcgaccttctctaactgcaactccgagtcattctgatacataggcagggccaagctcaaatccaagcacagaactctcttgctgctattggatctcttcaaaactgggacagcttcgggtaagaaaggcggttgagtcacggcggccaattcatgatctttactactattactggtggtatcaacattagtaggcgccctatgtctcctcatgtgacctccgagtgcttgcccgagaggaaactcaaggccgcaaatggagcactggtgagtttttggctttgaaggcgaattatgcagcttcaacaagttcccagttgattccatgagttttggttccttgtgactcgcacggtggcctcctaatgcttgaaatgaagggaaattcttatcgcatgttttgcatgaaaatgagcgaccggccccggccctggccccggcgccggcccctgccgttgctgctgctgctgg

SEQ ID NO: 13080 - DNA, 523 bp, Populus tremula x Populus tremuloides
  Predicted polypeptide sequence is orthologous to G363
ggaaaggtatgccagcctggcatcgttgcctctacatggatcctcattccgatccctaaggatagaggcacattcttcagtgcaccagaactttgcaccaccagtaaggtcgctagaaataagcagcagtgcaagatttgatcaaggttatgcaggtctgccggtattcatggaggatgatgaggcagagttgttatggccaggtagttttcgacaggtagctgtggcagacgatgctcatcaaagttttgtagtcgccggaagttcaaacatgatttttttgggggcaactccaccagtgaacttagatgattctgcgccagatctcacactaaaactttgagaacattggttgcagtatttatgctccgatattatctcttgtatagcaagttgtgcaatggaccatggctgaacttttatattccctgctaagaatttgtatgtcagtgtataagagcttcacggagattattctggagcttcttcgtttgttatatctatgtgattgatccttttaatt

SEQ ID NO: 13081 - DNA, 362 bp, Populus tremula x Populus tremuloides
  Predicted polypeptide sequence is orthologous to G366
ttaaatgcaagacggaattttattcataaattaagtacaagaccaaagaaattaattagtaaacagtaaaactacacaaatttaaatgttccaactgggtttcagaccaaattggggactaaatctaccaaaccattaacgatgttcatggccttgaaatcaaacagaaggcgacgaatgaacattcccatgtatgtaaactgtaaaggaactatatctttcaattttatgctgcatatataaaggcccagcgggtgctaataaaccacctcagcaacagccagacatattggccatgcctttcctaccctaccccttctcctctctcgcaaaccatatatagatatcatcaccgacaatca

SEQ ID NO: 13082 - DNA, 547 bp, Populus tremula x Populus tremuloides
  Predicted polypeptide sequence is orthologous to G388
tttttttttttttttttttagtttataaaaaaaatataaatcacattcccttctcattctacaaagtgccataaatgagatttacccaaactgcaagcccttaacttaaaagttctaaccacaaacaaatataacatacaaactgatgtaagaatgtccctctactttagatataaaatttggacagaggggaaaagcagaaacctgatcagtcttacagttaatttgtgtctatctaacttataagctaatgtaatcaactatcttcacattgcaagcttgtcttgatgtttttcagtgtgcatgatataagtgcgttaacagaatccacagattccatggttagtttggctgtgggagaggtattcgttaggatttggaatgctattgttagcaaacatcccccttcggtgctcttctcctcttgcctagaagtgatcactaatggtcttgattcgtgtccatcaggaagaagtgagaatcctgaaggtaatattgctaggttgcttgaatacatccattaatcacagattgcattccattagtg

SEQ ID NO: 13083 - DNA, 594 bp, Populus tremula x Populus tremuloides
  Predicted polypeptide sequence is orthologous to G390, G391, G438
aacgtcgtacgcagctccatgtggggccaagacgcttcctggctctcctgagctcttactttagcacaatggatatgccgaagctacaggatccatactggaggagaactatttcgggttgactcccaagctggcgatgctttgctgaagcagctgtggcaccattcagatgcaattatgtgctgctccttgaaaacaaatgcatctccagttttcacttttgcaaaccaggccggacttgatatgcttgaaactactcttgtggcccttcaagacattatgcttgacaagatccttgatgaagcaggacggaagattctctgctctgagttctctaagataacgcaacagggatttgcttatctgccagcaggaatatgtgtatccagcatggggaggccagtctcctacgagcaggcggttgcatggaaagttctcaatgatgatgattccaaccactgcctggccttcatgttcatgaactggtcctttgtgtaatggctgagaaagatgtttagagaccttggctatctattgaatagttactatctatttaagttataattcccttctttgttagtctacaaagacccc

SEQ ID NO: 13084 - DNA, 641 bp, Populus tremula x Populus tremuloides
  Predicted polypeptide sequence is orthologous to G390, G391, G438
catccatgttattacagaatgtacctccggcaatacttctcagattcttgcgtgaacatcgatcagaatgggcagacagtggtattgatgcttatgcagcagctgctgttaaagctggtccttgtagcttgccaatgtctcgggctggaaattttgggggtcaagttatcctccccttggctcacacaattgagcatgaagagtttatggaggtcattaaacttgaaaatatgggctatcgctaggacatgctcatgcccggtgatgttttcctgttacaactctgtagtggagtacacgagaatgctgttggcacctgtgctgaactcatctttgccccaattgatgcctctttttctgatgatgctcctattattccttctggtttccgtatcattcctcttgattctgggatggatgcctccagtccaaaccgcacacttgacctcgcatctgctcttgaggttgggcctgctggaaatagagcatcaggtgatctttcaggtcgtagtgggtgcacaaagtcagtgatgacaatagcattccaatttgcatttgagatgcaccttcaagaaaatgtggcatccatggcccggcagtatgttcgtagtattatagcttctgttcagcgggtagcatta

SEQ ID NO: 13085 - DNA, 694 bp, Populus tremula x Populus tremuloides
  Predicted polypeptide sequence is orthologous to G390, G391, G438
tttggccggggtcttccctggaataaaaacaaagatgcgcatgaggcattgaccacaaatcgcactctggatctaacatcaagtcttgaagtgggcccggtaacaaaccatgcttcagtggatggttcatcatgtcatttgcgatcagtgttgactattgctttccagttcccgtttgagcagcaatctacaatataatgttgccaccatggcccgtgagtatgtccgcagtgtgatttcatctgtccagagggttgccacggccatatctccatcaggattgaatccagctttgggaccaaagctatctgccggctcccctgaagctctaacactggctcactggatctgccaaagttattgttaccatttaagagcagaattactgagatctgattctgtgggtggagattctgtcctgaaacatctatggcatcatccggatgcaattttatgttggtcattggaggcactaccagtgttcatctttgctaaccaggcaggacttgacatgctggagacaactctagtggctctccaagacatcacactggataagatatttgatgaatctggacacaaggcattgtttacagacttcgcaaagttaatgcaacagggatttgcatgcttgcctgctggaatctgcatgtcaacaatggggcgtaatgtatcatatgaacaagccgtttca

SEQ ID NO: 13086 - DNA, 779 bp, Populus tremula x Populus tremuloides
  Predicted polypeptide sequence is orthologous to G390, G391, G438
tttttttttttttttttttttttagatcgtctcgtccacaatctctacgataatgaaccccacacaaatttataacatagcaaatgaactaggtgctccacggttgtaacatgttatacatagaagaaatacaagccagcaaaataagacaggtatagagttctcactcttaaatcagccactccactagattctggtttcaagtctcagacaaaagaccagtttataaacataaagcagaagcaatgcgcattttcttcttcattcaacactttccaggccacagctctttcatatgaaactggtctgcccatgcttgacaaacagataccaccttgaagacaagtaaaaccctgttgcatgatctgtgggaattctgagcagagagtttttcttccatgatcatcaaatatcttttccaaagttatgtcttgcagtgcaactaatgttgtctcaagcatgtcaagtccagcttggtttgcaaaagtaagacgggcaacaccttcagtgagcagcacataatggcatctgaatgatgccacaaggttttcagaatagattcacttccttcgcattggatttgagtagctcacacccaatagctcctgtactctggcagatcaacagcaagtgtctgtgcttaggagtacccagtggtgaccgagacagcctgtgaccagatgagaagagatagtgctatgcacctctgactgagatatatgctgcgattattgccagtcatgatgcacatgtcttgctgtgctctcatgcaatcaatg

SEQ ID NO: 13087 - DNA, 593 bp, Populus tremula x Populus tremuloides
  Predicted polypeptide sequence is orthologous to G390, G391, G438
aaaggataagcttaaactttcataaataaagtatagagcagaatgcaaagagaagagcaacattaagaaaaggggccctacacaggagatgggcaacaaaaaacgggggcccagatgccattgctgcatcatgctcattacagtatcaagggacttcaaagcttctgaaccagttccagtttgttctaatctgtttactttcaagatttatgttttgtccgaagcgtcacacaaaagaccagttcatgaacatgaagcagatgcagtgagcgctttcttcttcgttcaataccttccatgccactgctctctcataggagactggccttcccatacttgacaggcagataccacctggaaggcacataaacccctgctgacagcaatttgcaacagggtaacaacaatacttgataaaatggaggaaaacagttacttttcttttagtggatcaacctgggatgaaaacaagtattagctgctagctagtatcaaaggaaccaactttgttagcacataactctaaataaataaaggaccttcacaggcagccagtaaggggattttaattttaattcaacatttttagtttg

SEQ ID NO: 13088 - DNA, 274 bp, Populus tremula x Populus tremuloides
  Predicted polypeptide sequence is orthologous to G394
gggggaatacatatgaagttctcaattcatatttggtgcctttcaaggttacatgacaagttagtgcagcagagtatttatctgtggtttattgtttcttccatttcctccattgataagttcttaataatcttttctcatgtccaagcctccagcatataactctctgcgttgtttcttctctctcgtgcaaatcaccttgttgcccagcaactatttgcctgtttttattttctcccccttgaactattatttcttcctgtcttttgctttt

SEQ ID NO: 13089 - DNA, 382 bp, Populus tremula x Populus tremuloides
  Predicted polypeptide sequence is orthologous to G394
attcttgaagaagtgctgtgaaacactaacagatgagaataggaggctacagaaggagctccaagaccttaaatcactgaaaatggcacaacccttttacatgcacatgccagcagctactctcaccatgtgtccatcttgtgaaagaattggtgcggttggtgaaggggcttcaaagagcccgttctccatggctacaaagcctcacttctataatcccttcactaatccttcggcggcatgttaatgaaggttcaggatatatatgaagataaataaaattagaatatatatagaccaaccccacgatccctctaatggggtttgttaagagcttgtagtaaaagattaattagtgtaattaattattttgtagaaaata

SEQ ID NO: 13090 - DNA, 795 bp, Populus tremula x Populus tremuloides
  Predicted polypeptide sequence is orthologous to G416
tgttgtaaactgggaaaattcctttggtctgagaacagattcgtaaaatattccaattttgaagaataaatgattgaaaagaaaattcatctcgaagcatatgcaaatgaaaaattaaacacagttaacacatccaccagattcttttggttgaactttacattgaaatgtctttgagcctatcctaattctcaacttcagtagggaaatattgaatcccatataaaaatttgatcagaatttcctagaaatatcagatagctccaaatctggtaaaattttcaaacatagatactcatcaaaattcatgtaacaggattagaagaaagggggcatattcattcaagcatccaacttcttcctggaataaatttgttagtacaaggcatgcttcaagaaaatgaaccatctcccaccaacaatttgaaaacaattatatttcacctttatatctttcacataaaattttctcactgattaagaagtggttagattttaaaaggattccttaaaccataggtttgtaatcaaaagctgaaagtaactagcagatgttctttatttttcaaaggaatcaaaagctgaaattaactagcagatgctctttatttttcaaaggaatgatgtgtaagaaaatctctttaccttttacctttccaaccttctccagagtaagcatctataagattctgctccagcttcattttaatcatcaagtaccttgctctcctctgcaagcgtgatggttcatctagctttaccttgtccttttgccttttcttaggcttcctcttc

SEQ ID NO: 13091 - DNA, 741 bp, Populus tremula x Populus tremuloides
  Predicted polypeptide sequence is orthologous to G418, G965
cttctagtcaatattacaagagtctgggaggtcaccaacaccatcaagcattacatttacaaggtggagtgggacaaaacctccaccaagctcatgttggttttgggtcatcattaggagtggtgaatgttttgaggaattcaaagtatgtgaaagcagcacaagagttgttagaagagttttgtagtgttggaagaggtcagttcaagaaaagcaaatttggtagacaaaacacaaaccctagttccaataacaatccagggggcggcggcggctcttcttcttcaacaaaagatctccctcccttgtcagctgctgatagaattgagcatcaaagaaggaaggtcaaactcctgtcgatgcttgatgaggtggatcgaaggtacaaccattattgtgagcaaatgcaaatggtagtgaactcatttgatctagtgatgggtttcggggcggcggtcccttacactgcccttgcccagaaggcaatgtcaagacattttaggtgtctaaaagatgccatagcagcacagttgaagcttagctgtgagctacttggagagaaagatggtgctgggacctcagggataacaaaaggtgagacaccgaggcttaagttattagagcaaagtctaagacaacaaagagcctttcaccaaatgggtatgatggaacaagaagcttggagaccgcaaagaggcttgcctgaacgatctgtcaacatcttaagagcctggctttttg

SEQ ID NO: 13092 - DNA, 319 bp, Populus tremula x Populus tremuloides
  Predicted polypeptide sequence is orthologous to G418, G965
gagtgtacaggctgatccaacaaatcaacagccgtagctggtccaccagcaggagggaaattgaacatttctgataacatgccggcagtttcgtagaccggaaggccacttgattcttcttcttcttcttcaatacctactaatgccggagggggtggttcatagtctgattggattctaagcttatctctgcggatctgttgggctatatcgtgttgctgctgctgctgctgttgctgttgattatgctcttggagagatacggaggatctgtcgaaaccaccatgggagaaggaaaaaaaaaaaaaaaaaaaaaaaa

SEQ ID NO: 13093 - DNA, 849 bp, Populus tremula x Populus tremuloides
  Predicted polypeptide sequence is orthologous to G428, G1594
ggcttctctagtcccagcaaattcaaacttaagagtcattaataatggaactccaactccaaaaacatagaaaaactacaaattaagaacaaaacgctaagaaaacaaagatagaaggccaagctgcctgtgccttcttccttctgctaatatggacggaacgtacggtctgcactcaacggtggcggactactcagacaaggcgttgatgtcgccggaggatttgattttacaatcggagtaccagagcttgctgtcttcagaaactcttcggctgcggattccgattcttggatccgaagagttgctttcagaggcggcttcgatcagaacagaagaagatatgtccgctttgatcaaagccaaaattgcctcgcatccttgctatcctcgtttactcgaggcttatatcgattgccagaaggtaggggtgcctccggggatagcgtgtttcttggatgaaatccggcgagaaaacgaccttttcaagcaaggcgctgtctccacgtactggggagctgatcccgagctagacgagttcatggaaacctactgtgatttgttggtgaagtataaatctgatcttgaaaggcctttagatgaagcaacaaccttcttgaacaagattgaaatgcagcttcgtaatctctgcaccggtgcctccatcagaagcctctctgatgaaggtgcgccatcatcagatgaggagtaagtggaggggagttggatatgcatgaagctcaaccagtggtgaagaccgagagcttaaagataacttctccgcaggtttggaagtatattggtcgctgaactggagtctccaaagaaaaaagaaaggaagctcccgaa

SEQ ID NO: 13094 - DNA, 824 bp, Populus tremula x Populus tremuloides
  Predicted polypeptide sequence is orthologous to G440, G864, G1421, G1750
atttgtcactagctacttatataatccctccaactctggagatccaattaagcttagtataaagtagcttccttcagtttttttcctccaagaaaccaataagaatcttcatcgttgatcaaccaaataaattaagctagctagaccctacctgagctggccagtacatggttctgccgctatgtcttgacccacttcttaattgaatacaaaaaccaacccttggtaccacccaccatgcatcttctattccccaatgaattacaacccatgtttacctccaacgccaccatgtccgttcaaccaaaagtcaaatttactgaacatgtattcatcactagtaagctcatcgagaaccagcagctgcatccttcttcaagaacccgccaaagacttgttagaatcatccataccgaccctgatgccactgattcctccagcgatgaagaagagggagaacaagagaggaagtttgtcaagagagtgaagagacaagtgagtgaaataagcttgttagagcaagaaacaacagcaccagcagctccttcttccacaacttcaaatgatgatcaagaaccaagaagaaagagaccttcttcaagattaccagtacctgacgtatctcttcagaaaaagttcaggggtgtccgtcagagaccctggggaaagtggtccgccgagatccgtgacccgactcgacggaaacgggtctggctcggcacttttgacactgcagaggaagctgctacggtatatgatcgagctgactgtaactaaaagacccgacgccgttacaacttcctactaactccgtatacggataa

SEQ ID NO: 13095 - DNA, 633 bp, Populus tremula x Populus tremuloides
  Predicted polypeptide sequence is orthologous to G446
gtaatctaccgtaatgactgaattagagcttatgtaagaagccgacggctctgtctaacattacaaatgcaattgacaagtattaacatctcaacatagatttccagaagagaatgaacacataatagcacaacaacaattcccaaagtatatgcaaagcagataaatttacagcatgtaccgtttcatacctaaacaaacaagagcattctctccttccacacgtgaagcatctaacatcctttcgatgggcactttgagttgaatgccatgtcagggaccagtttcaatcagccccgttagagatgtcatattaacttggatcagaaaactttccactcactataacatgcttcttgaaacaaacttcaatgatcacgagaaattttctgcccatctgccagaccaggttccatccgaaactcagcagccagcacctgtatatctggtgttatctcccagttggctttatgatcccaatttgcgtgtctcggctgggtgccacacctctccaatccaccaatactgtcaatctgactttgtaaatcttcaaagtcctcatcagcaacagcttgtcgttatcgcagttctatatcaaagctccttttgggcacctctgggctcaagacatgg

SEQ ID NO: 13096 - DNA, 516 bp, Populus tremula x Populus tremuloides
  Predicted polypeptide sequence is orthologous to G447
ttggcctccacagcaacagtttcagcgaatgcgaacatatacaaaggtgtacaaacgtggagctgtaggaaggtcaattgacataacacggtattcaggttatgacgagcttaagcaggatctggctcgtaggtttggtatagagggacagtgggaaaatcaacaaaggataggctggaaacttgtttacactgatcacgagaatgatgtcctgctagtgggggatgacccttgggaagagtttgtgaactgtgtccgctgcatcaagatcctgtctcctcaagaagtccaacagatgagcttggatggagattatatggcaactctgtccttcctaatcaagccggcagtagttctgataatgtcaatgcataaattagcccacgaagatgccaacaattcttcttccacgtgaggaacttgtatttcttctaggattctgttaatagcttttctatgactccatcgcatctgggcttttccgtcgcctgcctgctggatttttccaggcacctg

SEQ ID NO: 13097 - DNA, 692 bp, Populus tremula x Populus tremuloides
  misc_feature (247)..(247): n is a, c, g, or t
  Predicted polypeptide sequence is orthologous to G450, G456
actactattcctcaacctttattacatgtgcataccataaacctctctacatcaagataattagtagcaagaaattaacaccaacaagaagaaaagagagagagagagaggggataagagaggtgcgtagtggtactacttattttcaagtatcggagcttttgtttttttgtttgtgaaggatgactagcataatgggagcagaacctgaaaagtatagcatgattaacttcgaagagactgaatntacgtctagggttacctggaggaattggtaacggaaatgatggtgaggttgcaaagagtaatggaaagagagggttttctgagactgttgatttgaagctcaacctctctacaaaggaatcagcaaagggaggcgacgaggagaaagtcatgaaggagaaaaccgttgctcctccggcctcgactgatcctgcaaagccaccggccaaggcacaagttgtgggttggccacccattagatcattccgcaagaatgtcatggctgtacagaagaacagcaatgacaacggtgaaaaatccggtagcagtggcaccggtgtggcttttgttaaggttagcatggacggtgctccgtatttacgaaaagtggacttgaaattatacaagagctaccaagaactctctgacgctctaggcaagatgttcagctccttcaccattggtaa

SEQ ID NO: 13098 - DNA, 1313 bp, Populus tremula x Populus tremuloides
  Predicted polypeptide sequence is orthologous to G450, G456
gcaagaaattattagcatcgtcaacacgaagaaaaggagcatagagagagagagagagatagagagagagagagagaagaagaagagggtttgttgctcatttttaaggactggaggttttgtgaaggatcgatgaccagcataatgggagcagaaccagctggcacctacagcatgatgaattttgaagagactgaactacgcctagggttacctggaggtgttagtaacggaaatgattctgaggctgcaaagagtaatgggaagagagggttttcagagacggttgacttgaagcttaacctttcaactaaagaaactggaaaggatggatcagatcaggagaaagtagtgatgaaggagaaaactgttgctcctcgccctaatgatcctgcaaagccaccgtccaaggcacaagttgtgggttggccacccatcagatcattccgtaagaatgtcatggccgtccagaagaacagcaacgacgagggtgaaaaggccagtagcagcggcgctactggtgcagctttcgttaaggttagcatggacggtgccccatacttacgaaaagtggacttgaaactatacaagagctaccgagaactctctgatgctctaggcaaaatgttcagctccttcaccatcggtaactgtggctcgcaaggaacgaaagatttcatgaatgaaagcaaattgatagatcttttgaacagttctgagtatgtgccaacttatgaagacaaggatggagattggatgcttgtaggagatgttccatggggaatgtttgttgattcatgcaagcgcttgaggatcatgaaagggtctgaggccattggactcgccccaagagctgtggagaagtgcaagaacagaagttgaagtgcttttttccaaggttaatatgatggtcagctgatcccaactgtccacaaagaaaaggaaacatgcaggctcatcgagctttgaagcctggaagtctctgcaccatgatttttcttttttctttttacatatatgtagtaagtccaagtataagaggaaatatatttgaagggatttgttaattatagctagctaggggcatgaagtaacaatagaagaagaagatgtgttcgtaaaacttctttttattctgtatgatcatgtgtaatgtttattgtcttgcttaataatgaccatcattattgtttctagctggctaggttgtcgagagcgtgttctgtcactctccctccatttctgtaatggtggcatgatgagattctctgcatgatatatacgaaatctttggatcaaaaaaaaaaaaaaaa

SEQ ID NO: 13099 - DNA, 1178 bp, Populus tremula x Populus tremuloides
  Predicted polypeptide sequence is orthologous to G450, G456
gagggagtgatcagtttctcagaggaaattattgaggtaaaacgtaatctcatcatggaagtagagaagggaacaaagatgcggtttgaggagacagagctaaggctagggttaccagggaatggtggagggggtactgaaggaggagagttcgcaaggaagagaggattctctgagaccgtggacttgaagctcaatctttcttccaaggaggggggtattgatccaaatcatgagaagactcgaagggagaagaaccttctggccactgatccagcaaaacctccagctaaggcacaggttgtgggttggcctccagtcagatctttccgaaagaacatgttagctgtccaaaaaagcagcaccgatcaggagagtactaacaaggttcctgggggcaacgcaacctttgtgaaggttagcatggatggcgcaccttacctccgtaaagtggacttgaacatgtacaagacctaccacgagctctctgatgccttgggcaaaatgttcagttccttcaccataggcaactgtggatcccatggaatgaaagatttcctgaatgaaagcaagctcatagatcttcttaatggcaccgactatgttccaagttatgaagataaggacggtgactggatgctcgtcggtgatgtcccatgggacatgtttgttgaatcatgcaagcggctgcgaataatgaaaggaacggaggcgactggacttggtaatgagtatacagcataaaaataaaaccaaaatgattcttctcgtttacctcctaatacaagttttgttttgccttttctcatttcatcagcaccgagagccatggagaaatgcaagagcagaagcttcaagtagtgagcaccacagcctgctccttcgatctcgagggtcgcatgcagggaccaaaaattaagatggtaaaagcgcactggatggattgagcaggctcttcgtgagggtgtttctgcattaatattaattgtacgtggtttgttatataatgttaattttgtgagatgctacttgatccttaatatttatcatggacaagaacgataataactcctaaatatgttccaaaagactccgttatatgtatcttgtttgttcagttgaatggcttgcttaattattcattattatagctaaaaaaaaaaaaaaaaaaaaaaaaa

SEQ ID NO: 13100 - DNA, 1206 bp, Populus tremula x Populus tremuloides
  Predicted polypeptide sequence is orthologous to G450, G456
gggggaagcccaacttatattattgaggtctctctctctctctctctagcttgcttgcaaaacatagaagaggacacaagaaataagaaacaaagaaacgagcaaaagctagctatcaacaacaccaaaagcaacaagcaataatacaaaacatatcagatcttccactaaaaccattcattggcgcgcgcgtggcagagagaaatggcaacagctaccgtgttaggtaccgagagggcagatttgaactacaaagcgactgagctgtgtctaggattgcctggtgctgttggtgtcaaaaatgaagttgagacacctaataaggctaccgggaaaagagggtttgctgagactgttgatttgaagctcaatcttcaggctaaagaaggtgtcatggatctgaatgagaatatcaacaatattgcttcagaggacaagaaccaccttccttctgccaccatcaaggaccctgctaagccaccagccaaggcacaagttgtaggttggccaccagttagatcttacaggaagaacgttttggctcagaagaacgccagtgaggaaggtttcggggcacaagttgaaggttggccaccagttagatcttacaggaagaacgttttggttcagaagaacgccagtgaggaaggtgagaaggcaagcactggcggatgcagtgcagcttttgtgaaggtttgcatggatggtgcaccctatcttcgcaaggtggacttgaagatgtacaagagctaccaagaattgtctgatgccttggccaaaatgttcagttccctcaccatgggtaattatggagcccagggaatgatagactttatgaatgaaagcaagctgatggatctactcaacagttccgagtatgtgccatcctatgaagacaaggatggcgattggatgcttgtgggtgatgttccatgggagatgtttgttgattcatgcaagcgcccgcgcataatgaaaggatctgaagctgttggacttgcaccaagagcaatggagaaatgcaagagcagaacctgaatcttatgtactcaatgtattcaggttccctgctggattccctctttttagccttgcatccatgtatgaagactagcaggcaaggcacttgcgcaacatggatggatcagtagtggtgtttctttggatgtgtctttactcttctttttttattattattattgctgc

SEQ ID NO: 13101 - DNA, 799 bp, Populus tremula x Populus tremuloides
  misc_feature (729)..(729): n is a, c, g, or t
  misc_feature (763)..(763): n is a, c, g, or t
  Predicted polypeptide sequence is orthologous to G451
caccacacaggaaatacagaagttaagttcgctgccactttagaagagaaacgtcaaacttcatttcattcaagatcgttgaacaaagaaacgaaaagtatggaatttgagagagatcttaatcttgatgcaacagagcttaggttaggcctccccggcactgccacaagacagtcagagaagcaaacacctaactcaaatcttgccaagagcaacaaaagatcattgcctgacatgaatgaagatcctgcaggatcatcaagggaaaattctagcactgtgtcatcaaatgaagaaaaaagccatgaccaagaaactgctcctccacccatcaaggcacaagtggtagggtggccaccaatcagatcttacaggaaaaactgtctacaagcaaagaaacaagaggctgaagctgctggactttacgtgaaagttagcatggatggtgctccttatctcagaaagattgatttgaaggtttacaaaggatatccagaactcctcaaggccttggaagagatgttcaaatccaaagttggtgagtattcggagagggaagggtataatggatcagaacatgtaccaacatatgaagacaaagatggagattggatgttggttggagatgttccatgggatatgttcatcaattcatgtaagaggctgagaatcatgaaagagtcagaagctagaggtttgggttgtgctgtgtaaagcctcacacatgcnattcaggcccctacaaaagatgaagaagagatcngaaagagttgactttagcctggttcttcgagaagaa

SEQ ID NO: 13102 - DNA, 799 bp, Populus tremula x Populus tremuloides
  Predicted polypeptide sequence is orthologous to G468, G2866
tttggcttcacacttccaaaatgggcagaggagctacctctagttcttcatcttcttttgaaagcagcaactacccatctgtatcaaccaagtcctctctctctcagctaaagaaggaccttagcacagatctcaggcttggacttagcatctcagcctctcaacaggagaacccttctacaccaagtgatcagcagctttctgactggccaccaatcaagccattaaatctaagcaaggcattagagtcggaggaaaatgagtgcagtagtgccaccttcttcgtcaaggtttacatggaaggtattccgattggaaggaagctcaacctcttagcccatgatggttaccatgacttaatacagactcttgaccaaatgttcaacactagcattctctggcctgaaatggatattgaacattctgggcaatgtcatgtgttgacatatgaagacaaggagggggattggttgattgttggggatgttccctgggagatgttcttaccttctgtgcggagattgaagatcactagggcagacagcctatgatcttggttcatgatgctgatcactagggcagactgcccctatatgattttggttcatgatgcttatgcggtctccttttctccttgacacatatataatatggcgagtcgaaaataaataggtagtggatagctaggtaaactctatatcaagtgttgagaatcacgtatgcacatgtacatccttgggataaatgatagaacaacagttgtcttttgattgtaaaaaaaaaaaaaaaaaaaaaaaaa

SEQ ID NO: 13103 - DNA, 712 bp, Populus tremula x Populus tremuloides
  Predicted polypeptide sequence is orthologous to G468, G2866
atggtcagaggagctgcctctagctcttcatcatctttcgaaagcagcagctacccatctgtctccggcgagtcttctttccctcagggaaagagggaccttagcacagatctaaggcttggacttggcatatcaacctctcgacaggacaacccttctacaccaagtgagcagctattggattggccgccgatcaagccgtctccggggaaggcagtaacatcagaagaaaacgagtacagtagttccaccctattcgtcaaggtgtacatggaaggcattcaaattggaaggaaactgaacctattagcccacgatggttaccatgacttgatacagactcttgaccaaatgttcaacactagcattctctggcctgaaatggatgttgaacattccgggaaatgccatgtgctgacatacgaagaccaagagggcgattggttgattgttggggatgttccatgggaggtgttcttaccttctgtgcggagattgaagatcaccagggcagacagcctatgatttggttcatgattcatatgcagtctcctcttctccctagacatgcacttgtatatggtgaatcgaaaataaataggtagtggacagcaacgtaactccatatgaatatgttgaggatgatagaacaaaagttggtcttttgttgtaaattaaggattttcagagttcatcaaaaaaaaaaaaaaaa

SEQ ID NO: 13104 - DNA, 636 bp, Populus tremula x Populus tremuloides
  Predicted polypeptide sequence is orthologous to G470
cgagcagcagcgatgtagcatatcaatcaagggaaaatatcagatacagtgcattcagtgagtatcccatgcttcacggtcagagagtcgagcaatctcatggaaactgtatgatgcctcccccgccatctcattttgataatcatgctcatacaagagagctgataccgaaacccaaactggtgcaagaacatgataccggaaaatctttggatggaaactgcaagctatttggtattcccctgaaaattagtaaacccgccacaccagagcaagcaggaccaacaaacatggtgaacgaactgatgggtcacacccaacctgcgagtcaccatctcacatctgaatcagatccgaagtcagaacactccaggggttcaaagttggccgatgaaaatgaaaacgagaaaccattccaggttggccacatgcgtacgagggacagtcatggaaaagcacaaaacagctcaaccaggagttgtacaaaggttcacaagcaggggattgcacttggtagatctgttgatcttacgaggttcaataactatgatgagctgattgctgaattggacggttgttcgaatttaatggtgaatactggctcccaaaagaatgggttgattgtgtatacctgat

SEQ ID NO: 13105 - DNA, 594 bp, Populus tremula x Populus tremuloides
  Predicted polypeptide sequence is orthologous to G478
ttttttttttttttttttaattaaagagagagtaaattaagagggaaaaataaataaaacactggattaacactatgttactgcttagttaatattaaatcctccttgatgatcaggtcattgacattttttacccacttgagaaaaacagtgagcttgaagatgtagaagaagaagcagtggcttgatacgatctttgcttgaaacaatccagagacattcgaggaggggacatcgccaccgtcacagatgaattaggatgagctacagagtccgttggagaccttgtgagaatctcagatgaggaaacggcggcattttctagatgtgatttctgattttcttgattaatttggtgtgattttcgcctacgacgattgtgatcagctaatctcttcctgcaactacgctttccattataaattctgagagaagatgaaacctgctacactgctggcagaatcgctgagtcaacccggcgggaatgacagtcgaagctttagagtgaaactcacagactttatggcgtttatggtagtgtttagcatgagtaagatcagcattgcacccttcagtttgggattttggagcatt

SEQ ID NO: 13106 - DNA, 542 bp, Populus tremula x Populus tremuloides
  Predicted polypeptide sequence is orthologous to G502, G519
tcgggcagccaaagacagctgggatcaagaaagctttggtgttttacgcaggaaaagctcccaagggagagaaaaccaactggattatgcacgagtatcgcctagccgaggtggaccgctccgttcgcaagaagaacagcttaaggctggacgattgggtactctgtcgcatacacaacaagaaaggcacaattgagaagcaaggacagcatcttagcgtcaggaaagcgaattcgacagagattgccgaggaggatgagaagaagtcggtggttatgctgccgccaccaccagctccgtcctcggcgacaggaacgatgaatgattacgtgtatttcgacacgtcagattctgtgccgaggctgcacacagattcgagctgctcagagcatgtggtgtcgccagaattcacgtgcgaggtgcagagtaatccttataattacttggattccaccatggatattccgttcgcgtcccaatttcaggggaatcatcagatgtcgccgcttcaggacatgttcatgtatctgcagaaccgtttt

SEQ ID NO: 13107 - DNA, 221 bp, Populus tremula x Populus tremuloides
  Predicted polypeptide sequence is orthologous to G515
gctaagaggagagtcaaagtaatgcaacaaagtgttaatttcataaaaaatttagtatgttgagagaatacccaatccgctattatccaggattgttgggattccttgtgttatattagatagagagagccggaaccaaatttctctaaaagtcaaaatttgctgaagcgtgggggactttagattgcttaacccgtctttggttgttgagaaattataaa

SEQ ID NO: 13108 - DNA, 357 bp, Populus tremula x Populus tremuloides
  Predicted polypeptide sequence is orthologous to G517
cgggtctcgttgggattggatatagatggggaatctatagatcgtagtagttcgccaacctctctaactaacatacgatacaatttcacttcacggcccaaaacaaaaaaaaaaagaaagagcttcgcctatcgtatgtatcggcctggcttcgtccagaaccaaggaggcattctggcgggcgcgtgcgtgtaggaaggccgaccactacataagctaaaactaaaagactacgactacaagccggaagcgactcgcttctattctcgttgggattggatatagatggggaatctatagatcgtagtagttcgccaacctctctaactaacatacgatacaatttcacttcacggc

SEQ ID NO: 13109 - DNA, 213 bp, Populus tremula x Populus tremuloides
  Predicted polypeptide sequence is orthologous to G526
cccttttaagaccactccaaaaattggttggttttggagtttaccaagccgaagcagtagaggccagcagtatcttcaaatttttgtcgaaaaggggtggcgaatgccaacgggcttcccaaattgcgtggggaaaaagccagggggccaaacgaacccttatttggggtgcccgcccacctaaacccttcgaatgtgggcctttcatttttt

SEQ ID NO: 13110 - DNA, 489 bp, Populus tremula x Populus tremuloides
  Predicted polypeptide sequence is orthologous to G526
agaagcatctggattggagaaacagtgcaaggttgagcgcttctcatctaatcaatctatggtcagcctttcacaggacactggacttagcacagacgtgaacaccacagctgagatatcatctgtggtttcaaagcaagaaataggaagccatgataaggtttttgaagatcttgagggtccatcagctggccccattgcagatttggattgcttgtgggattattgaagaccatagagaatatatgtatatgtacgcgtggtttaatttgttctttaaattcttaggatacatgaatgtaacgaaaaaaaaaagagagaaaaagtcctgaggacatatgatttgaaacagccatttctccattagctagctaggtaatttgattaaagtttggaaagttctttgtattgatataatctgtatagatttttattagttcatggggttcctcttccgatttctagaaaaaaaaaaaaaaaaaaaaaaaa

SEQ ID NO: 13111 - DNA, 639 bp, Populus tremula x Populus tremuloides
  misc_feature (600)..(600): n is a, c, g, or t
  Predicted polypeptide sequence is orthologous to G536
atcttctctctttctaaaacaatggcggccacaccatcagctcgcgaggaaagtgtttacatggcaaaactcgccgagcaagccgaacgttacgaagaaatggtggagtacatggagaaagtctctgcctccctcgagaacgaggaactcaccgtggaagagcgaaacctcctctccgtggcttacaaaaacgtgatcggagctagacgtgcttcgtggaggattattcctcgatcgagcagaaagaagagagtcgtggtaacgaagaccacgtgtctgtgatccgtgactacagggccaagattgagaccgaactgtcttcgatcgtgacgggatcttgaagttgctcgattcgagttgatccacggcctcggctggtgattcgaagtgttctatttgaagatgaagggagatatcacaggtacttggccgagtttaaaactggtgctgaaggaaagaggctgctgagagcactctcactgcttacaaagccgctcagaacttgcaaatgcagagctagctcccactcacccaatccgtctaggatggctcttaacttctctgcctttactatgaattctcactctccagtcgtgcttnagtctcgctaacaggttttgcgaggccttgcggctggat

SEQ ID NO: 13112 - DNA, 717 bp, Populus tremula x Populus tremuloides
  misc_feature (680)..(680): n is a, c, g, or t
  Predicted polypeptide sequence is orthologous to G536
gaccaaccaacgaaacaaagaaaaaccactctgctctcctactcagctattactcctaaaacacaaatccctctttcctctttcaaaacaaaatggcaaccaccaccactgtcccagacaacctcaccagagatcaatatgtgtaccttgccaagctcgccgagcaagccgaacgctacgaggagatggtccagttcatggaaaagctggtcctcggcaacacacctgtcggtgaactcaacgttgaggaacgcaacctcctctctgtcgcttacaaaaacgtgatcggctcacttcgtgctgcctggaggattgtgtcttcaattgagcagaaagaggaagggagaaagaacgaggaacatgttgtgcttgttaaggaatatagatctaaagttgagagtgagttatctgatatttgtgctagtattctgaggctgttggactcgaatctgataccgtccgctactgcgagtgaatccaaggttttttatttgaagatgaaaggggattatcataggtatctggctgagttcaaggctggtgatgagagaaacgctgctgctggagatactatgctgtcttacaaggctgctcaggatattgcgtcttcggatcttgcaccaacacatccaataaggctgggtttggcactgaatttctctgtgttctactatgagatnctcaatcagtctgacaaagcctgcagcatggcaaaac

SEQ ID NO: 13113 - DNA, 620 bp, Populus tremula x Populus tremuloides
  Predicted polypeptide sequence is orthologous to G536
ggtgcgaggagggcatcatggagaatcttgtcatcaattgagcagaaggaggagtcaaaagggaatgaaacaaatgtgaagaggatcaaagagtataggaagaaggtggaggcagagttaactggcgtttgcaatgatatcatgactgtggttgatgagcatctcattccatcatctatacctggggaatccgctgtgttctactataagatgaaaggtgattattaccggtatctagcagagttcaagagtggtaatgagaggaaagaggcagctgatcagtcacttaaggcatatgagactgctacatcaactgcagcaagagatctatctcccacccatcccattcgattgggtttggctcttaatttctctgtgttctactatgagattatgaactcaccagaacgggcctgccatcttgcgaagcaatcatttgatgaagctatttcagagctggatacccttagtgaagagtcttacaaggatagcactttgattatgcaactgttgagggacaacctcactctgtggacttctgatatccctgaggatggagaagaccagaagatggaaacctctgcaagagctggtgggggtgaagatgctgagtgatgatg

SEQ ID NO: 13114 - DNA, 746 bp, Populus tremula x Populus tremuloides
  Predicted polypeptide sequence is orthologous to G536
ggaaccaaagaaaaaccctctcctctcctctcctagtcccactgaagcacgatctctctctctctctctctctctctctctctgaacaaaatggtaaccaccaccactgtcccagacaacctcactagagaccaatacgtgtacctcgccaagctcgccgagcaagccgaacgctacgaggagatggtccagttcatgcaaaagctggtcatcggcaacacacctggcggtgaactcaacgttgaggaacgcaacctcctctctgtcgcttacaaaaacgtgatcggctcacttcgtgctgcctggaggattgtgtcttcgattgagcaaaaggaggaaggcagaaagaacgaggatcatgttgtgcttgttaaggaatatagatctaaagtcgagaacgagttatctgatgtttgtgctagtattttgaggttgttggactcgaatctcataccatctgctactgcgagtgaatccaaggtcttttatttgaagatgaaaggggattatcataggtatatggctgagtttaaggttggtgatgagagaaaggctgctgctgaagatactatgttgtcttacaaggctgctcaggatattgcggccgcggatcttgcaccaacgcatccaataaggctgggtttggcactgaatttctctgtgttctactatgagattctcaaccagtctgacaaagcctgcagcatggcgaaacaggcatttgaggaagctattgctgagctaga

SEQ ID NO: 13115 - DNA, 695 bp, Populus tremula x Populus tremuloides
  Predicted polypeptide sequence is orthologous to G536
tacggccggggtacgatcagatggtagaagcaatgaacaaagttgcaaggttggatgtggagttgacagtggaggagaggaatctggtgtctgtgggttacaagaatgtcattggcgcaagaagagcatcatggagaatactatcttccattgaacagaaggaggaggctaaggggaatgaacagaatgtgaagaggataaagcagtacaggcagagggttgaagatgaacttgcaaagatctgcaatgatatattatcagtcattgatcagcatctcatcccatcctcctcaactggggaatcaactgtcttttactataagatgaagggagactattatcgatatttagctgaatttagaagtgctgatgaacgtaaagaagctgcagatcagtcccttaaggcttatgaggcagcaacctctactgctatctcagatctgcctcctactcatccaattagacttggcctggcactgaacttttccgttttctactatgagattttgaactcccctgaaagggcctgccacctggctaaacaagcatttgacgatgctatagcagaacttgatagtctcaatgaggaatcttacaaggatagtacccttatcatgcaactactcagggacaatctcactttatggacctcggatctgtcagaggaaggaggtgagcactctacagctgctgaa

SEQ ID NO: 13116 - DNA, 714 bp, Populus tremula x Populus tremuloides
  Predicted polypeptide sequence is orthologous to G536
ggccatgatatcatgacagtgatcgatgagcatcttattccatcatgtacagctggggaatccgctgtgttttacttcaagatgaaaggtgattattaccggtatctagcagagttcaagagtggtaatgagaggaaagaggcagctgatcagtcacttatggcgtatgaggctgctacaacaactgcagccagtgatctctctcccacccatcccattcgactgggcctggctcttaatttctctgtgttctattatgagattatgaactctcctgaacgggcctgccatcttgcaaagcaagcatttgatgaagctatttcagagctggatacccttagtgaagagtcttacaaggacagcactttgattatgcagctgttgagggacaacctcactttgtggacttctgatattcctgaggatggagaagaccagaagatggaaacctctgccagaactggtgaaggtgaagatgccgagtgaccgtgctaatagaaccttctggtccttgaaagcgtgaatgggagtaggatgatttcccctagtgttgttctattgctttatttcaagaggatttttgtagtaccttatctcagttggtgttgatccccgtttcattcagctatgtattagcagaaatatttgttgggttatacaatattggtagccaacgactattgctgctttttcaaatttcttggatccaattaa

SEQ ID NO: 13117 - DNA, 672 bp, Populus tremula x Populus tremuloides
  Predicted polypeptide sequence is orthologous to G536
aaagaacccaaaacaatggcagccacaacatcagctcgcgaggaacatgtctacatggcgaaactcgccgagcaagccgaacggtatgaagaaatggtggagtacatggagaaagtctccgcctccatcgacaacgaggaactcaccgtagaatatataaacctcctctctgtggcttacaaaaacgtgatcggagctagacgtgcttcttggaggattatttcctcgatcgagcagaaagaggagagtcgtggtaacgaagaccatgtgtctgtgatccgtgactatagggctaagattgagaccgaactgtcttcgatctgtgacgggatcttgaagttgctcgacaccaggttgattccaacggcttcttctggtgattcgaaggtgttttatttgaagatgaagggggattatcacaggtatttggctgagtttaaaactggtgctgaaaggaaagaggctgctgagagtactctcactgcttacaaatctgctcaggatatcgcaaatgcagaactggctcccactcacccaatccgtctcggattggctcttaacttctcagtgttttactatgagattctcaactctccagatcgtgcttgcaatcttgccaaacaggcttttgatgaggcaattgctgagctggatacattgggcgaggagtca

SEQ ID NO: 13118 - DNA, 656 bp, Populus tremula x Populus tremuloides
  Predicted polypeptide sequence is orthologous to G536
taggggaaatgaagatcatgtcacaatcatcaaggagtataggggaaagatcgaagctgaactctgcaagatctgtgacggaatcttgagcctccttgagacacatcttgttccctctgcctcagctgctgagtccaaggtattttacctcaagatgaagggtgattatcacaggtatcttgccgagtttaagaccggggctgagaggaaggaagctgctgagagcactttgttgtcttacaagtctgctcaggatattgctctttctgaactggctcctacccacccaataaggctggggcttgcacttaacttctctgtcttctactatgagatccttaactctcctgatcgtgcttgcagtcttgctaagcaggcttttgatgaggctatttccgagctggatactttgggtgaggagtcttacaaggacagcacattgatcatgcaacttctccgtgacaatctgacactctggacttctgatatcacggatgatgctggggatgagatcaaggaagcatcaaaacgtgaatcaggcgatgggccgcagtgatgaagttcagttcataggatatgtactctgtacttctatctcgtgacatttacagacgccatttgggttattgtagctggatgttttaatgaattttata

SEQ ID NO: 13119 - DNA, 827 bp, Populus tremula x Populus tremuloides
  Predicted polypeptide sequence is orthologous to G550
aagaggttggatttccattcccaatttattttagtacaaaagggattcttatgctacacaaactcaattctttcctaagctctcagtctctcactgtttgcatatataaatatgtacattaacttggaaaaccatgtaagtggacatccaaaagcaccgtcctggactgcttccagcaaaaagataaatacctaacggtggctactgctgctagctaggatagttctcttctcctctgctctttcctcttatagatcgattgcaaggagaccattgacaaatgatgccattgactgaactgcaaaccttcagtttataaagctgttaaagtcgaaacaccagaacttgtttccactgctcggaacaaatatcaagttaaagctacccaaattatgagctctcctgaaatttgagagatctagacaatgctgccagattagcgtgtaagactggagaggtttcggctgcacgattcttctcaacctttgaatcaaaggccttaaagagtcctcggccaccaaatgagccaggcttatcattcttaatcccaagtgttgtccatatagagctttttgcggcttctcctggatcatcaatcctcagcgttttcggaatccaaaggcatctttcagtgtcattttgtttcaccagctcttctttggagttgctaggtttgagcaagttttcatctcttgaatgtttccctaggttggagagtttgggtcaaaatgtttccctagggttggagactttgggtcaaagctcgaggaggtttgctttggagaaaatggttgaggaagccaagggatattccaagcacctggtac

SEQ ID NO: 13120 - DNA, 557 bp, Populus tremula x Populus tremuloides
  Predicted polypeptide sequence is orthologous to G558, G578, G629, G1198, G1806
catcctataggatgcggaaacccacagacgttgttatgtggataggtggctttcctatctgaactcctaacttttggaataactggacctctaactgacaacactatgggcatttacaacttgcaacaatcttctcagcaggcagaagatgctctctcacaagggatggaagcgctgcagcaatcactggcagaaaccttggctaatggcaaccctggctcatcaggttcgtctgcgaatgtggcaaactatatgggtcaaatggccatggccatgggaaagctaggaactctagagggattccttcgtcaggctgataatccgaggcagcaaacactagaacaaatgcaccgtatatcgacaactcggcaatcagcccgtgctcttctagctatacatgactatttctctaggctacgagcccttagttctctctggttggcccgaccacaggaatgagtagcagtatgttgcccctcaacaaaattaacatgaatatttaccacctcaccaccctcctacttggccttcagttctcattatgccattgggtggga

SEQ ID NO: 13121 - DNA, 710 bp, Populus tremula x Populus tremuloides
  Predicted polypeptide sequence is orthologous to G558, G578, G629, G1198, G1806
ttttttttttttttttttttttttaaatcaactcaaaatgaaagtttctcaactttcaaaatcatttcgagattgtcaagtacaaggacagcatattctaaacttgccattacaactgtggataaaatgaaaacaggaagacgatcatcaggctacaaataattaacattgatgcatactgtacttgaaggactcaaattctatgctctaagatgattagtatgaaagaaagagcagtaccatgatacatctgagactacaacaagaggaatgcagaaaagagaagctattttgagcactagaaacaagaagcactgctggatgtggaatgagcctttgtgatttttgtgcagaactcgagttcagatgcaaagcagattcactctctcggtcgcgcaagccagagggaactaagagctcgtaaacgggagaagtaatcgtgtattgcgaggagagcacgagcagactgacgggtggttaatattcggtgcatttgctgtaatgtttgctgcctcaaattgtcagcctggcgaataaatccctcgagggtgcctagttttcccatggccatggccatctgacccatgtaatttgccacgtttccagatgaacctgaggagccaagaggtccgctggacaatgtctcagcaagggactgctgcaatgcctccatcccttgagataatgcatcttctgcctgttgggaggac

SEQ ID NO: 13122 - DNA, 475 bp, Populus tremula x Populus tremuloides
  Predicted polypeptide sequence is orthologous to G558, G578, G629, G1198, G1806
gacggtaagacaggtggcgcggtgttttgtggtgatcggagagtattatgggaggctacgggcacttagttccctgtgggcatgtcgtcctagagagacaatgatgagtgaagaaaactcatgccaaaccaccactgatcttcaaatggtgcacccttcacagaatcatttcgccaacttttaatataaaaaaaacatgggatagcgatacaaaagagccagacagcttgccttcctcggtgactgagaacctgtattgcgacaaatgttatgggctgttagaattcggataagcactttagtagtgaagataggatcgttttcttttcttttctttctcctctgccttcttcattatctttatatcatcaatcactatgttatcttgtaaatgcaaatcaattttatatgcatgaggagctttctcgcttgctttaaaaaaaaaaaaaaaggggaaaaaaaaaaaagggggggg

SEQ ID NO: 13123 - DNA, 607 bp, Populus tremula x Populus tremuloides
  Predicted polypeptide sequence is orthologous to G559
gcccgaggacagcttagaattttgaatcacaaatcgccatcaaaggcccatgattgcatcaaggttctacataaactataacatattaaatgcttaaactataaactcaatcttcaaggaaactagaatatagaacccgcctaaatgaggtatgaatgtaatgtatctaaaagactggagataaaaggtaaatgtcctatgtgataactaggatgtaaacaacagtagacagaacattctgtagctggtctgatgatcatgctattctcagtcctttgatgaggaggaattatcctcagatgaattatctttctggattgaagaagccattgatcctctcatttgcaaatccccaccttgctgctgctgctgctgttgaagttgttgctgttgaagctgatgcagctggagctgctgctgctgctgcttctgagaatgaatttggagttgttgaaactgttgtgcagctaaaaaagtatgcattgcttgattattgggatataattgctggcctcctccaaaagatgcatagtttggcacttgaccagtcagtaccttcagatgctgaatttcttctttcagtgcgtcattcaaggcatcttgcaag

SEQ ID NO: 13124 - DNA, 771 bp, Populus tremula x Populus tremuloides
  Predicted polypeptide sequence is orthologous to G561, G562
tgcagagtctgtgaagctagtgacaggttttctaatctaagttgcttccttcttcgtgtaaaattgaatacagagtgagcattatttcaagtctccggagttcacagcttgttatctgtgaggataaggagatttatgatctgagaattggaaggtgagagagttaaagcagtttttgcgaatcatctccaaattaagtaaggatttttattttttttggtgttttaccatgggaaacaatgaagagggaaagtcttctgcgtctgataaatcttctcctgcccaacaagatcagaccagcattcatgtgtatcctgattgggcagctattcaggcatattatggatcccgagtggctctcccaccatattacaactcgggtgtggcatctggccatgcccctcatccttatatgtggggcccaccgcagcctatgatggctacttatggggcaccatatgcagcaatctattcacatggaggagtgtatgcacatccggcggctgttccgattggatcccatccgcatggtcccggggttctgtcatctcctgcagctaatacccctttgagtgcagaaacacctacaaaatcttcaggaaatactgatcagggtttactgaacaagttgaaagggtttgatgggcttgcaatgtcaataggcaatggtgatgctgagagtgcatagggtgggagtaggctacctcacagcatggagacagaaggttccactgatggaagtgatgggaatacagctaggggaaaaaaagg

SEQ ID NO: 13125 - DNA, 589 bp, Populus tremula x Populus tremuloides
  Predicted polypeptide sequence is orthologous to G565
ggatgatttgttctcaacctacattgatgttgataagctaactggaggcaatagtgggaatggagctggagggggggttcagaatgataatgataataatatgaatggagagaaatctggggtttcgggttcgggtacttccaggcctaagcataggcatagtaattctgttgatgggagtgtgtttggtggaggagaggtaatggatgctaagaaagcaatgccgcctgataagttagctgagctttggactcttgatcctaaaagagctaaaaggatacttgcaaataggcagtctgccgcccgctctaaagagaggaaagcccgatacatactggaacttgagcgcaaagttcagaccctccaaacagaagctaccactctttctgcacaactaactttatttcaggtttatgtttgttggttgtaatttcagcatgcatttttctaccttagttatatttctatagtctatttacaccatgtttttccactgcaaggatgtctctcatttttgtgatccattttttgttggattgatgattgtgttaatgcctaaataaacaaattgatccacggacgtgaacca

SEQ ID NO: 13126 - DNA, 345 bp, Populus tremula x Populus tremuloides
  Predicted polypeptide sequence is orthologous to G568
tacttgtgattaatcatattttctcattgcttctttacaagaaatacaatcaagggattgtggattttggaactgccaatcggagaagaaaatgtctgaaaattttggtgcaaactgcattctgattgtttttcccttttattttaactaaatgtgcatgaatatccattctggtgtaacggttgatatggtgcaacattgagtggtgaaggaatcccagctattggcataagaaatcttattagatcagtcatttcctgtatcttatttctatattggaaaactttggtgattccatctcaaaagtgatttgaatacataataaagggaaagcagaaattgcat

SEQ ID NO: 13127 - DNA, 415 bp, Populus tremula x Populus tremuloides
  Predicted polypeptide sequence is orthologous to G580
ataaaaaaatattaatttaatatacatttaaaaatatatatatttaaaaacaattcctttgatttttggagtgtcagtcatccgagccattgaaaaatactttttccattgctggaccgtcattttttaggtccagccaggttggcagccacctagcatctgggaagcacagcccaatagtgttgtcctccagtccagataataaccatacattcgatttcttgcctgattcttctccgccgaaagaacctccttcggccagtaaaaccattattcacgggggggggttcaaactgaaagacaaaagttcttccacggaaaatttgaactacaaagaattgtaagagaacctatattataaaggcatataaatgatagcctattacaacttctataaacttgtccttcgattatt

SEQ ID NO: 13128 - DNA, 767 bp, Populus tremula x Populus tremuloides
  Predicted polypeptide sequence is orthologous to G581
ttttttttttttttttttttttgagctaattacctaacactgcagttgaacatttgataatggagaaaaggttaagaaggacattgaagttatgcaattacgagttcatgcagttactgctacatgttacatgagaatctagaaactaatttctactgcatggagaaatctttcaagttccggttgataagttgataaatgacgactcaagtctcgccaacagttttccaaagtgcttgtttgatcatcccttctggtgaaactggcgctgcccctctaaacttagatttcagggtcaacgtgaaaatgccatcaagagtggatgaatgaaccgaaagcacctccaactgccgtttgttggcttcatccaagatatcgagcaacatgtactccctgtaaggacatctcatctcgatgagaatctccttctctttcatgcatactttcagatctacgggcatgccatccttgggagcaacctcatcaagctccagttcagcttcatcaatgtcacgggccttcctcttgtttatccaaggcttcttgatgccatggttatctgatgtccggtctaccatgcccatgttactcctggatcttgcctcataatctgtcgagcctgtgcaagattccagttctgctactcttgactcaagctgtctcgggtaattaatggtgtaactgaggatcgatgcttgtcgatctcattaatagaagcactattgactcgagtgctagaaatttttcattctcctttggttttctga

SEQ ID NO: 13129 - DNA, 689 bp, Populus tremula x Populus tremuloides
  Predicted polypeptide sequence is orthologous to G591, G793
caattgtttttgtcaacagaagcttcttacatcactttagaagacaacctcctaacatctatttcaacttgaatacaaatttcttcgaatacatgatccacatacccatcaatcccttttggaaaggccctacattcccactatgcaaagggagaagaaaagagagttctcgccactaatattctggtcattttccactaaccccgccacctcaaatatttagaatagggtcacattcatagagcttcagaaatttcttgccttgacttgaccattgctgtgtaacatcaagtgcccgtgatttaatatcttccttggcacggaaatgactcgtttgacgggaaaggaaaagagaagaacagtttccctgacttgattattttctgtttctcggtaaggtcgactagtagtggaggttgaaacctgaatccagtgtcgatgtagaaatgggaaaccagacgcccgctggaatgatcgatgtgtacgcgcgcaaagcttgcacgttcttggttaggtttaattatgagtgggggttcgattcgggcttgaccggtgtcggagcattaggtgggcgtgctcggaagattgctgatgcaagtgatacaggcatgatgcagagcgccttggactgaaggagctgcacggcagctccaacatcttcttccatcaacttagctacttcttgttca

SEQ ID NO: 13130 - DNA, 491 bp, Populus tremula x Populus tremuloides
  Predicted polypeptide sequence is orthologous to G592
ttttttttttttttttttaaaacaataaaaaacactaaaaaatattaatttaaagctaagaaaatacggtccagccgcataaagaaacatgccttgaatcaataagcaacatagggttgggggggttggatgaatcttatagttagcttctggggcattcgatcttcactcccatccccacataataaatatagccctccctggctgtaagcagcgtcttcatcctttacagtgcaagagagaacccagctttgccttcatctcttttcttgcaaattcttattggttctatacacataaactaattcatacttcgaccttttcgactagggctgctgctgctgcttgtttatgcatgcacaccttgcacgaatctctgaaagtgtctggacttgtctttgaaggtccttgatgtagtcaacagccaaatccagcatgtctgatgtgtttgtttgcttatccatgttaggtacaagatcctggagtttcct

SEQ ID NO: 13131 - DNA, 704 bp, Populus tremula x Populus tremuloides
  Predicted polypeptide sequence is orthologous to G592
gaaatcggagaagaatgtattggtgggagcagtccagaaggcgattttagcaagagaaagtacatgtataacttcaatagcgatacttggggtgatgcttcgagattgaaggataatgatgggaacatgttttctgccctgaacacacgggaaagtcaggttgggaattctggaaaccgcatgactggtttgactcatcacttgagcttgcctaagacttttgcagaaatggctatggcggagaagtttttggatttccaaggcaattttgttccgtttaagatccgagccaagagaggtttcgctactcacccacgaagcatagcagagagggtaagaagaactcggattagtgaaagaatgagaaaattgcaagaacttttcccagacatggataagcaaacaagcaccgcagataagctagatttgtcaattgagctcatcaaagacctccagaaacaagtcaagactctcacggatactaaagccaagtgcacgtgttcaagtaaacagaaataatattcaagtacccctgcttgattttgtttctgtacagatagccctaggaaaatgaaaaaaagagaaaaaaagacatagctccttagttatcttctgtaaaataatagggtatcggagattgtgaactcaacgataagtagatacacttttcactgtaatattctgtaccactgctgatctcatta

SEQ ID NO: 13132 - DNA, 764 bp, Populus tremula x Populus tremuloides
  Predicted polypeptide sequence is orthologous to G602
ttttttttttttttttttttttttaacaaacatgttaagcttgtttctcacagatcaaatattgtattcctatacataataaacacactgaatatttaaatttgccgatgtttaatgaaagaagacatgaaaccatgtgggaaaaaaaataataataataataacaagcaagcaagaaaagcaaggagttaaaaacactatatgcagaggaagaattatgattcaactttccgcttccatgctcctacagttgcgacttcagaagcaaccaaggagcttcttcggggtttgcccggtagcacggtattttgcagccgtctcccctgcctttaaacctcttccccgcgtttggcttccacaattgccttcttttcctcagcttctttgtgaattaaagcaatcctgtttttcattttctctgcatattctgccttttgcttctccagtttttcctccctctttctcagtttggcttccagagctgcctttttgctgttctcccaggcaacaacagcagagaaatttttctgagacttgttctcggctttagttttctcgctgtcttcccatgccttgataaaggaaagtctcttttccttttcaaggtcagcaagagctacatctctgtcaattgatccgcctgaaacctttttcgaagcaggttctgtcttttaacaacagcaagagccttttgattccctcagcagcagtggctgccttctctttctctgcaccactggaggtgggggacccgtaactttccc

SEQ ID NO: 13133 - DNA, 715 bp, Populus tremula x Populus tremuloides
  Predicted polypeptide sequence is orthologous to G602
tggccgggggccaagtgtagactttaagctaactgttaatagttgaagagaagctgaaggggaaaagaaatggctgagcaagaagtgaagaaggtagaaactgagacgccggtgactccagctccggtggatgctaaaagtgacgtggcggatgagaaagctatagttccacttcctccagcagctgaagagaaagagaaggtagctgatgaattaaaagctcttgctattgttgaaaagacagaacctgctccgaaaaagatttcaggtggatcaattgacagagatatagctcttgctgaccttgaaaaagaaaagagactgtcctttatcagggcatgggaagacagcgagaaaactaaggcggaaaacaagtctcagaaaaagctctctgctgttgttgcatgggaaaacagcaaaaaggcagctctggaagccacactaagaaagagggaggaaaaattggagaaacaaaaggcagaatacgcagagaaaatgaaaaacaaggttgctttgattcataaagaagctgaagaaaagagggccatggttgaagccagacgtggcgaagaattattaaaagcagaggagatggcagcgaaatatcgtgctactggacagacccccgaagaagcttcttggttgcttctgaagcagccactttaggagcctagcatggaagcagcaagttgaatcatcagtcgtcctctgcata

SEQ ID NO: 13134 - DNA, 617 bp, Populus tremula x Populus tremuloides
  misc_feature (544)..(544): n is a, c, g, or t
  Predicted polypeptide sequence is orthologous to G611
actcatcatttctttttgacttgaatgatcagtttgtccttgatgcttaccgaaagggggataagctgaaatttgcaaaccattcttcaaatcctaattgctatgctaaggtaatgctggtagcaggagatcatcgagtgggcatctttgcaaaggagcatatagaagcttgtgaggagctattctatgattatcgctatgggccagaccaggcacccgcgtgggctcgaaaacccgagggttccaaaagagatgattccacaatctcccaaggtagagcaaagaaacaccaatcacattgatggatgattattggcatggcttgatattatggagcatgtttctgtaattcctaagtgtatttgaacagtctcttactcatagaatgaacataagttgcctataccaggccatgccatcatttatttgtacaaagatgcacgcacaagtgcgcttcctgtgaatttgactctttcaaaaagacaggatagcaataaggtcaaacattgttattgatattgagtttgaaactgatcttgcagtntcctgtagaagccaacagtatcctttcatgtaaaattgttattaccataactaataccgcatttttcttttcc

SEQ ID NO: 13135 - DNA, 605 bp, Populus tremula x Populus tremuloides
  Predicted polypeptide sequence is orthologous to G618, G2057
ttttttttttttttttttttagagttgagccggaagagcccacttaataaataaataagcttattttaaaatgcctggagaatctatcaaacatatttggagaaaaaaatgttttttccaaccagatgttttttttttataggccaaagcattcaactgaaatcactggaatctctgctcctttctttttctgtttgaccatcattctccctgattgattccatagtagtaaccttgaacatgcatgagcagcagcatgttcagctctatcttcaattctgagaatttggagaagaagaggatggtctatctggtacaacattttgctcatccccgccatgaattcgggttggaatgctaaaacctgacaatccatcagatacaaacctgcttccaaaaatcaaagattgatgaagttcctgtgttctatgatggtctgtggatgccatatgaagatcattccatgaacgaatggaatgcggaaaactggactgaaggggccccctctgggaaaatgctgaggcttgggctagcattgcttggtgtggtgtcagaagcggggggctaaatgtaaatcccccagcaactctattctccgcatttgt

SEQ ID NO: 13136 - DNA, 757 bp, Populus tremula x Populus tremuloides
  Predicted polypeptide sequence is orthologous to G618, G2057
gccgagccagatctgaggctctcgctccaatcatttcaagaaccaattcttttgcaacatcaagcacaccatcatggccatcaagctcaaaatgaacatcaagtgttgttctctggaaccactgctcattatctcggcctagatggctcttctagtgggtggtctgagcagcaccacgcaccagaaatcaaccgtttccaaagaaatctggtggcttggaatgcagctggcggcggcggcggtggaggtggaggattcttcttcaacacaccactaccaccgctacagacgatgtcgccatcgccacctatacagccggttttcggcccaaaccagtttttttcacagaggggaccccttcagtccagtaacacgccttcagttcgtgcttggatagacccagcaatcactcctgatcatcatgaacagcaacaaattccacaaatgtatcatcagcaaactgcaatatcaggcattggattcactgcctcaggtggtgagttctatgggtttcgagttccagcacgaattcaaggcgaagatgaggagcacgacggcattcacaacaagccgtcctctgcttcctctgattctcgccattgatcgagcaaaaacgtcaaaaatttcacctttaccaggacttgttcatagtttaagagagactaatacggtgctaagaagacatttcaaagactggcctggtgacttgaaaatgaatcaatggcaaataccgtgggaagagagagagatctgagtg

SEQ ID NO: 13137 - DNA, 701 bp, Populus tremula x Populus tremuloides
  Predicted polypeptide sequence is orthologous to G624
ggatggcaaaatcattacatcaaaaacctcagaattggagaaccagcagataagaatcggagactgccgacatgtcggattctcagaacagcacgctagcaacgtttcatggtgatgacaagatggaagaggactctggatctaagggattgattggtgaagttgtgggttttgatgatagaatccaggaagaacaaatgcatactgggaatacggagcactctttgaatagactcgatcctgtaaatcatggtcatgagccacgtcctaacatagacacaacagcggaaccatcaactaaggaacgattaactaaggaaccatcaactaaggaaccatcaactaaggaaccatcaactaaggtcatctcaaaaagtttgtctcggactgacatagaggaaagactgagcgttcctgcaagttttctacactttttcccaaagcatgaaggtgcaagagaaattgagttccaagcaatcgacactcttgggaaactgtggacctttaagctatcctgtcgccctgaaggacatcctaaacctgttatcactgggcagtggcttagttttgtgaaggataaaggtgtgaaggtaggtgataccgtaacaataactcaccaaaataatggaacgagtgaaggccaatacagcatttcagtgttcagaaagcttttcaatgttttggctaccttgccagcttga

SEQ ID NO: 13138 - DNA, 744 bp, Populus tremula x Populus tremuloides
  Predicted polypeptide sequence is orthologous to G636
ttttttttttttttttttatgaacaacctcacccccaaatgtcacacaatatggaaataaataaatgtaccgtacgtcaccttctcatcaacaagttaattaacatctacatagctaatcaaagaaaaaaaacagcttaattaactaattaattaattacttgttgtgccatagttgctgctggttcttctccttgttgagcttcaagtcaaacttattagtattccacaaatgctgatctccttcgtttatttgaacctgaaagcagctgttatcattgacttgactacccacataagagttagaaggtgatgaattcattccattataggattcaagttgctgaaaataattgctggtccttaaatcctctttacgcttcttgttagactctgttgtcatgttaaagtagatattcatgctctcccatttctccttgcactcatccacactcctatcatagcctaaactagccatttctgctgctatctcctcccaaatcccttcattcgaatacccattctcttggaatcttgagtccatggaggttctgagctgtatgaagctcaggatctcgggttcagtccatgtaatgttgttgaacttgtctttctgaatcttcttagcaccagcgctgtccgggtttttgttgtgcctttgagtggctactgcgatttgctcaactgacgatgacagttcgagtcctttctccgtatgtttcttcaaggttccattaatgcagca

SEQ ID NO: 13139 - DNA, 789 bp, Populus tremula x Populus tremuloides
  Predicted polypeptide sequence is orthologous to G636
ccgggcacagcaaacaccaacacctacgccaccgccgccaccgccagtggcacaagtgccaccacctcaaccggtggctaatccggacatgatgaaaccagataatggggatcagaattttatgtcagcaagctcttcaagatggcctaaagtagaagttgaagctttgatcgggctaaggactaatcttgattgcaagtaccaagaaaatggacccaaagggccactatgggaggagatctcagctgggatgagaaagctcggttacaatcgcaatgcaaaacgatgcaaagagaagtgggagaatatcaataagtacttcaagaaagtgaaagagagtaacaagaaaaggcctgaggattcgaaaacatgtccgtactttcaccaacttgatgctttatacaaggagaaaaacaagattgatggtccgtccaatagtactcatcatatgaaacctcaaaattcagtgcctttgatggtactccctgagcaacaatggcctccccctcaacaagaacatagacctgattcagtgacggaggatttagaaagtgatgataatcaaaatcaggaggacgaagatgataagtgtttggatgatgaagatgaagctagtggctatgaaattgtagcaaacaaacaaacatcaatgaacacagccgggtgagagttttaagtccacagaagcaaattaactctttgagtattcagaggaatactggcaagagcgtcggattctggcgtccttgaatcggaatggcgggctctgaagcctgaattaatttgtaa

SEQ ID NO: 13140 - DNA, 500 bp, Populus tremula x Populus tremuloides
  Predicted polypeptide sequence is orthologous to G638
agctgggagacaagatggcaagcattataggttctttaggcagcttgaagccctttatggagagccaagcaatcaagcttcagcctcagaaacccattttgttaacaacacacttctttaccaagctccaatgggcaacacaatcaaccaagaaagtcaagaaacatttcaagaaaacaagcacagtgagagtctgagtttctccaacacatctgagtttgagacttcttcatcagaaaacaatgatgatgacctttcagctattgcttacaacatgatgaaccgatcaacggaaaaacagaaagggataaatgagagccaaagtcttgcgaggcctaaaaagagttggaagctaaaggttaaggactttgtggactcacaaatgaggaagttgatggagaaacaagatgcctggatggagaaaatgttgaagaccattgaagatagagagcatgaaagaatgtgtagagaggaagagtggacaaagcaagagttgggtc

SEQ ID NO: 13141 - DNA, 480 bp, Populus tremula x Populus tremuloides
  Predicted polypeptide sequence is orthologous to G646
gcaaacacatgttttcaaccgggtttcctctgcaagaattcgagccatcaacccagaacttttcttttgaagggtttgaaagtgggtatagtaacattcaaggtgtgcatgagactggtagtagtgcgaggattttgtttcctatcgaggacttgaagcagcaggttccaagtaattctgaatttgagcggattaatgttagagggcaaggagatggtgctcctggctattggaatggaatgttaggtggtgaatcatggtaaaattcacatagagaattatggatatgatcacaagatgttaatctagtcttgtgttttaccttaatttagttttccttccccttttcttcgctcggcgatcgagtgacttgttttatgttaaatcaaaactagctagctagctgacagatagggttaataattttctctcttgctttcattaatttctagcttgatttttccacccttttctttaaca

SEQ ID NO: 13142 - DNA, 603 bp, Populus tremula x Populus tremuloides
  Predicted polypeptide sequence is orthologous to G653
aatactagtagaatccacatatttgcaattgaaattcctccgcaagtaattttacatttgtgggaatttgaaacccatctatcaatcaaacacaacaaacatgcccattatagctgggcagaaaggaagagagagaaaaaacaaggcagaaccaagttttgcatactccttccaatggaaatcggagggcatgaaaggaaaacacaatgaaaagtagataaagccacgcaaataaaatatcaaatggagatatttaagcctctggcacagaagccgctgcacgcttcattgttgcggacttgatgaggtggttgtagctgcccttttccttgaaaagttgggagaagtgatgcttgcaatacaatacgccctcaagtgctgcataatttgatggtgttatagcacagccaccgtgcgagcacttgaaacatgatttgtgataggcttggctttaactgtaccttctcgagcggataagcagttttaccacaagtagcgcacttttcttgtgtccctgaaacatgctacagcttgctagtgaccttgtagtcaggattaacttctagctacttgcggtactgaagtctgtgagtccgtctctga

SEQ ID NO: 13143 - DNA, 680 bp, Populus tremula x Populus tremuloides
  Predicted polypeptide sequence is orthologous to G715, G1646
ttttttttttttttttttcaaatcagtaacaaatagataataaattaagcgactgaacatcagatataattaggcaagtcagcagcaaatgtagagctgctatacaatgaagttaataagttttaagaagtctctaacagctaaggacagctttcttgaacaatagccaacaagtagacttggagatcatatgcactcaaattccaagtaaattagtcaaggtacatatttgccttctgtcatgccactaatcactgcatctgagaagcttaaccttgtccatcaaggttcccttgtccaccactcccataagaaccatcctcagcggcagctgtctgccaaacagattgccatgcctgagaaggtggctgaacataaaccccagtggcaggatccacagctggcctcccaatcatcatccctccagcggcagcggcaggctgtcccatcggagggtaataataaggtaccccactagccgtagcgccgacaattccaccaagaccagcagcttcctctttgatctcatctctaggtacaatatcaaccaagaaatcaaaaatgtcagttctggtaatagcagcagcaatgtcattcttctgtagagtccttctcttgttttcctcagcatgaagccaagaacgaattgtcagttctaaaatgaagagctccatgcttta

SEQ ID NO: 13144 - DNA, 815 bp, Populus tremula x Populus tremuloides
  Predicted polypeptide sequence is orthologous to G718
ttttttttttttttttactataatttaacttttatatctaagattgcggaaaggttttaaggactgaccaccacatgattactgtaaatttaagttgcagtgagcacaagaaagcattgtgcatctaagctaaatgtcaaactagatactgaccttcacttaatttgttaagatgaatacatcgcttcagcagtaagtcatctggatggaattgaagtcattcccctttgatgttcttaacagctgaaactcttgaaagtaactgctaccatcagtgtgacgtcaaggtatgcacttgagagtcagttgacggttgctcagtccgccaatactctgatgaagcaagtggtgagttttggggtataacttgcagcacagactgagtggtgtgatttgtatgcatgggttgttcaaatgaaatagattgcggttcacgtgaaccccatgaattgtttgacagaagagagagagcacgatgagattctggtgctgcttctgctttggaaggaatgatgtattcttccaaaccttggttgagaatcccagctgcagtgcccttgcctttagatggtaaggagctattagacttatgatggtgctgaatatcaatgccatttgtcagatcaaagccaggcaagtgaaactgcccgtcattaccacctatttctccaggctttgctatataatcttttgttattgtgaacttggagatgtatgtgccttcccacgtcaaatttgaattaggcctggcatgaacaagtggtgccctgtcccatgcaagactcatctggtgcctttcatcatataatgatgaa

SEQ ID NO: 13145 - DNA, 632 bp, Populus tremula x Populus tremuloides
  Predicted polypeptide sequence is orthologous to G718
cttacggccggggattgttcactttttgttgatggtaaaaagatgaaaccagctccattttaatacaagttagatatactgagacaatcgagatataaagagagaaagagagagaggagagagcatttattaggtgtgctgggtggagacagtttgttaggtaacacactgagaagtcatggttgtgtctaggagaggatctggtgtcccattgcttgttgatttcatgaagaagtattctttgtgaagtgattctataagttctgacttactgatggagtggaatggcaaacctcacttacagtgggactgggagagcctgataatgtttaatggaataacaactgaaaattctaagcagttaagcccaacagatttggaaactgatggagaaaaaggaaccgactctggttttttctattcatctgggagtgcaagcagaagcggtggttctagctctgatttggaacttgcttctttctcaaagtgctcgaagtcagcttccatccattctatatcagctggggaagttaaaacatccaaattcactttggacgcctctaaagcaaatccatctgattacaacaagaaagaaattggaaaggctaagacagctagtatgtcttccacaa

SEQ ID NO: 13146 - DNA, 821 bp, Populus tremula x Populus tremuloides
  Predicted polypeptide sequence is orthologous to G728
ggttactcatcattctacttgggtatgttagaggcattttggtatgaggagtaattctgggtgaaacaaagactaaaacgatggagcttagcttggacttgagtttggtttgtgaaccaaaaacaataaatgatatgtcttaaagaggtttcgatggttaaagatggaagccaaaagttaccaaagctttatgattatgtcgagagattagaagatgaacggagaaagatcgacgcgtttaaacgtgaactccctctttgcatggttctcttgaatgaagctattgcgagattaaaggaggaggcaatgcagtgcagtgaattgaacgatttgataccattgaaagggaattccaatgaagatgggaatgataaaaagaactggatgagttctgttcagctttggaacactaacaaccacttggattgcaaaaagcaagactcgaaatcagaacggaaacagaaaagtgaagaagatgatgataggtctacttgtgagaacccagttcagttaggtaatcatagcaacaagggaggggcttttgtgccccttcaaggctctttctggttttgaagggagtaaagggaaggaagaaaaggaggttgtttcgcaagttaccggactctctcctatgacctcagttcctgatttgagttcctgcaattggaccgcgaaagagcacaattgtagtattcaaacgaaggtctgagtaatcacacagcagcaccagcagcttaccagaagcagcggcggtgctgttcaccaaagcttaccggcgctttgttgatgcccttcacaccttggtggttgtcaagtggcca

SEQ ID NO: 13147 - DNA, 506 bp, Populus tremula x Populus tremuloides
  Predicted polypeptide sequence is orthologous to G728
gatgaagttaaaagtcccttgcaaaaatacaggcttcatctccgtaaagtcccagcatctccagcagccgcagcatctcaagatcaatgcaaggacccttcaacaggtaacatttcacagtctaattctccgaaaggatccctccatgcaagtggctctgccaaggctacctctaatactggaggagatagcatggaagcagaagatgatgacaaatcagagagtcatagttggaatggtgcgcttcacaaaccaggagaagctcatgtatagtttgacaaaccgattctgatcccatgaattttgcagatacaaatatacatagggaattggattgtagtctgtagagatgagcagaataatgaagtttacaaagataggattcaaaactggagtgttttcttaccttgagacagtaccattagaggcatggtgaaattttgcagataatacaggctgtgtccttcctgttgagttcatcatgaatttctgtaattcatattaac

SEQ ID NO: 13148 - DNA, 621 bp, Populus tremula x Populus tremuloides
  Predicted polypeptide sequence is orthologous to G729
gggagttttattggctgtctattagatggctctggtgatgaagatttcatgtctggaacagcgtgctttaatcaaaatgcaaactatttactcaaccagaaaggaggttcaaatgtgcctaatttacagcatgataatggtttctctcactctcccaccactctatggagcaactcttctagcaaaggaggaggatggcataacagctcaagagatctagatggactgaagggagaagctctatcttctcaacaagtatcgggaaataaactggacggagttggttttgctcaatcaagaagctttacaggatccaatcaagaactcaagaatccaatcctggagatttccttagggagaccagagtactggcaaaacgaagaacatgaatgatttaagatagagttgtgctggctaacaatggcatggtatttagaattccctttttcttaaacaaaaagaaaaggatcatagatgatataaatagatatagggctttgcaaggggagaagaagaaagtcttgttctgtcagttcagtgcatgtctgtctgtatattcttttttagaccattgttggactatgttatgagttgatgttagtcattacatggtgtattcaa

SEQ ID NO: 13149 - DNA, 828 bp, Populus tremula x Populus tremuloides
  Predicted polypeptide sequence is orthologous to G748, G1900
agaaggattttgttacaaccagaatctctcttctgtcgagttatctcacacacttacataaatatataaacatctaagataccatgtacatgaaaaacttaggaaacagatatcatctaagatgaataaggaaaaactacaggtcttaaagtggcagggaagtgcatggtcctgtcaggtggctatgctattctagagagtcaaaatagggacacgcaattctgggttttcttctctgcaggaattctgtcaataaggtggccttctggtggtgtaagtgccaaccttctagtgtaaaagggaacacaaattcgttgagatttagaggctacagcactctgatgaaaaactccatttcattgcattactgttatagcagaaagtgtacaactttgctgatctctcatcaagtgttctcatggaaattgagagaccgggaaaacgcagcacggttcgcttgcaacactggagttgttcctgccatgtaatttctgtcttcgttttttgattgaaagcccttgaagagacctcctccattaatagaactggatttctcattcgtgatcccgagtgtcgcccatatagagctctttgcagcttcactaggatcatcaatcctcaaggtctttggaaccaaaacacccgtttctgatttggtgcccgttccctggagggcctcttctaagcagggtggattaaggatgtggccatccctttgaatgtttcccccagtggaaaagtacgactggagctttgggtactgtggtttaaaacccggccataatggccgatttccccggttaccaacaccatgggcgcgccttttcc

SEQ ID NO: 13150 - DNA, 726 bp, Populus tremula x Populus tremuloides
  misc_feature (303)..(328): n is a, c, g, or t
  Predicted polypeptide sequence is orthologous to G752
gtttttttttttttttttgaaagtaaactgcatgtaccttaaaattcgtctttcaaggaacacgtgtatcacatagaaggggcacaattgtgccaaaaggccagaaacaatcaaagtaattttcattcattctttttctatgggtagacaatcgagtgatgactgtagaggccaacagagcctggacttattagtctgttgaaagagaattgatttgtacataaaagaaaacatataaaaaaaaaggaaagaaaaaaagatgaaggtgacagacttattttgtacaaaatgaaaaagccagtnnnnnnnnnnnnnnnnnnnnnnnnnntacgaggatggtggcgacggagccactgatgccttgcaaatagggcaccaatttttcagacttagccaatgatgtatgcaggacatgtgatatccatgctcacattgtaaccttcccacttcatctccaacaacatactcttcctgacagatgctgcacttgatgtcatccttatcaccgtcaaggtttgcagtcgcgttctccataggagtggaatgataaatgctagtcttgaggcattctgacaaggcttcctctgttagtgctgtgctcacagtacccattctctcttcaagagctaatagttcctcatatgacatactgtcgatatccagtctcatgtctctatgttgatcatggaagtttagtccattaaggaccaactggtctccaaaaca

SEQ ID NO: 13151 - DNA, 555 bp, Populus tremula x Populus tremuloides
  Predicted polypeptide sequence is orthologous to G778
tatctaattacaactcaacctttttaacgctatatatatagatttcaaggatcatattatgtaccatcattgctggtaccgaatccttttggtttttgttcaatgttgctttcgattttattggcagaaaaggagagataagataaaccagagaatgaagacactacagaaattggtccccagttccagtaaggtacgaaaagtttcttcggtagctgttcagtgtattacaaagaagctctttaaattttacccatgcgcgtttatggcacttcaccattacatattgtgcacctaccaatcttgtttagtaattaacatgcatcccttagctcgtcaaaagtggaaatagtcaccaattattgttgcccgtcttagggttttttttttttcttaaaataacaatggtaaggttattccccagccaagccagtatcatacaccgagaccatgttacttctagatcatcgcaaaataagagggttaagattggattactttctgagaaaaggaaaaaaaattatataattgctaggcctactctagtatggcatg

SEQ ID NO: 13152 - DNA, 636 bp, Populus tremula x Populus tremuloides
  Predicted polypeptide sequence is orthologous to G778
tggccggggaaactggtccccaattccagcaagacggacaaagcctcgatgcttgatgaagtgattgaatatttgaaacaactgcaagcacaagtacaaatggtgagcagaatgaatatgcagccaatgatgttaccaatggctttgcaacagcagcttcagatgtcaatgatggccccaatcagcatggggatggctggtatgggaatggggatgggaatgggtgttgtggacatgaacacgcttgcagctcgttccaacattgcaggggtttctccagttcttcaccccactgctttcatgcccatgaccacatgggatggttctaatggccatgaacgcttaccatctgcagctccttcagcaacggtaatgccagacccactgtctgcattccttgcgtgccaatcacagccaatgaccatggatgcttacagcaggatggcctcaatgtaccagcagctacatcaacaatctccagcttctaattccaagagctaagttttctgctatgcatgcaggtgtctttttaagacaaaatcttggcccgccacagacaaaagacaaaaagctccgcttatgaatgtgattatatgtttgcttgcaatggttatatatgtctgaaacatacactat

SEQ ID NO: 13153 - DNA, 821 bp, Populus tremula x Populus tremuloides
  Predicted polypeptide sequence is orthologous to G782
ttctttgctattgagatcgatatccaacttccctacattatattgttcatcctactggacttcattaaaaagttgttcttaactatttacttgatatgtacgtacaattaggctggaatcattacacagaatattgacctcgttaaatatccacacgtatcttcattaaataatttcttatgacagtcgtttacacacagacgtgggtgatgaaccaccatgcaaacttgccttccttacaatcaatgaggtctcgcacttacatttggttttaaccgcacttgaggattgttcttgtccttaaaaacaaaagttggcaaacatgatcccaaccaccgtccctggaagtttcttcaattaacgtaagcatgcggccttcaaaaaaaagaaaaaaagactcagtacagagacaattagatacagaagggattagaaactagtatatagggcagtaaaatgaaaaaaaaaaatgaatgaagaaggcagattgcatataataaatcacaaatggaaatggatgatgaatatgcaaaagttggaaacaacgtaactcccggggctcatcaattctctcgtttgtctaaatcactgacatttgtgttgctagctacactgttggatgaactatcctgtacactacgagaagaaaaacatctacttgaaaaactctcttttgtaacactgctttccttccccgtggattttttagattttctttgtactgaagttaagtcctgatctgctgtggatcccgggagtcttcaattccaggtctgtggtaacatcattagaatcctcgcttttctcaaccttgctctctc

SEQ ID NO: 13154 - DNA, 826 bp, Populus tremula x Populus tremuloides
  Predicted polypeptide sequence is orthologous to G791
ttttttttttttttttttttttgaaataaaattatgattgcttttttagcagttattttccaattttaacacaccagtgcacataaacatctttctcaaacgagaaatgagcaacatatttgaagataaaaactggtaagcaaaattaccaaatttgactaatgaaaattacaagttattccagcgatcactaggaattccaagtttcccatctgtgattgcactcatacattcttatactaaccaatctatcagagcgaaagatgattgaaagacaaacattatctgtgaccattaacaagaatcatagttagtaaaggcaacaaaagcttccatgctctgcgaggacgtagacataaaatccctgcctgaataacttaagcaactggagggcgtagaacatgatcctgagaggtatcaacaacagcagggggcatgaactgccacatagaaattccaggataaccaacaaagggcatcatcttgctgccaacaacttggcctggggcaaaaaatggagctggaatggcagagggatgaggcaggaagtttggtggagcactcaaggctttcacttgccgccctaggttctccttttctgtctttagcctctgtttctatcacgaagctcattcttctccgctttaattcatcgatcttctcctgtagactcacattagactctttcagcttctgagattcatctcgtaactgagtcaccattcgagcagcatcaaccgtatagcagatttgtccactttaggaggccttccagattctagaagaacacccaattcatgaccatggcgttcaggctatcccgccg

SEQ ID NO: 13155 - DNA, 718 bp, Populus tremula x Populus tremuloides
  Predicted polypeptide sequence is orthologous to G798, G1897
ggacccacatttcacatcctcacaaaccacacgcacattgacagaaaatcactcttctttctatcttcaaacacgacaaaacataaccaatcctcactcctccaacactctctttgcccccaaaagccaaaatgccggcagaattatcaagcagcgaagcaggaaggagaccacagcaatcgacagctgcaacattaactaagccaggaggagcaccacctcaagaacaggagcacttgccatgtccacgttgtgactcaacgaatactaagttttgttactacaacaactacaacttctcccagcctcgtcacttctgtaagtcttgccgccgttactggactcacggtggcaccctccgggacattcctgttggtggtggcactcggaaaaatgctaaaaggtcgcgtacttcagctacttctcctgcctccttcgtgggtcctattacaggcactaatattgatggcttgccactgcctgctaccccagtgctgctcccactcacagccaatcagggtttgtccgtccactttggtggtggtgatgggaagggtaacggtggtggtctgggtgggagttttacttctttgttgaatactcaaggcccagctgggttcttggctcttaatgggttcgggcttggaattgggcctgggattgaagatgtgaacttcgctcttggaagagggctgtggccttttccgggaatgggaga

SEQ ID NO: 13156 - DNA, 444 bp, Populus tremula x Populus tremuloides
  Predicted polypeptide sequence is orthologous to G802
tctacagcaagaagtagtaacaaaacgaaccgagcaaagagagaaggaaaaaaattaaacagatctaaaaacaattaaaatcaactgcttgttgtgtttttttttctcatgttgtagatcatggtgaaagacaccacgggcagggaagggaagagaagaagtcaatccagacccccctcattccctattttttttctagcagcagcgcttgaaaaaacacgccaccactgttcctaacacctagaaatttccagcattgttcccgagttcaagcaactttttccaaataattttttaccttgggaaggtcccatttgtaatctttacatgttggctggaatgtgtatttacattattgttagcattttaaattttttgacattggaaacttgtaattacgggcgtgggagtaaattatagtaaaaagagaatgtgtttgtgttt

SEQ ID NO: 13157 - DNA, 253 bp, Populus tremula x Populus tremuloides
  Predicted polypeptide sequence is orthologous to G811
ggggagggaacttgatgatgccatttctattatgaaacaaaaagacatattccagtttaacaaaaccttctatgaaaattttttttaattgggggaaacaaaaaaactttgtaattatttccctttcaccatccttttttttgataaaatgcttaaattcaccggaatatcttatgtgaagggtttctagctttggcaaactctgagcgagggacggggtgaaaataaatgtcattttgtcaaaaaaatccaa

SEQ ID NO: 13158 - DNA, 766 bp, Populus tremula x Populus tremuloides
  Predicted polypeptide sequence is orthologous to G831, G1202
gttttttttttttttttttcagaaaaacatgaaagatgcattctgtaaaagaaggcccttcattcatgtattcaggaatacaaaccaactgggtatcaaagaatcgttcgaggttaagaatgaaataaaattaagataccaaaataaagaaagaaagaaagaaatctccatctctaagaaacaaccagcccttgattctggccaggttttggcgccgtccaatactttttggttgcaaaaagaatcttctccctctcgtgagggctgctctcatggtccgcaatcctgccatcccattgcatcgcatctatgatactcttgaccttcatcaagatgtcgacatcgtctctcataacaacactcccttctggcctcaaaatcctgtccatttctaatagaatatcttccatatcacacctatccttgtagaggctgaaaacagaatcagcattaataaagtcataagtcctcgggtaagtagacatggcttcacaccaattctgatacgttccaattaggccacgctcgaaaatgacccctaaagtattggtctttgcctggacagggacaacgttcataaccacaagggatcgtcaacagggcagctgcaaaccctctagatgcgcattcatatcagcaagtacggtaccgtcagttgtgcagctgaagtcatcttctgtaacgctctctctttccagctctgagtttcatgagttcagctgtatcctcagctccctgtatctgaggatgatcatctctctgcatt

SEQ ID NO: 13159 - DNA, 732 bp, Populus tremula x Populus tremuloides
  Predicted polypeptide sequence is orthologous to G837
ccgccaaactgagagaggaaactaacgtaactctccaagcagagctctgaaactccactcaggcttgatctaatgtttcaaatcctcaaagcaagagcagaggactgacttatgccaaagacgccttgctcactcaaaccttacgggatttgatgggaaaacggaacttgagcaaaagcaatccttccgaggagaaacaagaagttatcatcatcaccgtagcaaaactctcatgcatttgcaggttgatcctgaagagctgcatttatacaaaattagttggcgagaggacttctctaggagcaactcgaagaaaacttccgcagaaacgaggaaataatgacaggaaattaagcaggagcgtcaaaacgacaagagctgacatggttgagatcagcgagggacaaaaacgcataagagagggacagaaggaaatcaggaaaagatttcaagaaataagcgaagagaccgccaaactgagagaggaaactaacgtaatctccgagcagagctctgaaaatcaactcaggcttgatctaatgtttcaaatcctcagagcaagagcagaggatgattctgccaaggacgccttgctcactcataccttgcgggattgtgggggaaaaacggaactttgagcaaaagcaatccttccggaggagaaacaagaagttatcatcatcaccgtaacaaaactctcatgcatttgcaggttgatcatggaagagctgc

SEQ ID NO: 13160 - DNA, 487 bp, Populus tremula x Populus tremuloides
  Predicted polypeptide sequence is orthologous to G839, G1196
gcttcgttctaggatggaagccctaatgaaaacagtggaaatgggccgacgatacttccctagttgctctgaagtgcttgataagttcatggaggatgacctccctgatttgtttttccttgaaaagggcaccccagatgaacaaagaatcaagaggacacgtttcatggaacttaaagaggatgttcaaaaggcatttaacaaggacaaggctgtgattaaccgctctgttttgtcttcctcgtcatcctcatccttctctaaaagatggtgttggtaacaagctcaggaaactatgagggcatgccactttgtcgcagatttaagccttaatattagttaaagattttgataagcttctttgtacaattttaaccgaagagcgaactaactctgtaagctcatttgcctgtattattaaagccttccaaagcttttatttcgaaagctcatagaaattctctctagttaccgcaaaaaacaataa

SEQ ID NO: 13161 - DNA, 647 bp, Populus tremula x Populus tremuloides
  Predicted polypeptide sequence is orthologous to G849
gctggaggctgtgagtgctgtacttggaagtggtttacgagttggggtgcttcttcatggaatgaaggttagggaagacaatagaaccctattgcagactggtatgacttctaaagagaatcttgataccctgggtttctcattggagcctattcctgtccaagcacctccacccttatgcacagaagatcctgcactattaccatgtgacacatctcaacttatatcaagttctccgaccactcctattatagattcaggaatttctgatgccttacctgatcctcctccatcgactaatttggacactaacactgaaagtaatcatgaatcagtttcctctcattctgacttggtaactgatgatacactgtcggattctagagctctggttgcagttccaccaattgatgctgaggctcttgcaatggtgcctttaaacccgaaatctaagcgatctgaacttgtacagcgtcgaaccaggagaccattctctgtgtcagaagtagaagcacttgtgcatgcagttgaggaagttggaactggaaggtggcgtgatgttaaattgcgttcttttgaagatgcagaccatcgcacatatgtggatttgaaagataaatggaagacattggttcacacagctcgga

SEQ ID NO: 13162 - DNA, 690 bp, Populus tremula x Populus tremuloides
  Predicted polypeptide sequence is orthologous to G852, G2633
ttgggtgcttatatgttagaagggcttagggcaaggttggaactctcaggaagtaaaatctacagagccttgaagtgtgaagcaccaatcagctcagatctgatgacttacatgggcgttctctatcagatatgcccttattggaagtttgcatacacgtcggctaatgctgtcattagagaagctgtagaataggaacccagaattcatatcatcgacttccagattgcacagggaagccagtggattcttctaatacagatgcttgcttgccggccaggtggacccccagcaattcatataactggtgttgatgattctcaatcagctcatgctcgtggtggaggacttgatattctgggacaaaggttatcaaaagttgctgagtcctgcaatgtgccatttgagttccatgatgttgccatggatggtagtgaggttcaactggaacatcttagggtccaacctggggaagctgtggttgtgaattttccatacgtgttgcaccacatgcctgatgagagtgtggacacatggaatcacagagatagattgataaggatggtgaagagtttgtcaccaaggatcgtgacactcgtcgagcaagaatccaacactaacaccaaaccattctttccaagattcagcgagacactagattattatgcagcaatgtttgaatctattgca

SEQ ID NO: 13163 - DNA, 848 bp, Populus tremula x Populus tremuloides
  Predicted polypeptide sequence is orthologous to G852, G2633
cttcagattctagcctaagtagcttcagcagtaataaagaagtatcacagttatctcctcgaactcccaggcgattgctttttgaatgtgctaatgcaatctcagagggaaacattgagaaagcatcgactttaataaacgagctccgtcaattggtgtcaattcaaggagatcctccgcagaggattgcagcctacatggtggaaggtcttgcagctcgtatggctgaatctggaaaatatctctataaagctctgaaatgcaaggaacctccttcttctgataggcttgcagctatgcagatcctttttgagatttgcccttgttttaaatttggatttatggcagcaaatggtgcaatgatcgaggcatttaaaggtgaaaggagagttcatataatagattttgacataaaccaagggagtcagtacataacactgatacaaacactcgccgaccatcaaggtaagctaccacacttgaggttaacaggggtcgatgaccctgagtcagttcaacgacctgttggtggcctgaggatcattgggcaaaggcttgaaaagctagctgaagcacttaaggtctcgttcgagtttcacgcagtggcctccaggacttcacttgtcaatccatcaatgctgaactgcaagcctggggaagcacttatagttaattttgctttccaactccaccacatgcctgatggagagtgtttcaacggtaaacgagagagaccagcttcttcggatggctaagagcttgaatccaaaactagcaacttgttgttgagcaagatgtgaatactaatactgcccctttttttcccgagatttaccggagcttacaac

SEQ ID NO: 13164 - DNA, 587 bp, Populus tremula x Populus tremuloides
  Predicted polypeptide sequence is orthologous to G852, G2633
tttggtggagcaagaatcaaatacaaacacaacccctttcgtcactcggtttgtagaaactctaaactattacctggcaatgtttgaatccattgatgtgacgctggcaagggatcgaaaggagcgtattagtgtggagcagcattgtctagccagggatatggttaatgtcattgcttgtgaggggaaggagagggtggagcgccacgagctctttcgcaagtggaagtctagattcatgatggcaggtttccagcaataccctttgagcacatatgtgaactctgtgataaagaccttgctgaggacttactcagagcactatacattggtggaaaaggatggagctatgctgttgggatggaaagataggaatttgatctctgcttctgcctggcattgatgtcggaggagatgaaggttggatgtactatatagctattacatgtacttttcataggtgggaatggtgcgtgcccctttctaggagagtgtttaaactgtaaggtcatcagcagaaaggtttttgtaatatctgtatgtcatagacaatgtaattctattgcatacttcaaaatttaataaca

SEQ ID NO: 13165 - DNA, 694 bp, Populus tremula x Populus tremuloides
  Predicted polypeptide sequence is orthologous to G861, G1140
ggtgtttgttttactttcggtaacaggaagcttttgattcctctgatcagacctaactcaagccagctcccaataagtataatggctagagagaagatcaagatcaagaagattgacaacgtgactgcaagacaagtgaccttctccaagaagaggcgaggacttttcaagaaagctgaagagctttctgttctttgtgatgctgaggttgctgtcatcatcttctctgctaccggcaagctctttgagtattccagctccagcatgaaggatgtgcttgcaaggtataatctgcactccaataacctcgacaaaataaatcagccgtctcttgagttgcagctagaaaacagcaatcacatgcgattgagcaaggaagtttccgagaagagtcatcaactaaggcggatgagaggtgaagatcttcaaggactaaatatagaggaactgcagcaattggaaaaggcgcttgaagtaggacttagccgtgtgcttgaatccaagggagaacgaattatgaatgagatatccacccttgaaaggaagggagtacagcttttggaagagaataagcaactaaaacagaagatcgcaaccatttgcaagggaaaaagacccgcccttgttgatttagacacagcagttcaggaagaaaggatgtcatcggagtctacaaccaatgtttgcagctgca

SEQ ID NO: 13166 - DNA, 474 bp, Populus tremula x Populus tremuloides
  Predicted polypeptide sequence is orthologous to G865
tgcacaaatcctttctagcaatgatgccaatttcccgtactacacttcaaacctctttaatcagcaaccttttgctccccatttttcatcaagctttttatcacaacaacaacaacaacaacaagatctattgagattctcgtcaaggttcgacagcccctctagctctgatcaacaggaacatgggaaggactccagtaatcctagcgagtaatatgttaattagcatcattcctttgaagcagtaatgccattagatgtcgagaagttcataattgatcaagaccttccaagtatttttgttgtgttttggaagctcttctctttcagttccctttttgtttcaatgcatggggtagacaccctaatatatattagtcaccccaagaatcacctatcagttggcaatttgcatgcatggtctgtactctttggagagataactatatatatatatatatatgagaaattttg

SEQ ID NO: 13167 - DNA, 692 bp, Populus tremula x Populus tremuloides
  Predicted polypeptide sequence is orthologous to G872
ggatcacaaacactaccacaaaagcagagagcacacaaaagctaaaatcataaatggtgaagcacagcgtcgagaagccagttacagagagaaacgactccaaattcaagggtgttaggaaaagaaaatggggtaagtgggtgtcggaaatcaggctaccgaatagccgggaaagaatttggttagggtcgtatgattctgctgaaaaggccgcaagagccttcgatgccgcccttttttgcttacgcggtcgggttgcgaaatttaattttccggagaaccctccgaacatagcaggtggcaggtcactttctccagctgagattcaagaagctgcagcaaggtttgccaattcggagcctcagagaagccaaccggaccggtttgaaacggatcaatccgtatctgcatccgaatcccgagcagaatctccctgtccttcggttgtatctgatgggactgtccagatggaaggtggtgagttgatgtgggatgggccgtttttggatatgttaatgaacacgggttcgtgtaatcactccacggaatatgggatatttcagggttttgatgatctttacaatgattttttcccaccatcattaattcctaatcttgattatggagaggaggccaatcttgatggtgtcttagaacaggaatcgtttctttggaatttctaaagaaagtta

SEQ ID NO: 13168 - DNA, 490 bp, Populus tremula x Populus tremuloides
  Predicted polypeptide sequence is orthologous to G877
aatgcaaacaataattgactcgccgcatcgcgcgggtcatttaactagtatgttcctattttccttgtaacaacgacaaaaatcataacaacaatcaataaataaacgttttgataacatattagagaaattaaaaattttacatctgaagcagcctactcattaaatgctgatacactgcttggttgttggaggacaggctcatattagtttcagtcactggctccacctttgcttctcctttcggcatcatcaaccccatttcattcactgcacgttgctgtgctaggtatggatgcatgggcataactggcatccttggttgccctggacctaacccagccattcgcatattggcaaacccaggttgattcattccaaatgagaagccagccggaggccccaactgctgcctgaaggacccaaatgcaggaggcctctcaaatctaccagtcatgctgttgtgaacttggatgcctcaggtctgtga

SEQ ID NO: 13169 - DNA, 676 bp, Populus tremula x Populus tremuloides
  Predicted polypeptide sequence is orthologous to G898
aatagtctataacttttatagcactgggtttaatattcaagttactatctgtaaatgtcataaaacttcctctgcaatctagtcactacgtaccttagtcaacagtaaacgaaaacagatcactgatatgcatccaatagacataaattttattccaataacaaaacccactattgccaccccactattgccaccgggcatttcattttgagctgcacaataagttagacaaattccttcaggcgaaaaattagaatccaccatagccattgctccatctatatccctctgtctcagagttctttcttttaaacataaacagcaattgaatgtgagcatcaaaatcaactggttgctgggaggaacactctaataagttctttattagtgacccttttcctacaagtaggacatttagcctgtcttttgattgcgtctgcaatgcaagtcttacagaaaatgtgtccgcattttgttgacatctcgtcaaccaatggacacaagcaaattggacagttgaaggttggctcctttggcggcagggtctgcacattctccttcatagacctgctgctgctgctgctgctgctgcctccttccaaattgatgtaaagatcacaattgataatcgtttggtttggtggacctcttctacgcttgttgaggttattgtgag

SEQ ID NO: 13170 - DNA, 532 bp, Populus tremula x Populus tremuloides
  Predicted polypeptide sequence is orthologous to G903
cccagacccagacgctgaagtgatatcattatctccaaagaccttattgaccaccaatagatttgcgtgtgagatctgcaacaaggggtttcagagggatcagaatcttcagcttcataggaggggtcataaccttccttggaagctgaagcaaagaaacagcaaagaaattaaaaagaaagcttatgtctgccccgagcctacgtgtgttcaccatcatccttcaagggctttgggtgaccttacaggtatcaagaaacattattgcagagaagcagagaagaatagaatgggaagtgcagcagcccaaatcccgacgagctttggacatgagcccagagcatgtcttcgttgccgccttgtcaaaacttacgaccagttcagagagtcgggatgcgagaactgtcccttttttaagatggacgaagatcatgagcgtgtcgttgattgcacaactcctaactttaccgggataatttctgttatggatccgagtagaagctgggctgctcgctggttgagaattggaaga

SEQ ID NO: 13171 - DNA, 629 bp, Populus tremula x Populus tremuloides
  misc_feature (507)..(507): n is a, c, g, or t
  Predicted polypeptide sequence is orthologous to G921
gggccgggtgtatagatatacttagagctagcttcttcaagagagagattcataactaattcatcaatggactcatcatgggtgaacacttctcttgatctcaacatcaatcccttcaagcatgtcaatgaaatcactcaagttcagaaaataaaaaaattcgagggatattctacctgggttgaacagaaattacaggttaaaaatgaggatggtgttcgtgttcttgttgaagagttgactcggataagtagtgagaacaagaagttgacagagatgcttggtgttgtatgcgataactatatgggtttgcaaaaacatctagctgatttggtgagcaagaattctgtaaaagaactcggtacaccaatatcatcacggaagagaagggccgagagtgaagattatagcatcgtgattaatggaatcagtggaggaaatgcagagagcagttctgttgatgaagagtcaagtaaaaggccaaaggagagtctgaaatcaaagatntcaaggacttattttaggactagtgaatccgattcaagcttggttgtgaaggatggatatcaatggagaaaatatggccaaaaggtgaccagagacaatccttctcctagggcttacttcaa

SEQ ID NO: 13172 - DNA, 714 bp, Populus tremula x Populus tremuloides
  Predicted polypeptide sequence is orthologous to G926, G2632
tacggccggggagaacaacgtgcaaaagcagaggttgacaagaagctgataaaagctagaaagccatatcttcatgaatctcggcaccggcatgctatgagaagggaaaggagttctggaggacgttttgcgaagaaaaccggtgatgatggttcaaagaacacatccgaaggcaagctcaatggttctggtccggtccatgcatctcagtcacggagttcatcaggttcagaactcttgccctctgactctgttgaaacttggaattcctctgatggtcaaaaggaagcaagagagtcccaagtgcatgacacttttgaagctcatgactatgtgaatagaggtggccactataaaaaacacagtggcttgcaatcctctgcatacggctcgtacgtgggtgacaatgaggatggagaccgttcaggtgaaaatgaggacggagactgtccaggccagcaactggggaaccaggccaaacgaaggttttttggccctcagtgaacccagcatgttaagtggatgccaaggtggagggtccaattcacgcgggtagcgaaacttgaatcctctctcttatcaggcaaccacgcacttggcaatgtatattgccaggcggcaaatcattcttggctttttctttttcttgcttgtggcttgaacagggtgaaggagatgatgaatccttggggtggctttcttttgtctgccaac

SEQ ID NO: 13173 - DNA, 590 bp, Populus tremula x Populus tremuloides
  misc_feature (547)..(547): n is a, c, g, or t
  misc_feature (563)..(563): n is a, c, g, or t
  Predicted polypeptide sequence is orthologous to G927, G1334
atacggccgggggctccccctctccgtttgctttctttttgtttgttgcttgagattttacagaaatggctcttaacaaatggtgtttctttgcttctgtatgagacctaagttgttgcttgcttctactactgagaattagtttgaactactgttgggataaagacgattaacgcaatcacaaaggtcattgcagagggaatttaacgacaatgaaaatgaaagaatatgaaggaattgtccataatccaagcgggcagttgtcagcggtgccatggtggactgcacttgggtcacaagctgttactggtgaatcgtgtggcctcttgagggctttacctgtagaacagcttgccattggaggtgaagctgcgactaagcaggccaggatgagtactgaccgaaggctagataaagggaatattactcaattcactatatttccaggtgactggaaaacttctggtgatgaacagagaaatcttcaggcagccatttcattgcaaacagctctgccagagtatcgtgctcattttgacctgggatntggtcagcctgtgatntgcacaaagtatcctcttgtggatcaa

SEQ ID NO: 13174 - DNA, 295 bp, Populus tremula x Populus tremuloides
  Predicted polypeptide sequence is orthologous to G927
aaagtttccgaactaatccctcattgaagcagataaagcggggagtcaaggatcaaaagctgaaaggttagataaaatagaaaatgtgccagttgctttagctttttcagaatgcgactataatcgcatgagattggttttgttccttgttgatcgaacatgaacgaagagaagatctaaatttatacatttttttaagaaggaaaaatgatttgatggtcaggatcttgcagcgaaatatcgctgctcctgttatcattactttttattggtagaaaaaaaaaaaaaaaaaaaa

SEQ ID NO: 13175 - DNA, 687 bp, Populus tremula x Populus tremuloides
  Predicted polypeptide sequence is orthologous to G938
gatccggagggagtgcatctttggtcattaatgattccagtgagtatgatgttgaaggagctgaagatgagccaaactttgatgtgcaagagtgcaaaccggagactctcagctattctaatctagggatggaaagaatgggtgaaaggctacctcttcgacaacaaccttatccaatcaagggagaagttatcaccagcacggattttattagaaagagaaagccatccagtgatataaacatgatggtggatcagaagatctacacatgcgaggctgttcaatgtgctcatagtcaaatccgattgggtttccccgacagggcttctagggacaatcatcaactaaattgtccatacagaagcacttcattggagtttagagggtcaaattttcatgttaatgaagtcaagcctgtcatctatcctcaaccatctgcactgtccatgacaactgcgccattggtgaacccagcaccctcttccttcaatctatcaggagtccctgaagatgggcaaaagatgatcagtgagcttatgtcaatctatgacactaatattcaaggcaacaagaacacaaatcgtggtaacaatttggtcacagaaggtcacaatgttttccagccaaaaatccaacaccagcaggacaaccacttgcggagtcaaagcaatatgatcaacggaaata

SEQ ID NO: 13176 - DNA, 600 bp, Populus tremula x Populus tremuloides
  Predicted polypeptide sequence is orthologous to G938
tcataaccccagaaaggtagaagagagaaactttgttaatttcttcaatggtcgcagcagctcttacgaatccacaactcattaacttggagcttagctgtggctgcctcttcctgcatcatatactctgaattgcaaagaataagaataggtgagcatctaagcgatagctgtgcacggagattgatatcgcaagagaggtgaagccaatcttaactgagcttagtcatccatccatttctttaaaccgagctgactctggtgtgtgctgaaatgggaatctttgaagaaatgggattttgcaacaatctggactttttctcggctcctcctggagaaatggatgtggttccggaacgcgaaccagaggcaacaatcgaggaggattacagcgatgaagagatggatgtggacgagctggagaggaggatgtggagagacagaatgttgcttaggcgacttaaagagcagagtaagaatacggaagttgttgataatgcaaaacagcgtcagtcccaggagcaagcacgaaggaagaagatgtcacgagcacaagatggtatcctgaaatatatgctgaaaatgatggaagtttgcaaa

SEQ ID NO: 13177 - DNA, 488 bp, Populus tremula x Populus tremuloides
  Predicted polypeptide sequence is orthologous to G957, G961, G2535
caaatcgagctacggctgctgggttttggaaagccactggccgtgataagatcatctatagtgggtttaaaagaattggattgagaaagactcttgtgttttacagaggaagagctccacatggacagaaatccgattggatcatgcatgaatacaggcttgatgacaccaccaacgacactaatgtctcaaatcctataggagaggcaatccctgaagaagggtgggtggtttgccgggtatttagaaagaagaactatcaaaaaacccttgagagtcccaaaagctcatcaagcttattggaggctcatcagattcttggttcaggaaatgatggagttcttgatcaaatacttctctatatgggaaagacttgcaagatggagaatgaaacatatagcaacatgaatatctccaacaacaacagtagtttaaggtttcctctcagacaatagcatcagtgatgggctccatgaaagattcatgca

SEQ ID NO: 13178 - DNA, 736 bp, Populus tremula x Populus tremuloides
  Predicted polypeptide sequence is orthologous to G958
gggttggaactagttgagtagctaagaaggaaccgtgtagtgactctggtcctaaaagattcaccgctggatgctcttgcgagcaattccaggtgcagagagatattttgatccccgtgctgtttgcttccctttggattcagccactatgtgccctccggcttcttctccagttgcagatattgattttcattgtagagatgaggagctctttatgtttttgtataaacatactagtggatcccctctcccaggaaatgtgattactgatgtcaatccttacatctatgcaccatcaaatctaccagaagacatctggtacttgcttcgcgtcaaggagaatgatgatacaggacttggattctggaaggtcaaaggggaggcctgtaagctgttctcgaattctgccatcacgggctggagaaccaccctcgagttttttgaaggccaagtgcctcatgagcgtaaaactgactggttgatgcaggaattctggataactcagaaggaacatagtgaaaaaagaaaggccaaggaagccagatcattatgcagagtatttctgggtggtgaacaagctctaaaccatgaaaatcaactgattgctagcccccacaacgatacccaaattgaccttacacaatcaattggtccagggactcttgctgatacaagccatggttcctcgagcaatcctgagtgaacaaggatgatgaaactgaaaacatggttgcaa

SEQ ID NO: 13179 - DNA, 587 bp, Populus tremula x Populus tremuloides
  Predicted polypeptide sequence is orthologous to G964
gacaagatcgttgcttcgaggaatcgacgtgaacaggttaccatcaactgctgattgtgaagaggaagtgggggtttcatctccaaacagcacgatatcgagtattagtgggaagagaagtgaaagagaaggtattaatggagatgagcatgagatggatagagcttcttctcgtggaatcagtgatgatgaagatggtgaaacctcaagaaagaagctcatgctgtctaaagatcaggccgctattcttgaagagagcttcaaagaacacaacactctcaacccaaagcaaaagatggctttggctaagcagttaggactcagacctagacaagtggaggtgtggtttcagaacaggagggcaagaaccaagctgaagcaaaccgaggttgactgtgagttcttgaagagatgctgcgagaacttgacagaagagaacaggaggttgcaaaaggaggttcacgagcttagcagctctcaagctttcaccacagttctacatgcaaatgaccccaccaaccaccctcaccatgtgcccatcatgtgagcgtgttgcagccccccccaccgcatcatccaccgttgat

SEQ ID NO: 13180 - DNA, 769 bp, Populus tremula x Populus tremuloides
  Predicted polypeptide sequence is orthologous to G1017, G2567
ggccggggagccggcatgctcactatggtctaccctatcagatctcaacctcaataaactgcatacaggtctactgcgggctggtttcccgccattgctagatcatactgcttcactcacaagagcctccaatatccaaaccattcaaaagcctgtcttgagcgaaggcgtttcttgtgagttgaccatgtcacattctacccagacttcaaagagagctgatgatgtgaagatacctcagcttgttctttttggtcaacgaatagtcgctgagcagcatatctctcttcgctgctctgataataccggctcgccagttcttgctagaaatagttgttttgaaggtaaattagataagatggaaaatttttctgagggatctgtgtccactcttcctcatctaggcctatcaaagcattcctcatgtgaaggattgcaatggaataagaacagccaccgaaagagtgagcagtccttagagattggtcactgcaaagttttcctcgaatcagaagacgtaggtcgcacccttgaccttcaattgcttgagtcgtatgaagaattgtatagaaagctggctgacatgtttggcctacggaattctaagaaatttagcaatcttctctaccgtgacgataatggtattaccaaacacattggcgaggaaccattcatcaacttctcaagaacagcaaggaggctgacaattgtgacagattcatgcagtgataatgtaagatgaatgtgggaggaaggaataaaccctttg

SEQ ID NO: 13181 - DNA, 789 bp, Populus tremula x Populus tremuloides
  Predicted polypeptide sequence is orthologous to G1020
gatcaaacctcgcacctaaccagcgaacaaaccccccgaaaaataacagtaggaaacccccaacgctaaaatggctccgagagaaagatctaacaacagaaacagcccgaatagccctagatcggagatccgttttagaggcgtcaggaagagaccatggggacgttatgcggctgagatcagagacccaggcaagaaaacgagggtttggctcggcacttttgatactgctgaaggggccgcccgtgcatacgatgcggctgctcgtgaattccgcggagccaaagccaaaactaatttccctacaattggcgagcttaatccagaccccacgcgcagtcctagccaaagcagcactgtcgagtcctcctccccgccgcctccacgcgccgtctctcctccgccaccactcgacctcactcttaacatttcccgccataaacccgacagccagccgttccccaatggagttagttttccaggaggcgcgtggtttccattccatgctgttgcgcgtcccgttttcttctttgacgcgtttgctcacgcgaagaatgatactcctaacaataatagtgtagtgaataatattaacgggtgcaggtttgatcgaacggtgatggtgaatggaggtggggcccagagtgattcggattcgtcatcagtcgtcgattacgatcatcatcgtgatagtaagggattgtcacttgatcttgatcttaacctggccccaccaccggaagtctcatgatcttgttgtttttcatggagagatctgattttggaagt

SEQ ID NO: 13182 - DNA, 728 bp, Populus tremula x Populus tremuloides
  Predicted polypeptide sequence is orthologous to G1020
ttttttttttttttttttaataaaaagggggattgaaaattatcagcaattgaaataatttgtgagcttacaacacaaaacaactaggaagagaattatgattgtatctctgtagttgcaaaatcatgatcctagtaatttacttacattagattacgatgacccattaaacgagatcatcacttctctctttaagatgtaaaattagctggaaaaaaaaattattcccctgaataatctcaaaaaaattaaataattatcaatcaagcatcggctggtggaggcaggttaagatcaaaatcaagaattgaactccttggcttaaaatcaatcacagatgatgaatccgagtcactgtgggccccgccctcgagacccaccgggtcaaaccgtacagggaaacgctgagccacaaactgaggcttaacaccatcaagaaaccagacaggaccaacagcgtttacaatcggctgctgctgctggaacacgaagggaaacctccccatccccatccccacaaccccaccaacctggcgagttacatcacgcgccaccgcagaaaccaccggggagcttgacgactcaacggtgctgctctggctagagctctgcttctcatcgtcataatcaaccaccttctccgctaatggaaagttggtcttcgccttggcaccacgatactcacgcgccgccttatcataggcccttgcagcctccactgccgtgta

SEQ ID NO: 13183 - DNA, 579 bp, Populus tremula x Populus tremuloides
  misc_feature (502)..(502): n is a, c, g, or t
  Predicted polypeptide sequence is orthologous to G1033
cgctcctccctcaactcccttcacattctcacacgtaaaatatcctccccccttctctcctcctctttctctctctttcaaaccctatctcagctcacctaccggattcgcaatgaaaggaggtagatcgaagtcagatactaagaccaccaaactcttctgtgaacaagaagccaaccaaaggaggaggagctgcagcagcccggaaatcaggaaaggcagctaaggatccaaacaagcccaagaggcctgccagtgcattcttcgtcttcatggaggagttcagagagcagtacaagagggaacaccctaaaaacaaatccgttgcagctgttggaaaagctggaggagataaatggaagtcatgtcagaggctgagaaagccccctttgttgccaaagcggacagaggaaggttgatatgagagagatgaagcttacaccaggagcaggctgagggccccaggaagagaggatctgagagtcatgtcagggtcatgtgncgtgagtgtgagaggattgggaggagtgcgcgcggtggttgggcgggatgctcgtcttgtttgccttttggctttgt

SEQ ID NO: 13184 - DNA, 374 bp, Populus tremula x Populus tremuloides
  Predicted polypeptide sequence is orthologous to G1033
ttactagtcactacctatttgtcatgctctttcaaaccctatctgagctcacctaccggattcgcaatgaaaggaggtagatcgaagtcagatactaagaccaccaagctctctgtgaacaagaagccaaccaaaggaggaggagctgcagcatgcccggaaatcaggaaaggcagctaaaggatccaaacaagcccaagaggcctgccagtgcattcttgcgtgcttcatggtaggagttcagtagagcagtactaagcagggtaacacccgtagaaaacaaattccggtgtgcagcctgtgtggcaaagagcctgggagggagattacaattggaagtccactgtccagagggctgaggaaagccccctttg

SEQ ID NO: 13185 - DNA, 620 bp, Populus tremula x Populus tremuloides
  Predicted polypeptide sequence is orthologous to G1033
aactctcttcctattctcatacccaatattctctctctaccactcttcctctctctttcaaaccctaaccccacacaccggtttctcaatgaaaggaggtagatcaaagtcagataccaagagcgctaagctctccgtgaacaggaaaccaaccaaatttttatcagcagcagcaaagatttcaggaaaggcagctaaggatttatttagcctaagaggcctgctagcgcatttttcgtcttcatggaggagtttagagagcagtacaagaaggaacaccctaaaaacaaatcagttgctgctgttggaaaagctggaggagataaatggaagtcactgtcagcggctgagaaagcgccctatgttgccaaggctgataaaaggaaagtcgagtatgagaagaagatgaaagcctacaacaaggagcaggctgaagggcccaaggaagaagaggaatccgagaagtcggtgtcggaagtcaatgatgaagatgaagatgatgaggagggcagtgcagaggaggatgacgacgacgagtaggatttggacatggggaatagcatagtcatgtaggtcgtgacagtgtctggacattgtatgttaatggcggagtattggca

SEQ ID NO: 13186 - DNA, 730 bp, Populus tremula x Populus tremuloides
  Predicted polypeptide sequence is orthologous to G1043
ggccttatggccgggcagaaaatgatcctcaatgccaaatatccaaggaactactacaggtgcacccacaagttcgatcaacattgccaagcaaccaagcaagtgcagagagtcgaagaagaacccgctttataccgcaccacatatcacggataccactcttgcaagagcttgctgaaggcttcggatcaatttgtcttggacccgactgatcacttccacacagattcttccactcttttgagcttcaagaacagcagcaatcaccaccagatgatgacgacaaactgcaagcaaaaccacccattttttatcacgcccttcccatcaatcaagcaggaatattacaaggaggaggacaatgacattccaggttatgatccaacgatccccgataaccaggaattatcctctgattatctcctgccaacggacgaccatgatcgcatctctacttttgatcatggagatgtgatttccggggtcaactcatcctgcaccaccagttcacatagcttagacattgatagtatcatggcggaatctgttggtttcggtgacggcggtgatgttttaggatttgaattttgtgcgtaattccggcgcattatatattgcagccgctttgtattttccatgtacaaatcaagaatgagcaagtagatttctcacaagagtacgagaaagtacgtaccatgtagctgtactgatcatagaagtctatatcttt

SEQ ID NO: 13187 - DNA, 834 bp, Populus tremula x Populus tremuloides
  Predicted polypeptide sequence is orthologous to G1043
gactctgagccctagagacactaaagagagctctcgagcgtcttcatgctccaaccttggcctcttcttggccctagctgagagaccagagagagcacccaaacaccagaaaatggattcttcttggcaagggaatttaccagcaaacagaaagaaggcgatagatgagctagttagaggtcaagaagttgcagcacagcttaaacttctagtgaacaggtctataggggttgatgagtctgtgtttgctgaggatcttgtcgagaaaatcatgaattctttcaatagttctctttatatgttaaatgggggtgagtttgatgaggttgcctcacaaattccacaagtgggttcaccttgttgggatggccggaagtcgtcgaaggattccggggagagtggcaagggtactgccgagttgaaggtgaaggacaggagaggatgttacaagagaagaaaaagttcccactcaagaacagatgactccactactctaacagatgatggccatgcatggagaaaatatggacagaaagtgatcctcaatgctaaatatccaaggaactacttcaggtgcactcacaagtatgatcaacaatgtcaagcaatcaagcaagtgcaaagaattcaagaagaacctcctctataccgtacaacatattatgggcatcacacgtgcaagaatttgctaaaagcttctcaatttgtcttggatccaagagatcatcgcgacgatatagactcctccgtactgataagcttaacagcaatggtgatcacgcttcaaacaagccaagcgactccctcctcgcatcctttcaaacagtaaaacaa

SEQ ID NO: 13188 - DNA, 648 bp, Populus tremula x Populus tremuloides
  Predicted polypeptide sequence is orthologous to G1050
acgagtgagaaacttgctgagattgctacaactgacccaaaacgtgcaaagaggattttggcgaatcggcaatcagctgctcgttctaaggagaggaagatgagatatatttcagaattagaacacaaggttcagactttgcagacagaagctaccacattgtctgctcagcttactcttttacagagggattctgttggtcttacaaaccagaataatgaattgaaatttcgccttcaagccatggagcaacaagcacaactccgagatgctctaaacgaagcattaaacggtgaagtacgacggttgaagattactacggcagagcggggtggggattctgacccatccaagggcttggttcagcagcagctttctgtcaaccctcagatgttcctgcagcagccacgaccttcccagcttaacaggcatcagcagcagcagcagcacttcagcctcccaaatcaacatgcatcagttgcaacagcagcagcggtcctcccagccacagcctcaacaaaatggcagtcctggcttaaagtcagattcgaatcaataggttggggaggaaaacatgggctgcttggggtattaatcgtcttaacaacttcggtgcttacatttgtttctttcatgcattcattcatt

SEQ ID NO: 13189 - DNA, 823 bp, Populus tremula x Populus tremuloides
  Predicted polypeptide sequence is orthologous to G1064
aaatgaaaaacccaaatgaggtcctttatcaaaaccacccaacacctgttaaaatagtactgtctttccttcaaaccctagctaaaaccccattttaatcacactcaaaaaaaatttggaataataattagggaaaagaaacgcaaaagaaaagggaaacaaaactccagtatttcaagaacaatcaaacctcacgtgtgttacacataaaaactacacaagtggagggatgatgatcatgatgatgctcttgctttgcttgctccatctctatgagtgatgactcgttgtatcatgccgatcatcgcttcctccaccaccgccaccatgatgtgagtgagacccactcgcctgtgattctgatagacctgaaggtcggtagggattcaatccagctagcatgttcaaatgcccttcacttatcccactattaccagcactggcaccgccaatgctagtagaccccagttgctggctaggcaataaggtaacaggagcagggaaattcataaaatgcaacccacttgacatgctgcctctgtacacactactgttgttgacagaaggaaatgtccatatagggtctccgctcatgacttgattgttattggaattagccagcatccaaaaatttgctggaatttgaccatgactagctgggattgcccctgaactggattgtacaaagtaattccccatctgatggtgttgcgatggtgataaatcttgcttcgaccttcgtttcctgctcaaactctcttctgtctccgttgataattccagtgaaaaatggctcgcaggtcttgcttcgcttgcagcactg

SEQ ID NO: 13190 - DNA, 831 bp, Populus tremula x Populus tremuloides
  Predicted polypeptide sequence is orthologous to G1068
tttttttttttttttttttaaactctcttcataattatcttatataagctccaaaattaatgattgtctcaaatcttaccacgataaaattaaaggcataccaatacgagttttaaagtgtagaaattcaaaccactattttctagcattataataaagtttgtgtacaataagtcctactttttgatgaaaataagccttgatgaaataaaagtaagcttccaactttaccaaccacttaataaatcttttcttcgaaaatctcccatcatagaatagaatctcatcaaattcaagaatagatctagggtttggcttgcctcgagataaatcttcaggcaagttcctcttctcttcacaatccttgtttgcgttacccattaacagagctagatcctctatgatttgctccaaacgatcaaacatttgttcccgagagtatggaagtattttcctcattgtcaaatttctacctcatatgtcacggagccaccagacattgctggttggcgaagtgtaacattgcagatggcaccatttgcagagagaatacaaactgtccgtggcccttgctgtgaaaaagccataatctttgatgctatgtcctctccagctttcaccgtgatcacatgtggtgtaaaccctacgcctccaaccccgcccaaggcatcaagctgtttcttcccagaacctggcggccttcctctgttctttttagaaggatgttcagatgccgaatcatgcgtgccacccccgccacccgaatccgcatgccagccgaaatcctgaaggacgggggtgggtgacaaacccaagcaatgttaccgtcgg

SEQ ID NO: 13191 - DNA, 801 bp, Populus tremula x Populus tremuloides
  Predicted polypeptide sequence is orthologous to G1129
gttttttttttttttttttttttgatgttaataggtatcgattttattcatactatgtggaaagtatacatacaaactatatacgctatgtactaagagtagtaaaagaatcgggaacaaaggcaatgtggaataaagtcttcgggaattgtataaattgatattctgattcacatctccatcttcagattgctagcttcaacagaacctgtaaatggctgaactgggaaggttgtttgtctcccttgatcaaatgctacattgtaaagattttgtagatcagcatcccaagttggcagggcctggatttgagtgaagcaggaggagtcaagaaatgtttcgggaatagatacaggagtactagtggtccttctaagccccatatcaggaggatttatccccatatccaatccacagcatgaaactaattgttgttgtgatggattaaattgaaggtatgcagcgttagtcatatccggtgatatcccaattgtggggaaattggttgaacaagcaggaaaagcctctttggcaaataagttgtcaatgttgaagtcaagccttggatttacagcagctagtttcattgacaagaactctacttgtctctggagagattgaacatagttaatgatttcatcaagcatgcctgcctttccagtgatattattgcaccctggtaccaaatcttgcagatacttcattctttcactgattttttctctcctcactctttcaactaaactgtggctgtcggtagcttgaccgcgacgtgcccggacatgaatgtaatctggcttt

SEQ ID NO: 13192 - DNA, 583 bp, Populus tremula x Populus tremuloides
  Predicted polypeptide sequence is orthologous to G1142
ggcatgaaggtaggaggctgggggtctaggtccagtacgataacctattatccacctcttattactgggcttgggagcaccctttctcaacgtcgaaataggccagggttcgtctatttcgatagaaaaaccacaactttgagagaccagaccaaacccactttgggaactcaaagaccaggaaacggaagcacgcttgaggcaataggggattgagtggggacggacaccatccctgcggaatggaaagaaggcaatccaacttagtgagctcgaacgcgcgaccatggagactctatctttggcgggggagaatcagaaagcggaataccggagtgaacggcaagaaatgcaggttgcttgcttactcagtggcatccacaactggattttctcatttttttttaggtatgaatcacttcacggtacagaagagtattcactacaacacataccttgaccatagatcgagtgtagggcaccgggcagaggtttgtccatctgcagctctcgacttcgtagtgccagctgtaaggctaggtcacctaaaatatgtaagtgtgggccctgttccacaatctca

SEQ ID NO: 13193 - DNA, 610 bp, Populus tremula x Populus tremuloides
  Predicted polypeptide sequence is orthologous to G1145
tttttttttttttttgccagaggtgaagcaaagcagccttgtgataaattcccacagcattttacacataaacccaagaggctagcactaacacttgacgagctacaaaactctcacacagagagatgtgatgtcagaaagaagtagaacttgttcttctaagctgatatttttgttcagctgatggttcaattggaaacttcttctcaaattccttctctttcttgagctttatattctcctcccctaaatgtgaaatcttgttcaccagctcgttatgataggcctgttttctagctcgtgaacgggcagcagattccctgttcttgatttttctcttgagcttcctctcaatactcgtctcaaatgcatctgatgtatcccttttccgtcctgatgtcgtagtatcaagataatgtgcttgttgacggtgatgaggaaacgaccattttctgtgaaaaactttgtggggtcactgcatcaacagtaactaaatccaaagaagggcttatagttgcttcggcaaaaagtcctgcttgtaccaagaaatcctccaaagtcatttcaccaagagtctgctctctttcctgaactttcatctcctcaccaa

SEQ ID NO: 13194 - DNA, 657 bp, Populus tremula x Populus tremuloides
  Predicted polypeptide sequence is orthologous to G1145
gggggaatggatagtgaaagtgccgcaacatcttctcttcaacgtcaggctagtttcacattggctagggcattgagtgggaatgacagtggatcaagtctggaaagagattcaagaagggcagaagaagaggtttggtctggaaatgaacgttcatgaaagagagcagacacttggcgaaacaactttggaggattttctggtacaagcagggctttttgccgaagcaactataagcccttctttggatttggttaccgttgctgcagtgactccgcaatgttttccacagaatatggtcctctcctcatccccttcaactggcacgttatctgactctacgacatcgggatggaacagggatgctccagatgcacttgagaagagtattgagaggaggctcaagagaaagatcaagaacagggaatctgctgcccgttctcgagctagaaaacaggcctatcataatgagctgatgagcaaggtttcacgtttagaggatgagaatataaagctcaagaaagagaacgaatttgagaagaagttcccaattgaaccttcacctgaacaggaatatcagcttagaagaacgagttctgccgctttctgacaaatctctctatgtgaaagattgtagttgatcaagcgttattgcta

SEQ ID NO: 13195 - DNA, 323 bp, Populus tremula x Populus tremuloides
  Predicted polypeptide sequence is orthologous to G1146
ttttttttttttttttaaaagtcttagaattacaagacattcaatgtcatacaaattttgaagaaagcgataaaaagcagcagttttaaacacgtaatttaaataatacacacccaacgctgacacaaccagcttgatattgtatgtaagggtaagcagaggcctcccatagatttaaacaatccaaaagtggggatgtctcgaatcctaacagtagaacataacccgcttgacattctccttcaaggcaggcaggggcctcacagcagcattagcagcaggtccgcgtgtggctcgaccacctgctcctccacctcctcgcc

SEQ ID NO: 13196 - DNA, 613 bp, Populus tremula x Populus tremuloides
  Predicted polypeptide sequence is orthologous to G1146
ggtatcatgatacaggcagggagaaagatgtcttcctcaagttgggcagtggaacatgatgaataagaaaatggttaatggaggcagagtcaataattggatctgcatcaatttttcaaggaatgtccaggacagtgtggcccgaggattttgctatgagcttgcacagatgtgccacatttctggcatggactttgctcttgagccattacttcctcctgttggtgctcgtcctgagcaagtagaaagggttttgaaaactcggtaccatgatgcaatgacaaaactccagccacatagcaaggaacttgacttgctcattgtgattctcccagataacaatggttctctttacggtgatttgaagcgtatttgcgagacagatcttgggcttgtttctcagtgctgcttgacaaagcatgtattcaaaatgagcaagcaatatctggccaatgtggctctgaagataaatgtgaaggttggaggaaggaatactgttcttgttgatgcattatctagacgtattcctctagtcagtgaccggcccactattatttttggtgctgacgttactcatcctcgtcctggggaagactcaagcccatccattgca

SEQ ID NO: 13197 - DNA, 826 bp, Populus tremula x Populus tremuloides
  Predicted polypeptide sequence is orthologous to G1146
gaatatgatgaacaagaaaatggtcaatgggggaagagtgaataattggatctgcgtcaatttttcacgaaatgtgcaagacagtgtggcccgaggattttgctatgaacttgcacaaatgtgtcaaatttctggcatggactttgctcttgagccattgctggctcctgtcagtggtcgccctgagcatgtagaaagggttttgaaaaatcgataccatgaagccatgaccaagctccggccccatagcaaggaacttgacttgcttgttgtgattctccctgacaacaatggttctctttatggtgatttgaagcgtatttgtgagacagatcttgggcttgtttctcagtgctgtttgacaaagcatgtgttcaaaatgagcaagcaatatctcgctaatgtggctttgaagataaatgtgaaggttggaggaaggaatacagtacttgtggatgcaatatctagacgtatccctctagtcagtgaccgacctactattatttttggtgctgatgttactcatcctcatccgggggaggactcaagcccatctattgcagccgttgtggcttcgcaagattggccagaggttaccaaatatgctggcctggtttgtgctcaagctcatcgacaagagcttatccaagatttatataaaacatggcaggatcctgtacgagggacagtgtctggtggcatgatcaaggaacttctcatatccttccgtagggcaaccggacagaagccacagcgaataatattctacagagatggtgtcagtgaaggacagttttatcaagttttgttgtacgaactcgatgct

SEQ ID NO: 13198 - DNA, 658 bp, Populus tremula x Populus tremuloides
  Predicted polypeptide sequence is orthologous to G1190
tgaatgtggtctcttcctatgctgccacactcttcctgtggtttttgaccgtggcctcatcgggacttttcatgattggtgcgaagctttctcaacttaccctcgaacttatgatctccttcatcttgatggcctcttcactgcagaaagccatagatgtgaaatgaagtatgtgcttttggagatggatcgaatcctacgacccaccggttatgcaattatacgagaatccagctatttcgtcgatgccatttctaccattgccaagggtatgaggtggggctgccgtaaagaaggcaccgaatatggagttgagaaggagaaaatattgatctgccagaagaaactctggtactcctcaaaccaaagttcaaggtgataaacaaagagatccaaaacatgccgatgcatctcttggagagaaagctcatgtaactgcaatacagaattccaggggatgatgagttgaggagataagtaataaatggaatcccgtacacacatattagtatattcaatagaagccaaggatctacaaggtcgatactgaaattgaagagttcgctactcaataacagaattttgttaatttatagaatcatttaagtacaaatagattctttgtaaggcatctatactatactttccttgcgctgta

SEQ ID NO: 13199 - DNA, 530 bp, Populus tremula x Populus tremuloides
  Predicted polypeptide sequence is orthologous to G1196
ggatttcaaggatataatttaaaggagaaagggagcctttttaagggagagaatggaccaccaaaacaagaacatggtcaaaataagtaaccactacgagcaaactatacagaaatgattatcacgcctcaaaccatgggtaaaaaaaaaaaagaaaaaaaagtgacccactaagggcagctatgcattccaagttacttgctggcaagtataaggaaaaccgacccactcctcccccgtcatatcataggaggaccgccaataaggcatctagcacaatccccatatgtgcatataaaactgcaagggttctggccttgaatccgatcactccctattaatagcctcgctgccaaaattcgctgggaacaggatagaaaaaaaaaggtaacaaagagtatcattgtcaagtattgattatttctttgagaccccatttatgacacgaaaagaaactgggaattttagggaataaaatgttttggaatgtatggagagttagctagttacaagatgcagggcggtagtta

SEQ ID NO: 13200 - DNA, 574 bp, Populus tremula x Populus tremuloides
  Predicted polypeptide sequence is orthologous to G1272
taattgaggcttgcaagtttctttatgagaggtggtccccaacgtttgcggtaattgtagctcagaaaaaaccaccacactaaatttttccaacctggatctcctgataatgtcccacctggtacgatcattgacaacaaagtctgccatccaagaaacaatgacttctatctctgtgctcatgctgggatgattgggactacaaggcctactcactaccatgttttgttagacgaggttagtttttcagcagatgatctgcaggaacttgtgcattccctctcatatgtatgccaaagaagcacgactgccatctctgtagttgcaccaatctgctatgcccacctggcagctactcaaatgggccagtttatgaagtttgaagacacgtccgagacttcctcaagccatggcggggtgacatctgcaggagctgttcctgtcccacagttgccgaggctgcaggagaaagtttgcaattccatgttcttttgttgagcatgctagccttttactctgtatgtaaataaaactagatggacagcaggtgtttggggtttctgaatttggtgca

SEQ ID NO: 13201 - DNA, 200 bp, Populus tremula x Populus tremuloides
  Predicted polypeptide sequence is orthologous to G1317
cctaaaaaaactagtaaaatttaatttcgattgcagggttcactggctaacattctttaaaggggatagtaacattgaaattacaaaaatgacttcagacaaaggccaaaaaaacaactcccaacctattcctcataaaacaatgctcaatttgctgctaccaccgctatctatactgcttgggactgggaaaaaataaa

SEQ ID NO: 13202 - DNA, 842 bp, Populus tremula x Populus tremuloides
  Predicted polypeptide sequence is orthologous to G1328
tctctctcaccccacaaaatgcccttacgaagcggggcacaagaagttctccgagtatgcggaaaaagttacaaaagagcaattcagacatgtaattgtaaagtttctcacttctcaacagaaggactaacttaagggcagatgacatgttacactgaatgctgaaagttcagatacatactggcatttgaaaacagggtgagaagctgctggcattccagtattcaccaatatcagtcacatagagataaacttcacaaattgtagtccaccgccactcacattccttccctaccagttgatagcaagcaattctatccgaattacacctttcacagaaccattatcaatgaaacacaactgagccaaaattatgttctcaaaaactgcacacaagaaatagcgaatataaataatgaacagatccatagtacaagtgcaatatcatttccttgagcttttcactacattgtgtcctcgaactaaaatggtgaactattaattgaaacgataaaggaattttgatgattcaagcaaggttttaaacaagtgggaataaaggctttctccaataggtggtgccttaagcatttattccctggaaacttttggagcaaaagggacatttcaagaagaggcgattgaagcttagtttcaatataaagctacacttttccaaatgggaattattggaaggtgggtccaaaatatattcttaaagatactgtagcaggcacacacacacacacagacaaaacagcaaagtggagtgacagtgtggcgtgactaaggtgtttattggcaacctttctcctcagcctattttccagacacctaccacc

SEQ ID NO: 13203 - DNA, 727 bp, Populus tremula x Populus tremuloides
  Predicted polypeptide sequence is orthologous to G1330, G2423
ggtccttcaacactaatctcatactacccaaaacccaaaacccaaaactctctctctctcttgcaaaatccttacttttattagtaagaaatggatgctcgagtaagaaagcatggtctagcaggtactgaagatcaggatatgggcacgaggaagggaccatggactgttgaggaagactccttgcttgctcattacattaacaaccatggtgaaggtcactggaatactgctgctcgctgtgcagggctgaagcggacaggtaaaagctgcagattaagatggttaaactacttgcgcccaaacgttagacgtgggaacataacccttcaagagcagctcttgattcttcaactccattgtcgctggggcaataggtggtcaaaaatagcacagcagttaccaggcagaacggacaacgagataaaaaactactggagaaccagagtccagaagcaggcaaagcagcttaaatgcgatgttaatagcaagcaatttcgagacaccatgcgttatgcttggataccccggctaattgaaaggattcaggctgaatccgaatctccggtggatcaacccatcatcggcactcccacttaccattccagccagattgacatcccagttgctgcaagtgaatcccggtcggatttgatcggccccgaatttcatgcccgatatatcgggtagctgtacttactcagactccttgggatgcccaggtttc

SEQ ID NO: 13204 - DNA, 467 bp, Populus tremula x Populus tremuloides
  Predicted polypeptide sequence is orthologous to G1341
tcaggttcagctatgagaagcgtaaccagctggtgtaccgcctgcatcccaggccgtaagcagaaagaaaccaagactgaagaatcggagaaatctttaagaaaaaaatcttcccgcgacgaatctagtggtcctggtgaccaagctcatgaaggcagcagccatcaaggaaccacccatgccgccagtagtgctgatactggtggcgcagctgttgtcgttatgactgcaacccatatgtctgacatggaaggtagttctcatgatggcggcggcggcgacggaggtggcggtgacggttaatcattaagcagtccccgtttgattgtgttcgtgattctttttattgatatcgtaatggttttttctcttggattattatatatcactgctgcttgcttctttactttccttgtttcaagttattgctctaagatgttgaaagccatggttgtgatgtgcgcgat

SEQ ID NO: 13205 - DNA, 538 bp, Populus tremula x Populus tremuloides
  Predicted polypeptide sequence is orthologous to G1341
catcggccgttagacagatccaccacgtcatcgctgtgcaccacctgctccagcttggtcctgtgatgctccaccactcagatgcttttgcaccaccaccgccttggccaagaccctttggtcatcaaccaccccctcatcaccaccatgacacctccacctcctggaccccctggtcctcccccaccaccattctttgatccctacaggccaccacctcctccttactagcaagtactaaaattctatacacttcagcctgcatacgtatattatacaacctagtaaccttccgtcctcttatcttgcctatgtgcaagctagatgtgtaaagtattggatttggatgtgctagaggttgtttgccgcacaggggaaaagaacaggaagccatccatccactattcatggatcaagaaagagaggtgtgtgtacacacacacacatatagaatggtttttcaagtgtgtacttgttagtattattatcttcttttatacaatgtacttttatgactgatatgcttttatgatcaata

SEQ ID NO: 13206 - DNA, 561 bp, Populus tremula x Populus tremuloides
  Predicted polypeptide sequence is orthologous to G1382
gaaacacaatcatgatgtacctacagctaggacaaacagtcatgacatggcgggaccatcagctgtgaatggaccctcaaggatcagaccagatgaaaatgagacaataagccttgatcttggggtcgggatcagttctacaactgaaaaccagtccggcgatcagcaacaagctttccgtgcggaacttatcaaacatgaaaaccaagcaagtggttctagtttcagagtagttcatgcaaccccaattacggcttactacggtgttttaaatggtggcatgaatcagtatggatctaggcaaattccaggtgaaagccgtagcattgaaattccaccttatccatatccgcagaacatgggaagattattaacgggtccataagtttgtccgagttttaaatttgtttcccgcatgcttgccttacagctggtaaatggcaaaaggacaaacaacaataattcgtctcttcttgttctccggggacaggacaaaatgaccgctatggaataaacctgttgcaaacgctactggaatggttccacctaataggtaatcca

SEQ ID NO: 13207 - DNA, 707 bp, Populus tremula x Populus tremuloides
  Predicted polypeptide sequence is orthologous to G1389
tcttttaaataatttacaacattataatttatttattaaaaacttcataacttgtctaaaatattatctatctaacaagaaacaagacttcaaaattaaaaataagtcaacctttgatttggttgattttacataacaagatgataatatcatagctaagtggcataacatggggagttttcttaaaccaatccttcgactaattgagatcatcaggtgagaatttttgcatgatcttgatttcccattggctgaacacccgaatcaaaaaagcttcccactgcagccttgtagaaaatctcattgaaccatgacggggatgatgaagcagatgatatggtggcgaaggtatcgttctatcgctttcaacttcggactgctggttgtcaatctcatgatccgacgatcctgacccttcaaatgaagtctcgtggtagtcaatgtcatgatccgaccatcctgacccttcaaatgaagtctcgtagtagtcgatgtcatgatccccctctgaaccttcaaaagactcgtggttgtaaatttcatgattcaccgcttctttgcgccgtccaaatgaatcccattgatcaaacatcgtgacatatgtgacatgtttgtctatcacatggatcccacatcgtaccacttcactgttttcggacctcaatatcacatgtgagttccaatccatcatctccacagtatttttc

SEQ ID NO: 13208 - DNA, 574 bp, Populus tremula x Populus tremuloides
  Predicted polypeptide sequence is orthologous to G1417
attacggccggggctggtgaggagtgtgtgagaaacgtaagaggatagagagaaaaagagagctgcaatggcagcagccattgcagcagctgcaaggacagcaagagagatgggagttgagtgattagatcctcctctatatatttattatatcctttttttaatctctaataaatggactctctcccgtggatgtaggtgattttgccgaaccacgtaaaatattgttgtcagtgtgcttgcccctccgttaagtaataatcagttcatcaccgatcgctggattccgcccaacaaattcttctaccagtgttaattcttaacgcttgggcttagaagatactgaagagctacttcactgtgggttccgatttactttgtgcatttgaagattttcccttcatatttttggaatcaaatcgaagggcattctggtataatcaaatggaggatttcattcagtgttgtattaagcaccgtttgtttcatacacctccttaccgtaattggattgtaatcatttgtaatctattgttgacttggattttatttcctacttcccatttattcccaa

SEQ ID NO: 13209 - DNA, 547 bp, Populus tremula x Populus tremuloides
  Predicted polypeptide sequence is orthologous to G1425
aaagagtgcaatggcattagtagcacttcgggcgaaagttgcagcactagataaatcagatgatatctgtggagataacatgacatggaagacggaggtctaatccagggtaggattgcatcactgcaattgtttatactggtaactagctacaattgactaacgggttaggaattacgaagtaggagttcaagtcattttttggactttgggatctacctctgataatctgtaaaatagagcataatcattcactgtctcaaactggggcgcagacgaatctttatactctcgatgcagaacccagcgagggcgttggagctcggttttccgattagggatagagcaaatggaggttttagttttagtttaccttccatgcctggaagatggtggtgaagctttaaaatagcagaacaataacattctatacttcaactaattctatctttgagtgcatacagcagtggcggtggaaaggaaaactgcttctggctaaaaaaaaaaaaaaaaaattcgaaagtacttctaaagcggggcggggggc

SEQ ID NO: 13210 - DNA, 337 bp, Populus tremula x Populus tremuloides
  Predicted polypeptide sequence is orthologous to G1446
gtctgattctcttttttgttgctcttgttggtcttgtaggaggtcggagtctatcccttgtgcttacacttgcatcatgtttgctgataaaattgattggaagatttagatgtgtaaacgagacagtgaataggtcccgagcttcaatctcgagctaggatcttgggtgatttttacagtttttgcttccagggaaagtgttcttcacgtctcaaaactgtattacaaaagtctgatgagcaattccaatctttttttgctgggattccaacctgaggtgttgtaactgtaaatttacagacacagaatcaagattcataaatactttcatttccaa

SEQ ID NO: 13211 - DNA, 129 bp, Populus tremula x Populus tremuloides
  Predicted polypeptide sequence is orthologous to G1463
attttaagcttgtttagcttccttgtttcctcgtagcttttctttttccaagtgtactttaatgtgtaaatgaatggattgcttgtgggtaacaagtctttggctctcaaaaaaaaaaaaaaaaaaaaa

SEQ ID NO: 13212 - DNA, 396 bp, Populus tremula x Populus tremuloides
  Predicted polypeptide sequence is orthologous to G1478, G1929
atcattttgagagagatctgaaaatgtgaggggtatcatcaggagagagataaccaatgcggttcttgtggcggagaggtggtttcatctaaggcaacctcaagattggtttgctgtgagctgtgtggatcaagggcatcattatattgtcaagcagatgatgcacttttatgtcaaaaatgtgacaaatgggtgcatggagcaaatttcctagctcaaaggcatgttagatgcatgctatgcaacacatgccaaaatcttacacaaagatatctcataggagcttcaactgaggtgttgcttccaactatcgtgagttggagagaaagaaggcagcgcaattctaatcttgaaaagaagagctctggatcacttaaaatgccctttttgtttctt

SEQ ID NO: 13213 - DNA, 811 bp, Populus tremula x Populus tremuloides
  Predicted polypeptide sequence is orthologous to G1480
gggtggataactctctcttgcgggattttggagaatcaagaaacaccccccctaaaaaaaaagaaggttttcgcgttttcctatttatttgatcagaaactgggagagaaaaaacatgggaactgaagtcgagagcttaaagaacttaaccggaggatggagtgttgcggctaaacgttgtgactcgtgcaaaaccgcggctgcagctgcgttttgcagggccgactctgcttttttgtgtctgaattgtgataacaagattcaccatagccaggtgaatagcaaaatcatgtcccggcatgagcgggtgtggatgtgtgaggtctgcgagcaagcaccagctgcggttacttgcaaagctgacgcagctattctctgtgtcacctgtgacgctgacatccactctgctaaccctcttgctcgccgtcatgaacgagtcccaatcgaccccttttataactctgctgaatcaattgttaagacttccacggcgtttaatattctaatacctggagaaaatggtgtgtctggatctgatcagaacgatgatggtgtttcgtggctgttacagagtaatcacacaacacatgaccataattcaaagctccgaatcgagaatcctgttgtgaagactggagacatgtttttctctgaaattgatccgtttcttgaattcgagtatcagaattccattgatgcgagctatgagcagattcatggtggtgctgatagcgttgtgcctgtgcaaaccaaaccagctccgcttccggcgatcaatcatgaaagttgctttgacattgatttctgtaga

SEQ ID NO: 13214 - DNA, 766 bp, Populus tremula x Populus tremuloides
  misc_feature (698)..(698): n is a, c, g, or t
  Predicted polypeptide sequence is orthologous to G1480
ggataaaactacgcttcaacctaaagaaccccatcgagacagaacacaactcaacagaagcttcaagccttgaaactcgtagccttcatcttccttaatggcatcaaagctttgtgactcatgcaaatcagcaacagcaacgttgttttgtcgagctgactcagctttcctctgcgtcagttgcgactccaaaatccacgcggccaacaagcttgcttctcgccacgcgcgtgtctgggtctgtgaagtctgtgaacaagccccagctcatgtcacctgcaaggctgacgctgccgctctatgtgtcacctgtgaccgtgacatccactcggcgaaccctcttgcccaacgccacgaacgtgtcccagtcactcccttctttgactcttcctctgctgcgcacggcggtggagctgccgttaacttcttggagtatcgttaccttgatgacgtgaatggtggggatgatgttagtagggaggaggcagaggcggagtcgtggctgttaccgaaccctggtggggggagtactaaaggggtggatagtttggatctgaatacgggtcagtatgtgtttggggcggaaatgcacccgtatttggatttggatcggtatgtggatcagaaagtggaagtgcaagagcagaacagttcaggtactactgatggggtggtgcctgtgcaaagcaacaaattanggtttcaagctcctggtttggttaatgacaattgctgctttgagttggatttctctgctggatctaaa

SEQ ID NO: 13215 - DNA, 783 bp, Populus tremula x Populus tremuloides
  Predicted polypeptide sequence is orthologous to G1480
ggacgaaggcacaacactacagaagagaagcttaaagccttcgtactcctcctcctcatcttcttcctcaatggcttcaaagctctgtgactcatgcaagtcagcaacagcaacgttgttttgtcgagctgactcagcttttctatgcatcagctgcgactctaaaatccacgcggcaaacaagcttgcctctcgccacgcgcgtgtcccggtctgcgaagtctgtgaacaagccccagcccatttcacctgcaaggcagacgcagctgctctctgtgttacctgtgaccgtgacatccactcggcaaaccctctcgctagtcggcacgagcgtgtccctatcactccctttttcgactcatcctccactgtgcacggcggtggggcagctgtgaacttgttggaggatcggtactttgatgaagtggatggtggtcgtggtgatgttagcagggaggaggcagaggcggagtcgtggctgttgcctaacccgggtggggggactactaagggggtggatagtatggatctgaataccggtcagtatgtgtttggttcggaaatggatccgtatttggatttggatccgtatgtggatccaaaagtggaagtgcaagagcagaacagttcagggactactgatgggggtggtgcctgtgcaacgtaacaaactaggatttcaagctcctgcgttggtcaatgataattgctgctatgagttggatttctctactggatctaagtcttttggtggtggctatggctataactccttgagccaca

SEQ ID NO: 13216 - DNA, 308 bp, Populus tremula x Populus tremuloides
  Predicted polypeptide sequence is orthologous to G1499
atcagaaatctaagggatctcagtttgaagcccgagctgtagctctcaaggttacctgccccatctgttcagctggcgaatagtaatcaactaggtgatcattatgcctctaaacatccaaaagagaagcctcctgctgaatcgagctgatttatcttggtcacttgtgtaaagaaacgaagttgttccaaactgtcaaagcattatgtcaatgaatgtgtgtgactattttgtcatctgaactccaggaattgatgatgtttgtttgttgttttttcatgtgcgagcgataagtttacatggctaaa

SEQ ID NO: 13217 - DNA, 798 bp, Populus tremula x Populus tremuloides
  Predicted polypeptide sequence is orthologous to G1504
gctcctctcccaacacaagtgtttctttcactaaactcaaaatactgcgtcgttcttgacgctcatggcttgatttcttccaagcaagcaaggaagcaatgaaggaagggatgagtaaatcttggtttttcgacaaggatttcagtggggttccagataattttttcgaggatactttggggtgctttgatttcccattggaagatgtagaaccaaatggtgatgatggagaagactgggagtctaaattccgacacctcgagcccccttcctctaatcttttaaccaccttttcaaccgctctctgtggtgaagatgcctcctccctggaacccaactataactcttgttcggttttgcttgatggatctttagagttaaaacattgggcaagctctgctgaagcatcttcaagcagaagcaaacccatcctttgtcggtcttcagacagcaaatattctcatctgttccaggccaccagcccagtttctgtcctggaaagcagtggcagttcttgccccaccgaaaatgcgacaacatattaccccaaatttgtcacaccagtaaagcgccctcgaagcaagctgccacgccgggggcgacaaacattccctttcatccccactgcctgtgcctctaaaaagttttattgttcggcttcttcagatccagaattagaatactataatgatgaggaaatattggattcttccaggaaaacacagaagaaaaggaatctgatgcagctatcttctgcagtagagatggcgccgaagatgaatcaaccagttgaaacca

SEQ ID NO: 13218 - DNA, 470 bp, Populus tremula x Populus tremuloides
  Predicted polypeptide sequence is orthologous to G1506
ttctaggaagaggacctgtgtcaatcggccaaagccatctccagttgagaagcttacaaaagatttatacactattttgcatgagcagcagtcgtcatgcttctctggctcttcagaagaggatttgctttttgacaacgaaactccaatggtttctgttgagataggacatggaagtgttctcattagacatccaagctcaatagctcgagatgaggaatccgaagctagctccctttctgtcgagaacaaacaatactcgacaaatgaggcctattcccatcctgtgatccttcctgtacataatgaaaataagagtgtcagtatggcatatcctattactgtaaaaactaagaacctcagcggacaaggaatgcagcaagagcaacttaatagggacaagtctccacatgaaaaagtacacatcctgggaagtcataattcaccactttgcagtgttgatttgaatg

SEQ ID NO: 13219 - DNA, 823 bp, Populus tremula x Populus tremuloides
  Predicted polypeptide sequence is orthologous to G1512
ttccagcaaaatatgaagatcaaatcatatatatataaatataagtgatccattgatatttcataagctcggatccattgccctttacaaactaactatcgaggtgaacaatggagaataacctagttctatatttcaaaatacaatgaggcataaaagaaagcaacaaaagagaaaaatggagattctattcaatgacttgtctgccatcagctcatgccttctcagcctagggctaccagtacccattaagtgatacgagtttggaaagggaccgaaaaccctcgcatacaccatctctctgaacatcccaacagctggttgctgcaaaccggtcattgcagggtctccaagattaagcaagggtgatggggaagcctcttcgaaactgccgtatggattagcattatagttatggttccggtaaggattacgatatggaagccgctggccggtattggatgtgtttgacaccacaccttgagcaccgcaagcagatggtctaggaggaatgatcatgcccctgtatggtgtcttgccttcagcttcggttgagccttggccacggccatacaggggaaccatggtgggtgtgagatatatcagccttgcaaactgggcattgcgggtgctcatcggaggcaagcgaggcgctctggacgtgaaccacttgtaaatgcagggccacaataaaggtggcccagagagtgactactggctctgtgcaagtcaaacagatatacagtcgaacaccctgggatttccgagtagatgcgcacttgaaactgattccatccctggtaaaatattctcaaatccatgg

SEQ ID NO: 13220 - DNA, 423 bp, Populus tremula x Populus tremuloides
  Predicted polypeptide sequence is orthologous to G1554
tttttttttttttttttttttttggacaaaatatagatccaatagaattgatcaatgcaacatataacaacacactacgtccttctaacatgcatataacaagttagagatcatgtgcagataaagctaaaacactaaccctatcctaacactaaccgtacagatcagatcagaggtctaaaacttacttccattgctcacttcaccttcttctctgagagcagcccggccttttctctctcctccatcattctcaccactctcgcccttccagctgctactctctgacttgccatcctcaatgctctcagatctgtccctactacctctaaaatccgactcaagggagctatgcacctgtgaagtgggcctaaacaattggaattggtggtggagggtgtggtggtgaaatggtggtggagg

SEQ ID NO: 13221 - DNA, 681 bp, Populus tremula x Populus tremuloides
  misc_feature (566)..(566): n is a, c, g, or t
  Predicted polypeptide sequence is orthologous to G1638
ggggtgagtaatcatgggtatgaagggttgaagcaattttatagtcctggaggtaagaggggcacagcgactcggccttctgagcaggaaaggaagaaaggtgtgccgtggactgaggaggagcacaggcagtttcttttgggtcttcaaaagtatggtaagggggattggagaaatatctcccgcaattatgtgactactaggacgccaactcaggtggctagccatgcacaaaagtattttattaggcaaagtactggagggaaggacaagaggagatctagtatccatgatatcacaactgtcaatcttccagatgccagatctccatcaccagaaaacggaaagccatcatctccagatcattcaaccataaccatgcaatctcaggcaccaccaataacgactggcatggttaaagggctatttgactggaaaccccaaaatgaaggaacagccacagttttcaatccagcaaatggcaatttgttgatggcacctttctgtgggatatcctcatatggatccaagctgcaggagcaaaatctgcttggaggaacacttcncaggatatcagttcggtccttacaatttgatttttcagatgcaatcaatgcagcatcactaaggtcatagatgaagtggagcatttggggctctgaaggcattgatattgctata

SEQ ID NO: 13222 - DNA, 803 bp, Populus tremula x Populus tremuloides
  Predicted polypeptide sequence is orthologous to G1638
gttcaatgattcagatttgaatgcaagatccagcatatgctacgtgatcgttctgcaagagtctaataaatatggactaacttgagcccccaatgacatattcacaataatacatgatagagaattgacaaagttatccaacatactgaatagcatatagaatatcaataccttcagaaccctaaatgctccacttcatctatgaccttattgacgctgcattgattgcatctggaaaatgaaattgtatggaccaaactgatatcctggaagtgttcctccaagcagattttgctcctgcagcttggatccatatgaggatatcccacaaaaaggtgtcgtcaacaaattgtcatttgctggattataaactgtggctattccttcattttgttgtttccagtcatataaacctttgaccgtgccagccgtttttggttgtgcctgagattgcatggttgtggttgaatgatctggagatgatagccttttgttttctggtgatggagatttggcatctggaagattgacagtagtgatatcatggatactagatcttctcttatccttccctccagtactttgcctaataaaatacttttgagcatggctagccacctgagtcggcgtcctagtagtcacataattgcgggagatatttctccaatcccctttaccatacttttgaagacccaaaagaaactgcctgtgctcctcctcagtccatggcactcctttcttcctttcctgctcggaaggccgagtcgccgtgcccctcttgcctccaggactataaaattgtt

SEQ ID NO: 13223 - DNA, 641 bp, Populus tremula x Populus tremuloides
  Predicted polypeptide sequence is orthologous to G1649
cagatgatgtcgatgggaactaggctttgtatgcctctaatgatgttaccaacaggaatgcaacatctacattcaccacttttagctcaattttctcctatgggtgtggggatggatacgagattaatgcaaatgggtgttggatgcagtccagcaacattcccagcttcaggtatgtttgggctaccagctggtcagatgctaccgatgtcggtatcacaaacgccattctttccttttaatatcggagggcattccacacactcatctgttccgatgccggccatgtctggagtggccagtaatcctctggaatttttgcgctctgctgtctttccaagttcaaagggtgttcttcactccaatacatcagctcgcaaatgataagcaatggaggcctagcttctagctagtttgggttgtacaagcatcgagtccaggcttgacgtgctttcagttcattatcgaaggaaatgaattaatggcatcaactgtgaattaacatatacatctttatagttccaaattgtctttatatatattatccttttattaatggcatttgtaagattatccttcatgcatgccacctccgaataagctggttattttaatcaaattgatggcttaaaaattaattt

SEQ ID NO: 13224 - DNA, 625 bp, Populus tremula x Populus tremuloides
  Predicted polypeptide sequence is orthologous to G1655
gcggatctattcgtcgaagcttctagaggctctgcgtcgatcatgccggataacttctcctcggggtgagaagactcgagaagtccgggaaaccgctgacagagtcctcgcggtggccgcgcgaggaaaaacacggtggagccgcgcgattctagcgaaacgcgcgcggttgttgagagtgaggaaggtgaagaaacagaaggtggctcgtgatcgcaagtcaccggggagcgagaagaggagggagttaccaccggtggagaagaaggtgagggttttgagccggttagtccctggttgcaggaaagtctcgtttgtgaatcttttagaggaagcgagtgattatattgcggctttggagatgcaaattaaggttatgaccaatcttagtgaaattctcaccgtcgctggcggaggaggaggcggtggcggctcgtcaggttgagagcgaggagacagatatactagagattgttagttatgccaggtgtccattataattaatttctttttgctttttgtttttcttaaatattttaattttctttttttttcccttctattaatattaattcatgatgttattgtatataccaccttattattattattgttctagccttaa

SEQ ID NO: 13225 - DNA, 462 bp, Populus tremula x Populus tremuloides
  misc_feature (36)..(36): n is a, c, g, or t
  misc_feature (42)..(42): n is a, c, g, or t
  Predicted polypeptide sequence is orthologous to G1660
atgggatgatgcccagaagtggatagcaagccccanttgganccggcctaaaacagggcatgctcaggtgcaaggtggacaaggaccacggaagacgggtaatgttctgagtcggcaatcttctaacaaagattgttgtagaagttccagaacaaaaggtggttacatttgaagaaccagatacaaaacgggttgatactagtcaggctaagaaggaaacttgtctgcagaaacttcaaagttgggaggctgattcatacccaatagttgattcctacggcaagcctgtgcttatgaatgagaattctgttgggcaatcagcaatcagtctcagcaggcatgattcatctttggccattcacagtgcaactacatttattccgcctccttcaactgctaggtctgtgtcatgagagatatgggtccggaatgctcctatgctagtcaagagccttctaggcc

SEQ ID NO: 13226 - DNA, 768 bp, Populus tremula x Populus tremuloides
  Predicted polypeptide sequence is orthologous to G1660
tttttttttttttttaaaaaataataaaaaattattaacatgtattttaacacaaaaaattatttaaaaaacaacatcaaccacactattaaacaagctaattttcaaagactggcttttatgtacaaagggcacagggtagtaaagtaaatggtaggttaggaccaaaaaatccgagaaggaagactagttcatttgagtaatatgtttcaggtttcaccaacaccaacaccaaccacaaaaggttaacgaggaaggaacacgaccagttctacgaatgtactctgcctgtttgtcagttttcgcagcctgcctgttactcttggcttctgctgttgctcgcttctcttcagccttgtgccttgctgctgctagtttgttcataagcctatcttgggcctgcccccttatcctttcaacctccacctcaatttttctcatctcagcttcagtttttgctttttgatgattctcccatgcatgaattttcatctcttcacgtttaaacctggccatatatttggccttctccgcctcctcccatgctgctgcacgtgtttcaatcacaattttactctgttgatcagctgctataattttctgtgaagtggatgcgtccttgtcctcctcctccttgctagcccaggctgcaatgttcattttacctagctgcgtccctagaaccattatttctctcttggttttcagttttaactccttttcagacaatcccttgtttggatctaaacggtcattgggaggatttgt

SEQ ID NO: 13227 - DNA, 602 bp, Populus tremula x Populus tremuloides
  Predicted polypeptide sequence is orthologous to G1666
ctcagtctccgtcaagtcctccggtgacaaggcggcgcaaggtcgacgtgctggctggttggtctctcctatagataatgaatcatagagctctctaagctgctgactcctttgcaaggaggcttcttcagtcgtaacctccattggttgcactgtttttctagtcttgattggcccattgtaatacccatctccccacactaagatcctgaacaacagcacgcagttctcaataacacaaacttataaattcattgagattgacattataattctccaaaattaacccagattgtatttgatacatgtgaacatggtggaatatttcgaagttttacttatcaatctatcatcatacataaaacatataaaggatgcattatttctggaagaaaaatattacccttgttgtggacacatttgccaaaagagactgtatgtccattgaaccgattgcactgcagcctgtaacatagtctgcaagcggctactaggcggggtagccattcttgcaactgtatattgatcaccaccagagagatacctcttctccttctaatactccagctcctgctctctactctaacaaaatcagtcgaata

SEQ ID NO: 13228 - DNA, 671 bp, Populus tremula x Populus tremuloides
  Predicted polypeptide sequence is orthologous to G1700
ttttttttttttttttttagagtggaaagtacgagctgctattccattgaactattcttgatcagattctagtttacaactgaaactaacaaaactgccaagaactcaaccatgttgacgggaaaatgaaaaacaaattacttgtggaatatttaaagcaacgaactttctgggagttgttccaacggcttatgaattccaacttctttcactctaaatactgatatttggactctctgaaattggaaatcctaatgaatgcagcttcaaatttgactcttctgaaggatttagggatttgacgggctttctacatgcttgtttcctgtgtcttttgcaatctgattactctcggttaaggggggtgaattctccccacatgcttgatcaccatcagatgcacaaagattatcttgaatggtgtccatcccatggctgtcatctgatctttgggacatcccatgcccagtcaacaagtagttattagaatgggaatcaaaggtctctgtgccgtattgagaacagatagctgaactgaacaagggttgcataaagcactttttttagggaaattaacgcaatgatattcgacacatgggacaagtggaatgttgttgcaaccacatgtctatgcatgtcacgtggaaggagtgcccacagtagggggagaa

SEQ ID NO: 13229 - DNA, 667 bp, Populus tremula x Populus tremuloides
  Predicted polypeptide sequence is orthologous to G1743
gagaaataaaatccttttctctgtcttcctctccttttttcagctaaatggggtttccagttgggtactcggaggttttattacccaagctgttcgttcacgcactttccttgctgggtttcatcaggggcctcgttttgtgtctttttacctacgtgggtctctcagatttcctcgagactgacaatatttggcccgattacccaacccgaacgtccttctccccgtctccatcggctgccctgatccgggaaatcttgcctgtcatcaagttcgaggacttgatcggcggagatggtgattgttgtgacttgccggagagttgtgctgtttgtttgtatgagtttgaaggagaggatgagatcaggtggttgaagaattgtaagcacatttttcacagggcttgtttggaccgttggatggatcatgacaggaacacgtgtccactctgtaggacttcgtttgtgcctgatgagatgcagggggagtttaatcagcggttatgggctgcaaatagtgatgatagtgatttttacgatgaatagagtcctgtttcggtttcgtagagagcttgatgaggttgtctgaagtgtatatatacatggagatttggcaattcagccaaataaaagaatttttttaaaaaaatgttttactctctgggcaa

SEQ ID NO: 13230 - DNA, 647 bp, Populus tremula x Populus tremuloides
  Predicted polypeptide sequence is orthologous to G1743
aagtttattacagtatggctagagacaccatacatgacattgcaggactgttattagagattctgagagggagatggcttcacccttccaggtaaattagctgatgatgcaatataggaagaaaaaaaaagacattatattctaacagtgaaccttcagcttaattagtctgtcacatgctcaggaattaacgattacttcatgcttgagaagtttgcatcaatggcaactcgttaacgaacatgccatgatattctgaaggagggggaagaaggtagttactccgttgtactttctcctgagcgaggtactaaaatcttgaagacttgattcatcgcagccaccatgtatcccgttcatcgttggatgtgacagaacagaacttgaacgtcaatacttctgttcggtgctgatcaaggataattgttctccggggagcaagacttcctcggcaaagtgggcaagtcgattgccggaagtcaagcaatctgtataagcatgctctatgaaagatatgcccacatctcagctctctgatttcttcgccttcttcaacgtcacttagacacacagcacattccgcaggagcttcattgatcaccgtgtttagttcttcaccgatttcagtcacagcaaacaattggtgt

SEQ ID NO: 13231 - DNA, 662 bp, Populus tremula x Populus tremuloides
  Predicted polypeptide sequence is orthologous to G1756
ggaacatcacgaacaactcaccttccttgtttgctcccttgagtttttatcaagatgagctcttaaatttccaagaaactccaacagattttgatggactagatggcctttacaagcccctttaccctttgttgcaccagacctttaattccccagaaagcaatatccttagtagcagtatcagcactggtactttagcatccatgtctgttccaaaagaagttagagagagacaaaaggtgcagaaaacgaagcctgtttctcctgaatctgctacttttgcgaacactgttgatgctacgagtggggccgaatcaaaaaggaggaagaatcagcaaaaaaaagtggttcaacacgtgagagaagatggtctctcatctgatatgtgggcttggcgcaaatatgggcagaaacctatcaagggatccccatatccaaggagctactacagatgcagcagtctaaagggatgtttggcaagaaagcaaatggaaagaagccgtacagatccatcaacgtttatcataacctacacagctgagcacagccatgcccatcctactcgaagaagctccctcgccggtagcacccgaaccaagccatcaatgcctaaagaagccacccaagatattgagcccaatatgccaacaataaaagacgaa

SEQ ID NO: 13232 - DNA, 389 bp, Populus tremula x Populus tremuloides
  Predicted polypeptide sequence is orthologous to G1765
attggtgtaatcaaatgaagaaatcgactgtgatatcaaggaaccactaatttcttaaagctagttcatgtatatactggttgtatcaaatgttcagtcctaggaagtcagatgtccaataaggattctctcttgtgttttttcttggtctatgggaagaggaaaacaacactaaacataaattatagctgaatattgactaaaacagtaaagaaaattgaagttgacagagaaatctctaaaatctgaaattgattgataggatttaaaacattgactagtaaaaatatccccagtagacaatcatactagttaagactctagtcctatttcttgtaggaaaatgttctctcatttagaagatccacaaaaaaaaaaaaaaaaaaaaa

SEQ ID NO: 13233 - DNA, 467 bp, Populus tremula x Populus tremuloides
  Predicted polypeptide sequence is orthologous to G1789, G1911
atagcatttaatctcttcataggcttcagggttctagccaatatggacttcaaagcaaaacaaactgttcgaaaatgccttggccatctatggtcaagaatctcctgatcgctggcagaatcttgccagtgctgttggaaaaacagtggaggaagtgaagaagcattacgagatacttgttgaagacgtccagcagattgaagctggcgaaatccctctgcccaactacactaaaagatctggagctagcaacaaaagctgccattgcattgatggtcaagcacaaagggtgaagaatcttaatctcaactgaaggatacatgaactaagctagctatagaataaagatccattgcgctacaaatgacaataggcagaagtagcagcagcagtgttattagctagcaccgaaaatgggattacgatctccctttgtgttatctgtataattactttctcgtcaaaca

SEQ ID NO: 13234 - DNA, 520 bp, Populus tremula x Populus tremuloides
  Predicted polypeptide sequence is orthologous to G1815
ttttttttttttttttttttaacgtgaaaagctttgatcttaaaatgcatttcaatgggttcttacagaacattgaggcaatgcagactgtctacaagaagaaaaaagacaagcaacaaagaaagaacctaaataaataaaaagcaaaaatatacaaaaagaaaacccaaaacttttctcgtatatgtattacgatacagcttcattctataacatgcgatgacttgaatatacaactcaaagccacgccttgcatatccaactttatctctaagcagcactgtaaactgcattgagggtgcttaatggaaaaaactgaccagcttaatgtgcccgtgttcacaatggccctgccatctattgttagctcttgattataggtgcttgttttccatgatttggcagttgacctgtccacagtatccaatgttgtctgagcacctgacttcacaaaaatggaagttttgagggtaaattgtccccgtttagctatttaacacgagcctagctctgccgggat

SEQ ID NO: 13235 - DNA, 707 bp, Populus tremula x Populus tremuloides
  Predicted polypeptide sequence is orthologous to G1835
gctaaaaatccattactcgtctcagagttttttactaacacattgaactgcaaaaagaatacccatggcaaaggaaaaataaaaaagaatgcaaggaagaaacaaacagactcccaagacctccttaccttaattaaggacctacccttgactaaacctaaaactctactatcccttaagcttccattacgcactaaccattttctgagttctgtcttacaatgcttctctactggctaaaattgtggtcatctagtgcttctattcaccgttccatccctgtacaaaaatccaatgaagaaagaaatgaaataacagtaaaccaacagaaaatacgcagccatcaatttgaaatgatccaattggaacactgttctccacaccatcccttatatgtaatccattgcagggttgctcttattaggaatcaactccggcgagttggccaccattgcagcaggtctgcttacagtaattttctccccaacctttgctctcatctcaacaactttcttatgggaattggaatgcagggaaggaacgaaggttggactaaccgcgggccggtactccggaaaaagccggcctgacttgtagcgaacaccacaagcattgcaaagggtttttggtcccattggccctgctctccattgtggtgtcttggttatctcacaatgcatgcattttcttactgcttgctgggggga

SEQ ID NO: 13236 - DNA, 473 bp, Populus tremula x Populus tremuloides
  Predicted polypeptide sequence is orthologous to G1852
gcaaccttgtggatttaatggtggagatggaccgaatattacgtccagaaggaacagtcattatccgagattctcctgaagttattgataaagtggctcgtgtagctcttgctgtaaggtggttggtttccattcatgagaaagagccagaatcgagtggaagagaaaaaattctggttgcaacaaaaaccttttggaagctgccttgagacataacctttttctctgtaatgtaattttcttttccgttcttctcaattctgatataacaccaaggcatactctgcatgcatcaaatggacgcagattcctttcttgctcctcttttggctatttatatatctagcagtggtaggaggtacactgatggaaggacattcagagtcatgttagtataggtatagcggctactgagaatactgtattgtgatatgatttgatttaatttatcgaatatgattttttttttcaaa

SEQ ID NO: 13237 - DNA, 674 bp, Populus tremula x Populus tremuloides
  Predicted polypeptide sequence is orthologous to G1863, G2334
taaatggagcagctttattagtgtaccaggagaacgtctatcaaagccaagctgcaaaaactgctacccttgattcactacagccacccacactactccccgtttctcaaatcacctgtctgagttttttatttccgcaattaaaactttgtgcttgcaaatgcagcagacgttacacagcacattaatgcagaaaacccacaaaaatttagctcaagtatgtgttaatctttggccaggaccacctttggctttcttttgtgacttcttagtgtcctctcagttatcttgtggagaacgacaacttgtggagaagtcagatgaggccattggaatggatatcgacagctgcgttgtagagaatgaggtctggttggaactatcattctccaggccaggccaggcgtctcggttttttggccactcatcaaggaagggtcgaagagactgcccgtcctgtttgacagattccctggtggtgaaatcactactgaaaaatgaatgctggggatgattgttttgcaacatcgagttttcagttgatttctctgtggtgaatgatgagactctggattgcatcaaaaaccatgcattgcccagctgtgagtctatctgaagacccttgttgcttcctgaggcttcagacaagaagctatgctccccaccttcaggct

SEQ ID NO: 13238 - DNA, 705 bp, Populus tremula x Populus tremuloides
  Predicted polypeptide sequence is orthologous to G1868
gcaaatcgttctgtattagctggccagaagagttgaaatctgactgtacccagctctcaatgtcaatctcaatggtctcgtcagactcctcgtcgtcatcatcctcacttctgcgtgagaaacttgccttctcaccgttgaggttatctcgcgagtttgaccctatacaaatgggtttaagggtgagcggtgaccataatgaatcaagccagaagcaagccaactggatacctatatcttggggaacttcaattggcggtcctctaggagaggtcttgaccaccagcaccagccatgcggattcctgcaaaagctcatcagctcttaaccttttgagggagggttgggatggcagcccgcagctgggatcttctccaacaggagtcttgcagaaatcgacttttggttcactttcaaatagcagttcaggtagcagcccaagagcagagagcaagaaaaacaatgaaagcgctagtctgtacgaggatgtggttggttcgataattgccagtgattccctattccatccctgtaatcaagaaaatggttaggatgaaacttgtgaagaagaagcttggagttatttatcttattaatttctgcagactgtttctccttgttgcttgtttccccccctcaaatctagaatgtaaaggcttggctgattccaattgaacaggtatcggccattcttgcacatatgga

SEQ ID NO: 13239 - DNA, 179 bp, Populus tremula x Populus tremuloides
  Predicted polypeptide sequence is orthologous to G1884
tttttttttttttttttttttttttttagggaataagaagattttttaatacaacaatcaaaacgtggttcccgttgtaccccaagttccaagttccaagttccaagttccgagttctgagttccgtctgttccgagtttcaccagagtctatggttacagctcttaactcttctatta

SEQ ID NO: 13240 - DNA, 823 bp, Populus tremula x Populus tremuloides
  Predicted polypeptide sequence is orthologous to G1893
ggactgtagctctacatttagggctacctagtccttgttctgctgatctggtctcaaggctgtcttcctctgagatctcatcagacaaagaagacgtaactgttgcttctggttatcaaacaagcagtactcttaacaagggtcagtattggatccccacaccttctcagattctgattggtcctactcagttttcatgtccactatgcttcaagaccttcaacagatacaacaacatgcagatgcatatgtgggggcatggatctcagtataggaaagggccagaatctctaagaggtacacagccaacagcaatgcttaggctcccttgttattgctgtgcaccagggtgcagaaacaacattgatcatccaagagcaaagccactcaaggattttagaacgcttcaaactcattacaagagaaagcatggaatcaagcctttcatgtgcagaaaatgtggcaaggcatttgctgtgagaggtgattggagaactcatgagaagaattgtggcaagctttggtattgcacttgtggatctgatttcaagcacaaaaggtccctcaaagatcacatcaagtcatttgggcatggccattcagcaaatggcattgatttcttcgaagaagatgacgagccagcctctgaaatcgagcaagacaatgattccactcagcgaaactaaaggctaatagctgttggaaacaagatcatgttaattctcagttgatacctcttgtgttttcactcaaaatcattgctctttagatcagcaagaagcctatttaagcgtcagagttactttaaatcccatgctctctc

SEQ ID NO: 13241 - DNA, 706 bp, Populus tremula x Populus tremuloides
  Predicted polypeptide sequence is orthologous to G1932
tcctcttcaaagcttccttttctttttaatcatccctttctgctcccttcctttcatggcttcttcaagggaaggacactacaggggagttcgaaagagaccatggggtcgctatgctgcagaaatacgtgacccatggaagaaaacacgggtatggctaggcacatttgatacacctgaagaagctgctctcgcttatgatggtgcagctcgttctcttcgtggagctaaggcgaagactaacttcccgtcaccaccttccacttctggtctctctctcgacctcaatcttccatccgaccctcaccaccaccaccttcgttggagttcaagtcctcatgtcgggtcccacaggtttggtggtcttggtgagttcttgcagactggagtggtttttaaagaaatgaacttcaatgctactgaggctgcagcagcttctgggccagtagtgaagatagagggtcctggtgttggtgctgtagctggagctccggtgccggaaaatgctgctccggcttcgtttttggggatggtgcgacgtgggttgccaatagatttgaacgagcctccacctttgtggctgtgactgaatattaatagtaacaattaactgatgatgacgatgaagaagaagaagaagatggtctgtctcgttttgttcttctaaggcatatcttgcggctggtttttattattaaccttacca

SEQ ID NO: 13242 - DNA, 765 bp, Populus tremula x Populus tremuloides
  Predicted polypeptide sequence is orthologous to G1946
ttttttttttttttttttttttttttaaggactcaaggatagcataatgtttcttgaggtctagaaactctcacaagatgtacagggggaaagttctaattaaaaaaaattgaaaaaaaagatagaaagaaaaaaagaaaagaagagaactttaggtctccacatgtgcaaaaataaaaactattgctggaacaggaaccaaaagcatcgatttgttgttccaatggccaaaggagtaggaccatctgattatcaaggttaaaagtttatctaggtgtttaactattacggtttgaaataaaggtacatttggtgtgcgagattaaagctgcttgcgatctgatgagagatgtcccatttgttctgtcagctgatccatatgctgagctttgtcccacccgtttataatttgatgtacatcatttccataggctttaccctccacagaacttgattcaatatcctcaggcactggactctgtgcaagaaggtcatcccagaagctagaattatcaagcaaagcatcgatatcaggatcaggggagatgttgtcaatatctatgggtattgtatcattaattccaagtgaagctggatctaggaacacatcactgcttgtgtctggttccatgtaatcttcaccaggaatatcagcagtaatttctggcaccatttctggcttttgagaaacctgtggcatgattatatctgcctgtggaataagtattgagggtgctccttgtcctccaaccaatatacttttcc

SEQ ID NO: 13243 - DNA, 543 bp, Populus tremula x Populus tremuloides
  Predicted polypeptide sequence is orthologous to G1954
gggacttgcagtggcagccacaataacaccattaaagaggaagatggcaagcaagatgaggacaagtctaccagtttagaccctgttgtgtttgtgcaagaggaacaaaatcagaagcaacagagctttgtgacttttaatgttgaccaatctgctgaagagagtcactccaagaagaaaaagaagaggaaaaatgaagagagtaagaagagcaggactcgggaaagcatggaagcttcaaatggaatcaatgcataaagaggaaagcagtgcttgtgacaaaagcatctcagagtaggaccttttgtaatgatgtagttgttaatatgagatggcaaatggctgctccaggttaaaggggaagttaattttgaaagtgatagtggttttataaagaaaagagctcacaattaagggtaggaatacaaatataacacatgatgatggaaaagcatgctatgtggttgttctaccaagagggttaatgaaatgttatttcaggagtatctaatattggattaagtgtaaaacgatattattttg

SEQ ID NO: 13244 - DNA, 379 bp, Populus tremula x Populus tremuloides
  Predicted polypeptide sequence is orthologous to G1957
gcgcccttttttttttttttttttttttaaacccaaaagttaaacaagtattcaaaagagtaacttatctatggtcatagcttacacaaatctaaaacagctgatttggatagttcttgcaaaccccacataactgtgcatcaccaaataaaacatttaatcctaaaaaatactgcaacatgatgatacaggactgaaaaaacataatccaagagcatgctatccttcattctacaatgagatgggcttaagagagagggatagagagattcctacatgctaaatggtaactaaaccaaacaagggttccagcctttatcgcttggatgatctcttatcatcctccccaccgtcaccatcatccgagtcatctttatcc

SEQ ID NO: 13245 - DNA, 736 bp, Populus tremula x Populus tremuloides
  Predicted polypeptide sequence is orthologous to G1958
ttttttttttttttttttttttaaaaaggtccacaacactagcatatactgttatcccctgaactgaaaaatgtcactagttaggaaattcgctgtggagagtttgattctttgctagacggacagtgttaacataagccatgaccataaatgtttaccccaaagaaaacataacttgagctccaaactttcctggtcttcagtgactctgcatcatctcatgggatatgtaacttctattaaggcttactgcatcatctccaggagcagcaaactgtctattgcagtaaacatgttcaattggacgcaggatcggctgacaatgctgttgtttcatctgttcttggtcgtttcactggtgctaaactggtcttctcttcgtttttgtctacaacctgacagtttctgtcctctggtgccttttgctttctgcttatagtctgggagctttcttctagtaaagcacttgcattacatgtgtcaaaccttgttttgacacagtccaaatccgaggcttctaatttgtcatttgcaggtgactgctctaactttgattcttgaagggaagggtcgttttgggaggggggaggagcctttgacctgtcaccctccatctttttttgtttctaaacatctcttgaagatacctcccctgttcctcaaccctcaattgtaaatttctctggatctcaagttgttcgtggagttgcttctggacttccatttgcaatctcaa

SEQ ID NO: 13246 - DNA, 541 bp, Populus tremula x Populus tremuloides
  Predicted polypeptide sequence is orthologous to G2010, G2347
acaagtcaagtcagtgcttgcaacaataccctgaaactattagaacaagattgggttaagttaattagccgagacactacgtgccacatgcactagacaaccctgacagcacatgcatggttgtcacacagatgtgacattaccgtttgtgtttattccggagaagtacataataataataataataataagaagaaggaagaagaataaagggaaagagtgtcagcatcactacatccctaggatgacagaagagagagagcaatcggtttagcttatctggaaatgtttgtaagtggcattttcttggattgttatcttaattcttcccctttcatcagcctgtccacataccagatccttcaactgagtgccatgagttccattcaccttgcggcttgagccttccacgtgagattcaacaacattcttccttcgcctctcgtggtgtccggccaaccgcctgcgacagcttcttttggtgtcatcaaactctgatagttcatggaatctgctacattgctggcaaaacctctgccta

SEQ ID NO: 13247 - DNA, 461 bp, Populus tremula x Populus tremuloides
  Predicted polypeptide sequence is orthologous to G2041
cagctttcagggtttattgaagaaaattggcttctccactgattaacaatgaagagaaagcttttacatcagtccaagcacccgtgtaatgcacacccttttgaggccttatatggcggctcttggcaaagcatggagctcataaatcagggatggggctatgactctgcattttgccgatagtcatcatagaattgaggagaagggtcctttctcaaacattcgagtgaagtcgaggaagaactttatctgattgcacctgctttctgaggcctggtattgatgtttgtgtgctttcattctctgaacgtgcaaagagttcagaagaaggaaattcagaacctgctagtgacctcgtcatgtcactgcattacggaaagctctgtgactttgaaaggattgtggatggcggacactcattacaatctcgcttattgaatttttcaaaaaaaaaaaaaaaa

SEQ ID NO: 13248 - DNA, 713 bp, Populus tremula x Populus tremuloides
  Predicted polypeptide sequence is orthologous to G2085
tttttttttttttttttttttttaaggacaagataacttcatatattgatgatggcactataatatctgtacattctacaggacatgcaggaattaattgctataaaaccctcaacatgaattgatgccgattacagtagccattcttgaaatacaactcaaaaactcggtcaatgatctgttattaaggctgtatcaccaccattggcgtaagtaacaggattgttatgtgtatcgatagcagggacagagtctgattcgttggcttctgtttcacccagatcaattggagccacagaatgctccagggctttcttggagtgatctctcaaagttcctctatttgcccaaaaaagcccacaggcattgcaaagagaccttggaccagatggaccacgccgcatcattggagtggattttgaattagtgccacaatgtgtacacgaggtttcatgttggctatcatcttgtgctgaatcctgaccaccatcccagccatatcctccctcagacttcttggcagaggtgaattgacctttattccgctgcatcctgagtgcaacctcctgacggacaccatatctaacttcttataaagcatcgctctttctctctgcggaacctactaatgagctgtcgtgaggtagacacgggtggactcatacacccttgatttgagagcattcacacaagagtatcaatctccatatata

SEQ ID NO: 13249 - DNA, 406 bp, Populus tremula x Populus tremuloides
  Predicted polypeptide sequence is orthologous to G2116
ggacggttgcaggggcttgatatcagtaacaaaggatcaaatattgttaagtcagaaggcccctcgctttctgcaagtgaaagtagcaccacattttgatgtaaactggctgctgactagctgacttgtccatggtgtgcctgtgtggtagattgtttatagactgacatccagtcacttagagaaggtttcttttttgatttcattattcattccattaatgatgtggggtcaattcctaattattaattcatagggttctccagaaagggaagcaccctggttttgctgcaatttgtaagggtcctttgtttaacatgggattttgtggtgatatagaacttaatggaatgtaaggtcattccaattggatgtcaagataaaaaaaaaaaaaaaaaacaccccc

SEQ ID NO: 13250 - DNA, 458 bp, Populus tremula x Populus tremuloides
  Predicted polypeptide sequence is orthologous to G2140
tgatgataatgatgagatgggcttgaatgagatattagctgctgatgttataccagagcaagaggatgttgaagaagctgcccgtcaggctaaggtcggaaaacacacttggtggatggtgatggtgatggtagtggacttagcaagacagtgaactttgaagttgaagattttggtgatgatgcatcggatgattaagaatcttcatcgaacatcggattacacctcttaattttcaccttaagaataaactaggtttatatgaggcttccttgatcattctgaagagatttgtgtggctcttgtacagatgtacaaatatgctgctgtaaataaataagattgctctagctacactcgaggcaataaacatgtgaaatattcacatgtgtgtgtgtatatcaaataaatcattgtagtaatatcccgagtaaaaaaccaaaataattttgttttaa

SEQ ID NO: 13251 - DNA, 697 bp, Populus tremula x Populus tremuloides
  Predicted polypeptide sequence is orthologous to G2140, G2765
gttggaagaaaaaccttattttaaatcctaacaaggaaaaatatttatggaccatatttagcttcctttgatcccatggtttgaatacaacttctagtacatgcatcctcctttttgccaatattttctttgttggctagtgcttgccattctcgatcctctctgggtgatttctctcccattcctttttctcagcacaaccacccgacagcaaaatgggaaggtaaccccaccaagtacgtaccaacccatataatccacgccacctttaattctctcactatctacgtatgctatattttgtagggatgtaagtccaaaaacacacaccaatataccatcattgtcttctttgttaactggcaaaaactacaccaaacacaccaaaaaaacacacccacaaccaaagaaaagaaagaagggagaggcattaaaaaagtaaggtactgatctcttagtaaaattataaaaacctgtgctgttgttgttgttgttgttgttcaaggaaattgatgttggttctctgtctcttaacacttcccgaggaagactcatcacctccagtcttctccataactgctttcaatgcttcctgaatcgaacttatagaatattggagggggtcctgctgctgatggtgatcattgctattacttgatgaatcttcttcaccactaataaacaaaacattctttac

SEQ ID NO: 13252 - DNA, 695 bp, Populus tremula x Populus tremuloides
  Predicted polypeptide sequence is orthologous to G2142
gtccaactcacaaacacaaatataccgtcggcggattgccggagccagcataaccattccacggccacggccggtgctgttcaccagaaaccacccaactctttaaattgtcaattcttctatattaattactccagtccagacttactgtaatgagaggaaaagggaatcgaaatcaagtcgaggaagagtacgaggaagatgattttggttctagaaaagacgggccgtcttcaagttttacagtgaacaacaataattccagtaaagatgggaagaatagtgacagggctaatgcaataagatcgaaacattccgtcactgagcagcgaaggaggagcaggatcaatgagagatttcagatattgagagatcttattcctcatagtgatcaaaagagagacacggcatcgtttttattagaggtcattgaatatgtccagtatttacaggaaaaggtgcaaaagtatgagggtccgtaccagggatggagccctgagccagcaaagttgatgccatggagaaacagccactggcgccttcaaagttctgtcggtcaccctcaaactattaaaaatggttctgttccaggagaaacatttccaggtaaacttgatgagaataacattgctctcacaccagccatgcttccaagcacaccgaatctagtagaatctgaacatgttgcttgcaaa

SEQ ID NO: 13253 - DNA, 741 bp, Populus tremula x Populus tremuloides
  Predicted polypeptide sequence is orthologous to G2142
aatctgaactgttgcttgcaagtgttggaacaccaacctgagctggcaaacaaggttatgcctcttccccacctgctcccattcgaagtgttggacttgttgctcacccctgtcagctaccagtctctgatgctcaatcagctgagtgtcccatcaccagtgaaattttgaaccagcaggagctggcaattgaagcagggacaatcaatatctccagtgtttactctcaagagttgctgaatactcttacgcaatcactgcagagtgctggtgtagatctatcacaagccaacatctcagttcagattgatcttggaaagcgggcaaatagagggctgacccctggtacattgacatcgaaggatcctcagaatccccatcctaccaatgaaatgataacccaccttagggatgcaagtggaggagaggattcagatcaagctcaaaagcggctaaagacatcataaggcactatgggatttatcaagtctgcattcggttttcctgtggttcccattattagtcattgggttaatggacatgcctatgcctttgggttcctcagattcttacatacttcatggaatcatgttaacagctgtcaccttagatgatatgtttcagtggagttgcttagatttgtggccatttcatgccatggccatatcgtggttgtaacgtacatattaattaaagccttgtttggcattgcgtaaaaaaaaaacacccaaaaaaaaaaaa

SEQ ID NO: 13254 - DNA, 691 bp, Populus tremula x Populus tremuloides
  Predicted polypeptide sequence is orthologous to G2142
ctatttagtacatatgtacgttacaaccacgatatggcccggcgcatcaaacgacccaaatctgagcagaaacatataatctaaggtgacagctcttaacatgattccatgaactatttaagaatctgagaaaccaaaagcacagcatgtacaataacccgagggttgatatcgggagcaaaaaagatatccccagcgcaaacttgataaatcccattctggtcttatgtctttagccgtttttgagcttgatccgagtcctctccttcacttgcatccctaaggtgggtcatcacttgattgcaatcctggggatccttagatgttgatgttccagaggccagccctttatttgcccgttttccaagatcaatctgaactgagatgttggcctgtgacagatctacactggcactctgcaatgcttgcgtaagggtattcagcaactcttgagagtaaacactggagatactgatagtccctgcttcaattgccagctcctgctggttcaacatttcactggtgatggggcactcaactgattgagcatcatagactggttgctcaaggggaggtgcgactagtccatcacttcgagcaggagcatgcatgggaagagcgtttgctacctcaggttgatgctccaacactttgcaagtgacatggtcagattctattaaatttagagtgc

SEQ ID NO: 13255 - DNA, 493 bp, Populus tremula x Populus tremuloides
  Predicted polypeptide sequence is orthologous to G2192
ttttttttttttttttttgtataaatctaaagtggatctctataactcgaaggaaaatttcttagaatccagtcaacttctctgaaccaaaattctacagcttcgtttgcctagtaatctaacaattgtgctcaaaattttccatatttacaaagacagctaatcataactccccagtgctctcacaggagctcccaagattggcatttgcatcatgaactgagagcctgattatattactgcttgatgatcttgaaacatccatgcactccagcaagtcagcatcacaagctatcagaacccactcatgatcatcatccagatacttgatgtcgaaagtacccacctccaacttcagcctcttggccacttcctctttcaactccacaatcccagaacccagagaaattcgaaaccttattacgtcttccctgtatgttgcctttatggttacactcttcgtttcttgcctggatgttgcctgaggaattgc

SEQ ID NO: 13256 - DNA, 710 bp, Populus tremula x Populus tremuloides
  misc_feature (523)..(523): n is a, c, g, or t
  Predicted polypeptide sequence is orthologous to G2226
gggcagccatcttcatctccatcttctatgaaacaatcccatatgacatgtataaaagttttgataatcccatgaatatgtcatgtttctaggctgctagcatgttcttgatgcttatatatttctttgcatagagaccaagacaggaacttcaaagcttccctagtgtcactgttgtcggctccttttacaggattttgctattcatcacttcatcatagtcaaaaaccctgtttatatgccccaagatcaagcaaagaaggaaacatccggttttctccatttgcttcaactgtgatttatacaagcatccctccattggtttccataacttccatttgagcacactgtgaatcaagaatcttttgttagcttgagctttgcggaatcactggaaaaaaaaaaaaaaaaacaagtcccacgaaacttcaatgggtctatcaagtctgccagctccatctgaaggagtactatgtgtgcttttagtaaacactgccttgtcaatttccattgtcaaaggaantagtccgttcaatccttcatattgttggtatccgtttgtcaccatctgcttccctcccatcgtcagataatgctgaagacaccagagagtcgtttgaatttcgtttaagtcccccagagaattacatcgaggagttccgaagcaggatgccgtcaatccgattcaacacggtgtgcagctgtaaaca

SEQ ID NO: 13257 - DNA, 672 bp, Populus tremula x Populus tremuloides
  Predicted polypeptide sequence is orthologous to G2343
gtcaaactctgctggggtttgtcgcagtttcctttattctttcctctgatctgtttccaacacgaaacaagcttgcatgaatacttatgcagttataatgttttcatttcctcacattttcacaatctcacctctggaagctaaaagggggtagaaatgaaagaaaagaaatatataaaaaggaaaaaagaaaactgtcttcaaaagcctggaccattctgaaagctctatatatcataaatatcttatagagatgaagggaaagaagagagtgtagcagctcccatgctagatgaatttggtgcaatttcttctccaccaagtactgattcttcaacattatcccaaaaaagaaagttcgagcattgctgtgattcaacccattcaatattcaactcttgcctttgtaagcactccaatgacatctccccttcttcgttcatgctacaggattgcatttcaataggcatcatgttgtcaatcaatggaggcaagtaatttgtgtccattccaatactaaaagttgcttgcgggggcagtgctgcttgaacttgatggtgctggtttgaattccatgtttccatgttcaagcttgccgaatcagggaaaacctctccgcgaacactactatccgccattccatcaagcgaggtgctcgtgtcaaacataaat

SEQ ID NO: 13258 - DNA, 744 bp, Populus tremula x Populus tremuloides
  Predicted polypeptide sequence is orthologous to G2348
agactgttctgatgtgatccaccttcttgatggtggcataagaagaagaagaagaatctcccaagttatttatttttatacaatcattatcattgcaaaataagataatacatgggcttggggttggggttgcaagctgttgtcagtacaaggaaacagaagatacaggattattggatattttgcctacaaagaattctcatgcaactaacaaaaccctaaagttacctccaactcatgtgaatgccatgaatctatcttgatgcgtccacctatcagtgtgtacagagccagcaatcaggagggggcattataatctggagacttattgaacatctaatatctgtctatcaagcacctgcgtatagatactgcaagtttgctaacctttcgtgggtggagaagaagggcgcatactgcaaaacatatggcaataatagcaattacaaacactgaaggacgatacttcaagactctgttagagaaaacgagaccacatgatttctttggcccctcgttgattaggttctttctaataacgttgtctctgttgaaaaggggaacctcctcgcttctaacaatacatttggagtttgccatcactcccaaacctccatttggtctttgctccaacacctcactggagataactgctggcttgttgcttacacagcagcttcctgaaacgcacactcctgtccaggacattccaagtgatgcttcataaccttcactttctcttga

SEQ ID NO: 13259 - DNA, 430 bp, Populus tremula x Populus tremuloides
  Predicted polypeptide sequence is orthologous to G2455
ttttttttttttttttttgtatattaattattcgttataattgctagcattcttctgcgtataacatccacttaaatattatacgtcttattctttcccctaacacagtcttgcaactagttttattcaaaatggtccctgcaaaagtcactgattattacaataagcaatgaaggtaaagcttaatttggagtcttgcgccagaccggagctgagaatccattcaaatcaacaagctattatcaaaataatcacaccatgcatgattactttagtttataagcaaacttcttggcaatgatatggccaatatgtttttattaggctccttgctggccggacgtacgagcagcaccttatgcatccatgccggtgtcgttgagtgtgagaccagactgggtgtgagggagatgagcccagttcttggctg

SEQ ID NO: 13260 - DNA, 608 bp, Populus tremula x Populus tremuloides
  Predicted polypeptide sequence is orthologous to G2455
gacttttctcttgttaaagaattctattctctcccttgatctgtactcaaatccatagttttcataaattagcactaaaaaagatgtctctggagttggtatctgaacctgtttgttatgttcactgcaacctctgcaacaccattttagcggttagtgttccaagcagcagtttgttcaatattgtgacagtaagatgcgggcattgtggcaatttgctgtctgtgaacatgggagcatccttacaaacacttcctcttcaagatccccaaaaactgctccttattaactcagaagatttgaacaagaactttggctcatcttccaaatgtaacaaggtcactgcttcagagtctacggagcacgaaccacctaggatgcccgccatccgccccccagagaagaggcagcgtgttccttctgcatataatcggttcatcaaggaggaaattcaaaggatcaaggctagtaaccctgacattagccacagagaagctttcagcacagcagcaaaaaattgggcacattttcctcacattcactttggactgaagctggacagcaacaagcacgcaaaattggaccaccagtcatttgcaggagagggc

SEQ ID NO: 13261 - DNA, 719 bp, Populus tremula x Populus tremuloides
  Predicted polypeptide sequence is orthologous to G2456
ctctcttctcttttgctatagtaacaagtcaacaatcaagacgattagatccgaggaagaggattattatctgttctttcaaaatatccaccgatcagtcaatccatcaatcaaatcaacaaaatctctaaagaagcataaaaaaatggcatcctcttcagctgccttttcaccggatcacctctcttcatcagaccagctttgttatgtccaatgcaacttctgtgacactgtcctcgcggagggaatgaggagtacgggagcaccgccaagtttgatgatcaatcagccaaacccaaatgaatctgttatgccaattcgaggtgttgaggagatccctaaaccaccagtggttaatagacctccaggaaagagacaaagagtcccatccgcctacaaccactttatcaaggacgagatccaacgtatcaaagcaggaaatcctgatataagtcacagagaagcatttagcgcagctgcaaagaattgggcccattttccacatatccatttcggacttatgcctgatcaacccgtgaagaaaactaacgtgcgccaacaggaaggagaggacgtgctcatgaaagatgggtttttcgctcctgcaaatgtgggtgtcactccctactgagaagtggagctattagggttttctttgttccttccctctctacatagccatgtcttttctttgactgtcgttagggtccttgctttaa

SEQ ID NO: 13262 - DNA, 711 bp, Populus tremula x Populus tremuloides
  Predicted polypeptide sequence is orthologous to G2456
gccgggcaacatttgtgacaccgtccttgcggtgagtgttccttgcacaagcttattcaagactgttactgttcgatgtggtcactgcaccaatctcctccctgtcaacatgcgtgggttgcttttgccatctgctaatcagtttcacttgggtcacagtttcttctctccttctcataatctcctggatgagatcccaaacccaactccaaacttcttgatcaatcaaaccaatgtgactgattttagcgttccggttcgaggaatggctgatcatgagcttcctaggccacccgttatcaacagacctccagagaagagacagagagtcccctctgcatacaatcgattcatcaaggacgagatccaacgcatcaaagctggaaatcctgatataagtcacagggaagcattcagtgctgctgctaagaattgggcccacttcccacatattcactttggtctcatgccagatcagatggtgaagaagactaacgggcgccaacaggaaggagaagatgttctgatgaaagatgggtttttttcttcagctaatgctggtgtccctaccccttactaagaagtggagctgctagttctcatgttgttttagtttttagtacgtagttattgtaggagaaagagtttaaggttaattagatgtttgtcaagtactttaacaagtttaattacttcataacctatctacta

SEQ ID NO: 13263 - DNA, 606 bp, Populus tremula x Populus tremuloides
  misc_feature (415)..(415): n is a, c, g, or t
  Predicted polypeptide sequence is orthologous to G2456
ggctatagtaacaagtcaacaatcaagacgattagatccgaggaagaggattattatctgttctttcaaaatatccaccgatcagtcaatccatcaatcaaatcaacaaaatctctaaagaagcataaaaaaatggcatcctcttcagctgccttttcaccggatcacctctcttcatcagaccagctttgttatgtccaatgcaacttctgtgacactgtcctcgcggtgagtgtaccttgctctagcttgttcaagactgttacggttcgatgtggtcactgcaccaacctattttctgtgaacatgcgtagcctacttcctgcagctaatcaattttaccttggtcatggtttcttcaatccgcagcttaatatcctggagggaatgaggagtacgggagcaccgccaagtntgatgatcaatcagccaaacccaaatgaatctgttatgccaattcgaggtgttgaggagatccctaaaccaccagtggttaatagacctccagaaaagagacaaagagtcccatccgcctacaaccgctttatcaaggacgagatccaacgtatcaaagcaggaaatcctgatataagtcacagagaagca

SEQ ID NO: 13264 - DNA, 447 bp, Populus tremula x Populus tremuloides
  Predicted polypeptide sequence is orthologous to G2457, G2459
ttttttttttttttttttaatatatcagatcatatagatattgacgaaatgaaaatagcttccataaagttcttacatcaagtgaagtaaacaatagcataaacagttggtcacaaatacaatattagagaaacatagattcatatatatatatccttaattaagacacgctgaagtcaaggattcttaattcacttcaaagagcatggagtttcatggaggtctggttttgaaaaatcaaaaccatgatcaattgttcagcagtgcagaccttgactttagatgcttctcactgccatcatccaccttagtttggttgttagtccccaacatcaattcaaaatgaatatgagggaagtgtgcccaatttttggcagcagtgctgaaagcttctctgtgactgatatcaggattattggccttgatcctctgaatttcctcttttat

SEQ ID NO: 13265 - DNA, 631 bp, Populus tremula x Populus tremuloides
  Predicted polypeptide sequence is orthologous to G2457, G2459
gcaacaacaatcaacttttaatctctttttttacatttttacatcttagacatccaaaatggcacctaagaaagcagctcctggtggcaagaagaaaggttccgcctacaatgacttcatgaaagaagaattggcaaaactcaagagcgactcccgccctcataaggaaaagttcaagcacgtcgcttccttgtgggccaagagcccaaagaaccccaagaaccacaaataaacgatcaaatgaacgaagaaggagaacaatttttgagggtccacagcgatatggcttcgatctgacaatcttgtccctctcttgtgagtgacgggacaaggttttgttttttttaaagtcatctctcactgttgttgtaccaaatttctttcatttccattctccctcattcttccttcttcatttatctcgtcttggtttcgcgttccttgcctttttcctttttctctctctcatcttcttttacgatcaatattgattcttgattctaagaaatctagtccaagtttcattttgctctacttagtgtagttttactaatcttcaagatgaagctgtacacgtcgagcaataatcattggtttcttgtcaaaaaaaaaaaaaaaaaaaaaaaaaaaa

SEQ ID NO: 13266 - DNA, 714 bp, Populus tremula x Populus tremuloides
  Predicted polypeptide sequence is orthologous to G2520
tttttttttttttttttttggttctgaactagttctcacatatccattactgaattcagtcagatgatataatacaattaaagattagatgtattttctacaaatgagatgatagtacaacttcagtaatggtcacagatatcacaaacacctttctgcatctaagggggaagcaaataacaaatttcttctcaataaactgaagaaatctagtgccttgattacgttgctcttttaaaacttccaccaacctgcatatgtagccattcggattgggatccttgaacatagtctcttgttggttgtgggccaaatatcattccagtagcatcaaatggctgtgcaccaaggttatttggatgaaggccttcaatcgtggggctcgtgctcatccttgaatttactgcttctatcttcattgagaggaactcaacctgacactggagtgactggatgtaattaattatctcatcaagggcaagtgctttaccaatgaccttgttacacccagggaccaaatcttgaagtatcttcatcctctcactaatcctctctctccgagctctctctgctaaactgtggctatcagtcgcttggccccttcttgatctgacatgaatgtagtcttgcataggcggctcagatggtttactgcttggttcagccggcttgttattagcagcagaacttgcttctatttcagctcttgaacat

SEQ ID NO: 13267 - DNA, 754 bp, Populus tremula x Populus tremuloides
  Predicted polypeptide sequence is orthologous to G2520
aaataagtttatacaagatttgagcactagaaatatcagacatgcaactttatctaacaagattaataccaattctaggaggatctgtacgcgtattagtacagacaagaacatgatgcctgttaagatatatggagtaaaaggaacattttccaacacaaacaaatggagatgttcagagcagcttgaattggaaatgtgttcctcgttttaacctagcgcgtatattttgacagccgatgaaggaagaagaagcattgccacttgaaggttcttgctggtaattgagggggattttctatattatgacgttctttgaaagccaccaccaacctgcatatgcaaccattccggtgatgtacagtgattgtattccctcgtggcttgtgaaccaaatgccatgccagcagtatcaaaagtgtgttggccaaaatctttagaaggaaagatttcagttccagggttcatattcaaattaactgcttcaagcttcattgatagaaactcaacctgacgttgtaatgattggatgtaattgataatctcgtcaaggaccagggccttgccagtaaccttgttacaacctgggactatatcctgaagaattttcatcctttcgcttatcttttctctcctagctctttcagctagactgtggctatcagtagcttgaccctttcttgctcgtacgtggatataatcttgtttgggtggttctggtagttgaggtttgtgttccacatgcttgcctgaa

SEQ ID NO: 13268 - DNA, 327 bp, Populus tremula x Populus tremuloides
  Predicted polypeptide sequence is orthologous to G2522
tcagtcacacctactagcatgccgcctcaaagtttcacttcctctccgacgagcatttggcctggaccacgaccagttgatatgagaaacccccacactgatattgacttgacgcgaggatgactgtttgctgcaacagaaacatggcaattttgtacatttctgttgttgtaaatgtatccaatcctgtgataattatgaactcaattctccccactaaagggcaatgcgtttgtgctaacgtagtttgtacaagaagccatcatttaaccttttcaagtgacagtgtaaacttgtcaaaatttccaggtaaacattaatctctag

SEQ ID NO: 13269 - DNA, 738 bp, Populus tremula x Populus tremuloides
  Predicted polypeptide sequence is orthologous to G2531
caaaagagggagcacctgatgtttggatacagacatacaaaggctttccaatcctgctgcgtatctgctgatgggatttctcccaaaaggcccaattgtagtactccaaggtggccaaaaaattatcaaacagttgcttccgcagagaaagatacttgaaaattcttgaactcaactccattcaaatgcaccatatgagaaggaacacagtctcgagatcgtacgatcttccttctgcaaaaccattctaattcatcaataacaggttgtccatcttatttgtttctgttcccctacctatcacaaggatcttgtcccacatatgtcccaagccagtgagcaatattaaaacattgtttcaacacatgagactcttccttccagtagtggtaaactgcacttcctcggtagtttgaatgacatcaattaactcactgttggattcaaaagattcatgtaaaaaaagcagttttaggaaggtcctggaccaatcttaaaaaaaaaaaaaaaaaaaaaaaatccttttgggccccctgggcccatttttttttaaactgaaaaaactttttgctggcggccgaaataaaacccccttgggccaattccccctaagggagggggttttaaaattacgggggccggcttttaaaaccgttccggatgtgggaaaaaccctggggggccccaattttattgtgctttcgaaaaaaatccccctttttaaaaaaaaaaaaaaaa

SEQ ID NO: 13270 - DNA, 756 bp, Populus tremula x Populus tremuloides
  Predicted polypeptide sequence is orthologous to G2531
aattgatgaatttatcccaacaatagagggggagaatggaatttgctactctcatcctgagaagctaccaggagtaagcaacgatggccaaatccgccacttctttcatcgaccatcaaaggcatacacaaccggaactagaaaacgcagaaaggtgcacactgatgaagatggaagtgaaaccagatggcacaaaacaggcaagaccaggccagtttttgctggcgggacagtgaagggattcaaaaaaattctggttctttacaccaattatggtaggcaaaggaaacctgaaaagacaaactgggtaatgcaccaataccatcttggaaacaacgaagaagagaaagatggagagttagtggtttcaaaagttttctatcaaactcagcctagacaatgtagttcaagcattaaggattcaattgacaataaatcgtcaaatcaaagtggtgatattgataatattcaccccctagccaagaacagtacaggcctccttgagttctataatcaaacttatatttcttatgatcatgggaatcatagcaatgaaatccctcaatttctccccaatttggttgttcagggtgacgggtcttcctatattaggttagctgcagagacaagcaaaggaaagcttcagagaaagcagtgatgtgatcagaaagagcatttggtagagcagaaatgacaaagactcatcccgagtgcatggttgttgcttcttttgtggtgtaaccctcacataaatat

SEQ ID NO: 13271 - DNA, 708 bp, Populus tremula x Populus tremuloides
  Predicted polypeptide sequence is orthologous to G2536
gcctttcttatggaatacccgctgcagattaatcctgtccggcgccaccgtagtaccaatccaagtccacatcccacatatcattatcgatagacattggcacgctactactttcaccggttctagagggattgccttggtcaccggagcatgaactgtcaggtgagcttgtgctctccactgttggatggttttgatcagatgctactagctcattgccaccagaggctggttgagttctcggctcgattacctcaaggcccaccggccgtctgtcaaatgctcgcaggcattttgagtttctgtagacccggcacaaactgtattcatgccttggctttggatttgcgctagttgacgaggatgctttcccttgatctacagctttgtactcgttcattttccactcagtttttcttccatttggagcccttccgctacagaaaaccattgttcttttcaaaccaatgctgcgattgttggaaaagacagacccgagagagccagttgctttccagtatccagtatttgttagtctcttaggcctccctccgcgagcttcgctctcttgtcttggaatgaagaaaaaccactgctcaggatctttaatatggtgcaagcctcctgaaaattgtggaagatcccatggatcgtgctcgtatatatcacggaccggtataatctggttaatgaccctggttaagctct

SEQ ID NO: 13272 - DNA, 737 bp, Populus tremula x Populus tremuloides
  Predicted polypeptide sequence is orthologous to G2559
acacaaaagacaatatcaaattcaaactcgggtcttgtcagaacttgggtaatgtaacacatgcactcccatttattggtttttacaaatatcaaaagacatttacagctgaaccaacaatatttgagcacagcataaaataacaagccaaaaaatcaagcaaatccaattctagcagcctttctcttccgtttaccccactattgttcattaaaatttgccaaaacatcttagacacttccttggtgtataaccagttgctcggaatttcgctgcagtttcctctaccttgagacggtcctcccctttttttgcttcaatcattgctttcttctcctcggctgccttgtggagttcggctactttgctcttcattttctctgcatattcagccttcttcttttccactttttcctcatacttctttatttttgcctccacagattctctcttgattgtctcccatgatccaatggcagagagtttcttgtgagccttgttctccgctttagcttctcatttcttccatgcttaagtaagcacatcttttctccgcttaacctcgcaagcacagcatctctgtcatttgaccccctgaagtttttgcagagcaggtggatctgcacctttcagtactagaccgactctctatagcagatcattaaggactctttctctcctacagtcatgtctgactgtgagcagaagctctaatcagctcctggctctctccatga

SEQ ID NO: 13273 - DNA, 823 bp, Populus tremula x Populus tremuloides
  Predicted polypeptide sequence is orthologous to G2559
tttttttttttttttttttttcacacaaattcaataagttaatttcgaaacaataacttgaaatgttctatacacccaaatacatcaacatggacacacataataaacgaacacttgccaattctcccctattgaaacagcaaagaaacaaacaaacggtaaccaatgaaggcttaacaactatacaaataataaaattttcaatcaaaactgagaaatcttagcctaaaaacttaaaaagcttctttggagtagttccagtggcacgatatttggcagctatctcttcagccttgagaagatcttccccacgtttagcttcgactatcgctttcttttcttctgcttccttgtgaattactgctattttgttcttcattttctccacatattctgcctttatcttctcaagtttttcctcaatcttcttcaactcagcctccacagatgctttcttgctgttctcccatgatgcaatcgaagagagttttttgtgagctttgttttctgctttggatttctcactctcttcccatgctttgataagtgatatcctcttctctgtaacaacccttgcaagagcagcatctcgattgacagagccctctgttttctcctagcagattcagatgctttctcaacaatagcaactgcttttgactcctcaaccttctcttcaacgagaggaggaggagagattcagtttttctcctcagctacatcttttgagccttaacttcagttcaagttcggctagtggtggaggaggaggaggttctgatggagtttcagtttccaccttctttggctcctcttttgccat

SEQ ID NO: 13274 - DNA, 733 bp, Populus tremula x Populus tremuloides
  Predicted polypeptide sequence is orthologous to G2559
tttcttacaaactcattaagttaattttccaaacaacatcttgaaatgttctatacacacaaatacatcaacatggacgcacagaataaatgagcacttctcaattctcccgttttgaaacagcatataaacaaacaaacactaacaaatacaggcttaaaaataaacaaataatacaattttcaatcaaatctgagaaattatagcctaaaaaatcccgagaagcttcttcggagaacttccagtggcacgatatttcccagccatctcttcagccttgagaagatcttccccaagtttagcttcgacaatcgccttcttttcttctgcttccttgtgaatcattgcgattttgttcttcattttctccacagattctgcctttttcttctcaagttgttcctcaatcttcatcaactcagcctccacagatgctttcttgctgttctcccatgatgtaatggaagaaagttttttgtgagctttgttttctgctttggacttctcactctcttcccatgctttgacaagtgatatcttcttctctgttgcaacccttgcagaacagcatctctattgacagagccctctttttctcctcagctgattcagaagtctcaatacagcaactgcttctgactcctcaccttctcttcagcacagaaggagggatcacagttttctcctcaccacatcttttggagcctcagctacaggttcaggtcacctgtgg

SEQ ID NO: 13275 - DNA, 726 bp, Populus tremula x Populus tremuloides
  Predicted polypeptide sequence is orthologous to G2592, G2713
cttacggccgggaagtgccacgcaaacacaacatgctaaccggataagtcgcagattccattctaggcaggtgtctccaagattacctgcatgtaactatagtataggcactatcacctatgagctcaatgttcttcgctcaagaggaccgaggagaatgcattgcatgatgcactctattccaatgtcttccattgaggaggggggcactgtcccaacactaacttcattaacagagacatttggtggccggtttccccacctgtcaacttcaaaagggaaggaatcagtctcagatattagttccccaagcccctctcaatcaccagtactaacccaaggttcagaagagcccctggttcttaagaacaaggcccctagatggcatgagcagctacagtgctggtgcttaaatttcagaggtcgtgtcactgttgcttctgttaagaacttccaacttgtcgctgctgttgaatcgtttcacaatgtgtcttctgcagatcaagaaagggtaattttacaatttgggaaaattggaaaagacatcttcaccatggattatcgctatccactttcagccttccaagcttttgcaatctgcctgagcagctttgataccaaaccagcttgtgaatgacaactatggcgcttggagatagttactgtgtaatctaaaatgtttccccaaatttggaagcgtatcttcactagataccgagctcatca

SEQ ID NO: 13276 - DNA, 739 bp, Populus tremula x Populus tremuloides
  Predicted polypeptide sequence is orthologous to G2592, G2713
gcatattctctagatgctgatgatatgtcaaagggaagcaatgcttatgttgggaaacttagatccaattttctcggaaccaagttcacggtctttgatggacagccacctcatgctggagccaagatgacaaaaagtcgcccctcaaggctagtaaatttgaaacaagtttctccaagagtccctactggcaattacccagtggctagcatctcatatgaattgaatgtattgggttccaggggtcctaggagaatgcattgcattatggatgccatccccgctgctgccattgaacctggtggaatagctcccacacagaccgagttttctcatcacagtgtagatttcgtcccatcactgccctttttccggtcaaagtcaaaccgagttgagagctttcaatcaggatccttgtccagtcagagagaaggagctttggtgctgaaaaacaaggctccaaggtggcatgaacagctccagtgttggtgtttaaacttccatggacgagttacagttgcttcagtgaaaaactttcagttggttgtttccccagaaaatggaccagctgggccagaacatgagaatatcaccctccaatttggcaaagttggaaaggatttgtttaccatggattaccgctatccaatctccgcattccaagcatttgcactgtgcctcagtagctttgacaccaaaatagcttgtgaatgatgcctcatggttgagcaggtttgaa

SEQ ID NO: 13277 - DNA, 818 bp, Populus tremula x Populus tremuloides
  Predicted polypeptide sequence is orthologous to G2592, G2713
ttttttttttttttttttttttttttacaagtcaagcttgcatcttggtgtctcaacaaataattaaagtgacaaatagttacacagccacaaaaagaaaacaaataaaaaggaaagaaagaaagaaaacaaatgcaagaaaataaaataaagaaaattgaagaaaataaaaataaaagagaagaaaacgcagagagtgaaatatacagagcattataggtgacacgtctagtcctaaaccatagatgccacatctctttctacatcatggattcttgatgcaggccaggctccaccccattatatcaaaacattcaaataagcagcagcctctgagcatttcatttgtattagtaactaccagatattaagttccctcacaaactttattgcaccacaatcagcccagaaaactccattccacctgctcaatcatgtgtcatcattcacaagctattttggtgtcaaagctactgaggcaaattgcaaatgcttggaatgcagagattggataacggtaatccatggtaaacaaatcctttcccactttgccaaattgaaggatgatattctcatgttctggcccggctgggccattttcttgggaagcgaccagctggaagtttttcactgaagcaactgtaactcgtccatgggaagttcaaacaccaacactggagctgctcatgccaccttggagccttgtttctcataccaaagctccttctctctgactggacaagggtcctgattgaaagctctcaaccctctcaacatgggttgactttgaccggaaaacaggagtgatggaaagaaat

SEQ ID NO: 13278 - DNA, 677 bp, Populus tremula x Populus tremuloides
  Predicted polypeptide sequence is orthologous to G2604
gaaggcattgctggaatgggagaaagggctgtggtttgtgtgtcgaagactctgtaagtttgtaggaaattggaaaagaaagctacaacttttctgagatattgcaatgccagttcctcttgcaccttatccaacaccgccggccccatatgctccgaccccccctcctcctcctcctccttcagcagccaatggtgcacagagccagcttgtgtgttctggatgtcgaaacctgttgctctatccagtcggagcaacctctgtatgctgtgctgtttgcaatgcagtcacggctgtgccacctcctggcacggaaatggcacagctggtttgtggaggttgccacaccttactcatgtacatccgtggagcaaccagtgtgcagtgttcatgttgtcacacagtcaatctagccttggaggcaaatcaagtggcacatgtcaattgcgggaactgcgggatgctgctgatgtaccaatatggagcacggtctgtgaagtgtgctgtttgcaattttgtgacaccaattggggtctcaacaagcgccactgaagagaagttcaaagcctgaatagttacacagctgtgctaagttggtcattacagattctacaagtatgtttatgcatattacaatatctcctccgacgatagcatctccaggtgaagcagaggaa

SEQ ID NO: 13279 - DNA, 353 bp, Populus tremula x Populus tremuloides
  Predicted polypeptide sequence is orthologous to G2639, G2640
tttttcagctgggaaattgccttagttatctagcacatgcttatgttgtggaagtggttctagcactggaacccagttcgaagacaattgtgaagagcactaaattttcttctcttgaatgcatcttgctgtcctgatgcagctgcactctcctgtaggcatctatctgggcagtgaattctatttttcttggcaacgctagtttgaactctaacagtaaattatttctgttctgcaaggctgttatactataaccttggaacattgcagttatactgtaaccttgagatgttttcgtgtcctacaattgttcatccttcacatgtgaaaaaaaaaaaaaaaaaaaaaaaaaa

SEQ ID NO: 13280 - DNA, 600 bp, Populus tremula x Populus tremuloides
  Predicted polypeptide sequence is orthologous to G2655
gcaagtacttggtgcctgcaaaaaaatgaaggaaaactctgatggtgataatcagcaacatgtttcttcactgcctttctctgagttctttacatttccacagtactcaacaagctcaattcatttcgaaaactctgttggcaagaatgaaaagttgcataagactcaatctactatagctgacatagaagtgaccatggtagagagtcatgccaacctcaaaataagatcgaagaggcgaccgaaacagctcttgaaggttgtttctgggctgcatagcatgcgcctcactgttcttcacctaaacgtcacaacggttgatcaaattgtgctttattctctaagtgtcaaggtagaagatgattgcaagctgacttcagtggatgagattgctacagcagtgtatcagatgctaggtaggattcaagaagagtgtgtgatgaattgttagaaagtttactattaattttcctttgtggttggccctctacacaccatatgagggcaatttctgcatttttaggcagtctctgaaaggctcatcgcaactaatgtctctcccattttattcctagtgtagcttcttctggttggtctaat

SEQ ID NO: 13281 - DNA, 863 bp, Populus tremula x Populus tremuloides
  Predicted polypeptide sequence is orthologous to G2763
gtttttttttttttttttttaattaacaactttattattaattaattaattaacattttttctagggattcataacagagaaaatagaataccttttttcttaaagaaaaaaaaaacagagacacgtatttaacagggagtcgaaagaaaaaaaaatgtgggaaaaaaaccagaaaaagacatctggcaacacaatcccattaggaggtcatcggctcagaagtagagctggcttcggaggtagagcgagaaagaagctcagctatagcagtcatggttttaacttgcatctccaaagcagcaatataatctgtagcttcttccaaaataacaggcaatggttgtttccggcaaccaggaactaaccgcccaagaacacgaactttcctttgaacagccggcaaacccttcgctttcaacctcaaaacactcactttatgcttcctcgacgaccggctgccactcccggtagtggatcctggagaagaagacgacgacgacgcaagtctctgtctcttatgttgtttccgaaatttgagtttgatgcggctagttaaaatggctcggctccacctggttttacctttagcagcgaaagctaaagctcgatcagcaacttctctaacggctcgacctttacgcggggctgatgaagttgaaggggttgagattgacttggcttaaggcttggatgatttggatgagtagacttgttggttgtgcttctgttttccatttggcgtggctctgtgagttttgggttctgtttgattggtgttgctgcacactgattcttcttcttttccttctggtccgatccgggttgatgttgggcgctagtgctcactattgctgctgctgct

SEQ ID NO: 13282 - DNA, 601 bp, Populus tremula x Populus tremuloides
  Predicted polypeptide sequence is orthologous to G2765
acggctatcggcatttagcacctgaccgtcaccccctttaatcccgtcctttctttcctggtacaagctccaatccaatgatttctctagggttttgacagcccaaaaaaaataattctctctggggatttcgcgtcaagaaggatctcgcccatcgttctctgcgtcgtcgagtaaactccatgaattgaaatgtgtcagtatcgaccatgggaagatgattcagcacaaattgaagattatgaacaacgtactagaaataacacagggcatgtagatacaaggttggaggctcgggtagctttattggaggcacggatggcaaatgttgaggctcgagtggaaagacttgaggcgaagatgttctttttgcaaaagggaatgcgtgtagtgtgtgctttgtttttggtcactcttgcatatgctgtatgtaaatgaatgctggagatgattcacttattagtctcaggcttgtatctgtgctgctcttaatgagataccctggaaaatgtgttccataacaatgaagaatatttctgcccccataaaaggcggaaagatgactatctatacaatacctaatgtccactagagtagaaga

SEQ ID NO: 13283 - DNA, 371 bp, Populus tremula x Populus tremuloides
  Predicted polypeptide sequence is orthologous to G2768
agtcctgaagaaggacagtcattagcttgctgtaatgacctttccgggtaacatcctctcaattttgataatcactcaagaagacgagaaagggagttgaagttagcagcacgtgtttggtttggatgcagggaaaatatagtttttgtatagtataatgggggaatcgttcgcacctcttagggctgctgactaccgagattttgttttttttcgttttttgaggttctggggacagcatcctttctggttttgtctgcaagtttagagaggtgcttgtgctgtttttctctatcgcttcgtcctattcccccattgctgttacctgtacataaagtaaaacctaaaaaaaaaaaaaaaaaaaaaaaaaa

SEQ ID NO: 13284 - DNA, 700 bp, Populus tremula x Populus tremuloides
  Predicted polypeptide sequence is orthologous to G2783
caaccccaccacagcaataccagcaacctccctacatgatgatgatgccgccgccaccgatggctcaaacccaacctccaccaccacacatgtgggctcagcatcaggcccatcaggcttctattccaccaccacagcaacaacagggacagggacagggacaacctccagctactgctgatgaggtcaggactctttggattggtgacttacagtactggatggatgagaactatattgctagctgttttgctcatactggagaggttgcttctgtgaaaatcattcgtaataagcaaacttctcaaatcgaaggttatggatttattgagatgaccagtcatggggctgcagaaaggatattgcagacttataatggtaccccaatgccaaatggcgagcagaactttaggctgaactgggcttcttttagtgggggtgataagcgtgatgattctccggacttcactatatttgtgggagacttggctgctgatgttacagatttcatgctccaagagacattcagggcccactttccctcagtgaagggtgcaaaggtggtgattgataggctcactggacgcacaaagggttatggatttgttcgttttggagatgaaagtgaacagctacgtgctatgaccgagatgaatggggcattttgttccacaaagcctatgcgagtagggcttgcttc

SEQ ID NO: 13285 - DNA, 572 bp, Populus tremula x Populus tremuloides
  Predicted polypeptide sequence is orthologous to G2790
ggtcctgtgctctccttacctgcaaaatctacctgaagcagagagattggagtaaaggagccaataaagaatctgagcagcagggggctgtgtcttgtcccagtggactgcaccgttcacctggcaagcagcaacggtgctgatttctggtcacctgctactactgaaaaaaaccatccaccattctcatcaagtaaacagtgaatctattgtaatagttaattctctgcctaattttgagagccaggtagctcaaggtgggaaagggtccaaaagatcaaacggacatggtagtaaaaataccaaaggactcgtgcatggtggagaagatccaagcgtcgggtgcaagggggttctctgcctattttttatgtaaaccaggtgagacttttgggaaggtactggaaggtggagaagggaagaaggaggatgcttctctccttgttttggggtggcagcctctttggcatagctagctttctaacatggatcgcacctgtaaatgttcccggcattactgatgtcagtgccatttttggtaagaagggttggttgcaagtctaattgtttct

SEQ ID NO: 13286 - DNA, 533 bp, Populus tremula x Populus tremuloides
  Predicted polypeptide sequence is orthologous to G2850
ttgggagaatatggcagacagacacagcatctgtgctgatggaggctatcggatacatcaagttccttcaaaaccaggtcgaggcatcaaattcggggggtgaagaatcaaagagggacctgagaagccgaggactctgcctggtgcccctatcttgcatgtcttacgtagcgcctgatggtgggggtggaggcatctggccaccacctaattttggtggagggacataaccatgtggattttaagcaattatgtttaacacttttgagcaaagattaattctgatttagcacatctttctccagtttgtttagtggagcaaatttggtcatcctgccaaaagtaaggatctggggcggaccaaatttgatccattaacaattcaggtaacaaattcatgtgtaatgtttaaggaactgttgctttttatgaaaaatccgagcaccttggcctcgttttattcaaccatgaatatcatacattaacacgaatcaacaccatatttgtgctgttgatcattaaaaaaaaaaaaa

SEQ ID NO: 13287 - DNA, 608 bp, Populus tremula x Populus tremuloides
  Predicted polypeptide sequence is orthologous to G2854
ggacttctctcgaaaaataaatccttagatctctccccaaccaccaccttatcctccatcagaataacacaatccctaactccaaacatgatgcaacaaccaggaatcgccggagcgggtgtcccgcaaccagatcaacaacaacaataccaacagcaatggatgatgcagcaacagcaacaatcgcaacccgtacctcctcctgctggatggactccgccgcctgttcctcctccgtcccagtatggttcggccgccggaagtgctgctgttggagacgagatcaagtcgttgtggatcggggatttgcagcagtggatggatgagaattatattctcagcatcttttctaacaccggagaggttgtccaagctaaggttattcgtaataagcaaacaggttacccagagggttatggttttattgaatttgttagtcatgctgcagcagagaggattttgcaaacatacaatggaacaccaatgccaaacagtgagcagactttccggctgaactgggctaccctcggtgccggcgagaggcgccaagatgatgggcctgattatacagttttcattggagatttggctgctgatgtcaatgatta

SEQ ID NO: 13288 - DNA, 597 bp, Populus tremula x Populus tremuloides
  Predicted polypeptide sequence is orthologous to G2854
gcaaaataaacgccatatgggcgtcaatgatgccggacagtcttgacatccccatcatgaccgtatcctatcgtcagagaacagctaacatcgcctaatgtgccaaacatgatgcaccagcccgggagtcgctcggagctgggggtcccacaaccagatcaacaacaacaataccaacaacaacagcagcaatggatgatgcagcaacagcaacaatcgcaacctgtgcctcctcctgctggctggaatccgccgcctgttcctcctccgacccagtacggtacagccgccggaagtggaggagatggagacgagattaagtcgctgtggatcggggatttgcagcagtggatggatgagaattatattcttagcatcttctctgccactggagagattgttcaagctaaggttattcgtaataagcaaacgggttatccagagggttatggttttattgagtttgtaagtccgtgctgcagcagagaaaattttgctgacatacaatggcacaccaatgccaaatagtgagcaggctttccggctgaactaacctaccctttgtgctggtgagaggcggcaagatgatgggccctg

SEQ ID NO: 13289 - DNA, 721 bp, Populus tremula x Populus tremuloides
  Predicted polypeptide sequence is orthologous to G2854
ttttttttttttttttttaataaataaaaaagtaaaccataatttaagtaattaaagagccacgagtgcgaaaaatccattaggcaaatagtgcaaactttgaggcaccataacattacaaaaccatgatcatatcagaatgcagtgatgtcccctccccatatggtgcccagaactgctaacactagaacaaatgtcaaaatgccaaactccaaacaccaagcacatccatgcaactagtgaactgcaacctaggattgctctgctaccgattaacatcagtcctcacacgtcgataccgcagtgtaagcagatcactgctgttgctgttggtaagctccgggttgctgttggtatgctcccggttgctgttggtaagctcccggttgctgttggtaagctcctggttgctggtagtttccatatccaggatatcctccataatacatgctagggtcttggggagcggcggcggcggcggcggcggcagcaacatatccatatgcatcatatccttgtggatatccataatatccaccaccgttccactggctttggtctggctgagcctgtttgttagaaggactacggccccatgagagtcgaatattttgaccagctatctgagttccgttcagcatcgatagtgcttgctccgcacaagtgcgattagcaaactgaacgaatccacaacgcttgccctgcaggtattttcacatgc

SEQ ID NO: 13290 - DNA, 784 bp, Populus tremula x Populus tremuloides
  Predicted polypeptide sequence is orthologous to G2869
ggccacagactgctcctcaagttgtgaggaatctatcattgctaggatactcccatcacctatacaagaatgcataataaatgctattcaaaaagcacactatgcaaataactgacgtgtggcttatagcaatgacaagtatacgcattggatagcctctgccgctctccaaatcccaaaaggaacattctcgagagaagttgttgccgtcgacatccctggtcatcaatggagcttccggtgtcgcacgtgaaaaaaagatgcccaccccaaaccactcctctcttcaagctggatgaagtctgcaaaaaccacgggtctcaaggaaggcgatgaactcatcttttctgtcgctcacaatgatggagctgagggtctgcaactcggaattgaagcacggaaaaaagtgaatgttctcggtgaagatatttggagcaatcctctttgaagaagaagaagaagctacgtactgatccaggcatgtaaaataggtgcatcttccatcttgattctagtatcagcttgtgtttctgagggtagtgttcttacgctggagtcttgttcctgctctctcttttctctcggcggggagggttttggccggccggggatctcaaaggagtttgatatcctagctgtacaagtacttaaagtcgtttctgcatatttcctcttctgtatggcactagctatgatcctgaatatgtctttggcaagatcttgtaatcatgggagtgaaagagtgaacgctccgaagctcaccatgcccatggttttggcctgt

SEQ ID NO: 13291 - DNA, 676 bp, Populus tremula x Populus tremuloides
  Predicted polypeptide sequence is orthologous to G2888
ttttttttttttttttttttttttttttgaaaacccattatcataatttccattaattaccaaaattaacgaacaaataatacttcacacatactgattgatattacaacacttcactaatccacttgagattataaccacaacactcacttggtataatgatcaatagatagaagaaaaaaattataagaaagagagagagaggtggacggggttaataatgaagaaacaaatacatagctagatatataggaggattaattatttcatctgttagaagtttttgcgagaccaatcccattattgtgctctacttcgccttctgttatagatgatgacatgtaactgaataccaaagagttttcatctgttgctgttcttgcatggaacttctgtttgcaagcatgacaagtgatttgtagaatagtggagttgatttgctttattgcatgttgtctaaagcttgtgctttgcctagttccgcttgagcttgttgtctgattctcttagcattggcgaattcttgctctgcagttcaatctgtctttcgcttgctgcttgcttcttagcataatctatcgcatggcatctcactgctccgtgcctgtcttaagcttgagcaccagttaggtttgactgtatgcttctcagaagctttgcacatgatcttgttggt

SEQ ID NO: 13292 - DNA, 619 bp, Populus tremula x Populus tremuloides
  Predicted polypeptide sequence is orthologous to G2898
ggaacagaaccctgaaaagaaacgaagaaaatggcaaagaaagcttcaaaatccaagaaatgtcactcttcttcttcttcttccttagcttcctcgacctcttctaaaagagtttctaaagagggaaaaatggtgttgaggataaggtccaatgagatcacaaagaggtctacacggcaacagagagtggttaggagtgagaacgagaggagaccaaagtcgaagaccaagaaaaataagaaattcgatgctaaaaagcccaagaaacctccaactgctttcttttacttcttagaggatttccgcaaggaattccaagagcagaacccagatgtcaagtcaatgcgtgaggttggcaaggcatgtggagaaaagtggaaaacaatgacctatgaggaaaaggttaaatattatgatatagccacagaaaagagagcggagtttgatagagtcatgtcagaatatatttaagagaaaggaaagccggtgaagatgaagaccctgagggatgcctctgagtttgatgagtagagttcaaggtgctgctgtttgaaaacccgttgtttcactaggaatacatgagggaagaaatgtatatctactttcaaaccactttctt

SEQ ID NO: 13293 - DNA, 744 bp, Populus tremula x Populus tremuloides
  Predicted polypeptide sequence is orthologous to G2933
tggtccaaacttaaaggcaattttgagagctttaaagtaaattgacaaatccgagtagagagcacacttgatgaggagtacacagaagcttaattcatattcaaattttttttatcgggaattcacctataaaatttaaatatatccaatcagttatgactattttaaatcccattaaaacagcttattaaaccatttctttttgtaagtctcatccagaaaatcctacgctaatttttccgcatcaaattagaatatggagcacctgaatttatagagacgatgattccctctttacagataaagacacaagcttcgccctcatggcctcactatccaatgtgtaagttccttccatgacctgaagatgtaaattatagaagaccctgtccccaaatgactcaaaggaagaagagttttttagaacaagtccatcttcctctaaggtgagcaagatttctgataatggacttttatggttcttgtaagtggaaatatgaacgacaacttctctatcactaagctggcttgccgataccgatgataaagagctatatacggtgtcatttctttgattttcttgatgaattataccacctttctttgataactatgataaaagctcctcctttctttgaaccagtctctccacttgctgttgaagctctggtaggtacttaagcgcacgtgaaacagtggccggcacgcttaatttcttcatttgatctgctgctgggagaagtg

SEQ ID NO: 13294 - DNA, 1640 bp, Populus tremula x Populus tremuloides
  Predicted polypeptide sequence is orthologous to G2981, G2982
caaatccaaacaacacgcgtctctcttctgttgctttatcatcaacctaacccaaaccgccactcctcttctcttgtataactgaccgttcccgtcactctcccttttccttttcgtttattaattcggtataatttcccatcttttatatcttaatggtcgctggtggggcccacctggaagatggagacaggcacccttcgtcggcctccagaagaggaggaggaggaggagccaccacgggctcctgggtgtctggccaatcggtgtcaactagcggcagcgtggggtctccatccagcaggagcgagcatgccatggccactcccgctagtgacagcactttcttaaggttgaaccatctcgacattcacgccgatgatgccgccactcaagatgccgccgctaataagaagaaaaagagaggtcaacgggctgttggagctgataagagtggtagaggacttcgtcaatttagcatcaaagtttgtgaaaaggtggaatccaaaggaacaactacttacaacgaggtagcagatgaacttgtcgcagagtttgctgacccaagcaatagtgtttccaccccagatcagcaacaatatgacgagaaaaacatacggcggagggtatatgatgctctgaatgtactcatggcattagatattatatctaaggataaaaaggaaatacagtggaaaggtcttccccgaacaagcctaagtgatattgaagaattgaaggttgagcgtcttggattgagaaatagattcgaaaagaaagctgcctatttgcaagaactggaggaacaatttgtaggtcttcagaacctgatacagcgaaatgaacaactgtacagctcaggaaatgctcctagtggtggtgtgtcgttgccttttattctggtgcagacacgccctcatgcaactgttgaagtggagatatcagaagatatgcagctggttcactttgattttaatagcactcccttcgagctccatgacgataattacgttctcaaggcaatgaaattttgtgagagacctcagagcgatggtatggcacccaatccacctgctgatggaggtgaaggttctagcatgtccagcatgtatcaaccacaaatccttgcttccccaagtacaaacaccccagttaggcatcctacttcgccgcctcttcctggaatcataaaagcacgtgttaagaatgagcattgagtcatgcacgatcatctgaaccatgggcaatcatgtcagctgtgtctgtatattgtgtaaagtagtttgctgtagatggtgcctccctataattatccccgttcacagtttgcccttgttaggaggaactgagatgacaagcagatcggcccttatgctttgagacttccatggaaacacttggttctatctggttctcagctttagatccattattcgcttctgtaactgtttaaccattttttttccagttattttttcccattgtagcaaaaattaagtttagattgtattaggctacataggattgtccagccttactcagaatgatagaatgaattaattcaattcttcaagaatttggtgttataaaaaaaaaaaaaaaaaaaaaaaaaaaaaaaaaaaaaaaaaaaaaaaaaaaaa

SEQ ID NO: 13295 - DNA, 684 bp, Populus tremula x Populus tremuloides
  Predicted polypeptide sequence is orthologous to G2983
agacaatgcctttcttctttctcgaaacaaagaaagaaactaaagaaagaaaagcacgtcaaggcagatcatcacaatgaaattaacaaagttgaatgggatttatttatttctttctttacaaccccttcatctgccttccgggtgcaatgggaaaagctcgagagttctatctcccttctctctacatgacctgctgtcctctaattccaagcactcaaaggcccagctcctacactttcttttgtacggactatcctcctctctctccacctttccctgtgcaaaaataagagtattaaatataaactaagcacaaaacattcaaagcttcgtttatcagcgtgaataaattaaaaattaagtctttatggttgctgagacataccctagtatccaaagatataatggtaacgggagatggggttctcggactatggcttaaaccaaggctgttcctcttctgtttttgcctctcgcgggctttgtgattttggaaccagtaaaaaacattcttcccttcaatcttgccgtatctgcttagttgtgcagggatatcttctatttgttgcccattaggagttctcattcctcccctaaacaacatctctagtatacctatctgctcttgcgtgggggtcacaacgtgtccctcccggatgcgtctccccctatatgcatccg

SEQ ID NO: 13296 - DNA, 568 bp, Populus tremula x Populus tremuloides
  Predicted polypeptide sequence is orthologous to G2997
ggtccccgggaaattcggcccttatggcccggggttccactccaaatggagatcaaggtactaaagaagctttcatctgtgaagcttgtggttgccatagaaactttcatagaaaacaggtgatcatgaggaatggtaccattcttcttgatactcatcattcacctcctcctccatatggagctccatatacctctgtcagcgacgatcctcctccatatggagctccatatacctctgtcagcgatgaagagtccctgtataatggaagcagctctgagaaaaaaatgaaggcaagaaaaaggcctaagagaggcacctcaatgcgcaacaagaaatgaggtgaggccattttctcacccaccacaataaattagacttctctggtcagcttcaaagctataggtcgtaatgttaccccacatagtggaaggtcataagtctctctgatgaagacttcactataatttcgttaaatattcatgcatttgccaaaagaggaggcagctccaccataaattacagtaaataatgaagagatgttgagcagcttgtaaaaaaaaaaaaa

SEQ ID NO: 13297 - DNA, 568 bp, Populus tremula x Populus tremuloides
  Predicted polypeptide sequence is orthologous to G3032
ggctgccccatttcttggtttcctcatccgatagtggtggtggttgaagcggcgacccctctgtgacagtggacgatgagggtggctgatgagattcggctcctgtagctttaggagctgataatgctgggactggtacttcatgttgctgtgcctgttgaggtgagcttgtcattttgaccgactagaactgaatggaaggtagatgtggcaagagcaaaaactatcggtgcgatattgaagaaagcagatttttttttgatggattgaagaaagtagatgaatcaaccttctagattgaaagcgtccttagcctgttagccagatgactattccgaggaggactatctaggtgaacaggtggcaatgccaaaaaactttttggcctactgaaattatcaggagaagaatcgaaaaggtttctagctagacaccattaataaatttaacagcctggctgtttttgtttatgatgtaatatctagagtgaataaaaattaggattttaaaattctaaggttatagctgagatttttgagaaatatagataaaactctagcgtaaaaaa

SEQ ID NO: 13298 - DNA, 770 bp, Populus tremula x Populus tremuloides
  Predicted polypeptide sequence is orthologous to G3060
ggctctctgggtttctctctcattcctatcctcttctactttttctctatatttctctttccttcgtagctttccgagcgagttggattagtggtagtttagttagtgaattgctggatctgaaaattacttaagagaatggaatttagcggcggtcaccggaagagaaccagaaacgacgctgcttttaatggcaatggtggccacaaaaagaacagacaagaaatggagtccttttcaactggtataggaagcaaatcgaagccatgcacaaagtttttcagtacttctggatgtccatttggtgagggatgccatttcttgcatcatgttcccggtggcttcaaggctgtgtcccagatgcttaatgttggtggcagcccagctcttccaccagcatccagaaatcaaggtgtcccaaccctttcttatcaagatcgctcttctcctccatctgtgaagtcccgtttgtgcaataaatacaacacagttgaaggttgcaagtttggtgataaatgccactttgcccatggtgagtgggagcttgggaaggcttctgctgctccatcatatgaggatcctcgtgccatggggccaattccaggcaggatgagcaggcacatggagcatccacaccaaggtcatggtgctgcagccagctttgggtcctctgcaactactaagatcagtattgatgcatcacttgccggagccatcattggaaaaaatggtgttaactcgaagcatatttgtcgtgttactggagccaa

SEQ ID NO: 13299 - DNA, 815 bp, Populus tremula x Populus tremuloides
  Predicted polypeptide sequence is orthologous to G3060
atttttcatttatttccctttgaagtccctctctcccccgcccgctctctcctcctcctccacttcaaaccctaactttcctcttatccctccctctctctctttaggtttttttttcccctccactcttctcctctcaagtttctctcttcttcgtagctagttagctagcggaggaggagccgaagcagcagcagaggttactgagttttggatctgaaattacttataaagagaatggaattcggaggtggtcaccgcaagagaggcagagtcgacgctgcttttaatggcaatggcggccacaaaaagaccagacaagtacttctggttgcccatttggcgaggggtgccacttcttgcattatgttcctggtggctataaagctgtgtcccaaatgcttccagctcttccaccagcctctagaaatcaaggtgccccacccccttcttttccagatcgctcttctcctccatctgtgaagtcccgtttgtgcaataaatacaacacagttgagggttgcaagttcggtgataaatgccattttgcccatggtgagtgggagcttgggaaggcttctgctgcttcatatgatgatcctcgcgccatggggcaaatgcagggcagggccgctgctccatatgatgatcctcgtgccatggggccaatgcagggcaggatgagtcggcacatggagcatccacaccaaggtcatggtgctgcagcaagctttgggtcatccgctactactaagatcatatttgatgcttcacttgctggagccatcattggggaaaaatggtgttaactctaa

SEQ ID NO: 13300 - DNA, 656 bp, Populus tremula x Populus tremuloides
  Predicted polypeptide sequence is orthologous to G3074
gatgagatgatgataaaaatcagacggtattcccactgcatttatactatgattacacaactcagctactcctgacactgttgtccctgcaagcttcctcaacatacaaccaactcctgaatctgaagcatgaggaagtcgcctggatggtcccttgaagacattgaaaagatggatatcaatcccgtgtcaactggctaacttaaatacaagaatggatgaggaggaggaagattactatgaacaagactgcagttactagctagtgttttgttctgctggacatggcttctcacatcctataggttttacgtccttgcatgaaaatatgaatctgaaggtagacgattattgaagctcatcagtcctgactagggagcttacggttaagtggtagtcatcattacagactatgcagaaattggtaggattctgtgtcttcttcagcatatattttctacagcatttgctgagtgtagattactcattaactcccctaggcatttagatatcagtctcgttgaaccgttcttgtatttgaagatgcaacacgctaactattacttcttgatggcatagaaaggctcatacgataactggggaaaaaaaagaaaaagaaagcttcaaaatgctttaaatgctttggagaagaagtg

SEQ ID NO: 13301 - DNA, 771 bp, Populus tremula x Populus tremuloides
  Predicted polypeptide sequence is orthologous to G3083
gggagcaattgcagacctgggagttgcttgcattatcttgcacacactactaggtggctagccatcgagcacaatcatgtccaagctggcaagtagtgcttcataccttgtctccacctcgccaaacggttctccttcccgtgaaacgtttcgcaaattcttcgagtgctggcttggagagcaaaacaattatctcgaacaactcatctcaacctgtaaagattatgatcacaacagaaaaaactccccccagtcatctcaggcaaccctccagcctcttatcaaccgtgttcttgagcattatgaacattattatagatccaagtcaagatgggccaaagatgatgtgttatccatgctctctccttcatggaccagcactctcgagcatgcttttctttggatcggtgggtggcggccctctgtggcttttcacctgctctactcaaagtcaggtcatcagtttgaggctcaactccatgagttgatctgtgggttggggacaggtgacttgggtgacctttcagctagtcaactcacccgagttgatcggttacagaggaagactgtcagggaagagaacgagctgactgagaagcttgcaaagcaacaagaaactgtagcagactcgtctatggtggagttagcacatgaggtgactgagttgttgaggagcgagaacacgggtgatgaagtggaggaagagcgagttgagtcaactctggcacctaaaaaggatggattgcaggaaatcttgcagatggctgatga

SEQ ID NO: 13302 - DNA, 807 bp, Populus tremula x Populus tremuloides
  Predicted polypeptide sequence is orthologous to G3091
ttttttttttttttttgaatagtgcaaacaaataatttgattataactaaatatgataatcaccgtcgctagtactgagaaagggggagatttggacgaacttgcactaattacatttaagttgtaaacatgatccataagataaacaaagagtacaaatcgaagtggcatatccacagaggtcacttcttgcactttgactttgtacactgtatatgataagacttgtcgtgcaaagggggagaattgatgcttgcctacggttcaagaaattaaagtccctaaccctaaggctagctctctaaactttggttggcctctcttatagtagcagcagcagccacgcgaggtacatgaagagtcctccgaatccgatgccattgccacttgttgcttttttctcttctggaagttctttgatgtcccaacaatcttgcacccaagagagcagaagcggaaggaatcgaggaggctgcgctcgcagacctcacaggtgttggtaacaccttttccaggcctaggctgaggcctctcattcaaaaacacaactcttgcactgttgataacataagtttgaacaccagagatgtctagcaccttctgtatttcagatacccttatcacatcatgatatgaggacctccgtatctgaataacacggtggtccttgtggtaggcaagacagagagagccaagggccccattcataccatccataccaatacatattgcactcacttcttgggtgaatctgccttgcagcttgccttgaacaaagaacctcttttttaacaaaaggtttaaacg

SEQ ID NO: 13303 - DNA, 857 bp, Populus tremula x Populus tremuloides
  Predicted polypeptide sequence is orthologous to G3091
gacatacatacacacccaaaaactctctctctctctctctctctctctccccaacctgcctagtacaaaccaagaagaagtttcattattttcttcaatctctctaagaccaggttgatcattttctttttagtcattcaagctggcgatcgaaaaccaagaaaccgctattaagcccaagaacagaagaataatgggagctggaggacctgatgatgaggaccacaggtggccgccatggctaaaacctttgttgcgcgagagattctttgttcaatgtaagatgcacgctgattcacacaagagtgaatgcaacatgtattgtttggattgtatgaacggtgctctttgctctctctgccttgcctaccacaaggatcaccgtgctattcagataaggaggtcctcataccacgatgtgataagggtttctgaaatacagaaggtgctagacatcactggtgtccaaacttatgttatcaacagtgctagagttgtgtttttgaacgagaggccacagccaaggcctggaaaaggtgtaaccaacacctgtgaggtctgcgagcgcagcctcctcgattccttccgattctgctctcttgggtgcaagattgttggtacatcaaagaacttccagaagaggaagaaacaacaaatgtccatggcatcggattcggaggactcttatagcacagcagcagcagcagcagccatgggcggtccatgaagacgaagaagacaccatgacaacaagtgcagagctttttcccctttacaccaccttcaacacctgctagtcaccgggcagcaagacgagaaaagggaatcccccaccgagcccatgggagggctaataa

SEQ ID NO: 13304 - DNA, 548 bp, Populus tremula x Populus tremuloides
  Predicted polypeptide sequence is orthologous to G3091
ggaacatcaaagaattttaggaagaagaaaaggtacaaggagatggatggctcagacactgaagaatcaatgaaaggcaccggcaacggaggtgctagaagcaaagtacagagctttacaccctcaaccccacctccaagtgctatgaataatcataggactgccaagaggaggaagggggttccacacagatctcccatgggagtatatatgatagaatactagctagtgatgaggaagacgacagcaaatatatcaatatagtggtgaccgcactgaccggcgtccatcgaaaaagaatatattattgctatagcaaactaccttaagttattaccatcttatatattatgatcaagagcaccactgtctctttatgctacgaagttgctaacatctgagcctttgtaccctgaggccggtgttgggcactgatcaaatgttctatatatttatttagaacaaaagaaataagtgatatagggagatacagctgaaatgagcataagaagctggcgatggtaagatatatgggagcatgagtaggg

SEQ ID NO: 13305 - DNA, 608 bp, Populus tremula x Populus tremuloides
  Predicted polypeptide sequence is orthologous to G3095
atctttatcaataccagtagtgattacaaagtcatggtgagtccatttgggcaaatgggggaccacgacatgggtccaccatggttaatacccatgcttagagcaagctatttcattccctgtgcagttcatggtgaatccaataagagtgaatgtaatatgttctgcttggattgtatgggaactgctttctgttcttattgtcttatttatcacagagatcaccgtgttgttcagataaggcgatcttcataccataatgtggtgagagtaaatgagatacagaagtacatagacatatcatgcgtacagacttacatcatcaatagcgccaagattgtgttcctcaatgagcgcccccagccaaggcctggaaagggggtcaccaacacttgtgaaatttgttgtcgaagtctccttgattcattcagattctgttcacttggatgcaagctgggaggcatgaagcggggtgacccggaccttacatttgcgctaaaattgaagcaaaatagggacccgttctttggtgggtcggaatcagatgagtcctcaaccccaaagaagattcgcaggacacatgctttcaatcgtttgatggacgggct

SEQ ID NO: 13306 - DNA, 719 bp, Populus tremula x Populus tremuloides
  Predicted polypeptide sequence is orthologous to G3095
cttacggccgggcatcgaagctaatagtaataacaaagtcatggtgagttcatttgggcaaatggggaaccacgacatgggtccaccatggttgatacccatgcttagagcaagctatttcattccctgtggagttcacggcgaatccaataaaagcgaatgcaatatgttctgcttagattgtatgggaaatgctttctgttcgtattgtctgatttatcacaaagaccaccgtgttgttcagataaggcgatcttcataccataacgtggtgagagtaaatgagatacagaagtacatagacatatcatgcgtgcagacctacatcagcaatagcgccaagattgtgttcctcaacgagcgcccccagccaaggccgggaaagggagtcaccaacacttgtgaaatttgttgtcgaagtctccttgattctttcagattctgttcacttggatgcaagctgggagggatgaagcggggtgacccagaccttacatttgcggtaaaattgaagcacaatagggatcccttctttggtgggtctgaatcagatgagtcatcgacccctaagaagattcgcaggacacatgctttcaatcgtttgatggagggactctcaatctattcctctaataatgatggcgcggagagctccggtgatgatgcagctaccaacatttctccggctactccttccattttcaatcatcgaaatgcaa

SEQ ID NO: 13307 - DNA, 638 bp, Populus tremula x Populus tremuloides
  Predicted polypeptide sequence is orthologous to G3967
aggctctggaagcacttcgggaaaaggtattgctggattaccattggatgcttcagatttggccaatttcttaacaatgcacaggcatattggattcaattgcagtgcacaagtgctattgagatcagtgcttcccgagaagcaagagttatgtttctctgttgtttctctattgtggcaaaagttaatagcatcacccgaaactcaacctagtgcagaaagcacttctgctcaacaaggatggagacaggttgttgacgcactatgcaatgttgtatcagcatcaccaacaatagcagccacagcagttgttcttcaggcggagagggaattgcagccttggatcgccaaagatgatgattcaggtcagaagatgtggagaatcaaccagcggattgtcaagttgattgttgagctgatgagaaatcatgataccccagaatcgttggtaatattggctagtgcatcagatctacttctccgcgccacagatgggatgcttgttgatggagaagcttgcactttaccacagcttgaggtaacataccaaagaagatttcacttcactttggaatatgtgacctgctctttctactagaagcaacagccagagcagttcagccagtgctgcagtgggg

SEQ ID NO: 13308 - DNA, 621 bp, Populus tremula x Populus tremuloides
  Predicted polypeptide sequence is orthologous to G3967
atatttcagatcagatgtcatcaactggcaagctgatatagaaaagtgcctaacatgggaagcccatagccgacttgcgacaggaatgcctgttcatcatcttgattctgccgccaaggagttaggcagtactatttccatataacattgatgagctcttgccagccattgcaggttttatcattgctccttccgtgagtgagacttacagatataagtagagaccatggtaagttgattgaaagatctgatggccagagaattaactttcactttgttctaggtttaaaacctgaggtataacagtgtatagtgaatcaaatcaacacggccatattaattttatctagttcgaatagacacctattttcacgccaaagttctacatggatggattaggtttccttcaacagattggtgtacagcagaggggacaagtcagattggtgtacagcagaagggacaggtactatctgaatttccattgcatagattgataaggcatcgggttctatccttttttccagaagttgattgtctttgtacttcggtccactgttgatcttagttctgtctctggttgcaagaacaataactacttatccctatttctgcttggaa

SEQ ID NO: 13309 - DNA, 669 bp, Populus tremula x Populus tremuloides
  Predicted polypeptide sequence is orthologous to G3967
caagaacatcaaatctaggatgacgaagaaacaagggggagtaatcattcaacttctaaccatgcagagactgtaggcaagcctgcaaaactaaatggatctgttagttgtggacgcactatgcaatgttgtatcagcatcgccaacaaaagcagctacagcagttgttcttcaggtggcaccaccttcagagtagggcaatacaataaaaaatcagaactacctatcttgatagtacaaaacatactcacctggacaattgaaaggcggagagggaattgcaaccttggattgccaaagatgatgatttaggtcagaagatgtggagagtcaatcagcgcatcgtcaagttgattgttgagctgatgagaaatcatgataccccagaatctttggtaattttggctagttcatcagacctacttttacgtgccacagatgggatgcttgttgatggagaagcttgcactttaccacagcttgagctactggaagcaacagctagagcagttcagccagtgctggagtggggagagtctggacttgcagttgcagatggccattcgaacctcttaaagtgtcgtctaccagctgctatccaatgcctctctcatccaagcgctcatgtccgtgctctgagcacatctgttctccgtgatattcttcgaa

SEQ ID NO: 13310 - DNA, 481 bp, Lotus corniculatus
  misc_feature (164)..(164): n is a, c, g, or t
  Predicted polypeptide sequence is orthologous to G28, G22, G1006
aaaatcccaaaatttggtggaccagtggatggcatgtggctcaaaggagcaggaagtggcatacacacatctcagataattacaaatgggattgaacaaacacaacaatactactactagcaactctaaaaatttctcatagtgtatttacacgaccccacatngcatccttgtcagcattaactgaccaataactgctcgccaggtgtaacctgtgccacttgacttcccacttgccccgttttcaatcccacctgggcagtcaccaccaccttcttcctcttcgccggcgacccactctccgacgaagaagagcaactctccgacgaagaccgcttcgaagccactctaaccgggtcgggttcaccggagtttacccggagcggaaaatttagcatcgccctcgagcccctcatcctgtacgcagctcgatcgtaagccaacgcggcatcctcggcggtctcaaacgttccgagccaga

SEQ ID NO: 13311 - DNA, 572 bp, Lotus corniculatus
  Predicted polypeptide sequence is orthologous to G28, G22, G1006
ttttatccaagttcatgaacctgcactcctataaatatcactcttccctctttgtttttgaagtttcaaaattcatttcaacacctgctttcaaaaataaaaaaaaataaaaaaccttactcaactcttttctttctctccaaacacagcacaagacacgaaaacattacggccacaacatgcacggagaaagtacctacgattccgatttggccatcttagaatccattcgccgccacttgcttggagaatccgatatatgcatattcggagccccgatttctaattcgggtaacccgccggtttacgttcggagctccagtttcagcaaactgtacccgtgtctgactgacaattggggcgagcttccactcaaggaagacgattcagaggatatgatgctctacggcgtgcttcgcgacgccgtcaacgaggggtgggtcccatctctcgattcatcgggttttcttcccgtcaaatctgaaccggagcttttcccggcagtgcagagcccaccggagcgggttgttccggctccggtgattcctaaggaggaagtcatgccggcggct

SEQ ID NO: 13312 - DNA, 554 bp, Lotus corniculatus
  Predicted polypeptide sequence is orthologous to G28, G22, G1006
taacacatttacaacccaaaagaacaccaccactaccatcaccaatttcataatccagatcaagatatatatagctgctaccatgtcttgtgatttttcgtcattggaatccattcaaaactttctgcttcttgagcttgaacacgataattcccacgtagattggaatgcatccaacaatgaaacctgctattcaccctcttacaatcaatttccaatccccaatttccagtcaagtggatcatcacaggctgtcactaacttagatagtgttgttggtcccgtgaagaaatcaccagggtgcaaaaagggttcctctgcagcagcgcgtgaatccaacgcgccacctgtatggaagcgttacaggggcgtgagacgcagaccatgggggaagtttgcaggggagataagagatccaaagaagaacggtgctagggtttggctcggaacctatgagactgaagaggaagcagctctagcttatgataaagctgctttcaagatgcgtggtaaaggccaaactcaattttccccacctcattggttctgactcg

SEQ ID NO: 13313 - DNA, 428 bp, Lotus corniculatus
  Predicted polypeptide sequence is orthologous to G28, G1006
catttgttttctttaattcctaattaaggcttttgattgtgtctttcccttttgattgtgccactcccactagagtcaccatcccaatccatctctcaatttcttggtgcattatttttgtaacagcttccaatttccaaaatttgttggatggttgagtgttcatctctcagaataagataattacataagcaagttgcattccacgtcagccttcaattcaccaataactgttctccacgtgtgcactttgcaacttgactcctccacttgttctgtttttaatcccacttgagcagtcaccacaggcaccgttggccccaccaccttcttcctccgcttcgccgtcaaaccactctccgacgatgacgatgacgaacaagaagaagaagaagacaatgaccgcttcgacggcacacgaaccgggt

SEQ ID NO: 13314 - DNA, 455 bp, Lotus corniculatus
  Predicted polypeptide sequence is orthologous to G28, G22, G1006
tctctcacaaatatcccaaatcttcactattccactctcttattagacaaacacagaaatcaggagctccagtttcaaaaacaccgccacaacatgtacgaacagagtaattatgagtccgattgggcccttgtagactcccttcgccgccacttcctgtgtgagtccgaacaaagattcggagccccgacatcagttccgggtaacgcccgggtttactctcggagctccagtttcagcagcttgtatccgtgtctgagtgaagattggggcgagctccctctcaaggaagatgattccgaagacatggtgctctacggcgtgctacgcgacgccgttaacgtcgggtgggtcccgtccctccatgccgggtgcgggtcacctgaaagtttctcgtcgggtttggtgatcaagccggagccggacgtcatgccggtgagagagagcttcccggc

SEQ ID NO: 13315 - DNA, 554 bp, Lotus corniculatus
  Predicted polypeptide sequence is orthologous to G1073, G1067, G2156
gctttaatttgtctccttcatctctctcttgctttgcttcttcttcttcttctcttcagctctctttctactcccttttctttatctgcactctccttctgtctgtttatcaattccttttccatcaacacaacttttttttatattcactccactcaccacttctcttaaaataaaccataaacacaaaagcaagggttttttaaaacatagtttgctctactattttttactaatatcaatattttttttcctttttttatgaataaaaattgtatatctctctcttcgtttgatatgtccatggctggtttggatttaggcacaccatcatcatcacacttccttcaaaacctccacagagaagatcacttcaaccttcagcagcagcaacagcaacaaccacaggaatcggaggaagaacccaaccacaactccgacccgttttcagctgaagatggaccacgctccggcgacttggttggccgtcgaccacgcggccggccaccggggtcgaagaacaagcagaagccgccggttatcataactcggga

SEQ ID NO: 13316 - DNA, 449 bp, Lotus corniculatus
  Predicted polypeptide sequence is orthologous to G1945, G2155
attccaaagaaaacaatattcaacattcaacaacatgttctccaactccaagcttcaacagcaacaccttttccaacctaataactcaagggaatgccaacaaacatcagaagatgatgagagcaagagtagtggtggccccaccccatcgggcgcggcgcaaaaccccgcatccggtgatggggccaccattgagattgtcaggcggcccaggggccgcccacccgggtcaaaaaacaggcccaaaccgcctctgattataacgcgggagcccgagcccgccctgagtccccacattcttgaaatccctgctggaagcgacgtcgttgaagccatatcccggttcacccgacgcaagaacaccggtttaatcgttctgaccggttctggcaccgtcgcgaacgtcacgctccgccagcccggggcaattccctccgccgctgtcacgt

SEQ ID NO: 13317 - DNA, 496 bp, Lotus corniculatus
  Predicted polypeptide sequence is orthologous to G2
atataaatatttatatattatatgaaagattatttaacttgaatgtgattactggcgggggcagaaaaaattgtacattaggatggtctcttgagtgtgtggaacccatttttctgcagccaaccttgagaagaagagggtcttataatctgcggtgggaatcctgatgatgctgcagcagttgctaaataatgtggaggtccggattgccactgttgtaaatgttgatgatcgctcgatgataaggatagatcacttccaactcgacctccatagctgctgctgggaaaatgaaaatttggagggtgaatatgtgcaaaattgtggaacattggagactctccagaagatctgtaggggacatatctttgcatttcattagaggctgaggaatggaggtgagtttgactcagcatcctcagtgcttcactctccccatgcacttccttgttgcttctatgcaaaggcttcggtagtatactcatgagcttgggct

SEQ ID NO: 13318 - DNA, 595 bp, Lotus corniculatus
  Predicted polypeptide sequence is orthologous to G4
ccccccttacttcccaaccacaagatctgacaagtatgacagctatgtgtggaggagcaatcatctccgacttcatcccggcggcggcggcgggttcccgccgtgtcaccgccgacatcctctggccgaatttgaagaaacccaattctaggtcgatgttgctcgacgatgacttcgaggctgggtttagggagttcaaggctgactctgattacgaagaggaggaggaagatgatgatgtcgctcaggatttgcttgctggtgctaagggatttgcgtttactgctactgctgccgctaagaccaagcgtcccaattccttctctaagggatcaactgctgcaaagtctgtggaatcaaatgagcaagctgagaagtatgctagcagaaagaggaagaatcaggatagggggatccgccagcgtccatggggaaaatgggcagctgagatccgtgaccctagaaagggggttcgtgttgggcttggaactttcaagactgctgaagaagctgcaagagcttatgatgctgaagctaggaggatacgcggcaataaaggcaatgtgactttccctgttgagcctcaattgtcttc

SEQ ID NO: 13319 - DNA, 574 bp, Lotus corniculatus
  Predicted polypeptide sequence is orthologous to G5, G974
gtacgggcccccctcgagtttttttttttttttttacatcataataaagttccattaatactcaacatcttctccttggccaagcaagaaaaaaaccagctgtggcctaaggtagagagggattatacaaagtattaacataaactatgcaagaaatataaaaacctagctaaggtacatcaattataatccaaatcctaaatagtagccctgcaattgtcaaaaactccattgcagtaaccacaaaccttagacactaaaagctacaaataagacacacatgtgatgatatttgacactatcaaaacacagctagcttcacagagaatcccaatcaatctcatatgatgggtacttgaacagatttaaattatctgaatcaccttcccactgtggctcatagacatcaccaaaggttagatctgagagaggagaagagccttctgatgaaggctcactctcactgatcacaacagattcaaccttgcaagtgctctctgaacccttcacatcaccaccaccaacaacaactgaattttcctccttgtgagtcatcggagcctccggcggagca

SEQ ID NO: 13320 - DNA, 542 bp, Lotus corniculatus
  Predicted polypeptide sequence is orthologous to G5, G974
cggaatgaattacatcaataacaataataatatacttcaaagaacacctaaaccggagtcattctccaggtcaagcaagaaaaaaaccagctgaccaaggtagacagagatttacatcatatattgacataataataataatcaataataaaaagaaaaataaccctaaaccataaacccaattacccaaataaatcctacatgcagcactgcaattttcaaaaactcaattgcagcagccacaagataagaagagacactagctaccacctacattaacactagtcacataacaagactctaccaaattcaacttcaacttcaacttcacagagaatcccaatcaatctcataagatggaaacttctgcagattaagatattctgaagtagtagcatcccactgaggctcactgaaatcaccaaatgtaagatcagacaaaggagaagaatcatcagagttttcactctcagtcaccactggagacaaagaagcttccaccttgttctcaacctctgcctgagcctgtttcttcaaacctt

SEQ ID NO: 13321 - DNA, 549 bp, Lotus corniculatus
  Predicted polypeptide sequence is orthologous to G19
tacaatcactaaatccaagaaagttggaatattaattaagctcataaggagacaaaacactccacttcctagtaaaccgggtgacggttagtcatgacgacgtcgtcaagcatccacaggtccatgaaatcgctctcccactcagcatcaccaccaggcagaggctcagcctgggcctggatctgggcttgggcctggactggctcattgtcgaggcccaaaaaccactcaatgtcagagatttgcagcttcaggttaggctgatcctcgagcccggtggtgatgatgggtgcggagctgtcagaggacccggtggtggtggtggtgggcccggagctgccggaggagctgtactccggctgctcagggctgaggcagcgttgcttcttggtaggaggcggagccgccacggtgtcagggaaattgagcttggccttgtcaccgcggatgcgcttggcggcttcgtcataggctctggcagcttcttcggcggtggggaaagtgccgagccagacacggacacccttttgtgggtcccttatctcagcg

SEQ ID NO: 13322 - DNA, 518 bp, Lotus corniculatus
  Predicted polypeptide sequence is orthologous to G19
tctctctgtctctgagagtggggaggtgcaatcatctctgatttcatagatgaataccctaaccgtggcggagattaggcactggtgacctctgctatgaccttgatactctctccgacgtcttcacttcttcttccactcaccaaccaccctctttccactttgatgatgtaattccaattccaaacaagcagggggtggcatcatcatgtgaggagaagaagagagtgatgattgaagttgaagaaaaaggaagcgatgagaagagtggagagagtgaggagggtattaggaagggtaaacgggttcggaagaatttgtacagaggaatcagacaaaggccatggggaaagtgggctgctgagatcagagacccacgtaagggtgtgcgtgttgggctcggaaccttcaacaccgccgaagaagctgctcaagcttacgacgatgctgccaagcgcatccgcggagacaaggccaagctcaactttcccgacaagcccgagcccagtgagccggtg

SEQ ID NO: 13323 - DNA, 558 bp, Lotus corniculatus
  Predicted polypeptide sequence is orthologous to G19
cacactcacacaaacacaaacacaaacacaaacaaaaactctcccacagaaatcttcacaaacttttcatcatacttgtctaaacctattcctactaaacctttgatttccttctcttccctcaatcacccaccacctacaacctgagttaagtaaccaacaaccaccatgtgtggcggtgctatcatcgctgacttcatcccccgccgtggaggccgccgcctcaccgcctccgagctctggccaaactcattcggcaagcaaaatgactcacaaatcgaaaaacctcccattgctcatcaacaacaacaacaacaaccatccaccttcaaaagatctcaacctcacatagctgagaaaccaatgaaaagacagaggaaaaacctctacagaggaatccggcaacgtccatggggaaaatgggctgcagaaattcgtgatccgagaaaaggggttcgtgtttggctcggcacattcaacaccgctgaagaagctgctagagcctacgatcgagaagctcggaaaatccgtggcaagaaagctaaggtgaatttcccc

SEQ ID NO: 13324 - DNA, 380 bp, Lotus corniculatus
  Predicted polypeptide sequence is orthologous to G19
cagctcacttttattttctttgttcttccccccattgctctcattatcatcatagcagcgacaagtactattaattttctctctttctctcgacatgtgtggaggtgctatcatctcagacttcattgctgtcaagcgtggccgcaaccttgccccacaggagatatggtctgagcttgatcctttctctgattttgctgcctttgatgctgcttctgctggtgctgctgtttccaccaccccaacttccaaatcctcctcaccacccctcaactttgatgatgtgattcaagtccctgaccaaaaagtggcaggatgtgacaagaaaggtgagaagaagaaaagcgtggtgggttctggtggtgcagggaagaagaacg

SEQ ID NO: 13325 - DNA, 540 bp, Lotus corniculatus
  Predicted polypeptide sequence is orthologous to G25
gggcccccctctagttttcttcttttttgtggttggaattcgaaatagttaacttcatcctgcaaaattaaaattacaattcaacatagcaccaaaaaggaaattgcaattcaaagaaactagatgatgatcctaagttctaaaagcaaataaacaagagagtcgaagctcatagcaacaattataaccaagtaccctatttacaattcaatccataaggtagaaaaggcagtgaagaaaatgctcagaagcaagtcagggtcagggtgaggatgaagagaagatccttgaaaattctcactcatcgaagctccaaagatcccctacctcactttcctgaacactattattctctgccagcgactgtccatcatagtacggaatctggtagaagttgtcatgtaattctcgcgcgccatcagctcatccgacagctcctgcacttcgttcttcgccgccgcttcagcttcttcaaccagctctgggttcggctctgtttctttctccttttccttctccttcaaaccaccgccaaagtaa

SEQ ID NO: 13326 - DNA, 464 bp, Lotus corniculatus
  Predicted polypeptide sequence is orthologous to G38
cagcccaattccttcgctgagggaatcagaaaatttcgccctccgctcagtgcaacttgccttgcatgcacatgttagagaaagccgaaaataaaggggatggatctaagtccctgcctaagatactagccaaatggaaagagtataatgctcagcttgattcctccaatgatggggataagccggttcggaaagttcctgccaaggggtcgaagaaggggtgcatgaaaggcaaaggagggcctgaaaactcgcgatgtaactacagaggtgttaggcaaaggacgtgggggaagtgggttgctgagattcgagagccgaacagagggaaaaggctctggctaggtacttttgccactgccattggagctgctcttgcatatgatgaagcggccagggcaatgtatggttcttctgcccgcctcaactttcctaatgttgctgtttccaatttctctgaggaa

SEQ ID NO: 13327 - DNA, 479 bp, Lotus corniculatus
  Predicted polypeptide sequence is orthologous to G43, G46, G1419
gacattgtcaacttttattttacaattaattaacaggatcctcatgaagagcaaagagtcaaagatagagaaaaataaacaaatactaatttaatttgataaacaaaattacaatttgcaatttcacacaaccattagctgcggaaatcccaaagctgggtggggagataacggcgacaaaggcgccaccgtgaaattgtcccagaacccagtccagctagacggcgttaacgacgtttcctttatcctattaatatccgattccaccgtgaataaacccttcacatcaccggagctagacggtggcgttaacagagtatcccttatacggttaataatctccgattccaccgtcttttgcctcttcaccgcttcctccgcctcctcctcacgactgtgcttccggtcaacgacaccggcttcaagcgggaagttgagaaccgccttcgagccgcgaaaggtaaacgcggctcggtcgt

SEQ ID NO: 13328 - DNA, 585 bp, Lotus corniculatus
  Predicted polypeptide sequence is orthologous to G43, G46, G1419
tgggtacgggcccccctcgagagagaactagtctcgagttttttttttttttttttcttgcaaaaacgtagtgaatgaattaaataaacttgtgaaatgtacatacatgatgatgctcatctcttaatcaaggatgcaacaaaagtcaaaccaaaaaaacatagtcctagatgagtaatttcacaccatcattaactgtgaatgaaaagccggaaggggagataacggcgacaacggcggcaccgtgaaaatccccttcacatcactgtcccataccccggtccaaatagacggcgtcaacggcgtctccttaacttccgattccgtggttttctcccttttcaccaccgccttaacttccaccacctcctcttcacggcggcgtttcctgtcactctctccgtcgccggaggcagcggcggcggcgacatcaagaggaaagttcagtatggctttcgacccgcgaagcttgaacgcagcccggtcataagccttagcagcttcgatggcggtgtcgaaagtcccgagccacaccctcgaaccacgcttgttcgggtcgcgaatctcagcggcgaacttccccca

SEQ ID NO: 13329 - DNA, 341 bp, Lotus corniculatus
  Predicted polypeptide sequence is orthologous to G43
ctcttctaaacaatttcaatcttcttcttctaaacaatctcaatttcaatcttctcatcatcatctttctcaaatggccaaccctgatgaagtctgtgccctttaccgcatcaaactgcacctcctcggcgaactctctcccatcccgatccgcaccacccacacccacacccacacccacgacgacgacttcgccttccagttcgatctaccaaaccctaactcatcccaatctcaatctcaatctcaatctttcacttccgatccaatcttcgaattcgactgcaaacccataatatttgacatagaaaccgaatctcctaaacctatacccgtccaca

SEQ ID NO: 13330 - DNA, 549 bp, Lotus corniculatus
  misc_feature (46)..(46): n is a, c, g, or t
  Predicted polypeptide sequence is orthologous to G44
aacaactctcacttgtggcaatccttaaattatagacaatatactntgatccaataaatgaataaacaaatttccataatactttccccaaaaaaactaatgtagctagcttcacactatcctatatttacattaaacaaaccaatatatatatcttcacctggaaaaatatactattagttttcctattttggtagagacaaaccatccttctgccttatctacttccacttctgtaatagaggataagcactagtatcatctcaatgcatatttggaaataccataaagaattatggttggttaaaatcatggataagtaactttcaagagtccataatttcaaacaaccatgagtggagataagggtgacaaaggaggcacactgaagatagttcccttgacatcagtgtcccaaaaccctttccacaatgagggagttaaagggcaaactgttgctgcagaaacagaaaccccattattgggatcagagcactcttctttcttcacctgcttcttaacagtaacactctcctccacacacttgtc

SEQ ID NO: 13331 - DNA, 487 bp, Lotus corniculatus
  Predicted polypeptide sequence is orthologous to G46
aaaaaaactttcatatttgcattgcttcaacttttctgtacccttagggctcaaagcatacacaaaatacttttaaacaatatgcagacatagccagcaaccatgattttcagggtaaacacacaattcttcttttggcttggctctatgcctctatcttaatctctatttgcatctattattgacttccccttcaaatacaaaaaaaaaatttacccaaaaacatgtactaactactaagggtacatgtttggaaattcttatataattgattctaaagtcgaaatcaactctggaaataagtttccgcgagcgagcggtttatgaatttcaaaattgaatcgaggaaagagaagttgaccaaactgagaattctcatgacataacatgacttgaacttggaccaaactctttttgttctctcccccttttccttccactattgctagggtttgggctagccttcccagccttcaaagggaaattc

SEQ ID NO: 13332 - DNA, 499 bp, Lotus corniculatus
  Predicted polypeptide sequence is orthologous to G129
attttgcaattttcattcacttgtgaacaaacttgcaaaacaacatgtcaaggtgtctcgtgttttccataatcatagaacacagtactaaacatatcagggagcgtttcaatatagatacaggatagagtactcttatgaaacgtctacaaattaagcaactactcagtactgagggaacacttacatttaaattccctccacatagttctgcttaaattatatatatattaaccttagcattcatctgctgctataatactaaattgcaaactacaagtcttagtacttctcaaccgcaaacacattacactaattgaagggacatgtggtcttggcgtgcatactgactactgggttgtaatgagatctggtcttggcgcgaatactgagtatgtgtagtgggttgtaatccagtgacttggaagtagccgcgagagtcgaattgctgctgctgttgctgctgctgagattgcatagactcatagtttgaggtgct

SEQ ID NO: 13333 - DNA, 532 bp, Lotus corniculatus
  misc_feature (248)..(248): n is a, c, g, or t
  misc_feature (288)..(288): n is a, c, g, or t
  Predicted polypeptide sequence is orthologous to G129, G136, G140, G146
ggctaggatatgatagaaagtatattgaaaaacacataaaacatatggtatttggtacaaatgtttctttcactagtgcatagttggaagaattttactaaaggaaattctaaagacactcatttaaacttggggcatgtactggctctccagtatagacaccacttgaaactattcagatagattataagatggagaagatggtggcagaatttcatgaggctttccagtttatcatcatacaagtnggagagcagatgggtcttgacatgacgaatactaatgatnggggacattcacagggaagaaattccggtcatatgatggtgaaggtatagacacgcatggatttccctgtagcaaactctgttcttgtggctgtgctctctcatgttgagctatcttagctcgtaacaaattattatggtttggcagctcaatttcccgcttttgcatgaactcaatatctccaaacaaagtttcgtgctttctagatctaactctgcttaggcctttttccaatctactctca

SEQ ID NO: 13334 - DNA, 672 bp, Lotus corniculatus
  Predicted polypeptide sequence is orthologous to G129, G136, G140, G146
atggggagggggaagattgagatcaagaggattgagaacacaactaatcgccaggtgacattctgcaagagaagaaacgggcttctgaagaaagcttatgagctatcagtgctgtgtgatgctgaagttgccctcattgtcttctccagccgtggccgcctctatgaatattcaaacaacaacatcaggtcaactatagagaggtacaaaaaggcttgttcagatcattcaagtacgagcactaccacagaaattaatgctcagtactatcaacaagaatctgccaagctgcgacaacaaattcagatgctgcaaaattcaaacaggcacttaatgggtgatgccttaagcaccctgacggtgaaggagcttaagcaacttgagaacaggcttgaaaggggaatcactagaattagatccaagaaacatgagatgctactagctgaaattgaatacttccagaaaagggagattgaactggaaaatgaaaatctttgccttcggactaagataactgatgttgagaggattcagcaagtaaacatggtttctggacaagagctgaatgccattcaggcattagcttctcgtaactttttcaatccacccatgattgaagatggaacttcctaccctcagcagcctgataagaagatccttcatcttgggtaa

SEQ ID NO: 13335 - DNA, 687 bp, Lotus corniculatus
  Predicted polypeptide sequence is orthologous to G129, G136, G140, G146
ggaagaggaaagatggagatcaagcggatcgagaacaccacaaataggcaagtcaccttctgcaagcgccgcaacggtttgctgaagaaagcttatgagctatctgttctgtgtgatgctgaagttgctctcattgtctcctcaagccgtggccgcttgtatgagtatgccaacaacagtgttagaggaaccattgataggtacaagaaagcatgtgctgcttcatcaaacacagaatctgtttctgaagctaatacacagttttaccagcaagaagcatccaaattgagaagacagattcgagatattcagaatctaaataggcatatccttggtgaagctcttggcaatctgagtctcaaggaactgaagaacctcgagggtagattggagaaaggtttaagcagagttagatctagaaagcatgagacattgtttgctgatgtggagttcatgaaaaaacgggaaattgagctgcaaaaccataacaattatctgcgagctaagatagctgaacatgagagagctcagcaacagcaacagcaacagcagcagcagcaacagaatttgatgttgagcgagtcattaccttcacaatcttatgatcggaatctctttcctgcaaatctgcttggttctgataatcaatattcgcgtcaagaccagactgctctccaactagtctaa

SEQ ID NO: 13336 - DNA, 810 bp, Lotus corniculatus
  Predicted polypeptide sequence is orthologous to G129, G136, G140, G146
ggaagagggaaaatggagatcaagcggattgagaacacaaccaatcgccaagtaaccttctgcaaacgcagaaatgggttgcttaagaaggcatatgagttatctgtgctttgtgatgcagaagtggctctcatagtcttctcaaaccgtggccgcctctatgaatatgcaaataacagtgtcaaagcatctattgagaggtacaagaaagcatgttcagattcttctggaggtggatccacttctggggctaatgctcagttttaccagcaagaagctgccaaactgcgtgtccaaatcagtaacctgcagaatcacaacaggcaaatgctgggtgaggctttgagcaacatgaatgccagggatctcaaaaaccttgagacaaaattagaaaaaggaattagcagaattcgatccaagaagaacgagatgctatttgcagaaatcgagtatatgcagaaaagggagatagacttgcataatagcaatcagcttcttagagcaaagatagcagaaagtgatgagaggaagaaccataactttaacatgttgcctggaaccacaaactttgaatctctgcagcaatctcagcaaccctttgattctcgcggttccttccaagtgactggattacaacccaataacaatcagtgtgcaaggcaagaccagatctcacttcaatttgtttgatgtgtttgtgcttaagaaggcaaacacttgtgtaatttggcatctagtatatgaaagcagctgccttataaaggaaatataatcagagctatgtggaggggatttattaggtgttgccct

SEQ ID NO: 13337 - DNA, 744 bp, Lotus corniculatus
  Predicted polypeptide sequence is orthologous to G129, G136, G140, G146
ggaagagggaagatggagatcaagaggattgagaacaccaccaatcgccaagtcactttctgcaagcgcagaaatggccttcttaagaaagcttatgagctatctgtgctttgtgatgcagaggttgctttgattgtcttctctagccgcggtcgcctctatgaatatgctaataacagtgtcaaagcaacaattgataggtacaagaaagcatgttcagattcatctggggctggatctgcttctgaggctaatgcacagttttatcagcaagaggcagacaaactgcgtgtgcaaattagtaacctgcagaataacaacaggcaaatgatgagtgagtctttgggctctatgaatgccaaggaactcaaaaacctggagactaagttagaaaaaggaattagtaggattcgttccaaaaagaatgagctactatttgctgaaattgagtacatgcagaaaagggagatagacttgcacaataacaaccagcttcttcgggcaaagatagctgaaagtgagaggaaccaccctaacttgagcattttggctgggagcacctcaaactatgagtctatgcaatctcagcagcagcaacagcagcagcaattcgactctcgcggctacttccaagtcactggattacaacccactacacatactcagtattcgcgccaagaccagatctcattacaacccagtagtcagtatgcacgccaagaccacatgtcccttcaattagtg

SEQ ID NO: 13338 - DNA, 558 bp, Lotus corniculatus
  Predicted polypeptide sequence is orthologous to G131, G135, G155
aggaaaatgttattatactatatatagaggcctagatatagcccagcagcattgaaatgcagtgagacatgatacatacagatcggaatccaggtatagttatcactaatcaaatgccttaattttgattgactatatatgcttttgaatttatcaatatgaaaagttgtacaatgtaatatattaattagtcttctattgatcatttgtaggacgaagcatccaagggggaagattaatggtgttagctcgagttggagtaggagtaggagttggagttctttcatcacatctggcttctggggagcctccaatgttcatggactccaatggttgagttactaggccagaggcaacatttgcactattttgaagcccctcttgctcctcttgggtggtgatggccttctctttttcctttatcttcttggtcagcaagttgttttgttcctgaagtgccttatcctttttttgaagctctgaaatagattcaaacaaggcttggttctttcgtgatctaatgtgtttgagagcggaatcaagttgctgttccaaatt

SEQ ID NO: 13339 - DNA, 1122 bp, Lotus corniculatus
  Predicted polypeptide sequence is orthologous to G131, G135, G155
ccgggaagagaagaaggtaggtaggttcaataatagaaatagaaacaaaacaagaagtagaagaaattaggaaagaaagatgggaaggggtagggttgaactgaagaggatagagaacgtgatcaatcggcaggtgactttctccaaaaggagaggtgggttgcttaagaaagctcatgagatctctgtgctatgtgatgctgaggttgctttgattgtcttctcccacaaaggaaagctctttgagtatgctactgattcatgcatggagaagattctggaacgccatgaaaggtacaactatgcagagagacagctagcaggaaatgcagataattctgatgaacaggtaaattggactatagaatatactagactcaagtcaaagattgacctcttgcagagaaaccacaggcactatgttggagaggatttggatacaatgagtctcaaagagcttcaatgcctggagcagcagttagatactgctctcaagaacatccgtacacgcagaaatcaagtgatgtacgattctatttctgaccttcagaaaaaggagaaagtgattaaagagcagaacaacatgcttgcaaagaagatcaaggagaaagagaaagagaaagctgtagcacaggaggctcctcaattggagcagccaaattacagggttgatacatccttcttactgcaccaagaaccccttcccactttgaacatgggtggcaattaccatcagcaagaagcaccagaactggggaggaacgatcttgacctcactctggaaccattctattcttgccatcaccttgggtgcttctgaaatagctggatgatgttatagaattacaagcatacatgaagttatgaacaagtttatactgtcatgtttgaatgctttatacatgcatgtttctatgcctttgcctaatgtgaagacattaatattgaagtattttggttgtaagctaactcatcttgaatttgtaatcaaattatgatggacctttagattatctgtaatgggactatttttaagcaggagaccaggagtcttttcacttaatcaggatatggatattattaaaattagacttattatctaaaaaaaaaaaaaaaaaaaaa

SEQ ID NO: 13340 - DNA, 1261 bp, Lotus corniculatus
  Predicted polypeptide sequence is orthologous to G131, G135, G155
ttcccggggtggttcctcttccttctccatatacttgtccagaagaagaaagacccatatataaattaatattattattattctcttctatcagtcggtttggcttggcttggctataatagcaaggtttttgagcatattactggggtttgttcccttttaattacttgattgggtttttcttgggcaaaaaaagggtaagagtaatttgctaggtaagagaagctagctatcaaagtgtaatataaattaagaaaggaaaaaaagacagttataacatcatcatcatcatgggaaggggtagagttcagctgaagaggatagagaacaagatcaatcggcaggtaactttctccaaaaggagagctgggcttctcaagaaagctcatgagatctctgttctctgcgatgctgaggtcgctttgattgtcttctcccacaaaggaaagctctttgaatatgccaccgattcttgcatggagaagatactggagcgctatgaaaggtatgcctatgcagagagacagctagttgcaaatgattctgaatcacagggaaattggactattgagtatactagactcaaggcaaagattgaccttttgcagaggaaccacaggcactatatgggagaagatttgggttcaatgagtctcaaagaacttcagagtctggagcagcagttagatactgctctcaagcacattcgtacacgcagaaaccaactcatgtacgagtccatttcggagcttcagaaaaaggagaaagtgattcaggagcagaataacatgcttgcaaaaaagatcaaggagaaagaaaagattgcagcccagcagcagcacgcacaatgggatcatccaaaccatggagttaatgcacctttcttaatgcaacagccacttccaactttgaacatgggtggcaattaccgtgaagatcatgccccagatgttggcaggaatgagcttgacctgactctggaacctttgtattcctgccaccttggatgcttttgaaaactttactagctgcagccatctcatattataatatttagatctggcctctatgtcatgtggtaattttccctactttaatttgaagaccttattaattagtgtgttgtaagtttataacttgattataactaaggctaggtttccaatgtctaagctttgctatgtgcaattaagctgctcaaagacaagtcatataatgaaatttgagctatttagtaaaaaaaaaaaaaaaaaaaaaaaaa

SEQ ID NO: 13341 - DNA, 1120 bp, Lotus corniculatus
  Predicted polypeptide sequence is orthologous to G133
ggcacgagctcatccctttggctttactatttagctttcatgactagctagttagtttctctcctatctattaatattggtggtgtttggaaagttaaggaagatagtgaaaatccattgatctctcagagaaatcatgggtcgtgggaagattgagattaagttgattgagaacccaactaacaggcaagtcacctactccaagcgaagaaatggtatcttcaagaaagctcatgaactcagtgttctctgtgatgctaaggtttccctcatcatgttctccaaaaacaacaagatgcatgaatacatcagccctggccttacgacaaagaggattattgatcagtatcagaagactttgggggatatcgatctgtggcgttcccactatgagaaaatgcttgaaaacttgaagaaactgaaggagattaacaataagctcaggagacagatcaggcacaggttaggtgagggtttggatatggatgatctgagcttccagcagctgcgcaaacttgaagaggacatggtttcttccatagggaaaatacgcgaacgcaagttccatgtgatcaaaactaggactgatacctgtaggaagaaggttagaagcttggagcagatgaatggaaatctcctgcttgaacttaaggaaaagtgtgtgatccatccacaatttgttttgcacgatgaaggagacccggaatcagcagttgcactggccaacggtgcctccaacctgtatgcattctgtcaacaccatactcatgtgaatcttcctcctcaccatcaccatgtccatggagaagatgatctgcgccttgcttgactcattaaatttgcttcaattagacattttgtaaattaaccactattagcaagcagtacttattatttaagctttttgtactatcatcctatcctattgctggacctattaaacccaaagttggacttggttggtcccatcctctttatctaggtactgaattagctagcttatggggtttggcaattgtgtgctcagaaaaacagaatcatgagtgtattctagttgttattattatcataagtttatgttgaatgaatatgttatattaactttaaaaaaaaaaaaaaa

SEQ ID NO: 13342 - DNA, 864 bp, Lotus corniculatus
  Predicted polypeptide sequence is orthologous to G133
atggctagaggaaagatccagatcaagaggatagagaacaccactaaccgtcaggtaacatactcgaaacgacggaacgggcttttcaagaaggcaaacgagctcaccgttctgtgcgatgccaaagtttccattatcatgttctccagcactggcaagcttcacgagtatattagcccctccacctcaacaaagcagttcttcgatcagtatcagatgactgtaggagttgatctatggagctctcattatgagaatatgcaagagaacttgaagaaactgaaggaggtgaataggaatcttcgtaaggagattaggcagagggtgggggattgtctgaatgatctgagcatggatgaactcaggcttcttgagcaagaaatggacaacgccgccaaggctgttcgtgagcgtaagtataaggtgataacaaatcagattgacacccaaaggaagaagtttaataacgaaagagaggtgcacaatagactcctccgtgacctggatgcaagagcggaaaatccaccctatgaattgatggacaatggaggggagtacgaatctgtgattggattctcaaatttaggtccacgcatgtttgcattgagcttacaacctagtcatcctaatgttcataatagcggaggaggagcaggctctgaccttaccacttaccccttacttttctagtaagcaaagcaaacattcaagctctcttacaaataccacatcactttccaataaaattactatgtactacttcaaacaaatatgcagtttgtatgtatccatagacactaccagacgcacatgtgagttaaattgcaactggtgaactattatctgtaaaaaaaaaaaaaaaaa

SEQ ID NO: 13343 - DNA, 780 bp, Lotus corniculatus
  Predicted polypeptide sequence is orthologous to G134
atggggaggggtaagattgagatcaagaggattgagaactcaagcaacaggcaagtcacctactcaaagaggaagaatgggatccttaagaaggcaaaggaaatcagtgttctatgtgatgctcaagtttctcttatcatctttggttcctctggaaagatgcatgagtacatcagtccctccaccacgttgattgatgtcctggatagataccagagagcctcagggaagaccctttgggatgctgagcatgagaacctaagcaatgaaattgatagagtcaaaaaagagaatgatagcatgcaaattgagctcaggcacttgaagggtgatgacattacctcactgaattacaaagagctgatggctctagaggaagcccttgagaatggcctcaagggtatccgtgagaaaaagaatgaagtgcacaggatgatcaagagaaacggcaagattttggaggagcaaaataaggagcttaatttccttctgcaacagcatttggcactggaaggtgtgggaaacatgcatggacaatggatttgagtttgaccacatcataagggatttaattcgcatgtttcatgttcaagaatgcagcatgcgtgcttactactatctaagtaatttgctccaagtattaatcaagttatgaacttttggcatatctggtttcatagtacgtatttgttagagctcagtgtagactctcgattccaaatactagttatggtgaaatgatcatcgaatttggctaaaaaaaaaaaaaaaaaaaaaaaa

SEQ ID NO: 13344 - DNA, 885 bp, Lotus corniculatus
  Predicted polypeptide sequence is orthologous to G134
atggggagaggaaagattgagatcaaaagaattgagaactcaagcaacaggcaagttacctactcaaagagaaaaaatggaatcctgaagaaggcgaaggaaatcactgttttatgcgatgctcaagtttcccttatcatctttgctgcatctggaaagatgcatgactacatcagcccttcaaccacgttggttgacatgctggagaggtaccacaaaacttccgggaagaggctttgggatgcaaagcatgagaacttaaacggcgaaatagagagactcaagaaagagaatgacggcatgcaaattgagctcaggcacttgaaaggagatgatatcaattcactgaactacaaggagttgatggcattagaggctggcttggaaaatggccttgaaagtgtccgcgagaaacagatggaagtatacagagtgtgcaggagaaacgacaagatcttggaggaggagaacagggaacttaattttatcctgcaacaacgaatggcagttgaaggtgcgagagatgcagacaatgaatttgatcagagcgtaagggatttcaattcccagatgccatttgccttccgtgttcaaccaatgcagccaaatcttcaagaaaggatctaaattcgcttctacgtacgctctctggccacaacttttggatcataaactccattttggcattttcacaatcaggtgtcacaactcttgatcataaactatgttggtatttcaatataacaaagtggctgaacatggttttctgaggttgagatatatactagtatatgattgtgtttcctacccttaatcttaggtcataataggaccttttattgggtaaaaaaaaaaaaaaaaaaaaaaaaaaaaaaaaaaaaaaaa

SEQ ID NO: 13345 - DNA, 535 bp, Lotus corniculatus
  Predicted polypeptide sequence is orthologous to G137, G145
gataaaaaatactcaatgatattaatattataaatttcttaagagggtcataccaaggccaaaggtttagcagtttcaagtcagctgtttttataccaaataaaaaaaaaaaataacaatagaagcaaagtagcatttacacatggcaaccttaagcacatggcttggttctttggtagggtgtatgcttggatatagccagataaacaagcttggctcaaagcatccatccaggaataaacccattcactggttgagcttgagttgttgcagccatctgatctgaagccacaccatggtacctatagtcagaaccaatctgcaatgtggggttgcattccaatggctggaagaagccctgagagtgagcatttggtgaaccaccatactgcatgcttggatcaccagcttgatcccatgatagcctgtagtgatttcttgaattgatatcatccagcttcactgacaaggatctgtttgcttctaccaacatctgctccttattttgaagatcagacaactggtccagcatgaa

SEQ ID NO: 13346 - DNA, 806 bp, Lotus corniculatus
  Predicted polypeptide sequence is orthologous to G137, G145
ggtgagaaagagagagaagaaaagaagaagaagaagaagagagagatggggagaggaagagtggagctgaagagaattgagaacaagatcaacaggcaagtgaccttcgctaaacgcaggaacggactattgaagaaagcttatgaactttccgttctttgcgatgcggaggttgctctcatcatcttctccaatagaggaaaactgtacgagttttgcagcagttcaagcatgctgaaaacgctagaaaggtaccagaaatgtaactatggtgcgccggaagctaatgtgtctacacgggaagccttggagttaagcagccaacaggaatacttgaagctgaaagcacgttatgaagccctacaacgctcccagaggaaccttatgggggaagatctaggccctctaaacagcaaagagctggagtcacttgagaggcagctagattcatccttgaagcaaataagatctacaaggacccaattcatgctggatcagctctctgatcttcaacgtaaggaacacatgctaagcgaggctaacaggtctctcagacaaaggcagctggaagggtaccaactaaactcactgcaactgaatcccggtgttgaagacatgggatatggccgccatccagctcaaactcatggtgatgccttctatcattcaatagaatgtgagccgaccttacaaattggttaccagcctgatccagtgtcagtggtgacggcaggcccgagcatgaataataattacatggcaggatggctgccatagcggctggggaagctattgtgatgtttccg

SEQ ID NO: 13347 - DNA, 563 bp, Lotus corniculatus
  Predicted polypeptide sequence is orthologous to G142, G148
cccttttttttttcaaatacgatcaatatgttcaattaaatacagtaagaaaaagtagtatctatgtgtatccagttacaggaaacactatataatcaagtctgcagcttcccgtggtggtcacaaagatacattaattttatatgctgaaacacaaatctaattaaaaagcatatagacaatgaggcaattaataagtcatatatttaatttattaatgactaagtgatcaaatcaaagcatccatccgtgcatgaagtttgtctcacaagtcatgctgttctttggaatactagatgattcagcttgaacatattgatggtaccctatttgcagaaagggttctggttggcaatccattgggttggattgagcaggatgaaagggaaagttgctggttccagcagctgaagtagaggaccacaagttttccataactttgggattatatccctctgattcaagcttgagtttaagttgcttattgaggtctcctaaatgacgttcccttgtgcgaagctcttccatttgttcaatcatgatttctgtcttcctttgcctag

SEQ ID NO: 13348 - DNA, 558 bp, Lotus corniculatus
  Predicted polypeptide sequence is orthologous to G161
cgctacttctctcaagcaccaccccaaacctctgataccatgcagtacattgaggctcaacgcaactccaaggtgcatgagctcaacgtggagctctctcaaatcaacaacctattggacaccgtgaggaatcacggtgaggagctgaatcgcctacacaaggcggcacaagctcagttttggtgggcttgtcagattgaagagatggataggcctaagcttgagcaatttaggatggccttgaatgagcttaagaaacagatcagtcgctattgtgacaggactcgcattcatggtgctcccgctgctagtactgccactactaacccaccaactcatatgttttttgcttctggttcgtccaatgtcatgatccctccccaccacccacaatcacctcctcctcaggtgtttgcaccacagttttttgagggctccatgaagcagggccatcatttgtttggtggaatatttaacaacatgggagcatacgatggaccccctggcttctactaagatcatcatcccatgacgatatgatgaagatgatgccctttc

SEQ ID NO: 13349 - DNA, 538 bp, Lotus corniculatus
  misc_feature (381)..(381): n is a, c, g, or t
  Predicted polypeptide sequence is orthologous to G172
gggcgtgacaacaatgattaacaaattacagtaaaaagatatcactcttatggttcacattgggcaacatataataagtacaactttttcccttcttggttcacccccttacaaagaagtaaagctaaagaacctcttcatcttatgttgaagtaaggttcacaacttctagtctatcattctatgtacaacattgggagacaagaaaatgtgcttccccaagtctataagatccaccaaagtaacttgaaaaagactgggcaatcagcaatgtagaggcatgacatgatcaataaaccaatatagaacaaacaaaacaatctcctctttccattcaaataaaaaaccacgcctctactcgatctctcatgagttaaagtngttagttttcctttcaaaatggggggacaccatcaaaactcttgtgtcacatgtattttgccatctaggcatataatcactcaaccttttgggtatcctcttttacaaggttcttttctttggcgcggaaatcctccaagctacgatattcttctct

SEQ ID NO: 13350 - DNA, 635 bp, Lotus corniculatus
  Predicted polypeptide sequence is orthologous to G184, G186, G916
cacctccttcatctctcttaccacacaactctctctctttcttcttgcacttatctccttgtttatttaattttatggacaaaggatggggtctcactcttgattcatcttcctctcaatccctccctctctttccatccaaaccttctgcatctctcatcaacaccatgttccccattcacggattccctgtcaatcttacccgcaacaccaacgatgaacaacacaccgctgatgacagccggaaagttgtcggcgaagtcgatttcttctctgatagaaacaactcatcgcctcctcctggctatctcgaccatcatcaacatgctaaatctaatatatctgttaagaaggagattctccccgaagaaaaacctcccaacgttaatactggtttgcaactcctaattactgggaacactgggagcgatcaatcaactgtggatgatggtgtttcatcagatgttgaagataagagagccaagaccactgagcttgcacagttacaatcggagcttcaacgcatgaattcagagaataagaaactcaaagagatgctcacccatgtcagcggtaactacaccgctttgcagatgcatctcactgcattaatgcaaaagaaccaccgcacagaa

SEQ ID NO: 13351 - DNA, 526 bp, Lotus corniculatus
  Predicted polypeptide sequence is orthologous to G184, G186, G916
attcaaattgaaatgatataaagaaaaaaatgaaggcatttctgatatctattccctcccaagacatggactaaaaaattaacaacatttatggcttggccttacccatgtacaaaaaacaggaaaagaaggaataagtaatatataataattaacaaaaaagaaagagaaaggcctagtttcctgaaaaattgctcattgtactcttgttgttgttgttgttgttgttattgttgtgactgccattgttgtttgcatgagaaccaccgatgatggaggagatggcggcagcaagtactgcggtgaagttggggtcggcggtgatggctgcggtggcggcgctaacagtatcagctagtgaaggctgttgttgtggtggctgttgagaagccaattggtgtgaagaacccacttcctgctgggatgacaattgaagacctgagaatttggactgattataaagcggtgcagcttgtgcaaatgaggctggtccggacatgaaattctggggtatttggaacggtgc

SEQ ID NO: 13352 - DNA, 513 bp, Lotus corniculatus
  Predicted polypeptide sequence is orthologous to G189
agaacaaatcaacccacttgctttactttacttttttccccactttcagattcaaacccgttaccaaatccaccatcaccttgactttcttttctttccaaccaaaaaaaaaacaacaatttactagtactataatggtaatggattcttcacagtgtttgtttgtttgtttcagcctcgaagacaacgaaaaagataaaggaatccaatccaatattgtaacacaaaccaaacagcctttagctaaaatctaatgatcatcattcatcaacatcaattacctttgaaattgcttgtcacattgattaacatgaacttaagatgattctaaaatgagattagtagcatctgctgcagagagagcgtgattgtgctctccttcataggtcactaccagcatagcagcatcatccagggctcgttctacatgttttcttgctgggcaacctctcacactactgcacttgtaatatccccttggatgaggggatcctttaataggtttctgaccat

SEQ ID NO: 13353 - DNA, 509 bp, Lotus corniculatus
  misc_feature (507)..(507): n is a, c, g, or t
  Predicted polypeptide sequence is orthologous to G197, G255, G664
gaattcggcacgagctgatttgaaccttgagttaactattagtcctccacgccatcatgagcctgatgaaacaggggagagaaacatctgttttggatgcagtttgggtttgcagaacagtaaggattgcagctgtggaattggtagcactagcagtggggacaacatcaatgcttcttcttcttctgctgcttatgatttcttgggcttgaaacctggtgtttgggattacacaagcttggaaatgaaataaaaatgaggcaatttctcagaaatagctagtgtttggaagataagttaaagaattgagtcacttgattttgaaatcttttagcatgtactgaatgctcctcaccagaattgattctcgcttcagaatcggtggtagaagagtttctagatatgcattttctctccctctttctttcttttcttctctaatttgtatttgtataaataactagttgctgatgcatagcatataaatgtatagtaccagtatagcanaa

SEQ ID NO: 13354 - DNA, 549 bp, Lotus corniculatus
  Predicted polypeptide sequence is orthologous to G207, G227, G230, G242
acacccacacttccaaattaaacaccctaacctcacaccaacaacaacaacaacagaaaaaatcatacaagaaaatgtacaacacacctatagcgtgatggctatgacccgaaaggaaatggatcggatcaagggtccatggagcccagaggaagatgaagcgcttcagaaattggtggagaggcacggaccgagaaactggtccttgatcagtaaatcgattccgggccgatctgggaaatcgtgcaggctgcggtggtgcaaccagctctcaccgcaggttgagcaccgcgccttcactccggaggaggatgataccattatcagggcgcacgctcggttcgggaataagtgggccaccatcgctcgcttactttctggccggactgataacgccatcaagaaccactggaactcgacgcttaagcggaagtgctcgtctatcttcgctgcagacgatctcgccgccggtggtggtggtggtgatttctgtcctcagccgctcaagcgatccgctagcgccgggttaccgggaagtcctgcctggtc

SEQ ID NO: 13355 - DNA, 547 bp, Lotus corniculatus
  Predicted polypeptide sequence is orthologous to G207, G227, G230, G242
ctccattcaaatctctagtaacgaaaatggacacaaacaccaacaccaacaccagcatcaccaaaatggatcggatcaagggtccatggagtccggaggaggatgaagctttgcagaggctggtggagaagcacggcccgaggaactggtcgctgatcagcaagtcgattccggggaggtctgggaaatcgtgcaggctgcggtggtgtaatcagttgtcgcctcaggtggagcaccgtgccttcacggcggaggaggatgacaccataatcagagcccatgcccgattcggtaacaagtgggccaccatcgccagactcctctccgggaggactgataacgcgattaagaatcactggaactctaccttgaagcggaagtgcgcttccttcatgatggatgaccacaacgcgccgccgcttaagaggtctgttagcgccggcgccgccacgccggtttccaccgggctctacatgaacccgccgtctccggggagtccctccggatctgatgtcagcgagtccagcgtacccggtgtgtaccccct

SEQ ID NO: 13356 - DNA, 481 bp, Lotus corniculatus
  Predicted polypeptide sequence is orthologous to G207, G227, G230, G242
attacattccttcattcttatcatatcaccgattgagctcactgaaattaatctgagtatggaagcaccgaacagaagctcctctactaccacttcttcatcagactcatgctcttcagattccaatcctaggagtaacaatcctaatagacctgagaggatcaaaggtccatggagcgctgaggaagacaggatcctgacccggctcgtggagcggcatggggcacgaaactggtccctcatcagccgctacattaaggggaggtcagggaaatcctgcaggctgcggtggtgtaaccagctgagccccaccgtggagcaccgtccattctcggtacaagaggatgaaaccatcatcgccgcccatgcacggtttgggaaccggtgggccgccattgcccggttgctgccgggtcggactgataatgccgtgaagaatcactggaactccacgctcaagcggagggtgcccggtggtggt

SEQ ID NO: 13357 - DNA, 502 bp, Lotus corniculatus
  Predicted polypeptide sequence is orthologous to G214
acctcaaatggacacaggagtaagataagattaataaattagtttcaacaaccaggaagagcacgtaaccttgggcagcacataaaagatcatatttacattcttttatttatgaacaataaatatatggatatattagcggtttgatattgaagaacacgtcataatcagcacatggtctacgcaacataggagaaaacaaacagcccaagaaccttgcatacttcgaacaagcttacattctgggaatcaatcttcatttggctgaaataaatgcaggaatatgtcccgtcgcgcgggatataagcagagagatgacatcatttcttaaccttgttctccaaatctgactcggtaagagggctatggtcctgagcaccagactctagttcgagttctctatcagttaccatcatttgctgatgaggcaaagatgtgcttggagcagccgactcagaactttctgactccatcggttcatgttcacctgttccagcagaac

SEQ ID NO: 13358 - DNA, 550 bp, Lotus corniculatus
  misc_feature (211)..(211): n is a, c, g, or t
  Predicted polypeptide sequence is orthologous to G214, G680
aatgcatcttatctaggtctatttagcggagtttttaacagcattaacatcagttcaaaatagtaaaagagcgtatgtagtaattaaatatggtacacacatcgacaggaaaagtttcttaagctgcaagattagaaataaacaatagagatacaccgttgtgggggattataaatgatatgcaaaaaccaaaggtttcctttatgtgatngcacgcatatatcaaacctcaagttgaagcctctctttccaaacgtattctcttacaacctttctcatcaccttggttgctggtcgtaccaacccggttttccttggcctccatggaacatcttttgtagggcttaaagcctgttcgacgagtattgagctttccttgttcaagcccaatggttacctgtccttcctcgttaatttcaaagaatggcaggtttttctgcattccttcataactagaactgcatttctggcggtcaacgtcgtctttatctttgtcatctgtgtttagcttgtcgtccatgatgttgtccaattgatgatccttattttt

SEQ ID NO: 13359 - DNA, 456 bp, Lotus corniculatus
  Predicted polypeptide sequence is orthologous to G254
gcggacgcgtgggcggaaaacaagtagaaacggttaacagtggtaacagaaacggagagttcttgatggtgtcactgaaccctaacccagctcaagggttttacttcttcgatccttccaatatgggccttcccggtgtcaactctctccctccgccgccgccacctccttctaccaccgccgctgcagccgaggatccgagtaagaagatccggaagccatatacgattaccaagtccagggagagctggaccgagcaggagcacgataagtttctagaagctcttcaattatttgatcgtgactggaaaaagattgaagcattcatcggttcgaaaacagttatccagatacgaagtcacgcgcagaagtattttctcaaagttcagaagaatggaacaagtgagcatgtacctcctcctcggcccaagagaaaagctgctcacccataccctc

SEQ ID NO: 13360 - DNA, 545 bp, Lotus corniculatus
  Predicted polypeptide sequence is orthologous to G256, G668, G932
gaaaaaatcaattcaaaacgaaagatctcatcgtaggaaatttacataagcaagcttttcctgcagcaaggtactcagtatatatctctaatagtgtgataattatgttgattaatagtgaaaaatatacacacctatactagcaccaatacatttgaaaacttgtctatgaaccttttccttgaacttatgaaagaaaaattgcaaaagttccaatctaaaaaatcttatcatcatcaccaaagcctaagattttctctggattaacactgcactcatcaagaagccacttctctagcaaagacaagggcatttctggaccaataacattaacatctggctttctttcaggtgacaaattagatggagaaaactgatcagaatttggagactccaaagactcaaaaccaaacaaggactcaaatgtttcagacaattcagcactagtactgctaattccttttgctccactagaagaagcagtgtcagtccctgcagcattcaagttgtaattgaaggagttttgtgtggcaactgagttagtc

SEQ ID NO: 13361 - DNA, 528 bp, Lotus corniculatus
  misc_feature (363)..(363): n is a, c, g, or t
  misc_feature (386)..(386): n is a, c, g, or t
  Predicted polypeptide sequence is orthologous to G264
cacaaaacttaaacataatttgcatgaaaaagtttcagccctttacaacacaactagttgtcgaggctcataactaagtatattaatcatgggaatttcacataccattagtataactagtacttcaagatagcttgctcaaagtgtgagctgatccatacccttaatgtttctagagattccatgaactgatctcccttcctcttgctcatcgtatgggttggctcgatagttggatatcgcctcttcattgtccgaacagcctggtctttctgtaaggaactgttcccaaaacacatcattcactctatctggagcagctgggctgacttggttgctacttggagttggagcagctaaatnggtaacctcattagctacatttnggtttgaggaaactccaatatcagattctttaccactggcataaaatcttgattcagcaattttgccaatttcttgacaatctatttggggtgatctggctgagtatgagtttctgttggctggtaacggacaagacgctag

SEQ ID NO: 13362 - DNA, 499 bp, Lotus corniculatus
  Predicted polypeptide sequence is orthologous to G268
aaaactatgtcacaaaagaataaatgaattttacaagcaagttaaaccagcactaactaactcttacgatctgatgtcaaggattaaataaacaaatgcttctagacaattatatagaagtgatatctccacatactttcaattctcaagtgtgtatgatgacccttttctggcagggaccaaaaacaagaatgtgagttttatatatcaaccgcgtagtaggtgcttatcacaaaccaagaccctgtaacttgcatgaggaccctcagatgtgtctcgcaccgtcgcttgccagcctatagccttggcaatctcaacaagctcatccattatggcaagagaatcacggatgtacgcacgcccaccaggtctcagtatccggtccatctcgagcataattgatgacacattgcatcttttcttctccacagaaagtaggttggcagcatgcagtaaatcataggttcttggataggtgtcaaatggttcacaccagtca

SEQ ID NO: 13363 - DNA, 532 bp, Lotus corniculatus
  Predicted polypeptide sequence is orthologous to G274
gatcatcaacgtaaatagcaaactctggtaaaatatgttgaatacttatacagtggaccaatggagaggatacaacttaaaattcagaaaaatagaactatttttttcatttggttcaaatcaaaacattaaaataacgaaaagaaactcctgagataaagccagtaagagggtgtttgctcttcattgtgacattataagataattaacttacgccaaaaaatgcgtagcagaaaacctcgagccagctctgttactttctccattaataaattaacgacatatgaaacattttatctgctcctgcaattgtcccctctctgtgccatagctgtgatgaccaattaagccaaaatgtccatgacaaaactatgtgaactctgggaatcgtatacagtacagtagtagtaagttactagcagcctaaggccaaagcctctatttcaacttgttttcagtgtctatagtgttgacgtggaattagtgacccaatactgcttcacagcaattagtaccttctcaggaacaagag

SEQ ID NO: 13364 - DNA, 564 bp, Lotus corniculatus
  Predicted polypeptide sequence is orthologous to G274
caatagctcagaatactttaggtgttgtctttgaaagaggtttgattggcatttatcatgactggtgtgaaggattttctacataccctaggacttatgatcttattcatgctaatgatttgtttagcttgtaccagggcacgtgcaacctggaagacatccttctagagatggatcgcatcctgaggccggaaggagtagtcatcatccgggatgaagttgatgtccttatcaaggtcaagaaaattattggggggatgagatgggataccaaaatggtagatcatgaggatggcccctttgtgcctcggaagatattggttgctgtgaagcagtattgggttggaagtggtaaaaacaccacctccaatgaggaataaaacaggttacaggtagaattgtcttgggtgtgaatctaatggctcaccctgcagtaacaacaatcaatgtttctaaaccgaaagcaaagaacaaatggaaaagggttatgaattaaatgaaaagaggaaagattgttgagcctagtaaaagcaaagattggttctgggagcttattctactatg

SEQ ID NO: 13365 - DNA, 577 bp, Lotus corniculatus
  misc_feature (63)..(63): n is a, c, g, or t
  misc_feature (543)..(543): n is a, c, g, or t
  misc_feature (549)..(549): n is a, c, g, or t
  Predicted polypeptide sequence is orthologous to G275, G837
tattcagatcaataatgtgttatccatgtcaaaatattcaactatataattactgtcaaattntggaggacatctcacaaaattccagaatctcaactattgattaccaaaggcctctacatttgcaagaacgtgtgatcaaatttccttacctatggtaacatgttacaccaaaagacaccaacctctaaatagagatcaaaattaccaatgaaaaataaaacaattacataaatacctaacttaatgatacatgaataatggttttaagtacaattgcacaagaattttgagcggcaaaaccccaaaaaccacctaactctgttgttggcatctcatccatgtttaacgagcatactcgagtgtctcgagttctttaggccgccacatggacttctggacacacaaaaaccccacattttctttagagtaagtcatacgaacctcccactgcatagacttcaccaagctctgaagctcattgattatctcaacgctgtcccggacaataagctttccctcgggccggagcatcctatcaanctccgncactacagcttcaaacttgcaccttttc

SEQ ID NO: 13366 - DNA, 525 bp, Lotus corniculatus
  misc_feature (422)..(422): n is a, c, g, or t
  misc_feature (501)..(501): n is a, c, g, or t
  Predicted polypeptide sequence is orthologous to G275, G837
aataatgataatcataacaataacagtgataaatagttacagatacaactaacaacatagagtagtacatatgacattcttcaagatacacatggaagtaaaagaatatagatgttacccatttcgccaaaacaagagggtgccatcctttagaaattgaaagagtgaagcaacataatcaggcaatggctgacataatggttacaacctctgttggacgccacaatgtcttctgaatgcaaagtaatccgtccccaagttttgaataggtgaactgaatatcccaatgtagagatttagtcatgctctctatctcaccaatagtttcaacattgtctcttatgatcaaatatccttgtggtctcagcatcctgtcaacttctgcaatcactgccactatgttgcacctttccttcagtttngagaacaaggaatcagcatggagaagatcataagatctaggataggtactgaaagattcacaccaatcatgataaatancgaacaagccacgctcatatatta

SEQ ID NO: 13367 - DNA, 463 bp, Lotus corniculatus
  misc_feature (158)..(158): n is a, c, g, or t
  Predicted polypeptide sequence is orthologous to G278, G1290
agaaaaatatagtaggtaaatctctactcagtaactgtatagctcttcaattagtgaaaagagaagtttaatgatattacaaaatttatacggaaatcatccccggccatagcgggagaaacatgtatccccaataaaagactccctactctcagatngctccaatatctatgcattatcgatctttagatgatacctctccttcctctgtagatttattgatgcttttaaacatgaactgtttttctaccatccaaaataagccatttgtcaagagagacactataatctggggctctcctttcattgcagcaacatgcaacacactatagccctgagtacagtatgtgattgacatctgtggctcaggttaagagaggtagcagtgaggtagctctaccttcaaccctctctactcaaggccttaactctgttgcattcatcttccacgccaaaagtacct

SEQ ID NO: 13368 - DNA, 474 bp, Lotus corniculatus
  misc_feature (437)..(437): n is a, c, g, or t
  misc_feature (456)..(456): n is a, c, g, or t
  Predicted polypeptide sequence is orthologous to G280
aatcagctcaagtcatgtcctcttagacaattaaggaaaaaagtaaaaaataaacaaagactctcattctcataaactaagctaccactacataattttacaaagcaaaaattacattgacacaaagaccaaattccctacattgtctaagaccaccacaatcacaaggcacactctatgattcaacgctgacttcagtcaattgaggcttcaccttaggaggcctccccctgggcctcccactagaaacagcagcgcccggagacgccgccgcagccgaccgggcaaccttcttgggccggcctctaggcctgccacttgcaattgacaccaccttgggctttggctcagcattaggatcctttggtggacgacccctgggccttggtggggccaccacagtgtctagaggcagagcagccttgggcttgggtggnctgccacgtcccctcttangtggggcatttgggtcag

SEQ ID NO: 13369 - DNA, 565 bp, Lotus corniculatus
  misc_feature (72)..(72): n is a, c, g, or t
  Predicted polypeptide sequence is orthologous to G291
actgcaacagtttcatcattaactaactatagagaacccgattcaaatgatgaaagacgcgcatgttccttntggaaataaaacaaggatgtacacgccaaaaaggaaaaaacgcaaaatctaaaatgagggcattaaaatgaagtgtatataaatgcaggtctggtagatgttagaatcagctttcaatcattggttcagggtcagaagttgtttctgtgcgagacttgtttgcttggtgaactgagttgaacagaatatccttgattacctgcgacattagaccatgcacttgctccacagttattttcgcactgtcacgagtaatcttagcaagtggagattcttcttctttctttctaggtgtgggtgctatcagtgacccaaagcgtgagtgcgccaactgattctctgcttgctctaacttttcagctaaatccgagatttgtccagcaacgtaatctccattacccaacagaggagaagatgacagtgtattcacccaatatttgttccacagcaaatccaacaggtgtgaatcaagggaggacttgaagtaagtgat

SEQ ID NO: 13370 - DNA, 508 bp, Lotus corniculatus
  Predicted polypeptide sequence is orthologous to G291
gttttttctttttttgtgtttgacttaaatagtttcatcacgagtaaaatataaaaaaggcacggcaagataataactgcaacagtttcatcattaactaactatagagaacccgattcaaatgatgaaagacgcgcatgttcctttgggaaataaaacaaggatgtacacgccaaaaaggaaaaaacgcaaaatctaaaatgagggcattaaaatgaagtgtatataaatgcgggtctggtagatgttagaatcagctttcagtcataggttcagggtcagaagttgtgtctgtgcgagacgtgtgtggcttggtgaactgagttgaacagaatatccttgagttacctgcgaaattagaccagtgcacttgctccatatttattttcgcacggtcacgaattaatcttagcaagtggagattcttcttctttctttctaggtgtgggtgctatcactgacccaaagcgtgagtgcgccaactgattctctgctaactctaactttt

SEQ ID NO: 13371 - DNA, 424 bp, Lotus corniculatus
  Predicted polypeptide sequence is orthologous to G291
ctcactctcactctctattgatcattcatattcttccaccttcgtactcctcagtctctggggaacagaaaaagaaagcaaaccgcaccagagagcttcagaagaatcatcaatggaggtttcatcatcgtcatcatctgcaatcgcacaacaaacatgggagctcgagaacaacataatcccgatggacactccttcagacgattccatcttctactacgacgaagctggccagaacgagttccagcgtgagaagccatgggcaaacgaccctcactacttcaagcgcgtcaagatctccgcactcgcgcttctcaagatggttgttcacgcgcgctccggcggcaccatcgaagtcatgggcctcatgcaaggaaaaaccgacgccgattcgatcatcgtcatggatgctttcgctttgccc

SEQ ID NO: 13372 - DNA, 551 bp, Lotus corniculatus
  Predicted polypeptide sequence is orthologous to G307, G308, G309
cagttctcaaccccacaacaattcacttttttttcttctagctttccttttctgataatgggtatgaattgaaattaaaattaaaaactaccaaaaaaaaaagctaggatgcgagttgagttgagttgagttgagttcagctgagttgaatcagtgagtcgccaccgaattagaagcgagttgccacgcagaggtggcaatcaatggcctagtgtgccaaccaagagtaagacacccattattctcctccactctgtaaccgtcgccgccggcgaaaagcgccaacaacatgctagcttgcttgaacgcgttggacccgaggtgaaccggagagagtccggccgagttgaaccgggttcgccactgagtcagtgtctcgtgccgttcgatccggtcggaaccctcgcacgccaccacgttgcagatttgcttccccaggtagatctccgtcatggccttgtcctgcgactcgacggcggaggagccttcgagcgagtcgaagagggctgagtagtagtggagcgactcagtgaaccggtctaggaaactag

SEQ ID NO: 13373 - DNA, 497 bp, Lotus corniculatus
  Predicted polypeptide sequence is orthologous to G307, G308, G309
cggcgaggctgttgcagacgaagccgcggaactcgaactggacgccgatggtttgagcaagctgagcgagcttccaacccacctgctgcaaggcgtcggagttgtccggctgcggtggtccgattccggtgaggcggaaagtgggtggtccgccggggcgcaatgcgagtgcctgcatgagcgccggccactgcatcccctgtttcaggccgaaatcgacgacgtggactcttccggcggtggcgaaagcctcaagaatggcctggttggcggtgaagtgtgcgaacttcaggtagggacaggactcgtagaagtgcatgtgaagcacgtcgtggagggaggaatcgacggtgtcagggaagattccatagattctccgagcaagagcttgtgcgaaataggaagcaaccttcctcatcgcgccggcttgcgacgcagcgaccacccctatgtgcttcacgagcgtgtccgcgagcttgtgattctccttctgaact

SEQ ID NO: 13374 - DNA, 568 bp, Lotus corniculatus
  Predicted polypeptide sequence is orthologous to G307, G308, G309
ggtcgggccccctttttttaaaaaaaacactagtaattcacagtacaattacaaattaaattacagttttttcttttttttttcacttcctttatttaccctcagcctcgctggctcgctcactcactcactcagtagctactgactcactcattcaacatcaatcaaaccatcgatcccattgggccattctcataataatcatcccaattaaaatctacatcggagagtcatttctttcttcttatcatctcctaactcagtagggcccaaaccgagtcaactcactacgactcactgggttgtggaagcttccacgcggaggtggcaatgagtggcctagtgtgccacccaagcatgaggcacccattgttctcctccaccctgtaaccgtcaccgccggcaaacaatgcgagcaacatgctcgcttgcttgaaggcgttcgacccgagatggaccgggttgaatccggccgagcccatcctggtcctccattggaccagggtctcgtgccgctcgacccggtccaccccttcgcacgccagcacgttgcatatctgctccccta

SEQ ID NO: 13375 - DNA, 586 bp, Lotus corniculatus
  Predicted polypeptide sequence is orthologous to G307, G308, G309
aagaaatccgcaggaaaattggtggcagagagagagagagaagaagaagatgaagagagagcacgagcaagtgagtgggaagagctggatgggaggcggcggtgtttgggaggaggaagacgagcttctcgcggtggtgggttacaaggtgaggtcatcagacatggcggaagttgctcagaagcttgagcaactagaagaagccatgtccgatgacaccatcgctcaccacctctcatcagataccatccacttcaaccccgccgacatcggcacatggcttgaaaccatgctctccaattccaatttcgaccccactctggcaaccaccaccacctccgattacgacgacctcaaagccattccgggaagagcaatctacgctcctgattccccttcctccagcaaacgcaccaaaacctcctcctcttcctccccctacgccgagtcgtcaactcgctccgtcgtggttgtggattcccaggagaacgggatccggctcgtgcactcactcatggcctgcgcggaggctgtcgaccggagcaacctcgccgtcgcggaggcgctggtgaagcagatcggacac

SEQ ID NO: 13376 - DNA, 484 bp, Lotus corniculatus
  Predicted polypeptide sequence is orthologous to G307, G308, G309
ctgtgaaaggtgaatgctcgtcaatgccgaccggcaaggccaagatgtgggaggaagaacacggcggcgccgccggagttgatgagcttctggcggctttaggttacaaggtgcgttcctctgacatggctgatgttgcccagaagatggaacagcttgagatggtgatgggtattgcacaggaagatggaatctcacaccttgcttctgataccgttcactacgaccctaccgatctgtattcatgggttcaaaccatactcaccgagctcaaccctcctccaaccaccaccaccaccttgcttgatccatcttctctcttggaaaatcaccaaatcaacgaccctttaaacccttcttcaattcttctcaacaacaacgcttcaagggtcttcaacgatgattctgaatacgatctcagagctatccccggcatcgccgcatacccaccaacccaagacaacagcaacgacgaaaccgaacc

SEQ ID NO: 13377 - DNA, 432 bp, Lotus corniculatus
  Predicted polypeptide sequence is orthologous to G312
tgaacttcatgcttcagttgtataatctcttggatgagactccaactgctgttgaaactgcacttcggttagctaagtctttgaagcctaggattgtgactcttggtgagtatgaagcgagtttgacacgagttggatttgtcagcaggttcaaggctgcactgaagcatttctctgctttgtttgagtctctggagcctaacttgccctctgactcgcctgagaggttccaggtggagagccttctgctcgggcggcggatcgcgggtgtgatcgggccggagttgccggggtgtgtgagggaaaggatggaggataaagagcagtggagggttctgatggaaagttgtggttttgaatcagtaagtcttagccattatgcaattagtcaagctaagatactcttgtggaattacagttacagttctctgt

SEQ ID NO: 13378 - DNA, 544 bp, Lotus corniculatus
  misc_feature (223)..(223): n is a, c, g, or t
  misc_feature (294)..(294): n is a, c, g, or t
  Predicted polypeptide sequence is orthologous to G324
actttatattaaaacatttattttctccacacgtctttttttggtacaaaagctaagaaaagaaaaaagcctaaggcctcaaagaagggatgccttgaacctcagtcattcaaatagagaaagtagttctccacacatgtctacctatctacaagttattagatgcgcataaaatacatgtatttcttagaacagctaataattccacactgggatgaagatngggagtgccaagggtcagtgatcaagtaatcaataacgcctgacaccagctgttgacagaagaactcgatngggtttctttcccttcttccccacatcatttgtctttggtgcattcaagctgttattagattctgctctagatataacattagagtatgatggtgtctccccatttctcgaacctgctgtaccagaagaatcagtgctcttatggttattatatggaccgctagtttcttctggtattggtaatgatggagaatcatgaccagcagcaaaaccaagcctagtaacgctcgagaacaatcttctctcccca

SEQ ID NO: 13379 - DNA, 518 bp, Lotus corniculatus
  misc_feature (33)..(33): n is a, c, g, or t
  Predicted polypeptide sequence is orthologous to G343
ggggtaactggtaacgattattgagcaacacantgggtaaataatgatattgatacacacctaatatagtagccatatataaaaaaaataaaaaacaaagagagagcaccgacaatggacacgtcagcacactttgaaatcttgcttgtgaagatagcactgatcttgctgctgctgctgctgctgctgcggctgttgttggtggcggatcagctccttctgacgacggagttccatgactttgcggtgagagttcgagtgctgagacagcacgaacgtggggctcgcggcgggtcggtattccggcacgagccgacccgacttgaacctcacaccgcacgcgttgcagagtgtcttcggccccagcggtcctgttcgccattgcggcgtcttctccgatgcgcagtggctgcacctccgtactcctccctcccccgccggtgacccttcaaccgccgccgccctcttcgatctcgactttccggtcaccgatgcaatcacatctgaggaattgcggt

SEQ ID NO: 13380 - DNA, 553 bp, Lotus corniculatus
  Predicted polypeptide sequence is orthologous to G343
atggggaaaagtttcttcgagtgcttctgagttgagaattaaatatggtgaaagataagctcatacagacatgctaaaaaggaaagtggatattagccatataaatgagcacatggactgtgatcattaccactaatcacatggactgtgatcattacaactaatcactccccttaatagtatctctgtttccaaatagtttgttgttcctaaattttgaagtttgatttacattaaagtatagtaaccaaacactactactgcttactaataggaatggaagaaagaggagccatcctcatctccatgactttcttgtgggaattggagtgcaaaaagctaacaaaagtgggactcttggctggcctatactctggatgcaacctaccagacttgtacctcactccacatgcattgcatagtgtctttggccccaatggccctgccctccactgtggggtcctctgagacaagcaatgggtgcacctccttggcattgggttttgaccattattgctaacctcaccatcttcaaattcctccttcacaataa

SEQ ID NO: 13381 - DNA, 520 bp, Lotus corniculatus
  Predicted polypeptide sequence is orthologous to G343
aagaagcaaacataacatcaaattaaagacatagtagaataagtagcaaatccattctcatccaacagggatagagaaggaaatgctcctactttagagtaattcctaattacaatccaaagttccgaatacatataggctttaaacatataattaatagagtatcaaggtccatctcaaggtaaaagttgccacagagagaaagaaaggacatgggaacaaagagagagtgatgatgggatgagattcacctatgtcctaaccagggtgggtgagcaagtgaagtacccaagggaaccaaaatatctcccagggttacatgcaagagttttgagttccacatccttggatgcttgatgcagacctcaagatgatgatgatgaaatgtactactacatatgctaagtggggaagtaaaacactatccctccttaagattagtagatggggcttaaactccttagtttagccacaatgaatttacaggtaaagaaaaacagcagttaattcttccctcccc

SEQ ID NO: 13382 - DNA, 593 bp, Lotus corniculatus
  Predicted polypeptide sequence is orthologous to G347
aacaagtcatgaaagaaattacatttcctcagtccaggacttgtaagtcaaaatacaacaagaatgaaccactcacacaaacatgttccatatgcccttttcataacttgtcctcctatccgtctaacccttatattggaaaatgattcacttcaatataaccgtttacaggcagcaatatcatatacatatacacaaaacaatatcttggtgtgacaagaacttttgataactgataattcgtcaaatactgttgttccttttatatatggctgcatcatttcttatctggtgggacgccaacaacaacattgctaaccaatttcccacttgaatcaacagacattggattttctaccaccactgtttgggtctgagattggggcattgacgttgaagtagaaggtaatgctccagagttggtcgtcccattaggtctatgcataggaacttgaagccttccattggacatattgacattagtaatatagtgacaaagagcacatttgactgagggagctccatatggatacatgagggttgtccggcaattcccacaagggacgtgggcaacttgattagctgctggagca

SEQ ID NO: 13383 - DNA, 553 bp, Lotus corniculatus
  Predicted polypeptide sequence is orthologous to G351, G545
gataaagcaaagttaattaaatagatagatgaataaatgaatgaattatatgataatgaatgactgtcaaaatacaatgtagaagaaatcctaaaaccagctaataagctccaagtccagctagctagctactgtatatgtacaagaacaaatcaaatcccaattcccaaacaattgaaaagctaattaagcactaattaactttgatctaaatgcattaattaattaataataatgagggatttcaatcttgggcaaaagacgtggcttcttcgaaggcaggggactggaaacctcttcttccacgaaaaatttgctggcggagaagtccggaaaagccggcaggttcagatcgaagttgcgctggtggctgtgtgtggatcccacaccttccgatgcggtggctgtggcggtgctactagcaccaccaccgccttcatagtggcaacgcttgtgtcctcccaaggcctgtcctgtagggaaggatttctggcagatggagcactggtggaccttgcctccaccgttggaggcagagctggtggtcacggcg

SEQ ID NO: 13384 - DNA, 457 bp, Lotus corniculatus
  Predicted polypeptide sequence is orthologous to G351, G545
tcactcaattttctcaaaccaccactctctctaatggccttagagagcttgaattcacccaccgcagccaccactcccttccggagtagctaccaacaagaggaggaggaggaggaggagcttcaccaccatgagccttggaccaaaaacaagcgctccaaacgacctcgtttcgacaacccaacaacaacagaagaagagtacctcgctctctgcctcatcgatgcttgcacagagtggcaacaacaacaacaaaaacaacaacacagacaataacacaaagcaccttgcgcgcagaatcatcatccaattcacagtcacaatcgccgccgcaacaacaaccgccgctgaaacttactcacaagtgcagcgtgtgtgacaaggcgttcccttcttaccaagcactcggcggccacaaagcaagccaccgcaaatcctcatcggaaaatcaaactcc

SEQ ID NO: 13385 - DNA, 550 bp, Lotus corniculatus
  Predicted polypeptide sequence is orthologous to G351, G545
gtttttgttaaacaatgaacaaatttgtctgtacagagaaagagtgaaactgaaaacaaacaaaatctgaacctaatcccaatgggccctgacccataacaacaaattcaatccaattaaattaaattaaaattaaaatccatcatctgaaactgaacaaagctacgccgtttcaccaccatcgaaaaacaaccgcggcctcgtggcggttaccggcagagggctctccacctcctgctcaccgcttcggatcttgttcgtcctgcaatctccgccgccgatccccagtggcgtccagaattccgtcagcggcgcggggaggttcagatcaaatccacggaggctgtgtgccgaggcggcgccgccgtcggaggtagtcgtgacggcgctgctggtatttgcgtggacgtggctgtgggtactgttgctgctcttgccgccttcgtagtggcaccgcttgtgaccgccgagtgcttggccggttgggaagctcttgtgacagattgaacactcgtgcatctttccgccgttaccggtggatgtcgacacg

SEQ ID NO: 13386 - DNA, 474 bp, Lotus corniculatus
  misc_feature (16)..(16): n is a, c, g, or t
  Predicted polypeptide sequence is orthologous to G351, G545
catgaaataaataaantgaattcccactttcaaaactacattaaacgcaaagtgaagtcagagagaagacttcaaaatactcctaagtcttacgtttctactatatttacaaattaaaaaaaaaaaacatcacaaaattttctcaataatcaaaaaggaaaaaaaattcctaaaatggggctttcaataatgaaggctatgtttgattttcagtttgcgagtccgatattggaattcgacgtcacacatttcaatgccctaggtgtgaaagaggctttgaaccttcgtcattcaatggagttgagggatttcgatcttgggtatcatgaaaacacgttgcttcttcttcatcacagggtgagggctctcaacctcgtcttctccggccttggtgcttggaaactccggcagagcgggtatgttcagatcgaagtcacggtggtggctgtggctcacggtgtgggtggatccaac

SEQ ID NO: 13387 - DNA, 560 bp, Lotus corniculatus
  Predicted polypeptide sequence is orthologous to G355
attctttctaaacacttgaacatttttctaccctcacctcaaacggtcaaaccccactagagattgtatctttctagacaaacacattttgctataccattcaaagattgtttatatcattgttagctatgaagagacagagagacaatgaaggaacacagtttcgatttaacaaactgtcttatgttaatgctgtcttatccaaaacagaaaagaaccattaatgagagtgttgaatttgagtgcaaaacctgcaaccgcaagttctcatcatttcaagctctgggtggccacagggctagccacaaccacaagagagtgaagctggaagaacaggccaagactccgagtttgtgggacaacaacaaacccagaatgcacgtgtgctctgtttgtgggttggggttctctctgggacaggctcttggaggccacatgagaaaacacagaaacaatgaagggttttcttcttcttcttcttcttcttattcaatcaaggaagaagttgcaaaatttccagttttgaaaagattgaatagtagtaagagggtcttgtgctt

SEQ ID NO: 13388 - DNA, 161 bp, Lotus corniculatus
  misc_feature (129)..(130): n is a, c, g, or t
  Predicted polypeptide sequence is orthologous to G359
gatctcagaaaatttattaattacaagtaatatataaactcaagatgtgtatttccatttcccccctatccaaaccctaggtactagactagatcacaaatcaccaattatcacaacttaaaataccannactccaaatttagacaagaatgaaaagccaa

SEQ ID NO: 13389 - DNA, 539 bp, Lotus corniculatus
  Predicted polypeptide sequence is orthologous to G361, G362, G370, G1995, G2826, G2838
gaattcggcacgagaaatccgcaaccacactagaagagtaaactccaattccaccacgtgcttaaagctcttcggcttcagcgtccatgaagacatggacgacgaagccgcagcgcttgaagacacgccggactcactaccagtcaaggccacttccccatcaggctcctctgactccggcaacggagacgccgccggctccgcctctggcataaacactccctccggcgaccggaaaaaaaagtgccagtactgctgccgagagtttgcaaactcccaagccctcggcggccaccagaacgcgcacaagaaagagcgccagcagctcaagcgcgcgcagctacaagccacgcggaaggccgccgtatccttcgtccggaacccgatcatctccgccttcgcgccgccgccgcacctgctatctccctcgggagctatgatggtgccggcggggacaccgtcgtgggtgtacatgccgccacgtggtggccctcctcccttccacgtgtcggtttcgcacggttgcgttttcccggtcg

SEQ ID NO: 13390 - DNA, 566 bp, Lotus corniculatus
  Predicted polypeptide sequence is orthologous to G363
ggatgaaaacttcaaataaaccattgatcaattacaaatacacacctcactgtacaatgcaagccctgccaattaaccatttcatgtctgaagagaacgaaaattcaaagatgaaagatgctaatgacttcagagtgaggacatcgatagatgtaaatgtttgagcatgatgtgccattgctacaaaaatactaaagggaagcctggtacatcaaagctcccactatgcgcaggtccggagaaggttacgaccaattagtctattgtacgcagccttaccttgttgttaacacaagaagccttctattatttaaattgaacaagacactttttttttttcttaaagcctcagagtgagatcaggagatgtagatgtctgtgcaggaggtgtagtttctacaaaactaggacttgaattatgagcatgttgttcatgttcatgccccaaattaacaccagcccttgcatctatctgcctgaaacttccaggccaaaacagaccaacatcaccatcttgcatgaacattggtgtcccgaaacagtagtctttctcaaatcttgctgca

SEQ ID NO: 13391 - DNA, 516 bp, Lotus corniculatus
  misc_feature (244)..(244): n is a, c, g, or t
  Predicted polypeptide sequence is orthologous to G374
atatttcaaaaaacatatataagcaattaaatgccaagtcaatactcaaaatagattacatcttcacaacagaactatttcagaaggatgagacaagttaataaatttgggtacataaatagcaaaacgatagccattacattacatatgaaagtcaatacaacagacttttctttcctttctgtttccttgatatcacagtgcacacaaattcttcttttctctcaaatctcttccctccatnggttttgggtggaggtgggagaagagaggcaaggatgggcctgacttaaaactcactcatttttagtagtatttgttgattcataagcagcatcagcactggatgtgtcaatatcattcagacccaattcttcattttgctcccacgacctctcatattcctcaaatgttaattgattgtcgtcttttagatcatcagttgcaggtgctataaaagaattggctaatgcatcatcaagaactagagtccatgcttcttccaagctaagaagc

SEQ ID NO: 13392 - DNA, 508 bp, Lotus corniculatus
  Predicted polypeptide sequence is orthologous to G384, G385
agaaatgggtgagaaattgattaaccaatgtcttaggtgcatgcaaacatagctcccaccaattactagtctgggatcctcttctcaaacacacaaataacaatgaaggataaagagttttcatcaaaataaaacgaactaaaccctagtaaccaaaaagctgaccctaattaacttaatgtatttagtcctagctagaaaagtttaacaagggtagcaaggtctagattgaaatgagctcttaacatttactattataatctagggaagtcaattcccgaaccttaatcctctcaactcttttaatttgaggaatcatgcaaggggcgctcttgacttctcaccatctttgaattagaagccgaagttcctcactacctttttccaccccttaattcttcaagtaaacacacaatccattagtcttggaactcaagaccttcaccaattaaagaagccttaattcgttcaacagtgcaggcaatgaggttattaacagtagcaacag

SEQ ID NO: 13393 - DNA, 528 bp, Lotus corniculatus
  Predicted polypeptide sequence is orthologous to G388
accaaacacataaggaattaacaaatgataattctgtacaagacgacatacatgatttctaggctctaaacttttttttttctctctttctagttctgcctatggaactgcagatacaaattacaaatataaatattcagtccaaaccctccttcctaatggaacaatgaataaaattaacccaaagtaaggagataaatcataaatgcaagctagttttgccaggctgaacactggccaaaaaggggatagaatgcagaagaatatcacatctaatcaaagcctatcttgtaattatctgattttgatttttgactatccatcttcacactgtaaacttgttctgatatttctcaatgtacatgatacaagagtgttgaccgagtccacagattccactgttaactttgctgtaggagaagcattggtaaggatctggaatgctattgtaaacaaagatcctccctctgtgttcttttcttccttccttgtagtaatcaccaatggccttgactctaggccatcagg

SEQ ID NO: 13394 - DNA, 520 bp, Lotus corniculatus
  misc_feature (199)..(199): n is a, c, g, or t
  misc_feature (450)..(450): n is a, c, g, or t
  Predicted polypeptide sequence is orthologous to G390, G391, G438
agatgaacaaaaattctgatttctttttccctctcaaaattttctcaattgctttatacactcttacattcaagcgggaaaaagctgggctataaatacagaaattagatttttcatacaaatgaccaatttatgaaagagaaagctaagcaatgaacactgttatcttcttcagcaagcactttccaggcgatgactngctcatatgaaacatgccgccccattgtggacatacagatcccagctggcagataagcaaatccctgctgcattaacttggcgaaatctgcaaacaatgccttgcggccagactcatcaaatattttatccaaagtgatgtcttgtaaagccacaagagtggtttccaacatgtcaagcccagcctgatttgcaaatatgaacatgggcactgacttcaaagaacaacacaaaatggcatcctgatgatgncacaaatgtttcagtaccaaatcacccacaagagaatcagatctcagcagtccagtccccaaataataac

SEQ ID NO: 13395 - DNA, 483 bp, Lotus corniculatus
  misc_feature (38)..(38): n is a, c, g, or t
  misc_feature (471)..(471): n is a, c, g, or t
  Predicted polypeptide sequence is orthologous to G390, G391, G438
aactatggagctataacaaaaaagaaatggggtcatgngatggatcttggagccacatatatatactcacaacagtttaatagcatatagcattctagggattctccaaagttaacattaaaaattaaaaggtaacattgctctctactttcctacatcttatactctaatctatcagacaaaggaccaattgatgaacatgaaacagatgcaatgagctgattcttcttcgtttaacactttccatgccactgctctctcataggatattggcctccccatgctggacaaacagatgccaccttgcatacacatgaaaccctgctgcattatctgggggaactcagagcacaggattttctttccgttgtcatcaaagattttctccagggtgatgtcttgaagggcaaccaatgtggtttcaagcatgtcaagtccagcttgatttgcaaatgtaaaaaccggtaatgnctttaaagagca

SEQ ID NO: 13396 - DNA, 550 bp, Lotus corniculatus
  misc_feature (51)..(51): n is a, c, g, or t
  Predicted polypeptide sequence is orthologous to G394
ggcccccttttttgacaaaaatacaacttcttcatagatctatgtattctnataacgataatgatgggagtggaaaaacaaaaaagaaaatttaatcaacccgttactactttctacagtattagctaattacaacttcccttagctaattacacacacccctcaaccaaaaaaatacaaaggttgtgggggatcctcatgtatttttctcctcctttttacgtctggtttctgaaaagtgaacctaagtgaagtccataatcaacacgctgcagaaggatgagtgaagggattgaagaagtgaggcttgggagtgatggtgaaagggctcttaatattggaaccaccatcgccgagcctctcgcatgagggacacatggtgagggtggctgcagacataggcatgtacaagggctgtgctagtttcagcgccttcagctcttgcagctccttcttcagcctcctgttttcgtcggttaacgtttcacaacacttcttcaagaactcacagtccacctccgtctgcttcagctttgttctggctctccga

SEQ ID NO: 13397 - DNA, 544 bp, Lotus corniculatus
  Predicted polypeptide sequence is orthologous to G394
ctttttttcatctttgccctgaaaaatgaaaaattaattacaatattcaacatgctgcagaaggattggtgaaggggttgaagaagtgaggcttggaagccatggagaacggaatcttattggaagcgccgccaccactaacaccaccaagcctctcacaagaagggcacatggtgagcgtggccgccggcataggcatgtataacggctgcgtcttcagcgccttcagctcttgcagctccttctgcaaccgcatgttctcgtccgtcaacgtttcacaacatttcttcagaaagtcgcaatccacctcggttggcttcagcttggttctgcaacaccattagcattaagattatttttaactcaattcaatttcaatcaggtataagtgtataacagttctataatggatcatgttaaaaactgatccaccaatgaatgatgttcgtacaatatgttttttatcggctaaaattaatttgtagaaaaactcattgtaacttgcaaaccatattttaatttcttaatccacgatagacaaagc

SEQ ID NO: 13398 - DNA, 590 bp, Lotus corniculatus
  Predicted polypeptide sequence is orthologous to G418, G965
ccccccatgcaatcaatagatcacaaagcttctcggaaacaagcaaaccattcagccaccaccacggccatcaacaatgccaccaccgcctctgaggtggcgccacccgtgtctcagtgctttgactcagtctcagacgatgacctgccaccgcacaggtcaattatggccgcagacgacaagtgtcgccatggcagcttggttgcagcagattacgggaccgcgcctgcaagtggtggtggtggtgacattggatccacactcatcagatttgggaccaccgccggtgacgtgtcactcaccctagggctacgccacgccgggaacacgccggagaaaactaattccttctctgttagagactttggagggatttaattagacaattcaatcaacatagtactcacattattacatcatcataatatgatcatatacaagaagatgcatgctttattaattatgttatatcatcacaagataacattttttggccctttgatgtctctcttatattccttagtctttttatttgcattgtgaaaggacagcaaaaagtggtaataagatatgagaaacgcagtcttaag

SEQ ID NO: 13399 - DNA, 528 bp, Lotus corniculatus
  Predicted polypeptide sequence is orthologous to G418, G965
gtggccaccaccaccacttagtgcaaactccaacgccctcagccaccacgccaccaccaccaacatttcaaagtgaaaacgacccctcagtactaaatgcaattaatagacaaggcttcttggaaaaccacgagtactccaatgcaactaccactactgttacggtggcgccaccggtgtctgactcagatgtgcacccggctaacaccgctgatgacacgtgtcgacatggcagcttcggtacagaagattatgggaccgcttctgctgcttctgacaacattggttcagctcttataagatttgggaccaccaccgccggtgatgtttctctcaccttagggctacgtcacgccgggaacgtgccgccggagaaatcgcctttctctctcagagactttggagccatttaatttaaattaaacatcgccctatattgttaatcacatcacataataattaaatgttaatatattacacgtatataggaggttgttttattataatatattattatggtgattatga

SEQ ID NO: 13400 - DNA, 503 bp, Lotus corniculatus
  misc_feature (65)..(65): n is a, c, g, or t
  misc_feature (81)..(81): n is a, c, g, or t
  misc_feature (317)..(317): n is a, c, g, or t
  misc_feature (473)..(473): n is a, c, g, or t
  Predicted polypeptide sequence is orthologous to G419
atggaaacatatatgttcgtatatatttaatttcctacctaccttggtaaagtaaccaatcatanctgaatgtagcatatntggatcattatctaatttttcataatcaattatggcatctagccagcagatactactcatagaagagacttctcctacgaattgattttaattttaaatttacttctaaatgatttccaaaatgcatttacttacccatcttaattaagaagatcatgatctttcctagctagctttctatcctgccaaatcatggagtagttgtgcccccatcaaattcctgtatggtaaatttngtccttcaccatccaagagagagtactgaaccggttgacaatcttcaatttggtcccttgagtagaacagcgagctttgatgagttggtggcggaaacgccaaactcactccacttcctccatgtggtggcaaccctagtgtcaaagacacaccancactgcgaacaccaccgttgaaattactct

SEQ ID NO: 13401 - DNA, 533 bp, Lotus corniculatus
  misc_feature (11)..(11): n is a, c, g, or t
  misc_feature (102)..(102): n is a, c, g, or t
  misc_feature (454)..(454): n is a, c, g, or t
  Predicted polypeptide sequence is orthologous to G427
ggagcggcatngttgtacttgtacatataaaattacttaaaaaaatgatcacgaaacttgcagcatgcacattcatggattttcccctttctttcaaaaatngtttcagtgtaatgcgttacaaatatataaataggaatcaccatgcatgcattcttagataccctttaaacgctgcaacaataccaggtaggactatcaagctgcagcgtcatatacaagtacaacaatactatttctaaacagtgactgatgatatcatatataaattaaattccacttcactttcatgcgctgtttgcctgtttcactttgaaccccaccattgttacatgcacaaaatggagattaatatagagatagtccttttcctctgttcaaaccaggtatcaatcatttacatgaagctctggttacttgtttcacctgcaccactactcttgcgcttggtttnggttccggcaccagtagaagaggaaggatcggtatgccaattcctttttctttgattaatgaaccagttgtttatctgc

SEQ ID NO: 13402 - DNA, 559 bp, Lotus corniculatus
  Predicted polypeptide sequence is orthologous to G427
aactacaatatatatttcatttaacattacaatgtaactaaaacacatccatggagttaaccaattctgtttctgtatataactcctaatagaaatctctgattttgttgcaccgtgggaactcgatcatctctgttaaccttgttccttgaacttaagaaaactgtaacttgggctcattgactttcgatgaatctgcttccatgcaaagcatgacaacaaaaaatcagagatttgtcttgaggttttctccatttatatgtaaccatcagcactattatgaccttttgcgcttgctcttcaacgcagtagaagttgaagcattgctatgccagttcctcttcctttgattgataaaccagttattgatctgcttcaactgcaaacccgtttcctgcaccaaccttgccttatcctcctctgtagggtaaggccacttggaatgtgattgccaccaggctttaaggacagaggtggtgtcaccaggaagtttcccagctcgtctcttgcgcatgatttcctctcttatgtccacaattttcgatttataaccatgttt

SEQ ID NO: 13403 - DNA, 587 bp, Lotus corniculatus
  Predicted polypeptide sequence is orthologous to G427
gatataggacaaaagaaaatatagtaaaaataaatcgtcaatctttcaaacttctgtataataatagtaatagttcttcagccggtcagaaacgtaacaaacaatttacaaagacagttaaaaaccacacacctaaacagaaaagttggcataggttaatagcatgttttgttccgcgatgaaatactctagaatcatttctggttagaagctacaagtctcagcttctgaataaaggtgcgttgaattatgtgggaatcgtgaaaccaaacatgcgctatattccacaaatttacatccagctcctgttcaagctatgatctactatctcctgcatctgactggaatccttagtgggactacattctcttgcgtttggacttcaaagaggtaaccgattgagagttgctgtgccagttgcgtttcctttggttgatgaaccaattattaatctgcttcagctgcaaacccgtctcctccacaagttttggcttgtcatcttctgttgggtaaggcactttgcatgttgctggcaccagttctttaaaactgtagtgtgtcacaggtaattcccagatcttcttttc

SEQ ID NO: 13404 - DNA, 436 bp, Lotus corniculatus
  Predicted polypeptide sequence is orthologous to G427
ctcccagcagccataacagcttccatggcatgaacacggacatgctgttgcaattgttctttaaaagcacacagcagcagaacataatgcgtcatgaattgatctagctccttctcatccaccacaccattcccaaggcgagagtacttgtccaccacgcgctgcgcctgctgcagctgcgcgtcgatccgaggaagctggtccaccggcgtcgcgatcctcaaacacgaaacatgcgccgacagcagctggtcgtacagcggatgtcccagaatgtccgccttatactccgccaagtcctccgactcgccgttgtggttgtggtctcgatcgccgccgctcttctccatcaggccccgaaccacgtcgtcgttctgcgccgcggagtccggctggagatgcaggaaattctgctgccggagcgccgccgcgttgt

SEQ ID NO: 13405 - DNA, 420 bp, Lotus corniculatus
  misc_feature (286)..(286): n is a, c, g, or t
  Predicted polypeptide sequence is orthologous to G427
gtgtgcatgggattttcccctttctttcaagaaatggtgtcagggtgaaggcgttacaaatatataaataggaatcaccaggcatgcattcttagataccctttaaacgctgcaacaataccaggtaggactatcaagcgggcagcgtcatatacaagtacaacaatactatttctaaacgagggactgatgatatcatatataaattaaattccacttggaaccccaccatgggttacagtgcagcaaaagtggagattaatatagagatagtccttttcctcgntccaaaccaggtatcaatcatttacatgaagctcggggttactggtttcacctgcaccactactctggggctgggtttgggttccggcaccagtagaagaggaaggatgggtatgccaattcctttgtcttgga

SEQ ID NO: 13406 - DNA, 553 bp, Lotus corniculatus
  Predicted polypeptide sequence is orthologous to G427
ccctttgctgcttcttcaacctctttgctttattatttatttaccacacacacacacacacacacacacacacacacacaccacttatgttaatgcaggagtgggggagatgcaagaacccaacctcggaaggatgggcggtggtttcaccggtgatgtttcagcttccggcgaccaccaccaccgccaagtcaaggctgaaatcgccactcaccctctctacgaacagcttctcgcagcacacgtcgcgtgtctccgagtcgccactccgatcgaccagcttccactaatggatgcgcagttatctcaatctcaccatcttctccgctcgattgtctctcaacacactcactctcttcctccgcatgatcgccaagaacttgataactgtcctggcacagtatgtgatggttctgtgtaccttcaaagatcagcttcagcagcatgtcagagttcatgccgtcgaggctgtcatggctggccgtgatattgacaacaccttgcaggctctcacaggagtcagtgagggagaaggaactggtgccacaatgtc

SEQ ID NO: 13407 - DNA, 635 bp, Lotus corniculatus
  Predicted polypeptide sequence is orthologous to G427
gaattcggcacgagcagtcttggctttggtcctctagtccccactgagagtgaaaggtctttgatggagcgagtcaggcatgagttaaagcatgagctcaaacagggatacaaggagaagattgtggacataagagaagaaattctacgaaagaggcgagccgggaagctcccaggggacaccacatctcttttgaaagcttggtggcaagcacattcaaaatggccctaccctactgaggaagacaaagctagattggtgcaggaaacagggttgcaattaaagcagataaataactggttcataaatcaaaggaaaaggaactggcatactaacccctcatcagctactagcaccaaaaccaagcgcaagaggcgaaaccagtaaccagagcttcatgtgaatgaactcatgttagtccaacatgaacgtgaaatggtggaatctggatgtaaaaggggaatttatgataaaatcactgtaatgaaatagtattattggttcaattacaaaatgtattgttgtatatgaggctgctgcttgatttcctgatattgatttagagagaattaatgtacttgattagattaatgggtagcaaggtgatacataaatatataatatctcatttaaaa

SEQ ID NO: 13408 - DNA, 501 bp, Lotus corniculatus
  misc_feature (317)..(317): n is a, c, g, or t
  Predicted polypeptide sequence is orthologous to G428, G1594
ggaccaaactataagcattcattcagaatgtcagcagtttttcatcaagaatacaagggaagaaaattacatgatcatttcccttttgatctctttgtgggaaatgtaagcatattactgtcagtaatctgcttctagtttataatttacaaaagaaaatacaggcaacagttactaagaatatacatttgaatgcatgcatatacatatgcacctcattcatcagaaaggaaccgtccggtcagatgttccatcatagaaaactgcatgttctcagatggtttccaatgtcgttttctctgattaataaaccaatngttaatttgcttctggtctaaccccgttgccttagccaattcaatcttatcagattccgttgggtaaggccatttgtagtgaacattccaccactgaagcagtgtttgtcttgcttccttgggaagcttacccttctttttcttctttgagaactccaatttcaaagtaccaatgtgactccca

SEQ ID NO: 13409 - DNA, 681 bp, Lotus corniculatus
  Predicted polypeptide sequence is orthologous to G428, G1594
atcaaagctaaaatcgtttcgcaccctcagtaccctcgcctcctccaagcctacatcgagtgccagaaggtgggtgcgcctccggaaatcgcgcgtttgttagaggaaatccggcgagaaaatgacctgtgtaagagggacgtagtttccacgcgctttggagccgatcccgaactcgacgagttcatggaaagctactgtgatatgctggtgaagtataaatcagacctggctaggccttttgacgaagcgagcaacttcctcaacaagattgaaatgcagctcagcaatctctgtactggtgcttcagttcccactctttctgatgaggggggtgtatcttcagacgaagaattcagtactggagatggtgatgctcaagatggacaacaattaaggggagaagatcgtgagctcaaggataggcttctacgcaagtttgggagtcacattggtactttgaaattggagttctcaaagaagaaaaagaagggtaagcttcccaaggaagcaagacaaacactgcttcagtggtggaatgttcactacaaatggccttacccaacggaatctgataagattgaattggctaaggcaacggggttagaccagaagcaaattaacaattggtttattaatcagagaaaacgacattggaagccctccgaaaacatgcaatca

SEQ ID NO: 13410 - DNA, 508 bp, Lotus corniculatus
  Predicted polypeptide sequence is orthologous to G431
acctggtattttttaatacatgaaaattataaaaaatatataacacaacatccgcaataatcaaaaaagtgtacgtagataatacatagcatgattagctatttagcttcatactcactcctccgaagcagttcagagataagcatggattttgaccctgccttaaactaaaacatgcattataaccatgcatgctaggctacaacttgaaaatagatagggttttgacagagctctatataatacaaaacaaggttcagataagagtattttagcttgggagaggatatgtaaaatggaattaaagaagcattggcatggcatccataggaaatggcttgcacataacattttccatatagtagttagttgcatccatcacagcaaattgcatatcctcagaaggcttccaatgacgttttctctgattgatgaaccagttgtttatctgcttcagatccaatccagtggattctgcaagtgcttgcttttgagattccgatgggta

SEQ ID NO: 13411 - DNA, 543 bp, Lotus corniculatus
  Predicted polypeptide sequence is orthologous to G431
caccgtctcttggcagcctatgtcagttgtcaaaaggtgggagcaccaccagaagtggtggcgaggttggaagaagcgtgcggttctgcggtggggatggccggtgatgctgttgggtcaggtagtattggtgaagatccagctctggatcagttcatggaggcttactgtgagatgctgaccaagtatgagcaagagctctccaaaccattaaaggaagccatgctcttccttcaaaggatcgagtttcagttcaaaaatctcacagcttcttctgacgttggttgtaatgagggcactgaaaggaacactggatcatctgacgaggatgctgatctatacaacatgatagatcctcaggcagaggacagggaattaaagggtcagcttttgcgtaagtatagcggatacttgggaagttcgaagcaggaattcatgaagaagaggaagaaaggaaagctaccaaaagaagcaaggcaacaatttcttgaatggtggagcagacattacaaatggccttacccaaatcgatgtcgactcgag

SEQ ID NO: 13412 - DNA, 569 bp, Lotus corniculatus
  Predicted polypeptide sequence is orthologous to G447
gccaaggaaccagaattaattcaagaatagcacaaaattacaaatcttgaaagtcttaaaactcttacaaacaaactatagacccactctttaaattgatatcgcgtaaatctcaactcttgagagatagaactcgagttctaagtgaggctcacatgcacatatggataagtataaatatcattgacattttcgcctcatacttctagcttttagccactgaatcacaattctcgtatgttaaaactaatcaactaactctaggatactgtctccacctaaagcaatacctctattatcatcttaaatgcatatattcagattgaaagagaggcttggactttcatcggggaacgtgaatagggaaagaattctggagtgagattttagaagacactgcctctttctacattgtatcgccaaaatcacaggtaaccctcgtcatcttttgtacccaatcacctcgataagtagatgaataaaccataagacaatgatgatcttctctcatctaacaactggcattcctggttgccttggaaacttgggccttaaaaatggaggtggat

SEQ ID NO: 13413 - DNA, 519 bp, Lotus corniculatus
  Predicted polypeptide sequence is orthologous to G447
cttgggaggagtttgttaactgtgtccgctgtattaaaatactttctccccaagaagtgcaacaaatgagtttggatggagattttggcagtggtggccttccaaatcaagcctgtagcagctctgatggtgggaatacttaaatggaatccagtaatatgctaactactcatccatattgataacttagattgtttctaggtaggatacatacattattgtcccataggcggtaatcatgcaataggggacgttggtgtcctgcatcaggacttaaaagttatattttgcagtttgaaaagaagacaggtggagaaactaactgctgctagtgctagaagttttgaattcaatgtttggagcaccctgacaaagttggatatgtttgaagcgtatgttgttgtaaacttgtaatatttaagcaaagattgctcttatggtggtttgaaatgtttaattcactccattgtagaaagaaaggtttaatttacttgatagttctgggtgtaaaaaaaaaaa

SEQ ID NO: 13414 - DNA, 529 bp, Lotus corniculatus
  misc_feature (113)..(113): n is a, c, g, or t
  misc_feature (118)..(118): n is a, c, g, or t
  Predicted polypeptide sequence is orthologous to G450, G456
gacaagactcactaaacaatcaaataaagaaagccaagtctataacaacatagtaatttagagtcattattgttcgagttcataatcaatacttaattagactctctcacatngtttngtttggaacattaatcatataacaaagtaacaaaccatattgatacacaaactataatgtaacaccctgctatgctcatttgtgtctgctgcagcttatcatggtattagttgtacaaaaccaaactgggcaccacaattacaaaggaaaggagcaggttctcaattaaactggtaccacttgtctagctagctagctcctgttcttgcatttctccatggctcttggtgcaagaccaatggcttcctttcctttcatgatacgcaaacgcttgcatgattcaacaaacatctcccatgggacatcaccgacaagcatccagtcaccatccttgtcttcataggttgggacataatcagagctgttcaatagatccatcagcttactctcattcatgaaatccttcatccc

SEQ ID NO: 13415 - DNA, 603 bp, Lotus corniculatus
  Predicted polypeptide sequence is orthologous to G450, G456
tgggtcgggccccccgaaacactagtggtattcacaaaagtttactcaccatggagctggtagtctcatcatcaacaacaacaaggagatcaagatggggtttcatgaaactgagctcaggcttggaattggattgcctgctgcagcaaataatattgaagaagttgtgaggaagagaggcttctctgagactgaatctgagactgacacagtggatttgatgctcaatctctcctctaaggaaccaacttcagctggggcagatccaagtcagaaacccaagactaatctgcagaaagagaagacacttttgcctgcagatcctgccaagcctccagccaaggcgcaagtggtgggttggccacctgtgcggtcgttccggaagaacatgttagctgtgcaaaagagcgttggagaggagagtggtggtgagaagagcaataatggtggcggcggcggcggtgcgagctttgtcaaggtgagcatggatggagcaccttaccttcgcaaagtggacttgaagatgtacaagagttacagagacctttctgattccttggccaaaatgttcagctccttcaccattggcacttgcgagtcgca

SEQ ID NO: 13416 - DNA, 573 bp, Lotus corniculatus
  Predicted polypeptide sequence is orthologous to G450, G456
agctccactttcttatcactgactctgtttctgtttacttgttgtttgtctattctgatttctgactcaaagaagagaagtaatgacaagtgtggtggtggatgcagagagagacaagtatagcatgataaactttgaggaaactgagctgcgactagggattcccggcgccggtgagtctggtatcaagatcggtggtggtagtggtgggaagagaggcttctcagagactgatgctaatgtggatttgaagcttaatctttcttctgatttgggctctgcctcttcctctgtttcttcaactctgcctccaaacaaaggcaaggagaaaacagctgcaacaacacaagctaatgacccggcaaaaccacctgccaaggcacaagttgtgggttggccaccagttcgatccttcaggaagaacatcgtgaatgtccaaaagagcaacaacaacgaaggcgcagagaaaaaggtcaccaccaccaccgccacaaccaccgcaggcaacagcgcagcagcagcagcatttgtgaaggtgagcatggacggtgcaccatatctacgtaaggtgga

SEQ ID NO: 13417 - DNA, 542 bp, Lotus corniculatus
  Predicted polypeptide sequence is orthologous to G450, G456
ctacggaaaacattgacatttattagttactggtcaagtatggaggcactggacaaggtcacatgtttgttcctggaaacaaaaacggggtcatatataaacattttctacattgtcctccctaaggaatttccaactattttctcatgcatataatacacatatacgaaattaaattttacaaaaaagaaaaagatggcacagacacataataataattaataacaataacaatgtaaattaaaactcgatcttattcctcctatatggcttgctcgaaccaatttgcttccttgggacgcagaggatcaacactatcaattcagcttctactcttgcacttttccactgcccttgggcgctagcccaatggcttcagaacctttcattatgcggagacgcttgcaagattctacgaacatttcccagggcacatcaccgaggagcatccagtcaccatcctggtcttgataagtgggcacataatcagagccgttcaaaaggtctatcaattggctctcattcatgaagtccttcatcat

SEQ ID NO: 13418 - DNA, 496 bp, Lotus corniculatus
  Predicted polypeptide sequence is orthologous to G450, G456
gtgaaaattaagtaaaatacaaacgatatataggtacaacagacaagcacattatggatcagcttactattatgcaagcacacaacaagtaaagaaataaagtcttgcgacataattcagatcgagtcattatcgtttctgttcacaatatatacttagaattaatctcacagttgggtttggaatattatataacaaaccatattaatgatacacaaatataattaactatatttttaacaccctgctttctttgtccatccgtgtctgctgcagcttcttcacctgacttgattcagttactaagtcaacttggaccacatggaatatggagcagttgcaatggtaacgactagtctagctccggttcttgcatttctccatggcgtctggtgcgagtccaatagcttcctttcctttcatgatacgtaaacgcttgcatgattcaacaaacatctcccatggtacatcaccgacaagcatccagtcaccatcc

SEQ ID NO: 13419 - DNA, 413 bp, Lotus corniculatus
  misc_feature (43)..(43): n is a, c, g, or t
  misc_feature (50)..(50): n is a, c, g, or t
  misc_feature (53)..(53): n is a, c, g, or t
  misc_feature (56)..(56): n is a, c, g, or t
  misc_feature (63)..(63): n is a, c, g, or t
  misc_feature (74)..(74): n is a, c, g, or t
  misc_feature (76)..(76): n is a, c, g, or t
  misc_feature (79)..(79): n is a, c, g, or t
  misc_feature (81)..(81): n is a, c, g, or t
  misc_feature (85)..(85): n is a, c, g, or t
  misc_feature (89)..(89): n is a, c, g, or t
  misc_feature (95)..(95): n is a, c, g, or t
  misc_feature (102)..(102): n is a, c, g, or t
  misc_feature (110)..(110): n is a, c, g, or t
  misc_feature (116)..(117): n is a, c, g, or t
  misc_feature (122)..(122): n is a, c, g, or t
  misc_feature (126)..(127): n is a, c, g, or t
  misc_feature (131)..(131): n is a, c, g, or t
  misc_feature (147)..(147): n is a, c, g, or t
  misc_feature (151)..(151): n is a, c, g, or t
  misc_feature (157)..(157): n is a, c, g, or t
  misc_feature (167)..(167): n is a, c, g, or t
  misc_feature (175)..(176): n is a, c, g, or t
  misc_feature (183)..(183): n is a, c, g, or t
  misc_feature (187)..(187): n is a, c, g, or t
  misc_feature (191)..(191): n is a, c, g, or t
  misc_feature (198)..(199): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (217)..(218): n is a, c, g, or t
  misc_feature (223)..(223): n is a, c, g, or t
  misc_feature (225)..(225): n is a, c, g, or t
  misc_feature (245)..(245): n is a, c, g, or t
  misc_feature (248)..(248): n is a, c, g, or t
  misc_feature (251)..(252): n is a, c, g, or t
  misc_feature (258)..(258): n is a, c, g, or t
  misc_feature (261)..(261): n is a, c, g, or t
  misc_feature (275)..(275): n is a, c, g, or t
  misc_feature (277)..(277): n is a, c, g, or t
  misc_feature (289)..(289): n is a, c, g, or t
  misc_feature (301)..(301): n is a, c, g, or t
  misc_feature (331)..(331): n is a, c, g, or t
  misc_feature (343)..(343): n is a, c, g, or t
  misc_feature (349)..(349): n is a, c, g, or t
  misc_feature (358)..(358): n is a, c, g, or t
  misc_feature (386)..(386): n is a, c, g, or t
  misc_feature (404)..(404): n is a, c, g, or t
  misc_feature (410)..(410): n is a, c, g, or t
  misc_feature (412)..(412): n is a, c, g, or t
  Predicted polypeptide sequence is orthologous to G450, G456
ttttttttttttttttttttttttttttttttttttttttttnaactggnaancanccaaaanctcattcatananaananactntatnattttncctccanaacaattnccaaannttttntaanncatncaaaaaaattattttnaaantttttngccaaaaaancattatannactgggntccnaatnaaactcnnccaancnggtttttngtnnaactngnacttaaaaactaaacttttnagnttnngttttngcncttttccactgctntnggggctagcccnattgcctaaaancctttaattattcgcaggcgcttgcatgancccacaaacatntccaangggacatcncccactagcatccaatctccatttttgncttaatatggcggcacanaatcanana

SEQ ID NO: 13420 - DNA, 556 bp, Lotus corniculatus
  Predicted polypeptide sequence is orthologous to G450, G456
aaacactttgagagaattagggggaagagaaaaagtttttattttcctcttattgaaaatctggtgctaagaaaagcactttcagattcattgagaagccaaaaatggctactttgttgggaaaggtgcagaatgatttgaacttgaaggagactgaactatgcctgggtttgcccggtggtggtggtggcggcggtggctctgatcaggtggaaactccaaggtccaatgggaagagagggttctctgagacagttgatctgaagcttaaccttcaatccaaggaagatctgaatgatgatgtgaagaatgtttcaaaggagaagaccctccttaaggaccctgccaagccaccagctaaggctcaagtagttggttggccaccagtgagatcatacaggaagaacatgatggtacagaaggtgaacaatgaggatcaaggcactgagaagacaacaagcagcactgctggtggggcatttgtcaaagtttccatggatggagcaccttaccttcgcaaggtggacttgacaatgtacaaaagctacaaagagct

SEQ ID NO: 13421 - DNA, 478 bp, Lotus corniculatus
  Predicted polypeptide sequence is orthologous to G450, G456
gaaaaccaaaatgacaatttaataaaagaaaaagtatgatgttcttcttttcttacctttctatgacaaacaaaatgctcacaggcttacattaacttgtagagagggagactagattaccagtgcaatacaaaatttacatactaagggtagccttaatgactgtgattaaagtgaagtaagggagaaccttaaaaacctcgaccgtccacctcaaaatgatgtagacgtttacagcaaacctaatatactgtcatcaacatatcttgcatcatcataaaaagtttaggatgctccaatctcctatatagaattatacataagcaagaagggtattatatgctcagatgtgatctgtcatcttcatggatcagtgtagataaaggcatgcttcattgctctaggtgcggcttttgcacttttccatggccctaggtgctagcccaattgcttcagaactcttcattatcctcagcct

SEQ ID NO: 13422 - DNA, 632 bp, Lotus corniculatus
  Predicted polypeptide sequence is orthologous to G450, G456
ggtttagagagaaaaagagtgaaaaattcatcatatggagaagatgatggtgtttgaggaaactgagctgaggcttggccttgggttgcctggaaatggaggcacagcagcaggcactggtactgaaggtgctgctgcagaaggagctgtgatgagaaagagaggattctctgaaactgagtcgactgagactgaagaaacagcaaccactactgtggatctgatgcttaacctttcccctaaagaagcttcttctgcttcggctgctgctggtggggcagatccacgtgataagcttaagacttcttcgcctaaggagaacaccctgctggtctctgattctgccaagcctcctcctgctaaggcgcaagtggtgggttggccaccagttcggtcgttccggaagaacatgtttgcggcccaaaagagcagcggagatcaagagagcgagaagaacagcagccctaatgcaagctttgtgaaagtgagcatggatggagcaccttacctccgcaaagtggacttgagcatgtacaagacttacaaagatctctctgatgccttaggcaaaatgtttagctccttcaccattggaaattgcgagtcccaaggcattaaggatttcatgaatg

SEQ ID NO: 13423 - DNA, 567 bp, Lotus corniculatus
  Predicted polypeptide sequence is orthologous to G464
tatttttggaggagaaaggcattcaaagttgttggatggatcttccaagtttgtgctcacttatgaagacaaggaaggagattggatgctggtcggggatgttccttgggggatgttcaccggttcagtgaggagactacggatcatgagaacatctgaggctaatggacttgccccaagattggaagaaaagaacagcagacagaaaagcaagcccatatagatattgttttaatggctaaggataaggagaacttatcacgttagtaactgcaatagaagaagaagaaaacaaaaaaacaagagaagagcaaaggaatacaggaagtacatggattttgagatttaaatgatccagctcccttttttggttctttattgattcagtttgtgtttgcttaacttggtatattttgtcactgcctctctatacttggagggtgcaggcatcatagtttttcatattatactactgatcataaaagtcaggctctttattaatgctgtaaatgttggatgcttgctaacttcctcagccatttagttactgattgaattttcttactg

SEQ ID NO: 13424 - DNA, 557 bp, Lotus corniculatus
  Predicted polypeptide sequence is orthologous to G470
accagccaatcaaccattaagctgctatgtgtatgaacttcattacattaattaatgggttggtgttctgagggagggagagaaacaactatgtacagaagagaaggctatctccacccccataacaccctcgttcaaaacacaatgattacatataactgggcagacacattcattgccatctcattcaggatctccaaaattggatggatggatactcattcattgccatctctacattctgattcaaagcgtcttcatgtcatgttctctaaccggatgacttgacgccagttccctactttccacctcggagtctgaaagctatggaaaaccactactaattatcagggccattgtctgaatttagtttctgatgcagctgagctttaacttcttttgcatccgtgccttcgctagctgacagattctcttcatttttcgaactcaaggtacctggactcattttctgaatctcctctttcgggtagatataaattttccgaaccattgaacagaactcctgccatggatcatcgcctacaagcatcatgtca

SEQ ID NO: 13425 - DNA, 606 bp, Lotus corniculatus
  misc_feature (580)..(580): n is a, c, g, or t
  misc_feature (583)..(583): n is a, c, g, or t
  Predicted polypeptide sequence is orthologous to G470
ttttgtggtttcgtttttgcccctcctgcaaccctttctttctatattcacaaaaagcgtgaagaacaaaattcagttcagactgaaatagaaacaaaaactgagctgagaagcagtgaagagcgtgtttcggatgagagatctgtggtgagtttcacggaaatggcatcatcagaggtggcgatgaaggggaattgtccgaaccacggtgatggtggtcggagcgtaacaaccgagggacagaatggtcattcagcgtcgacggcgagagacgcggaagctgcgctgtacagggagctatggcatgcttgtgctggtcctcttgtgacggtgccacgggaaggagaacgagtcttctacttccctcagggacatattgaacaggtggaggcttcaacgaatcaggtggcggacgagcatatgccggtttacgatctcccatctaagatcctatgccgggtcatcaacgtgcagctgaaggcggagccggatacggatgaggtgtttgctcaggtgaccttacttcctgagccaaatcaagatgagaatgccgtggagaaggagcctccgccaccgccgncgncacgatttcatgtgcattctttc

SEQ ID NO: 13426 - DNA, 576 bp, Lotus corniculatus
  Predicted polypeptide sequence is orthologous to G470
gggccccctcgggagtctcttcaccctcgactcatttgaaccgcatagctatggtataattatttggtaagggactccatgtattgatcataaggaacaataaattgcagctgggactggtcctaggttagtaataaacagtaaacatggtcccggtcaagttggcatgccaagcagtggcaaggacaccgagatgcaggctggggcttgagataactgaagatgaaacattagcctgctgtctcatggcacgcctgacacccactcgaagttccccattctcacctcttaggaaaataaatgcatccccagcaactagcctcttagagctgacaaaaacactccaagcgcttagcaataagtgtctacgtggttgaccgagaaagatatgcctgaatcgccactcgctcccatggaggtccttggctaccaatgcctgggtaggtggctgtttggacatgtccagcggagggaggcattcatcagcatgtcgtctcagcactgaaaacccagcgtgtgtactggtatccgacgctgtgagcgttaaacagaacgaatgcacgtgaaatcgtggtg

SEQ ID NO: 13427 - DNA, 660 bp, Lotus corniculatus
  Predicted polypeptide sequence is orthologous to G475
gtccatattaatcttcctctggatctgtcttgctttgcttgcattcatggataggtatgagggaaagagaaccttgaggtacaaagagtacgatgaggaggaagaggaagaagaagaagatgaagaagaagagggtagaagaaagagagtagttacagatctatatagcaagagagggtctaaaggtggaagctcagtgccaccttcttgtcaggtggaaaattgtgatgctgatctaagtgaggctaagcagtaccaccggcggcataaggtttgtgagtaccatgccaaagctcatgccgtacacattgcagggatgcatcaacggttttgccagcaatgtagcagattccatgagctatcagaatttgatgactctaaaaggagttgtaggaggcgtctggctgggcataatgagaggcgtcgcaaaaatgcaattgactatcatggacaatgatttcatcaatgagatgggcattgaggcaagcatataaatgaattaataaagtcacccattgaaaccttttaaatagtgttgctggtctctatgcatggatgctctctatcttctgtcaaatcatttttcctgtatgatgaaaagattggtgctgctattaataacatccatgagaggttattttcacttaaaaaaaaaaaaaa

SEQ ID NO: 13428 - DNA, 517 bp, Lotus corniculatus
  Predicted polypeptide sequence is orthologous to G477
acattttgatgcatctaaggctctagtttattacatccgcatggataaattaagactgagagggacaacttttttagtcccaacaaacaaaaattgatgtagcctcacgtgattacacggtaagctattctactcacaagttcttcctccaaatcagcacaaccaacttgatccaaatagttagcatctgatgggaatagcaccaagtttctacttccttgtcttctacattgtctaagatgattggcataggtgtatgtcacatgctgcacaacttttacccatttcaaggcaccttaagtaatccggagagtgcacggagaatcattctcttgctttagctgcaaggattgccgctgatgctccactcgctgaagctgtgatgacagttggagcaagtcaatggtcgcatcatcttcacaggaaagacgatctttcacgctcacaaaatctgattgttggaaaatcccatctgccattccaaagtggacaatatcatgattgtctgatatcaatg

SEQ ID NO: 13429 - DNA, 465 bp, Lotus corniculatus
  Predicted polypeptide sequence is orthologous to G478
aaagtagaaaagagcaatgccaattacacaatcccattgctaccctactagtacccaattaaagacccaacaattatagggcactagagttttatatagaacataaaaagaaattaacatacatggtttgaaaatcacaattaattctagcaaattcataacaggagattaaaaagctaactttgaaaattaaatctgggagaaaagttacaaatggaagttcactatgtattattgctgaacactcctccatgcaagttaagtactgctctcctacatgatgatgaactacccgcttgagaaaaacagtgagcttgaatttgaagggcttgtgctttggttatatggcctcggccgaaaataatccggcggtgacactgccacagtcaccgatgatgatggttgagttccggagtcagcaggggaccttgcaatgttatccagagcagtagtagatttctgaat

SEQ ID NO: 13430 - DNA, 561 bp, Lotus corniculatus
  Predicted polypeptide sequence is orthologous to G484, G2631
aactcttttaattacattaacttacaaatatggatcactaaaagaacacaatggccagcacatccacataggctagcaaactagtgaatgggttttatgcaaatcgaactaaattaacgcagagaagagtcagagatgcttgcctatgctcaagaaaataaagatcctaaaaggttagctctcttaactttggtcagcatctggctccttggaagtaatggtccctccattcatcctagcacgtgcttctgcaaacatcctttgctgctcagctaacgcttcttcctcggtcatctcagctctgttgctccacttggcacctttaagagtgtccattgtctccaacttgtgctgttcatatgctgcatagacttcctcaatgtaatcaccaaatccaagaacccctaaagccttcaatacgtgctcaggcgcaattgtccttctctcctctctgccacagacttcattggattctgacgagacgaggtttataaactctacacaacactcgatcaataaatcctgggcatctctggcgacacgaacatccgggggcagcat

SEQ ID NO: 13431 - DNA, 521 bp, Lotus corniculatus
  Predicted polypeptide sequence is orthologous to G489, G714
ggaccagaaaattaaaccgctacaaataacattttatccagcataattaaagataaggtgcagttttccctagcatattatctacgggggtcccattatctacataatagtcggcattacatgtaaactatcagctacactttcggatcatcgctatagacccctttctaaccattcagctggacatcatcaggagatggcagcacccctttctaaccattcagctggacatcctcacgagattacagcaccggataatctggatttccaagacacgcccataataaagcatctacggatctggagatgggggtcgctgcgggtctggtggctgaggccacattgggggtgccaggtaaggatgagatggctgagcatacatattgggatccatcacaggctttcccattatgacaccagcaggtccaactggctgaggcatgccgtagcaataaggaagcgcgtcaccaggcccagccacaggcatggatcctctggggattgatgcgagcacttcatct

SEQ ID NO: 13432 - DNA, 516 bp, Lotus corniculatus
  misc_feature (346)..(346): n is a, c, g, or t
  Predicted polypeptide sequence is orthologous to G502
aattcaattcaacaaatattaattagaaagtcggacttagatctgatgacatgacatagtgttttggaccttatctacattctacagtagctaagctaagctagctatacacatgtaaatcctagacacagacagatccaacatgcaccgctggatcatcctcatcctaccgccaccaaccaaacccatcggtgctaaacggtggaccaacatgtgcattttcatcttcattttctttctttctcctcctttgccttatctaaatttatcacctacacactcgcacaggcacactcatggacctccagtctcgtgctaccgtgcgatgcatcttgcggcatagatngtgttctgagtttcaaattttcaatgcttagaaacggcttgggcatgtacaggaacatatcctgcagcggcgacagctgattaccactctgaaactgggacccaaatccgttgttgttgctgttgttatggctgagagtggcatccacgtaattataaggaaactcgagg

SEQ ID NO: 13433 - DNA, 510 bp, Lotus corniculatus
  Predicted polypeptide sequence is orthologous to G502, G519
tacgggccccccgcacaaaaaccagagtcatcacaaggaagagaagaagaagaagaagaaaactcaaacccacacgaatgcaaggtgcattggaattaccacctggtttcagattccaccccactgacgatgaacttgtcaaacactacttgtgtgccaagtgtgcttctcaacccatcaatgttcccattatcaaagaactcgacctctacaagtttgatccatggcagcttccagatatggctctttacggtgagaaggaatggtactttttcactcccagggaccggaagtaccccaacggttcacggccgaaccgggctgctggaaccgggtactggaaggcgaccggagcggataagccgatcggaaaaccgaagactctggggatcaagaaggcgctggttttctatgcagggaaagcacctaaaggtgtgaagactaattggatcatgcatgagtatcgtcttgccaatgttgatcgatctgccaccaagaaaaacaacaaca

SEQ ID NO: 13434 - DNA, 533 bp, Lotus corniculatus
  misc_feature (37)..(37): n is a, c, g, or t
  Predicted polypeptide sequence is orthologous to G502, G519
cgcaaacagagagacgaagatcatcatcaacattcanacaacactacatcaccatcatcatcaatcaatcaacaggaattcaaacaccaagggaagggtgaattagagttgccacctgggttcagattccacccaacagatgaagaattggtgaaccactacctctgcacaaaaggtgctggccaatccttcaactactccgttatcaaagaaatcgatttgtacaagtttgatccatggcagcttccagaaatgggtttggatggcgagaaagaatggtacttcttttctccgagagaccggaagtatccgaatggttcccggccgaaccgggcggccgggagcgggtatgggaaggctactggagctgataaagcgatggggaagcccaagggcgtggggattaagaaggcactggtgttgtatgtggggaaagcacctaaaggaatcaaaaggaattggatcatgcatgagtatcgtcttgccaatgttgatagatcagctggaaagaaaagcaacttgaggcttgatga

SEQ ID NO: 13435 - DNA, 373 bp, Lotus corniculatus
  Predicted polypeptide sequence is orthologous to G522, G1453
acaagagcttcaatgtcacgttcatttagtttattatgtccaggaaattaaacagcactcgtttttttaggtataattagttgagattcctaatattagtatatgcccttaaatcaattcaagcagccactatttccacatgtcaacggggaagctggggtttgacgttgaggcattttcaggcttcatttcatggttttctatgtccctgaattcttcattgctattgttcttcaactgaaagatgtctttggttatatcttgactgagttgtgaagcaacaaacttgtcaagagctctccaatcatgagccacttgctgaaggttttgctgttgagcttgttgtatgattgatgcagcatggttgtcttct

SEQ ID NO: 13436 - DNA, 482 bp, Lotus corniculatus
  Predicted polypeptide sequence is orthologous to G536
aaaggaaaattaaaccatatataattaactggattataaagtatcctttccaaatcatatgacacataaaaaagagtctagtctttctgctcattaacattatatcacaaattgccaatcatttataaactagggtgattcttaatcagcacaaaagaaatgacattcaaagcccacctccttcagaggaagaataccacacatcaacttataagggatatcagggctcatctagctggtcctggacatcagaagtccaaagggtcaggttgtctcttaaaagctgcatgatgagggtgctgtctttgtaggattcttctcccaaggtgtccagctcagcaattgcttcctcaaatgcctgtttagccatggcacatgctttgtcagactggttgagaatttcatagtagaacacagagaaattgagtgccaaacccaatcttataggatgagtaggtggaagatcagtagcagcaatgtcc

SEQ ID NO: 13437 - DNA, 527 bp, Lotus corniculatus
  Predicted polypeptide sequence is orthologous to G536
gatctgcaattcgaaaccctaattttgaagaaatcgatcggtggtcatggcttcttccaaggatcgcgagaccttcgtctacgtcgccaagcttgcagagcaggctgagcgatacgaagagatggtggattcgatgaagaaggttgcgaatttggatgttgaactgactgttgaagagaggaatttgctttctgtgggttataagaatgtgattggtgctcgcagagcgtcgtggaggattctgtcttccattgagcagaaggaagagactaaaggaaatgatgtaaatgcgaagcggattaaggagtacaggcagaaggttgagtcagagcttgcggacatctgtaatgatgttatgagggtgattgatgaacaccttataccttcagctactgctggtgaatcgactgtgttttactataagatgaaaggagactattatcgttatcttgcagaatttaagtcaggcaatgagaagaaggaggctgctgatcagtcaatgaaagcatatgagtctgctaccactg

SEQ ID NO: 13438 - DNA, 484 bp, Lotus corniculatus
  Predicted polypeptide sequence is orthologous to G536
gcctcagtagggctccttaagttattcagaaaggtatgcaaaaaggacttcacaacaacactaagcattcataaacagccaacaataaaaaaattataaatcactaaaccaccaagcatattcttctcatcaataaaacacataaagggtccattaaaacattggtaatcccaagggcaaacggcacttgaaatcatgaaatccacaactaaaatcctactagggaacccaacagggaatctatattaggggtaatacacatgccgccaactaccacattatggctccccatcgccggatgggggcttagatgtttcctggatctcatctccagcatcatccgtaaggtcggacgtccacaaagtcagattatctcggaaaagctgcatgatcaaggtacggtcctggtatgactcttcacccaaggtgtcaagctcagaaatcgcctcatcaaatgcctgcttcgcaagattacaagcacgat

SEQ ID NO: 13439 - DNA, 556 bp, Lotus corniculatus
  Predicted polypeptide sequence is orthologous to G536
tcagtttttcaagggccaaccgacgagctgatcttaatcataacacgattcaaatagaggaatcaagcattacaaaccaatggtgctatggttgcagaaacataaataaaactagccaacaatattgcaaatgaagcagataattcaaatatgctgtcactctaaaataacaatgactcaaaagttgacgacgagcaccacccatatagaggattcactacaatatcatggtattgacataccgacgggttagcggcccaactcattttctccttcaccacccatggctgcgctttccattttttggtcatcaccatcttcagggatatcagaagtccataaagcaaggttgtctcgcaacagctgcatgatcaaggtactgtccttgtaagaatcttcattcagggtatccagctccgagacggcatcatcaaaggcttgctttgcaaggcggcaggccctttcaggtgaattcattatctcataataaaacacggagaaatttagagccaggcccaatcggataggatgtgtacgtcgtaattcactctcagca

SEQ ID NO: 13440 - DNA, 507 bp, Lotus corniculatus
  Predicted polypeptide sequence is orthologous to G536
ctgtcaaaaaaagatgtaaatttttattccacggttatattaatgatatgaggtttccacggttgctaaagcgtagctataaatcgtccacaattactgaaccgtggaatgaaatgtagatgccacggttttcatcacctgtggtcatctagcgtccacacttatcgaaccgtggcatatattatacttaggccacggttttttctccgttgaagaattaagcgtggtctaaagtgaaaaatggtgtagtggatgcatcatcctccacctcagaggtccaaagggtgaggttatcacgaagaagttgcatgatcaaagtgctatccttgtatgattcctctcccaaggtatccaattcagatatcgcttcatcgaaagcgtcttttgcgattttgcaggcacgatcaggagagttgagaatttcatagtaaaagacagagaagttcagagcaagaccgagcctaatgggatgagttggagcaagttctgcattagcaatatcctcgg

SEQ ID NO: 13441 - DNA, 491 bp, Lotus corniculatus
  Predicted polypeptide sequence is orthologous to G536
tctcaaatcacacaaacaaaagacaagtggctgtggctgggtggggtcccggaaaacctaagcagggaacagtatgtctacctcgccaagctagcggagcaggcggagcgctacgaggagatggtggagttcatgcagaagctcgtggtagggtccacacccgcggcggagctcagcgtggaggagcgcaacctcctctccgtcgccatacaagaacgtcatcggctccctccgtgcggcgtggcggatcgtctcgtcgattgagcagaaggaggagagtcggaagaacgacgagcatgtggtgcttgtgaaggattacagatccaaggtggaggttgagctttccaagatctgtgctagcatcctcaagcttttggattccaatctcatcccttctgcttcttccagtgaatccaaagttttctattacaagatgaaaggggattatcataggtacttggctgagtttagggttggtgatcagagaaaag

SEQ ID NO: 13442 - DNA, 529 bp, Lotus corniculatus
  Predicted polypeptide sequence is orthologous to G536
aaccatcactctgacctttatctttttttctggcttgccatcgtttcttcgagaaagggaagagcgatctccatcttttgtgccagcaacactcattttaaaagttttgacaatggcagccgcatccacaactcgtgaaaagtacctgtacatggcaaagctcgccgaggaggctgaggcctatgacgagatggtggagttcatggagaaggtctgcgcagctgcagacagcgaggaccaggaactcacggtggaggagaggaacctcctctcggtggcctacaaaaacgtgatgggaacaaagcgcgcttcgtggcgcatcatctcctccaaggaggcgaaggaggagagccttggtaacgaggaccacctagacaacatccgcgaattccgttacatggtagagtcccatctctgtaacatctgcgacgatgtcctcaatctcctcgactcacgcctcatcccgtcggccacctccgcggaatccaaggtcttctacctcaagatgaagggtgattactacaggtac

SEQ ID NO: 13443 - DNA, 398 bp, Lotus corniculatus
  Predicted polypeptide sequence is orthologous to G536
atcactctgacctttatctttttttctggcttgccatcgtttcttcgagaaagggaagagcgatctccatcttttgtgccagcaacactaattttaaaagtttcgacaatggcggccgcatccacaactcgtgaaaagtacctgtacatggcaaagctcgccgaggaggctgaggcctacgatgagatggtggagttcatggagaaggtctacgcagctgcagacaatgaggacgaggaactcacggtggaggagaggaaccacttctcggtggcctacaaaaacgtgatgaacacaaagcgcgcttcgtggcgcgtcatcgcctccaaggaggggaaggaggagagccttggtaacgaggaccacctagacaacatccgcgaatttcgttacatggt

SEQ ID NO: 13444 - DNA, 530 bp, Lotus corniculatus
  Predicted polypeptide sequence is orthologous to G536
gtagtcaagaaaatagcgatttttaaacacatacaaataaaacagaaattattcattcacacttcatattttctttcatcttatttttcgcttaccttctcttcttatcaatctctttttttttttcaatcacatcatttcttttctctcatttctatatatattatcttttcttgtaattcagtgtgttttgtatgcaacaaaacattattcaaataaaaatggatggacaaaataaagcagccaagtacatccagaattcataacagacttgaatgccaaaaatctcagcacctaataaacgagattagcaacaagcatctcgatcccttgaaaaacatcagcagttgaatatatcttcagtctttaatttaatctgatgcatcatcctccacctcagaggtccaaagggtgaggttatcacgaagaagttgcatgatcaaagtgctatccttgtatgattcctctcccaaggtatccaattcagatatcgcttcatcgaaagcgtcttttgcgattttgcaggcacg

SEQ ID NO: 13445 - DNA, 603 bp, Lotus corniculatus
  Predicted polypeptide sequence is orthologous to G536
ggttttgtagagagagaaaccttgcagatcgtcaatggcgtccaccaaggaacgtgacaacttcgtctacatcgccaaactcgctgaacaagccgagcgctatgaagaaatggtggaggcaatgaagaatgtggcgaagctaaatgttgagttgactgttgaggagagaaaccttctgtcagttgggtacaagaatgtggtgggtgctcgccgggcttcgtggaggattctctcctcaattgagcagaaggaagaagctaaagggaatgatgtgagtgtgaagaggataagggagtataggcagaaggtggagtctgagttgtccaatatatgcagtgatatcatgattgttattgatgagcaccttattccatcgagctctgctggtgaacctagtgtctttttctacaaaatgaaaggagactactatcggtacctggcggaattcaagtctggtgatgatagaaaagaggctgctgatcaatccatgaaagcatatcagttggcttccactacagcagagactgaattacctcccactcatcccattcgattgggcttggctttgaacttctctgtcttctactatgaaattttgaactc

SEQ ID NO: 13446 - DNA, 711 bp, Lotus corniculatus
  Predicted polypeptide sequence is orthologous to G536
gtttctctctctacaattcaacaatggcggccgcaccctcgcctcgcgaagagtacgtctacatggcaaaactcgccgagcaggccgagcgctacgaggagatggtcgagttcatggagaaagtctccgccgccgccgacaccgaggagctcacggtggaagaaaggaacctcctatccgttgcttacaagaacgtgatcggagccagacgcgcttcctggcgcatcatctcctccatcgagcagaaggaggagagccgcggttacgaggatcacgtctccgtcatccgcgactaccgatctaagatcgagtccgagctctccaacatctgcgacggtatcctcaagcttcttgactcgcgactcatcccctctgcttcctccggtgattccaaggtgttctaccttaagatgaagggagattaccataggtatctggctgagtttaagaccggcgctgagcgtaaggaggccgctgagagcaccctcgccgcttacaaatctgctcaggatattgcaaattcagaactgccaccaactcatccaattaggctcggccttgctctgaatttctctgtgttttattacgagattctcaactctcctgatcgtgcctgcaacctcgcaaaacaggcttttgacgaagcgattgctgaattggataccttgggagaggaatcatacaaggatagcactttgatcatgcaacttc

SEQ ID NO: 13447 - DNA, 460 bp, Lotus corniculatus
  Predicted polypeptide sequence is orthologous to G546
aaaactctctctactttctcttctctttccatcactctgttttgactctgtttctcccctgtttctcctctgttttctcacaaatcaatttctttcctttccttttccctctactgagaaagatgacacgtgcgatgaggattctcaatacggcgggaaaatccgccgcggtggcagctgcggtggcgccaccgccggaggcggtgactctggagtcagatttcgtggtaatcctagctgcccttctctgcgctctgatatgcgtggtggggctcatagcggtggcgcggtgcgcgtggctccggcgagtcaccggcgatggcggctaccccacccggcaagctctggctaacaaaggagtgaagaagaaggtggtccagtcgctgcccaaattcgcctacgcagacagcagcccgagagagtggctggcgacgacggagtgcgcgatttgcctggcgga

SEQ ID NO: 13448 - DNA, 481 bp, Lotus corniculatus
  Predicted polypeptide sequence is orthologous to G558, G578, G629, G1198, G1806
cactcacaaagttatgattctatttcagatagggggaaaactctagcaagtgaaccaaacattcaaatttatcacatccaaactacttggaatgaaataaacacaaagcccttcaactactcttacaagggacaacattatgggtaataaacaagatacaatactctggtcaacaattcagtttctagattatgtgactagatgaacactgatatcagtaacctgaaaagtacaacacagtaaaattaaacctatgataacaaagtattcctggtgccagatccatgaaaatgaacttgacatgctatttatcactcatcaatctctggggcgggcaagccagagggagctaagagcacgcagcctagaaaagtagtcattgatggcaaggagtgcgcgggccgatgggcgagtggtcaatattcggtgaatttgttgcagcgtctgctggcgcaaatggtcagcctgccgaataaacccc

SEQ ID NO: 13449 - DNA, 515 bp, Lotus corniculatus
  Predicted polypeptide sequence is orthologous to G558, G578, G629, G1198, G1806
gcaaccacaaaccattaagcaggaaaagatacaaaaagagaggaaaatctccctcaaataagctgatttctgaaatacaattaccagctgtaacctaaatacaaacactattctacattttccccttcacctctatctatcaaacacctacacaatcaaattattgagactattttcaaagcaagggaaagcttaaataaaaatgttgcaccacaccagcatcaggtggagagaagagtaatcacattatctaatgtttacagcacagctaggcttctagaggaattcattgccaaaggacaccagcttccaattaactgatttaatgcagaagattcaatcctcatgttgaatgtgatctggcttgaaaaaacttcatgaatggagccttgataaacttcactcccgtggcctggccagccagagagaactcagggctcgcagccgggagaaataatcacttattgcgagaagggctcgagcggattgtctagttgttaatatcctaagcattt

SEQ ID NO: 13450 - DNA, 344 bp, Lotus corniculatus
  Predicted polypeptide sequence is orthologous to G558, G578, G629, G1198, G1806
actaagtttcaaaagcagatgttattatatgcattttacaagaccaactttaatttcacacaggctcatacagtttctaaatacttcattttgcaacaatctaatatacaacatgcgtccaaaattaatttatttacaaactcctatggatgaaataaacgaagcagccatattcacaacttctccaaaacgcaagactgcaggaaaaatttgatgctcaaggccagagaaactacatcacatcgcgttcataatcacaagtttttgttcttgtaatcttgtgtgactaagcaggttcacggggtcgattcgaccatagtgagcttaaagccctcaggcgttgg

SEQ ID NO: 13451 - DNA, 568 bp, Lotus corniculatus
  Predicted polypeptide sequence is orthologous to G558, G578, G629, G1198, G1806
ctggttttcatttcagttaccagttataggaaaaccatgagttccacttgtaacaagttgagacagagaggcaggactcttgcaaacaaaccaatgaatgaggttaatgcacaaggagaaatcttcaaaattaagggtaatacaacttttgtgatgaactatgcacgttggctggaagaacataacaagcttatttctgagatacagagtggtttaaatgatcataaacaccttattggtgatgacaagctgctgtttcttaaagacagaatcatgaagcattattttgaactgtttgagatgaaaacaagtgctacaaatgtagaattcttcaagtatggcgatttgtggcggactggaggaggctttcgcccttctgaacttcttcaggttattctacctagacttcaacattcttggaccgaggaacaactttctgatatttctaatcttggatatacatgtcaacaagctgaagaagcccttgcacaaggcatggaaaaactccaggaaacccttgataaagccacagaagcaggtgacaaaggatttcaggtgacatgtgtct

SEQ ID NO: 13452 - DNA, 563 bp, Lotus corniculatus
  Predicted polypeptide sequence is orthologous to G571
ggagaaagagaggggaagtaatatataccattttaaaagaggacacttaatttataattcaagagaaattaaagaaactacaagaaaggtcatatatctagctagctagccgcacattggcagctatatggaatgtaacattgctaccaccactcactattcttggcgagggcgagtcaaccacagagaactcagtgctcgtagacgatggaagtactcagatattgccaccaaacacctcgccgcttgctgtgttgttagcagctggtggagacggtgaagggtctggtgcctaagattatctgcctgtctcaaaaagccttcaagagtggagagcttgttcattgcaacagccatctgtcccatgtagttagccatgtttggaggacaactcaaggagtcagatgttatagtatctgagagagaatggttaagagcttcaagtccttgagaaagagcttcttctgcctcttgtgttgattgttgcaatccacatattccaagtatttgttgctccgtgagaggctcaatttgacttagaataatcttaatgagttcagatg

SEQ ID NO: 13453 - DNA, 532 bp, Lotus corniculatus
  Predicted polypeptide sequence is orthologous to G571
aagcaaaagatggaaactatatatatgagttctgctacgaactatgaagtacgacgtattagctcatgatacacacggacttaatttaattcaatgttcttaaaaaaaaacaaatcatatttttttaaatacaaattcagcaaattaaaagtaaaagttttataaaaacacgatcctgcctttcgtccaatgcatctatcgtgtcatttagtattttcctataaataatcaatcaagcaagtcatcctgtgtcaacaacagttatcctcaccagtcagcacctcttcctcccccaacaatatgcttgcagtaagcagccttccattttctcagtcagtagattcaagcatcatcctacaaaggcagctgagttccttgtaaaagtgcttctcgcttagcgggcaaaactgaactcctgcttaattctatataacgtatcttccgattctgattcaatacctaaacaacagtgacatatgccacgcttgtaagaaatgttccaccaacgttagtatattgcagccatctatga

SEQ ID NO: 13454 - DNA, 460 bp, Lotus corniculatus
  Predicted polypeptide sequence is orthologous to G584, G1136
aggcagaggagggagaagcttaaccagagattctacgcgcttcgcgcggtggttccgaacgtgtcgaagatggacaaagcttcactgctaggagacgctatatcctacatcacggagctgaagaccaagcttcagagttcagaatcggataaaactgggttgcagaagcaatttgatgcgatgaagaaggagctggagaaaaccagtgaacagtcttcttctccaactccacctccacctaacaagaacaagtccttctcctcatcctcctcctcttccaatcagattctagtggaggacattgacgtgaagatcattgggtgggatgcaatgataagggtccaatgcagcaagaagaaccacccggccgcgattttgatggcggcgttgatggagctggaccttgaggtgaaccatgctagtgtgtcagtggtgaatgataccatgatccagcaagcaa

SEQ ID NO: 13455 - DNA, 477 bp, Lotus corniculatus
  Predicted polypeptide sequence is orthologous to G584
gggagtggaatacaccgcacgggatatacataattctgagataattacaatgaggaaataaatgtatatttgaagcaacagaaatttaaacagaactattgttcctaagattacataagatgcatcacctaaatgacaaactctacagtgtgtgtctagcaagtgtgaaacaatacgtagactcgcaaacttaacaagaaacttgcccgttctccagcatcttcgaagcaacaaaccttgaaggctttagcaattgccgtcaaccaaatatgggaagcaccagatacttcattaatcatcccaggcactatctgctgctccgtctcctttaatgtttgaggcagtcatcataaatttgaacttatcttcaatgttaactgaagcagctcccgatccaatgtgtttggataaaacaatatttgcctctctttgtgcagctgctgcttctttctcctttcttctagcaacctttccagt

SEQ ID NO: 13456 - DNA, 1529 bp, Lotus corniculatus
  Predicted polypeptide sequence is orthologous to G585
acaatggagacattaagcaaatgaagacagtgcaaaccatggaaactaaggctgataaaataggcctgcagaggagtgaacaactgagagaactatacaagtttcttcttgtaggtgaagctgacccactagctaaaagaccttctgcttcattatctccagaggatctctcagattcagagtggtattacttggtttgcatgtcctttgtgttctaccccaaccaaagtttgcctggaaaagcactagaaactggtgaaacagtgtggctatgcaatgctcagcaggcagatagtaaatttttctctcgttctttgctagcaaagagtgcctctattcagacagtggtgtgttttccctatcttggaggtgtcattgagataggaacaactgaactggtatctgaggatcctaatctcattcaacatgtgaaggcatgcttcctagaaatctcaaagcctacatgttctgataaatcatcctctggccatgacaaaccacatgatgaccaccaatatcccacatgcaccaaaggtgaccatgaaggtttagacaaaattcccatggagaactcatgttcctttgcagaagaactcaaatttgatgaatatcctggcagggagttacaagatgatgataacaatgaagattgtgacatggatggattctctgatggtggttgtgatcattatgaatccatgatagagggcatcaacgagggtggttcttctcaagttcattttgtgaatgaaggtggtgacatcaatggtgccccagattcctctagttcttgtgattgtaggtctgaggcttctgagaaccatggtaagaaggattctaaaaatgtaatccaaattcaacaaaaggagcttcaagactgtgatgataactcaaaaagtagctctttggatattggagctgatgaagttttgtactacacaagaactctctgtgctgttctgggaaattcatcaagttttgcacaaaatctatgtgcaagtaaatctagttttgtgaaatggaataaaggaggagtttctgaaaggaagtggccgcggttgcaacaaatgatgttaaagaagactttgtttgatgtcccttttatgcacctaagttgctcctctctcaaattacaaaaagaaaatggaagaaaagaatggacttctaaattggaaaatgctgataatttcatggggaatgtcttctctgataagaaaagagaatctagaaacattcaggtactcaaatctgtggctccttctgcatgtgaggtggagaagatttcagttcttggtgacacaattcaatacttgaaaaagcttgaggcaagagtggaagaactagaatcttacatggacactacagctactggagcaagaaccagaagaaaatgcccagatgtgcaagagcagatatcagataactatggccccagtaatatttacatgggaatgaaaaaatctaggataaacaagaggaaggcttgtgatattgatgacatagacacagggctagacataattgtttca

SEQ ID NO: 13457 - DNA, 539 bp, Lotus corniculatus
  Predicted polypeptide sequence is orthologous to G591, G793
gatacaaaaggaagagcatttcaaagtgaacttgacaagttatttccctttacatgaaattttccaagacaagatggggtcagcttgcattttttaagctattgacatcgaaccctatattgacaaagcagaaagaacggcaaaaaggaaaggacaatggcatcctactttgaatgcaacttgatgagagccaatgactaaaggaggtttggaattggaacagacgaataacgcgtgggtcccaaaactataaggtaacccctcgatggctcgatgggatcactgaaaggtgaaccggtgcctgaggtttgtctatgaaggaggagaagtttcaggcttaactatactagagttttctgatggttgtgactggtatattgctgatgctagtgagatcggcatgatgcagagtgcctttgattggagaaactgcatggcagccccaatattttcttccatgagcttagctacctgtttttctgtgccgtcatttgaccacttctcccaggctggttggttccttccaccctcgccacctt

SEQ ID NO: 13458 - DNA, 518 bp, Lotus corniculatus
  Predicted polypeptide sequence is orthologous to G591, G793
gggtcgggcccccctcgagcaatctcggctccgcctcggctcggcgactctggcttagtcggacccgacatcggacttgccggtacggctccgatgatgcttcagctcacctccgccgatcatggcaaccatcatcacctcgccggcggtggtccctttcatgcgcctgtgtaccagttagggttgagcttggaccaagggaaagtagtaggaggaggagggttcttgaagcccgaggacgcttctggtagtggaaagcgtgtccgtgacgacgtcgttgatggtagacctatgaatgtttatcatgggcagcccatgtctactacgatgcctgctgctccccatcctccagccatgcgtcctagggtgcgggctagaagaggacaggctacagatccacacagcatagctgaaaggttgcgcagagaaagaatagcagaaagaattagggcatagcaagagctggttccaagtgtcaacaagactgatagagccggcatgttagatgagatagtgga

SEQ ID NO: 13459 - DNA, 458 bp, Lotus corniculatus
  Predicted polypeptide sequence is orthologous to G592
gcaaatgatctatttgatttattgtttatgtgattgaaatccccaattaccttaaagaacctcaatattgtagcaaaaagctaaatgctggctatctgtgttacactcaataaagaaaatatcatattttttcagtttttttctacttagttttttgctcttgtagatttgacacgatgaacggatcctatccatgtctacacacttcctttattacctgtacaaaagaaactcaagcaatttgatttgattctgatgtgtgcattcttgtacatttgcatttagctcgtttttcacttagagtcttgaattgtttctgaagatcattaatgtacactgcagccaagtccaacatttctgcagtgctagtttgcttgtcaagatttggaacaagctcttgcaattttcttattcgttcactgatcctagttcttctcaccctttcggcaatgcttcga

SEQ ID NO: 13460 - DNA, 614 bp, Lotus corniculatus
  misc_feature (115)..(115): n is a, c, g, or t
  misc_feature (217)..(217): n is a, c, g, or t
  misc_feature (585)..(585): n is a, c, g, or t
  Predicted polypeptide sequence is orthologous to G605, G1944
ccccctttttttttttttctttttttaataaaaataatgtcataaattatatttatttaaataaactaacaagacattttaaataatccattttatttttaactaaataatcttntgaaaaagtcttcattataagtgcaaatgtttcgaagcgacccattaagcatccgccatggctgtcattgcagaccaattatctcaacggagattagacatnggaatagcagacacaggaacagctgcagtgggtcttgatcttatctcatatggcacaaaactgcctacaatcacctgcacgggagttgcagccaccaacataccagctaatgtaccacctgcaacacgtccatctggacttgcaaaaacaatgctcatgttgccagaacggccaagtgtttccccaccactttcatgtggacagaaatggcctgataatgatagaatcctaaactgtccctcatgggttactgtcctagcagaagaaccaggctggttaagggtgacagttgatatgtgtcccactgcagagagaatgcatatatctcgcggagttggctgagagaataccattatctccctaaaaanattctctccagaattgatggtgatgagat

SEQ ID NO: 13461 - DNA, 518 bp, Lotus corniculatus
  Predicted polypeptide sequence is orthologous to G605, G1944
gcaaatttcaagcagctttggaaaatcccatcagccaacggaaaattttcattgttctggtttggtcaaattggcttgagagtggtaattcaatatatgcatggaagcaagagaaggtatcagttctggggttacagtgataggagcagaagctccatcagcttatcatgtggcaccgaggagtgaagctccgaaccaagttcatgtccctgcaccagcatcagcaggtactgctgcagctattgttggctcaccggtgagtgtagggttggatgttacaattaagaagaaacggggtagaccaaggaaatatggaccagatgggcctgtctccatggcattgtcaccattgccaatctcatcttcagttccgccttctaatgactattcatctgggaaacgagggaagccacgcgggatggaatacaagcagtcgaaaaaaattgggttggatcatcatctaggtgacttgaatgcatgctctgatggtacaagctttatgccgcatatcatcactg

SEQ ID NO: 13462 - DNA, 515 bp, Lotus corniculatus
  Predicted polypeptide sequence is orthologous to G616
agacaatatcaaacaattactagaagtacaagactatatcaacactcaagtagattttacatttctccaaaacacataatgaacttgaacgtacaaaccaatacaaatgtccaaatactgaatgtaattgaatgacttcaaaatgatcccacaagaaatacaacacttgatgacaaaaatgtatcatctgttttggccaaggcaagctttgggactcaacttgctcttagtactctccttttcaaatccaggaagaaaatggagcaaaagattgtgtcccggagctcagtttttagccttccccttctgatctgaatgccggcatccgtcgccatagtaaagctgcaagctgccgccatcaaaaacaggtgaaaactgaaggttgtggtggtggtggtggttctccatggcaggagcagtagcagctgctcctccaaggaagaatggtacagtggatccgtctaaaggtgaaaacctttgcagaaaagacggagaattggactgaagggtccccc

SEQ ID NO: 13463 - DNA, 531 bp, Lotus corniculatus
  Predicted polypeptide sequence is orthologous to G620, G1821
ggcagggttgatgagggaacaggaccagtacatgccgatcgcgaacgtgataaggattatgcgaaggactcttccaccgcaggccaaaatctccgacgaggcgaaggagacgattcaagagtgcgtgtcggagttcatcagcttcgttacttccgaagctaatgagcggtgccagaaggagcagaggaagacggtgagcgcagaggacgtgctttgggcgtttgggaagcttggcttcgatgactaccttctccctctcacccttttccttcaccgctaccgtcacactgaaggcggacttgtcatgccaccaccgccaccgctgccgcagccagcgccagggtactactacagggatgatgatgcctctgcttctggctcttcaattgcaccatttgattctctttttcacctaaagcgtgatcctgatgatttgatttgatgtgagaaattagtttaagagaaaaaccaatgcatgcagattcaggtgagagtagtgtttctagctagtacatttgcatgtccctgttg

SEQ ID NO: 13464 - DNA, 550 bp, Lotus corniculatus
  Predicted polypeptide sequence is orthologous to G635
accaaaaaaaggtcttagccttaggatttagttaaaaacttaaaataaagtgacacgttttggtgtaactaaaaatttgacatcactacaattaattatgacaaatattagacaaataaataaagaaaagggagacttttcttttatgttctctatccctacagccctaaaaaaaactatggacctaaatatcattaggccatgttccaagaatcatgcaactgatggattatcttcttggtcaccatgctcaaacatgccatcaattttattgtagaaatttgtcctacatatttcttatcctgtccaccgtattgtaatcacttggttgccggtgtttcctcattggacattgccctttccatgtcctcacgatactgccaacttttattgccatctgtattcttgatctcctcatatttcagtaccaaagatgtccacagagatttgcactgtccaggacttctgctgatcccatcagccaacaaattttgcgatatctcttcccagagagccatccttcccttcacaacttgaaatctgtcgcgta

SEQ ID NO: 13465 - DNA, 417 bp, Lotus corniculatus
  Predicted polypeptide sequence is orthologous to G652, G1335
caggttcaatgaccagaagggtttcggattcatcacccctgacgatggcggtgacgatctcttcgttcaccaatcggagatcaaatccgagggtttccgatgcctcggtgaaggagaggacgtcgagttcatcgttgcttccgatcccgatggccgcgccaaggctattgaggtgactggccctaacggccaagctgtgcaaggaactcgccgcggaggcggtgctggtggcggtggacgcggaggaggcggttatggtggaggcggatatggcggaggcggttacggtgggggaggacgcggaggtggcggatatggaggaggaggcggatacggtggaagcggtggttatggtggtggcggtggatacggtggcggtggacgaggaggtggtcgcggaggcggcggtggtggtgc

SEQ ID NO: 13466 - DNA, 419 bp, Lotus corniculatus
  Predicted polypeptide sequence is orthologous to G653
aggataaatgatttccttactctctaagaatacaacagcatccagtagagaatacaacaaaaggctgtcatcaacttggaaagttagatcttgcaaatcacgctctcattggtcattactgaatgtgcattggataaataaatcacacaagaaatccacgccagacatagaaggaaatatcagaaaaggatcaagtcactatagaacaattgaaaaaaaaaggccacacatacaaacacttgattgatagaccaaatatcttctttaaaaaaattgaaagcaatacaagacaccaacaatcaagattctggaactgaggctgctgcccttttgattgatgcagacttaataagatgattatagctccctttctccttaaaaagctgagagaaatgatgcttgcaatacaaaatgccctc

SEQ ID NO: 13467 - DNA, 487 bp, Lotus corniculatus
  Predicted polypeptide sequence is orthologous to G653
gaattcggcacgaggttgaacttgctctgttctgtgggtatatcttttatctttacccttcaaaatcttcttcttctttagctataaagcttcaatctttagatcacacccaccttcccgatccaccatttcccaattcattctctcttcgcaagatctagaagccacagcgatgtcttttcttggtacccagcaaaagtgcaaggcttgtgagaaaacagtgtatcctgttgatcagctttctgctgatggtacttcttaccataaagcttgcttcaggtgctctcactgcaaagaacattgaagctgagcaactattcctcaatggaaggtgttctttactgcaagcctcattatgagcagcttttcaaggagactggcacattccagaagaacttccagtcgcctgcaaagctagctgacaagaatactcctgaactgacaaggtccccaattatagtgcgggcatgtttctgggaaacaaaaa

SEQ ID NO: 13468 - DNA, 574 bp, Lotus corniculatus
  Predicted polypeptide sequence is orthologous to G670
agatttaaagagattaattatacatataaaatgtgaatttaaatttgaacagttcaatcttgatcaagcagctatggaactgttattgcagtggctttattaaaatgtaactgcaggaaagtcatatccctttctaccccagaaccaaacatgctatgtattatgagcagagatcccttggagcctctaaaatctttcttcatgtcaaaacctgctgctatatattttcaaaggctgctgttagcttctggaggtccttggaaaagatactagaactttgggaaggttcttcttgctgcttggaatgaggcaacatggcccctaaagtatcaggcaccaaatgcttggaaggtgtttgattttgtgcagcttccagcattaacattgggttttgaaggtactcacaccacttggcttcttcagtagaggagctacaatctgtcaaaccccaagaagaagaagaaaggatgttgctacttgacagctctctgctgccaatgccatcacttgtgttgctgctattgctattgttggaagcactggcttcccagtaattggatccattcacagcaaa

SEQ ID NO: 13469 - DNA, 516 bp, Lotus corniculatus
  Predicted polypeptide sequence is orthologous to G715, G1646
ggaataaacggttcattagctgatgatcaaacatgttacacgcatatgcacagaaggatcattgttcaattttaaaattttgtacataaagtagttaaatgatgttgatcatcaagttaacaggttcataatgtcatcccataaaaatttggttaacaaaaccatttctaaattgcaagcaataaaaaattccaagcaacattgcagaagtccagaatcttcatatctcctgacagttcatcgccattattgtcactcagctctgagaaccgtcgagattgggctgcccactggtgccggcggtgccgtaagagccgtcatcggcggcagtctgccaaacagactgccaagcctgtgatggtggctgaacatacaccccagtagcaggatccatcgcagggcggccaatcatcatcccagcaggctgtcccatgggcgggtagtagtacggaacgccgctagcagcggcggcgacgagcgacgcttcctccttgatctcatccctaggaacgatat

SEQ ID NO: 13470 - DNA, 516 bp, Lotus corniculatus
  Predicted polypeptide sequence is orthologous to G715, G1646
aataaaaggttaaaatttcactagcacacagtcgaactatatatgttaatgtctgcattgcatgtaagctatcagctacattttctaatcactagggccttctcagatcccaccatccaatttttcgtccccaagtctgcaactgataactaacaggcatcagtaatcttaatatccatgaagcttcaataacaggtagctaatggtctggagatgattgttgttgctctggcggttggagccacatttgtggtgccatgaagggatcaggctgcatagcatacatattcgggtccatcacaggtttatgcatcatgacacctccaggtccaacttgctgtgcatgttgaggcggcatatagcaataaggaagtccatcaccaggcccagcaacaggcattgctcctccgggcattgttgcaagcacttcatctttcaggtcctcccgaggcacgatgtcaaccaagaaatcaaagatatcagttcttgtgatggctgcagcaatgtcattcttct

SEQ ID NO: 13471 - DNA, 541 bp, Lotus corniculatus
  misc_feature (87)..(87): n is a, c, g, or t
  misc_feature (102)..(102): n is a, c, g, or t
  misc_feature (479)..(479): n is a, c, g, or t
  misc_feature (522)..(522): n is a, c, g, or t
  Predicted polypeptide sequence is orthologous to G729
ttttttttttttttttttacagaagaaaagagaatgctataaccaaaataaaggttcaatttcttccccttctctctctcactttcntgttcttctacattntgctgctacatcagcttcctttcctccacctcaccaataaataaataaaattaaatacaagaaaatgctaaacaaaactgtccatgagctcagaaaacttccaaaaggaacttcattagtagaactatgcagagaatttcttcttctctttgacaccaacttatatatatctaattaacaccaccttggtggattataatcaaattaatgcaaaatagagacaattaggaaaccaatgaaaaattagctaggcttgtcctttgccattccaatctggtcttcctaatgtgaactccaagcttggattcttacactctaaattagatcctgacaaattgttcttgagttgggttgaatcacacttctgaatttgatgncctcctgaaattggttgtgattggaagattgttggtctaaaancttctacttcgttagaact

SEQ ID NO: 13472 - DNA, 425 bp, Lotus corniculatus
  Predicted polypeptide sequence is orthologous to G732
ctgatttctgattccccttcttcttcttcgttcccaaaaccttgttcctccgatttagggtttctcagtttctctgatttgaattgattcatatagcaaaaaatccccaatgtttacagagtttctatgacgctcgtcaaccccatgcgtcgaattcgtctccaacactccttctccgttgcattcctctactggttctacgtcttctcatgaactccctctccaccatcgcttaatctctctaatttcccctttctttcaattttgctaccaattagatctaccaaaccctaatttcacaaaaaacaaaaaaaattcaccggaaggaatggcttcggttcaacgcggttccagttcgggatcggaaggcggagatctggctattgacgacaggaagaggaagaggatggtgtcgaaccgcgaat

SEQ ID NO: 13473 - DNA, 466 bp, Lotus corniculatus
  Predicted polypeptide sequence is orthologous to G735
ataaaagtatattttatccaaaaaaagatataggggtcaggggcactgatgaatagtgtcacgtccccaaattaattgacaatgttgtcaagaagaataggcctttactgataactaactgaaataagtatttttagaataatttcttgaatagagcatccataagatttgccttgggctactactattactgctctccatgagaaggagctccacatgaatccacaccaccacgaatccgcttctgaagatgttccaagctagccaccctctgcaggggagcagctgcttgacccatcttgttcccacctgccactgctgcaccattctgctgctgcacattttcaattgaagaaatgtcccccaaaccattgttgactctcagatcaggtctgggcataggattattagacacaggccgatagaatggttgatgatgtgagttatctggcacaggaacagctgc

SEQ ID NO: 13474 - DNA, 430 bp, Lotus corniculatus
  Predicted polypeptide sequence is orthologous to G748, G1900
ctctagtaaaatacacttccaaaaatattaacaaatgtacatgaattcaaactcatcaaactaagtacattaaaagaacctattctaatgaagggaaagaccaaaatggtccccaactcacaagaactctcctattcaggagttctcatgaaagttaagggatcttgacaatgctgcagggttagcccgcaacactgaagagtctacatggttcttttcatcaccctttgttgatttgaaggccttaaacatgcttccaccactgagtgactcattcttgattcctagagttgcccatatagaactcttggcagcttcattcgggtcatcaattcttaatgttttcggagtcaaaacagacccgtttctctgctttgatggttcttcattttgcaaagagtccttttcactcacatcatcaacatcccta

SEQ ID NO: 13475 - DNA, 540 bp, Lotus corniculatus
  Predicted polypeptide sequence is orthologous to G760
attcaagtaattaataataataataatatatactaggatatgtatcaaagaccggtcactctaagttggcactctgaaacaaaaaatgtatgtaaaggtgaatatgttacaatgaaggtatagattagtatgactaaactaccacaaagaaatctacaagttcatgggatcctaatcataaaatgagcgcgatcaacaacacaaaataatatcctaacagactggtggagcttactctctcatagccaaccttacagttgtcatttagcagtatacatgtagcttccaatcttgaaactcagtgagagaatcagaaccgaaaaccccatcaagtataaacagccaggtgacaacacacatgtagtcttgctagagaccaagtcagaaataggcatcaaagaatcagagttaaagtcagattgagaaaacccggaagacattatggtggcattaaatcctccattcttgcccaccatccaatccatcgcattgcctcttaaagtaatgtctgttatgctgatcatacctgctatatgggtg

SEQ ID NO: 13476 - DNA, 615 bp, Lotus corniculatus
  Predicted polypeptide sequence is orthologous to G773, G1412
atgggtcgggcccccgcaaacaaaaatgctctctttgaactcttcttaattcttatccttcaattcttcctcatcatcgtgaaatctcagcagaatgggagttccagaaaaagaccctcttgctcaattgagcttacctcctggtttcagattcttccccactgatgaggagcttctggttcagtatctctgccgtaaggttgctggctatcatttttctctgccaatcattgctgaaattgacctgtacaagttcgacccttgggttctaccaggcaaggcgattttcggtgagaaagagtggtattttttcagccccagggacaggaagtacccaaacggttctcgacctaacagagttgctggctctgggtattggaaagccaccggaactgacaaagtcattaccactgaaggtagaaaagttggaataaaaaaagcactcgttttctacattggcaaagcaccaaaaggcaccaaaactaactggatcatgcacgagtatcgccttctcgactcttcgcggaaacacaaacttggcagctccaggctagatgagtgggttttgtgtcgcatatacaagaagaaatcgagcacgcagaaggaagcggcagc

SEQ ID NO: 13477 - DNA, 455 bp, Lotus corniculatus
  Predicted polypeptide sequence is orthologous to G773, G1412
ataacattttagtttggtttcgaaaacaaacagcatcatcatcttctatctaaacccctctcttcttcttcttcactgaatgacaatggggattccagagaaagaccctctttctcaactgagtttacctcctggtttccgcttttaccccaccgatgaagagcttctggttcagtatctctgccgcaaggtcgctggtcacaatttcactctacccatcatcgctgaaatcgacctctacaagtttgacccatgggttcttccaagcaaagcgattttcggtgagaaggaatggtacttctttagcccaagggacaggaagtacccaaacgggtcacgacccaacagggtagctgggtctgggtactggaaagccaccggaacggataagatcatcaccaccgaaggtagaaaagtcggtatcaagaaagcccttgttttctatgtcggcaaag

SEQ ID NO: 13478 - DNA, 573 bp, Lotus corniculatus
  Predicted polypeptide sequence is orthologous to G778
gaacaaaacaacaaatattttattcaagttacaatagaaagccaccgattcttaataaatttctcatccaagaagggcagtgtaaatactatgctattgtttcacataaccagctttggagctaatatgaatatttctcatataaagaataaatatgcacacatttttgctgcaactcagcaaacatctcaattctttggaccagaagctggaggctggtgcagctgttgatacatcgcagcaagcctactataggcttccatgttcatgggctgtgattggcatccgaaaaatgtggacatagggtcaggcatcatggtggctggaggtccttgaagccggtcaccgccggttgcggctgtcgcagcatcccatgaggccatgggcatgaaggcagaagggtggaggactggaggcatgccgggcatgttagcccgattcatggtgttcatatccatccccattcccattcccatccccatacccattcccatccccatgcccattggccccattatcgacatttgaagttgttgttgcatggtcatcgggagcatcatggatgacatgttg

SEQ ID NO: 13479 - DNA, 604 bp, Lotus corniculatus
  misc_feature (213)..(213): n is a, c, g, or t
  Predicted polypeptide sequence is orthologous to G791
gtacgggccccctcgacatcttttcaccttcctcttgttgtcttcaactcccaatcgtgcaagcaagcaaaccctctcatctcaaataatccctgtttgtttcccaggaaaataacaataacaaacaacagataaagtaaaagcgtttttctctcccgagaaaattctccgggaaccgacgccgcagaatggtttcccgggaaaacaccaatnggctcttcgattacggtttgatcgacgatattcccgcccctgaggtcaccttcactgtccctccctccggattcacctggccctcctctcaacccttgaattcctcttccaatgtcgtcggtgttgagattgatggctcattaggggattctgacagtctcaaagagcctggttcgaagaagagggtcagatctgagtcatgttctgctactagctccaaagcatgccgggagaagttgcgtcgagacaaacttaatgacaagtttgttgaactgggctccatattggagcctggaagacctcccaaaacagacaaggctgctatcctgattgatgctgtccgaatggtgactcagttaaggggtgaagcccagaagatgaaagacactaa

SEQ ID NO: 13480 - DNA, 575 bp, Lotus corniculatus
  misc_feature (57)..(57): n is a, c, g, or t
  misc_feature (68)..(68): n is a, c, g, or t
  misc_feature (109)..(109): n is a, c, g, or t
  Predicted polypeptide sequence is orthologous to G831, G1202
ctttatgaacttttagcaaagcattacaggatagataacccaccaaaaaattctttnggggccataantgctggggaaaaaaaacttcactaagcaccacccataaatngaggctggaaaagaatagaattcctgaaaaaattatgacaaataaagaaaaatacacaaatcttgagccaaaaaagcaaatcaaaattacaacttcctttgttggcttgggtcaggtagtggggctgtccagtactgtttcactgctacaagtattttctctctttggtgaggacccttttcatggtctgcaattctggtatcccattgcattgtatcagcaaacctcttcaccttaagcaacacatccacatcatcgcgcaagatcacactgccttgtggccgcaaaatccggtccatctcaagaagtatgtcctctatgttgcatctgttctggtagagggtgaaaactgaatcaccatgtatgaagtcataggttcttgggtaggtggacatggcttcacaccagttctgataggttccaatcaatccacgttcatatatgacaccaagtgtgttgatctcag

SEQ ID NO: 13481 - DNA, 560 bp, Lotus corniculatus
  Predicted polypeptide sequence is orthologous to G839, G1196
aactaatggtcgatcttatatattttatttctttctcaaaatttataacatacatttatcaactaacatgaggtgatggagattattttcaaaaagcatattgattacaacatagcaagagatcactatttctgctttcaccattatacagatgagttggaagttataaccttaagctataaacaaagacactaaagctttttcacacttttctggccttgtaatatagaatctctgagggatgatgaggaagatgaagatgaaatcccagagcggctaaacacagccttgtccttgttgaaagccttgttgacatcatctttaagctccatgaaacgcttcctctttattctctgctcttcttgggtacccttttcaaggtagaataagtctggcaaatcatcctccatgaacttatctagcacttctgagcaatgaggaaagtaccgccgccccatctccactgttttcataagggcttccatcctagaaagaagtcttttgttctgcattatgggagtctcattgagatcaacctctcttaagtttccatttgaacc

SEQ ID NO: 13482 - DNA, 548 bp, Lotus corniculatus
  Predicted polypeptide sequence is orthologous to G846
gaaagagaagaaaggttatctattatttacaatcaaaacaaattctatgtggctgtctatgctgctgctccctacgacctatacaaatatccaattaagactacctcaaaattttatccaataaagactaactcaaaatttcagggtaaacgactgaatcatctagatcactctgaacaattaagacaattcacacaatcttcatgtcaggtatcaacagaggccatgttagaaaatttggctgtttttttctgctgccacaaaaagaacaacttagatacgcctgctcccagggaaaaaaaatcaccagttcaaaaaattaaaattatatctgtaaggatgtataactaatcacatcatgaacaagtatttcaaatcatccactgtaagacggcttggaccactaccacttccatcctctccaaatgcagatgaaaccatctttcgcttctttggctgtagagctaaaatacggtcttcaaccgtatcccttacagttaaccgcaaaactgtaacaggacgagtctgtccaatgcgatgagctctgt

SEQ ID NO: 13483 - DNA, 531 bp, Lotus corniculatus
  Predicted polypeptide sequence is orthologous to G852, G2633
gactataaacttagaaattctataaggaagataaggatgatacataagctaactcaaagccagcagtaacaaaaatgaactgactgtcactggattttcatctccaagcacaagaggcaacaagaacttgattcatccaaccaagaaacagtgcaccatctctctcttctaaggtgtaatgtccgcggtagctctccagaagatccttgattgaagaatttatataggagttcaatggataaggtgtaaatccagcactggcgaaccgcattctccacttattcagaagttcatgacgttccactctctctgccccttcacatgctactaagttgacaacttcgcgagccaaacaatgctgttccacattgatcctctccttgtgctcccttggaagaacaacatcaattgattcaaaaacagcctggtagtagttcattgtctcaacgaaacgctgcaagaacggagcgttgttagtattgaattcctgctccaccagagtgactacctttggagacaaacacttagcca

SEQ ID NO: 13484 - DNA, 567 bp, Lotus corniculatus
  Predicted polypeptide sequence is orthologous to G852, G2633
ataagtgatagtttgttatatatattaaatactatcaaacaaggaaacgaaatgaacaacttgctcatctctgcatggaatatttgaagggggaaggaattaaacaagaaaacaaaacaaaatgtgaaattaacagcaaagccaacgaagcaagaatataattcaagctaacaaaggctttcttttttctttcattcagaatttgacatttacagcaagttttgagattctgctagctgcagtacaacaaacaaaatggtacatgtctgaacaaagctaaatctcaagtcctatggagacaaactgcggataccatgtttatgctaaaggtacagataaaaaaagtggccagagctcaaaacattcagtttcacctccaagcagaagaggtaaccagagctctcttcatccaaccaaggcaaagagcaccatctctctgttcaagcctataattatgattgaagtccctcaaaagattctgggtagcagtcataactgaagaactcaacggccattgtttaaatccagccatggaaaatcttaacttccacttcccaaaaagctcat

SEQ ID NO: 13485 - DNA, 510 bp, Lotus corniculatus
  Predicted polypeptide sequence is orthologous to G852, G2633
cataattttgtgattgacataattttcagacacaaggtctacaaaacaaaacagtgaacatgcttacatgcccaaacattttgtaaaagaattaatatactacgccactagtacatgagactctatatggacaaatgtaacaagcatagacctataaaacaatgaaatatgacatagcactggctcagctagcatgaggttttccatcatcatgatatttctacaattactactactacactattccctatctatgttcttatcaatgccatgctgaagctgatatcaaacttctgttcttccaccccaacagcatggcaccatctttctcaattagtgtatagtgttctgaatagcatctcagaaggttttttatcacagaattcacataagaactcaaaggagattgacgaaacccagccatggttaacctagacttccacttaccgaacagttcatgccgctctaccctttccttcccttcgcaagcaatgacattcacgacatccc

SEQ ID NO: 13486 - DNA, 494 bp, Lotus corniculatus
  Predicted polypeptide sequence is orthologous to G861, G1140
cgaaaagaagggagagaagattatgaatgagatcaatggtctccaaataaagggaaagcaattgatggaggagaacgaacggctaaagcgtcacgtggctggcatgattagcacaggcttaatgcatggagatactgagtcagaattgttagttatggaagaaggtcattcttcagagtctgttactaacgtttgtaactccactactgggcctcccttagaggatgatagctcagacacgtcgctcaaactggggcttccatactaaggctgaaggaaaagtgtgtggagttaaacttacagggcaagatgaacaaatattaatgtgaatggtctttagtggattaattggtggtatagtacttctatattagtaatgacttttggaggtacgcgagatatgtcattgagaaattgataagatgtaattatttcccaactaatgttctaattcgcattataattaaccaggacaatgtggtatccttcctttt

SEQ ID NO: 13487 - DNA, 570 bp, Lotus corniculatus
  misc_feature (534)..(534): n is a, c, g, or t
  Predicted polypeptide sequence is orthologous to G864, G1421, G1750
tttttttttttttttacaaaaaacaaaaagtctcatccattcattccttaaaccataatagtcactactacttgagtacaccaagtaccacaaacaaaaagagattagtaattaaactgattacagtcattatactaatttgctgtcgatacaaaatttgccggtaaagaggcaacacaacgacaagccataatatccatccatccattcttgttaactgctaataaacccatcaaatcaaatcaaagaacaagaagcggatctgaaacaaacaaatcatcaatatcttggaaaaagtcacggttgctattcatcgtagtagtattattccaactattgaatccgaattccaaatcctcaaacaaatttgtactcgagctgcagcaaccaccatcatcttcgaaaaacatgcttctttctggcaacacatcattgaagctgttgtttccgtacaaaacatcttgaaactggacgtcaaattgcatcacatcatttggaattggaaacagtgattcagattcttccatcttctcntgtgttggcaatgcaatcttttcagtactcaaattc

SEQ ID NO: 13488 - DNA, 505 bp, Lotus corniculatus
  Predicted polypeptide sequence is orthologous to G866, G883
ccaaccacaaaaacaaaactgtatatttcattctaatttttttggtcaaaatttacattaaagtccttgattaatttcttatcatcaacttgtagacgactattcctctttcctttggtccacaaaagtcacatctcacaaagcaaaagttgactttgcctatacttgtcttcctcggaatctccgatctattctcaggccataaaaccaacggcggcggtggtggttatcaggtgccggtgctctccctcataggtaacgatgagcatgttaggatcatcctgcgctctctccacatgcttcctcgccggacaccctttctcactgctacatttgtagtatcccctgcaacaaaaaccaaatcaaatcaataaactactactcatttccattcaattagtattattcaaaatgcattgagattgatgtttgactttgaccaattcatcaagattgaaaatatttaccgtggatagggtgatcccttgatcggtttctgaccata

SEQ ID NO: 13489 - DNA, 537 bp, Lotus corniculatus
  Predicted polypeptide sequence is orthologous to G866, G883
agtccctaaaagataatgataaaatcttttcaaccaaaacaaatttacattgcaaccaccacctcggttccaacccattcatgtttttttccctcttttacctactactcccaataaaaaaaattaaataaaaaaattcccaatattttttcccttcaaattaccaccttacgttgactcgtatacgaaacccacagcaccagaaatgttatcatgcatcgcggtctgaatcccatgatcgtgctcatcctcgtacgtcacaatcagcatcgccggatcatccgttgcccgctccacgtgtttcctcgccggacaccctctcacggtgctgcacttgtaataaccacgtgggtatggtgtgcccttgatcggtttctgaccgtacttcctccatgagtactcgtccgccggaatatccgccaccttcgaactcaccgccggcacccttatcgtcttcttcacccgattcttccttctcttggtgcagtggcacttggtgttggagccggagggatcgccggagtgctcgtggcacct

SEQ ID NO: 13490 - DNA, 565 bp, Lotus corniculatus
  Predicted polypeptide sequence is orthologous to G866, G883
catcaaatttgacaattttctttcaataaatagaaaaataattcccaacatgccaaagaaaaaaaaagatatattcattttttgggtccaatatagtgaatttacacaaaagtcctcacccacttttacacaactccgtcaaactctttacaatgagaaagttgacttttgctccgtttgttccaccgttagttcaaaacctttgttttgacgcttcaccgtaaaagccagccggggccgccgttaccgtcacggaatgagggacccactttaacggtgccgatgacggagtttccaaaacgacgccgtggatcagctcagtttgaccggaggctaaaaccgacggcggtttgctgttgctggtggcggtgctcgccctcgtaagtcactatcagcatgttgggatcatcctgagctcgctcaacgtgcttcctggccggacaccctctcacggtgctgcacttgtagtagcccctgcaaaatcaaatcaaaccaaacatcagtgaccatcatttttcaacgattaatcatctttcaagcactaattagaggggaaaaccccgaa

SEQ ID NO: 13491 - DNA, 550 bp, Lotus corniculatus
  Predicted polypeptide sequence is orthologous to G866, G883
aacaattatatataaataacttgagattccaatcttcaacctctctataaaaataataaaataaaacaaatttacaacgcagcccccaccataccttccttccactcaaatcctttcaataaaaaaataaaaattccttttcttttgaaaaagacctccattaccacccactttttttttcaatattatagtattccaccatctacgttcacgttgactaaaaaaccaaacccacaaccccagaagcgtcctcgtgcatcgcggcctgaagcgcgtgcctgtgctccccctcgtacgtcacaatcagcatcgttggatcatctgtagcacgttccacgtgtttcctggccggacaccctctgaccgggctgcacttataataaccccgtggatacggcgaacccttgatcggtttctgaccgtactttcgccacgagtactcgtctggcggtatatcggcggtttttgaactaatcgccggtactctcacggtcttcttcacccggtttttccgtttcttggtgcagtggcatttgctgttgccagaaac

SEQ ID NO: 13492 - DNA, 448 bp, Lotus corniculatus
  Predicted polypeptide sequence is orthologous to G866, G883
ggcttcaatctctaaacattttctccttcttatggcacactgaaactgggtcttcatataattccctcagtccctatctccattcacatcaaatggcagtggaactcatggggttcccaaaactggatgagcaaaaggccattcaggaggccgcatcagaaggcctcaggggcatggaacacctgacccgaaccctctcccatcaacccacccacttaaacactcacctcaccgacctcaccgtttccaagttcaagaaactcatctccctcctcgaccggaccggccacgcccggttcagacgagccccggtccacccaccaccggttcaccacatcgcaccttcttctacctcctcctctcttccttcactgcaaccgctaaccccgcccgctcacttcgccgctccggcgccggtctccatccgccatgcgccggcgagcttcgt

SEQ ID NO: 13493 - DNA, 393 bp, Lotus corniculatus
  Predicted polypeptide sequence is orthologous to G869
agctctgatgctgaggcttatgacatggttgctgaattggctggtctagaaataccagacttgagtcttctgacattgcctccatcaccaccaccaactgttgctgatgttgttgttccaactggctctgagccaaaccctgtgcttgattttgatttcatatttgattgtccaggacagggctttgatgatgataccaaccttggtggtggccttgaggatatcccattttttgggtttgacgataatgtgcctagccagcttcctgatttcgattttggtgattttggttctgatgagtttgctggttgttttgaagaacccttccatataccctgcgcctaaagttttgcagctattacataggaataaaaatcaagagtaatacatagt

SEQ ID NO: 13494 - DNA, 503 bp, Lotus corniculatus
  misc_feature (418)..(418): n is a, c, g, or t
  misc_feature (451)..(451): n is a, c, g, or t
  Predicted polypeptide sequence is orthologous to G877
aactacatttaccttttaacatgtgaggaataatgtcacacattacaatgatatagtaatgaggagtctacctgtgtatagcctgagcattaaatacatatatatatgtatgtcataaaaatttaaacattagttttctttaaagaataagggaataaaattttatctatgaggtccaagaggcatgcgactcatcatttcctgatatactgatgagtctcgactaggcatgttaaggccaccacgttcaggcataggctccacatttggttctccctttggcaacatgaaccccatttcatttgcagggcgctgttgtgccgaaaatggatgaaaaggcattgactgaattgccatgttcgagagcataggttgattcataccaaaggagaagccatggggaggtcctaggtgctgnctcccaggaaggttgaatgagccaagggaaggnctctcaagtcttcccatgctgttgtgaacttgggatggttcaggtctatgaa

SEQ ID NO: 13495 - DNA, 499 bp, Lotus corniculatus
  misc_feature (320)..(320): n is a, c, g, or t
  misc_feature (396)..(396): n is a, c, g, or t
  misc_feature (405)..(405): n is a, c, g, or t
  misc_feature (422)..(422): n is a, c, g, or t
  misc_feature (465)..(465): n is a, c, g, or t
  Predicted polypeptide sequence is orthologous to G881
gaaaccgacagacttttctgtttcttccactctagttaatacagaattaacatttcaaagtcgtccatgaatttcacattttcatcacaataacacaaacctccggtcaacccaagactcatctcaaaggaggaaagtacatactacccatttaacacaatctgtgagagatgaggcaaaggacctaattaagtcagtcagcagctatttctaatacaatatacaaagtcacattttcaaaagataccaactgggctttatgtggcggcaagcaggacatcaaatagaaatataaattatttccccatccttgttctttngttgcccaatttccatctctgcacttgtaccagagagaattcaacaaccagaagagggttttaacagcctccaatngttagagtngtatgcaattgtccttngatcgccatgaaaataataattttcacccggagtttaaacttngaattcatcaaaccggtgactgctccaactttat

SEQ ID NO: 13496 - DNA, 534 bp, Lotus corniculatus
  Predicted polypeptide sequence is orthologous to G898
gagtcatgactggccgctctggccggtactatcactaaaaaaaggactgatggttcatgcatgaaaggggaaaatactgagcaagttatttatatctatctaccaagtatctttggatatgataaattaaataagagaatcagagaaaccaaaatgccagagtacaatgtttcttccgttctccatcctcctcaacacagcttacatgggaacctttagttagtagatgggagaaacactcttataagctctttcacagtaaccttttttctacaagtaggacatttattctgggcacttatagcagccttgatgcaagccttgcaaaaaatatgaccgcaccttgttgacatttcttctaccaaaggacccatacatattgggcagctaaagacaggctccttcggaggttcaggtggctttttaacagtttccctctgcaaaagggatatccaaatcaagtcagaaatttgaagtccattaatccttcatggtcatcaatgatgatgtcgttatttgataggtgcagcaatc

SEQ ID NO: 13497 - DNA, 591 bp, Lotus corniculatus
  Predicted polypeptide sequence is orthologous to G898
cggacgcgtgggcgctcgctcatcgttcttctccaccaacaacggttgtgacttggttggataaggggaatttgaaccaagatgagctctcgggctggcaaggggcctgctgtgaaagctaccgacggaagaagtgtttaattgatctcaaccttgctcctgcggttactgagaatcgcgagcaggaaggaccttccagtcaggtggtgactcaagaagttcaaggtgatcagcaaccaccggttgcacaaccgccacaggatgcactgccaccagaggttgcacagccaccagaggttgcacagcagccacaggttgcgcagcctccactgattgatgttgaggccattgatgatgatgatgttattgaatctagcccaagggcttttgctgaggctaaaaacaattcaagaagaaatcgtgcaagggctgtagttgatttggagtcagatgatcagaccagggtgaccaacaataatcgcaacaaacgcagaagagaaacctctaaccagacaatcattaattgcgatctcttcataaatttggaaggcactagcaattcaatgagggaaactgttaaaaagccacctg

SEQ ID NO: 13498 - DNA, 573 bp, Lotus corniculatus
  Predicted polypeptide sequence is orthologous to G912, G2107, G2513
gtttttttttttttttttttagaaaataaagtgtgtatatatctatgtgtgttgatttttctaatatccaccctaatcagtatccgtactattgaaaaaacacacaagtacggacactactccctaatttccaccctaatcaacctctttattcctcaaataattaagaaaaaaattaaactaataaactattcttttttttaatgtaataaaataaactaaattgaaaaactccacaatgaaacttcagcatctagaaattccacgtcagcagcaccatactcactcccccagcaatgtgtcggtgacatcagcgccatgtttctcagaaactccggcaccgcctcttcctcttggtccactttcaccgtcaacgccggcaccgtctccgacgactcaccacccttcctcccctcaccggtctccgtctccaccaccggacggaaggcctcagctgcctccacagcagccttccggatacccctagcatccttcgtggccggaaccggcagcctccaagcagagtccgcgaagttgaggcaggctgacctccccctaagcgcaatagccgcc

SEQ ID NO: 13499 - DNA, 410 bp, Lotus corniculatus
  Predicted polypeptide sequence is orthologous to G912, G2107, G2513
caaactcaacaccaaatcacaacacaacacaaaccaacccaaaaacacaaacaacaacaacttctagtaactactagctagctaacccttttgtgtacactgttccattcagtctaataacttcaaagaacgaaactagctttttcctcattgacatgtttaccctcaatcaatttcccgaccaggataactctgaggtatttttggcggcaagcaacccgaagaagcgagcagggaggaagaagttcagggagacgcgccacccggtgtaccggggagtgaggtggagagactccggcaagtgggtgtgtgaggtcagggagcctaacaagaagaccaggatttggctagggacgttcccaacgccggagatggcggcgcgtgcgcatgacgtggcggctattgcgctt

SEQ ID NO: 13500 - DNA, 559 bp, Lotus corniculatus
  Predicted polypeptide sequence is orthologous to G921
gttagactctagaacaaacaatttagtgcatctttagaaatcttctataattgattctaaagtcaaattcaattctcaattgaaacttttgtaagtagcttctgtgtgtcggaattgattctgagaaaagagaatgttatacaagactccaaatgtgaaagtacacttttcattgatgttgcaccctgagccttagacaccttttgcttggatgattctcttgttcattagtccattatagaatagccctttcggctataactctgtgaatgattctaaaatgtgcttttgcttctaatttcagtcaaccaatgagttggaggaggagctgaagcgggtgacagcagaaaacaaaaaattggttgaaatgctctcagtggtgtgtgagaactacaacactttgagaagccaattgatggaatacatgagcagaaatcctgagaaggagctcagcccatcatcaaagaaaaggaagtctgagagcagcaataacaacagtgatctggtgggggttaacaatggaaactctgagagcagctctactgatgaagattctttc

SEQ ID NO: 13501 - DNA, 558 bp, Lotus corniculatus
  Predicted polypeptide sequence is orthologous to G921
tgcaaagaagtgtagatgatcaatctgtcctggttgctacttatgaaggggagcacaatcatcctcaaccttctcaaatggaggcaacatcaggctccggccgcaatgtgagcctagtaggctccatgccttcttcaaagtctctcagctctcctgctccagcagttgtaactctcgacttgacaaaatctcggtgcagcaatgattccaagaatgcagaacccagaaaagattcagctaagttaccacaggttttggtggaacagatggctacttctttgaccacagatcctaattttagagcagcacttgttgcagccatctcaggaaggcttttgcaccagaattgaatggaaatttggttgagcttagctaacttagtgtcaaactgttgagtattccatagagtggatcatttttttttagagcataggatctctatgtaaatacaacatggaagattgggacataattctcactttgatcctggaagtggaaatatagagtggatcaatgcggatagcatgatcagttcagcctggtcggctcttcattttg

SEQ ID NO: 13502 - DNA, 514 bp, Lotus corniculatus
  Predicted polypeptide sequence is orthologous to G937
agtgatttagtatgtgtaagataaggtatgtaaagaaataatccagcaattaggtctaatcatgaaaccaacaaaacatgcagagactctcaacacgggactgcttctcatggggcacagtgacaacaagaaatgaaagaataattgatatgtagaaattgaccttcctcatttttaactcggagtctcaaatcaaaactcatgtagaatagaaggcaaactaagccttcaaaatttccaatagcctctctcctttgaccctcttctatgtattattattcttctgtagccgtaaaactcctcccatgtatacttgtatctgcaaaatgcatggtgtaggagtagtatcctatacataaactggtcctggtttgtgaatgtgacttctccagctataactctcggatttagtatcatcatcatcctccatgctgtcaccctcggtcggggatgtccctcccctggaacctgcagctaaatgaaggggactttgcggcgaaccggacacagaact

SEQ ID NO: 13503 - DNA, 570 bp, Lotus corniculatus
  Predicted polypeptide sequence is orthologous to G938
ccaagcatgcacttagattaactcaaattcagaacagaattcaaatcttatttatatcacagtcttacatggaaaaatcttaggaaaaacaaggctgcactaatagaaacacaaacacagggctaacattatgggaacatacaagcctttattataaacccataccagacctgccaaaagcataataaaatatctagttgtatacctagagggttggttacatgtgaagaaaattgcagtaaaaaattctggtcaagggaactaacttcacatgataagggtggccttggcctaccctttgaaggaaaataaaagagaccatgatgataaatgagttttcccaattctcagtggtcattttcagtcactggtaccaaattgaaatatctggctgtttttgatgtgcctccatgcctactccttgttgcatgtcctccttgaaatcaaaggatgccaaatcacaaggggacccaaacatcaaatggaaattattgttgctgctttgatggggggccttcaaaggagaattcaaagctctgaaccggtcaaactgattttcctctcttgcaa

SEQ ID NO: 13504 - DNA, 428 bp, Lotus corniculatus
  Predicted polypeptide sequence is orthologous to G938
ctgaagtacatgctgaaaatgatggaggtttgtaaggcccaagggtttgtatatgggataattcccgagaagggaaagcccgtgaccggggcatctgataatcttcgtgaatggtggaaggataaagttaggtttgatcgcaacggtccagctgccatagccaagtatgaagcagataacgcaatcccagggaagaatgacggatgcaattctatcggtccgactccacacaccttgcaagagctacaggacacaaccttgggttctctcttgtcagcactcatgcaacactgtgatccccctcagaggcggtttccattggagaagggtgttcctccgccatggtggcccacagggaacgaagaatggtggccgcagattggaatacctaaagatcaaggtcctccaccttacaagaaacctcatga

SEQ ID NO: 13505 - DNA, 405 bp, Lotus corniculatus
  Predicted polypeptide sequence is orthologous to G938
caggttacaggacaccaccttgggttccctcttgtcagcactgatgcagcactgtgatccccctcagaggcggttccccttggagaagggtgttcctccaccatggtggcccacagggaatgaagaatggtggccccaaattggtttgcctaaagatcaaggccctccaccttacaagaaacctcacgacctgaagaaggcgtggaaggttggtgttctaactgcagttatcaagcacatgtctcctgatatcgccaagattcgcaagcttgtgaggcagtccaaatgccttcaagataaaatgacagccaaggaaagtgcaacctggctctccatcatcaatcaagaggagtctttggctcgagagctttatcctaattattgccctccattatcctctgctgg

SEQ ID NO: 13506 - DNA, 458 bp, Lotus corniculatus
  Predicted polypeptide sequence is orthologous to G938
gtaagactgccacttcagcagccttcttttgcaatcaagggagaggctgtaacaaacttggatttcatgcggaaacggaagatctctagcgacttcgacatgatgatggatcagaaaatttacacctgtgaacatctacaatgtccttacggtgaagttcgccttggttttcaagacaggacttcgagggacaatcatcaattgaattgtccatacagaggagcttcttcaaattatggcggtccaaatttccatgttaatgaggcaaagccagtcatatttccccagtcctttgttcaacccaaatcgactgctcagtctgttaatttggttccaccttcaattgatctaaccgggctcggagttcctgaagatggccagaaaatgattggtgacctcatgtcagtctatgatacaaatgttcaaggcagcaaaaatctaagttccagtaaccgtgt

SEQ ID NO: 13507 - DNA, 404 bp, Lotus corniculatus
  Predicted polypeptide sequence is orthologous to G962
aacagctcaagctttgtttcattctattccaacatcagataaacattgaaccaaaaatgaccaacaccatatgcggtcgcctacacatacagcaaatgtaaagaacaaaaataacaatggtgattacaaaacactataaacacttcctaattcaccataataatctaattaattaagaaaaaaactatcttatatgcctcatcatcacaattatcacacactcaaacggaacattagaggccgtcattataggcttgtgcttcttctgaagctgaagccgtcgtcattgtaggcttgtgctccttctgtgtgaacttgagtctcaagtttcaagccgattgggcagtcccagacccaaatctgaaattagagcaactactctgcctcatcaaaagagaagaact

SEQ ID NO: 13508 - DNA, 487 bp, Lotus corniculatus
  Predicted polypeptide sequence is orthologous to G975
aaatagaagatcgatcttgccttctatgaatgtagcatggtaggatatcagatcaagctgcattacattaggaaaaagacaatagcatcattacatactaaagggtcatattgcataatgaggatatctatcaaacctaccactaccattacttctgcaagacacttgttccttcaattggataagcagcaaagtcaatcacttcgactcctccgcagccgaatcatcagaatcagaatcctctatatcatcttcagattcttcaaactcagatctgccagactcataggcatctgcagagggtttaaaacatgcataaggatcttctccttcatggctaacttcaatattagcaactcttcctaggaaagcaccaaagtccccatccccaagcttatgcaaataaatatcatatttcatcaacttccgacgaagttcttcgaacgacacaggccttttatatgatctcaacaatttcctaatcttc

SEQ ID NO: 13509 - DNA, 536 bp, Lotus corniculatus
  Predicted polypeptide sequence is orthologous to G987
ggcccccctttttttaccaatcatgcgaagtatctatttacatgggaagaaaaatcccatcatataacaaaagacaggaaaaaaatctttcttttccccccttttctaatgaagatgaaagttgcagattatcaaccacaacagatcaatatgaagctaataaaatgcaaagaataagaatgatggctgaacaaggagcagtcagcagtatgtataatacaataacctgcatatagcagtttaaacatcatcatcaatcctgcagtgtgacttcaccacgttctatctctttaattctggacaatagcttatcagaactaagactagtgcatttatatcctgagagccatctgcagacctcttgaaaaaggaaaatatctgccagaaagttgaatgcctatattataataaggggaagattgaacgactacagttgcttttcttaccaacttcttctccactgtcttctatctttgcgggacttttctgttcggtagtccacaaatgtgaaggcaggagggtcttttgtgatggca

SEQ ID NO: 13510 - DNA, 584 bp, Lotus corniculatus
  Predicted polypeptide sequence is orthologous to G987
cttgaaaaataactatacaaattcatccatctcaaattagtaacatattgtcaactcagtagctaatatgtctcaagagacaagtatcctgcaaaaacctatgatcaatttattggtaagaagtaaaatgccaaacactataagggccttcctacactaatacacactccttatcattactgaattagcattacactcacaagtctcaattctacaagagaagttgttctgacataattttctagagtaacttggtggaagacttttgaagaatattcatcacagcacctgatgatcaagtaacaaggagtaccagaacctagtatgagttcatcaagccggtacccaacaagtggaagcatacataatgcggcctttccaaccttgaagcatccagttgttgtcttcatcaaagacaaagtccttatggtaccatttctttaacttggtcctaaatttgtccattagtccctcatttaggggtagctgcttgaaaccagcccttgtattcctaacctgccaccttttatatgtctcaggcctctcaaccctctccaaaccttcacatgctatcacattcatag

SEQ ID NO: 13511 - DNA, 688 bp, Lotus corniculatus
  Predicted polypeptide sequence is orthologous to G1013
gaattcggcacgagcagaaatctattaagaatagcccaaatcctaggagttactatagatgcaccaatccaaggtgcagtgcgaagaagcaggttgaaagatccaatgaggaccctgagactcttatcatcacatatgaagggctccacctccactttgcatacccatgcttcctggtgggccaaccacagcaatcccagtcccacccaccagtcaagaagtccaagtttacctcttcacaagtccaagcccaggcccaagcccaggacttcatagtcaacgaagcccaagccagtgcttctgtgggcctgacatcacccacgctgctgaactctccacaagacatggcccaacaaaatttgggctcacaagggttgcttgaagacatggtgccattcatggtgagaaacccctccaacaacctcaacagtggttactcgaaactttcatgttccgcagacccttctccaacatcacctcctctgtggacttctggtcattccacctcctttcataccgttggcttgaattcaaccacttagattatatatataatgtatatgtaaagatttagagactcaataatttcatcgaggagttgttattattattttgtttatgttaatgtaataatgcatcatatgagaatatagttttttataatgcaagaaaaaaaaaaaaaaaaaaa

SEQ ID NO: 13512 - DNA, 483 bp, Lotus corniculatus
  Predicted polypeptide sequence is orthologous to G1017, G2567
aaacaaaaatatggcatttttctttatagaatgtgaaagtttacttcatattcagtctcctctagtaagtaagagtggtaactacatccttcaaacttcacaaatcaaagctaaaaaccaaagtctcatgtgccacaccatattaagcaaatatactcagaggacctgtcttatttgacgcatccaatccacgttcagcattcctagttcctgtaatcaagacccttctagtatctttgctgcctgcagaatctgtcagaatggtcaatctttttgctgtcttcatgaagtcactgaagggttcttcaccagtatgtttaacagcacctgtggagtcacggtagagcacatgactcaacagctcagacctttccattccaaacatgttggccagtctcctataaagctcttcataagaaccaacacgtgacaggtccagtgttcttcccacatcttctgactccaagaaaaccttgcaatgac

SEQ ID NO: 13513 - DNA, 734 bp, Lotus corniculatus
  Predicted polypeptide sequence is orthologous to G1020
gcacacacgtacctgcattctctcatcaaatcaatcatcatgcgaaaggcaccctcatcgaccaccgttacgaaggcgagaaacaccgccgccgcaaccaccgccgtgagcgccaagagcaagatacacaagccttccaataatgcaaccgaggttcatttcagaggcgttcgtaagaggccatggggccgttacgccgccgagatcagagatcccggcaagaagagccgcgtctggctcggcaccttcgacaccgccgaggaagccgctagagcctacgacgccgccgcccgccagttccgcggccctaaagccaaaaccaacttcccccaatcaccctccccggacaacaacaccggacccaacgacgtcgtcgtcgctaacgtcaaggccaaccagagcccaagccagagcagcaccgtggaatcctcaaccccggagcgtgacatcacgcgcggcggtggtgtggtcgtcgaccgcttccccttcctcccgctgcatccacaacaactgatgcctttctccggcggcggtgacgttgtttacactgctccggtccgcccggtgatttttctagatccggcttctcaggccgagtttttcgcccagcggttccctgtccgattcgaatcaggaccggtcgattttaccggcatgtttggcggtggtatccagagcgattccgattcgtcctccgtcgtggattgccggccaaaacctacactcaatctcga

SEQ ID NO: 13514 - DNA, 460 bp, Lotus corniculatus
  Predicted polypeptide sequence is orthologous to G1033
gttgaaggtcttctcctctttccttcatctttcagaagacggtcttggtaagggaactgagaacatgacaaagggaaagaaagctggaaagacttcaaaggaagtattgaaaccagttgatgaccgaaaggtaggaaagcgaaaggcggctgttaaacccgataagggtactgcagggaaggcaaagaaggccaagaaagatcccaacaaaccaaaaagaccgcccagcgctttctttgtgttccttgaggatttcagaaagacttttaaggctgaaaatcctaatgtaaagggtgtatccgctgtagggaaagctggaggagaaaaatggaaatccttgactaaggctgagaaagctccatatgaagctaaggctgcaaaaaggaaagctgagtatgaaaaacttattaatgcttataataataaacaggcaagtacagcggatgatgtagacgaggaa

SEQ ID NO: 13515 - DNA, 534 bp, Lotus corniculatus
  Predicted polypeptide sequence is orthologous to G1033
acacaccactcgctctttctctctctctcttcctctctctcccaaaccctaaccccaaaccctatttcgcttccgtcatgaaaggtggaaagtccagaaccgaatctaatagagctgagcctaagctcgctgtgaataagaaggctggtggcgccaccaagccggccaggggtgccaaggggaaggcagccaaggaccctaacaagccaaagaggcctcccagtgctttcttcgttttcatggaggattttaggaaaattttcaacaaggagaatcctgagaacaaggctgtgtctgctgtgggcaaagctgctggagctaaatggaagtcaatgcctgaggctgagaaagctccctatgtggcgaaagcagagaagcgaaaggctgattatgagaagaccatgaaagcctataacaagaagcaggctgaaggtccggctgctgcagatgaagaagagtctgagaagtcagtgtctgaggtgaatgatcaggatgaagacgatgatgacagcgacgaggatgatgatgacgagt

SEQ ID NO: 13516 - DNA, 566 bp, Lotus corniculatus
  Predicted polypeptide sequence is orthologous to G1033
aacaaaccctcgctctctctctctctctaacaaaccctcgctctctctctctcctcgccgcaccgtcaccatgccgaaggccgcttccgactccaaacccgctgacagccggttgaagcgcaagggcgctggaactggaaggaagcagacgaagaaggctgcgaaggatcctaacaagcctaagaggccttccagcgctttctttgtttacatgtctgagttcagaacgcagttcaagaaggataatcctaacaacaagtccgttgctgctgttggcaaagctgctggtagcaagtggaaatccatgactgatgctgagaaggctccctacgttgctagggcagagaaggcgaaggaggagtatgagaagactctccgtgcctacaacaatggattggctgagagcaaaggctctgctgaggaagaaggttctgacaagtcaaagtccgaagtcaatgatgatgatgaggacgatgatgaagatgacgagtgaaatcatgtagcaaatgaaggagcttaagggtgtaactggatgcaataattttcataggctcgcttcaatttta

SEQ ID NO: 13517 - DNA, 536 bp, Lotus corniculatus
  Predicted polypeptide sequence is orthologous to G1049
aaaacattaactttccttacatgatttacatagaatttaaaccaataaccttatcaatgtaaaaaaatattccaccaaatccgctaaatgggtttgaagcattaattcaatgtattggctttttcaaatacaaacaaatagataatcagtacatactcataaaacctttatctaaatagcctcttaagcctcgagccaaacttccactttcccatctgaatttgctcattcttcatgcctcgacaacaatggaacttatgctgaagcaaatgaacttcagttcagataatcgacaaaaggaagcacaggtgaatgatgtctaacacagtttgcccacagatcaaggatgaagaagcaaaagcacttgaacggactgtggtcaaaggttgtcagacttagtattgagaaccacaaccttgttcttaaactcaaccatgtgtctgagtcctatgacagagccctcaatagaaggcatgccttaaggaagaaacttatgatctacgtcaaatggtagcagacatgcaaattagaatctc

SEQ ID NO: 13518 - DNA, 509 bp, Lotus corniculatus
  misc_feature (50)..(50): n is a, c, g, or t
  misc_feature (329)..(329): n is a, c, g, or t
  Predicted polypeptide sequence is orthologous to G1062
aaaaaaacaatttattccaaaacttaaaaacaaagttaacagcataagtntgctttttcataatcaagatgagaaaaatatcagagctaactcctcaacctacagatttagctaacctatttgatcttggcctggacgggtaggccattacaaagggcaacaagaagcaatgcatttacaaacagcaagctacagcaactacagttagtgccgctataagggtagagcatttatcaagcacttcaatcacaccatacccgggtagccagctgaatcaagaagcactgctttgatttgctcagggaggacatcctggccttctgtgcatngctcagctctgaacacatctaaagcaaagccattaaagcagctaataacagcctgctgaacatccaatccgaggttgtccaacgccttcatagtagaaagcaaaagacctggtctgcgggtacaaaacatatgaatgttgacagctctcccttcccttaacctaacttccaccttcacag

SEQ ID NO: 13519 - DNA, 550 bp, Lotus corniculatus
  Predicted polypeptide sequence is orthologous to G1068
ttttttttttttgaggaaagcaaagatcatgttttaactatgttcctgccaaagtgcaggcaccaaattccaaaatggcacaattcagataatgcatagcatatccttggctatcattactagaaatgctataattctaattatagccaaaaatatcctagacgactgaaagttggagataaacttaaaccttaaaataaactgatctaaagtcagaccttaataatgcttgttagcattatagaattgacctctagccactacttcgaacaatcaagcaaataaataccctcctgattctgcactgttaatccgtacccaaattcacaccttcagtgatgcgtttggccagcccatagtggatgatggtacatttgcatactatgaacaggctgagtagcattgttgtagagtcctggcccccgattgaaagaactttgatcattgtcctccgaggactcggttgaaggcccttgagaggtaggagggctagttggagttactggtgcaccaaaggccaacatttgggaggttggtgctgaggaaggtg

SEQ ID NO: 13520 - DNA, 579 bp, Lotus corniculatus
  Predicted polypeptide sequence is orthologous to G1068
aggggaacagccacagcagctcacatctaatatctgataaatacaagcggatccaaatcagtaacaagctaaataaacataagctatcatcactagctacggttcactgatgatttaaaaatctagataagcagaaaaatgaatagaaatttatatggacattaagatagaccccctcctaaaactagccccaataatgccatgttagcattttagaattcaacctctagccactactttgaacaatcgccatataaaataccctgcttctgcactgttaaacacaaaaacgcatcctcactgatgagtttggccagcccatatttgatgagtgtacattggcatattatgaaggggctgactggcattattgtagagtccaggcctactattcccattgtcatcagacgactcggttgaaggcccttgagaggtaggaggactagctggagtcacgggagaaccaaaagttaacgtttgggaagacggcatagaaggaggtccagatttcaggttacttgagttagacttttttccatccgcaataaagctacccacaatgacctggactgcagatgc

SEQ ID NO: 13521 - DNA, 559 bp, Lotus corniculatus
  Predicted polypeptide sequence is orthologous to G1069, G2153
ctttttttattttatttaggtcttgtatattattatttatcaaggaaaaggagacaaaagcaaagtgaagcataaaattaagctcatggctaaaatagaagaaataggagaaagaagcatatagataccagggtcaccatcccaaaagttgcttattagatatcagaagttggcgcagtaaactaattaaatatacagatgatgatgcaattgaaatcagtccctactttacttcaacatgaaaaaactaggaagaagatcagaagccaaattacggtccctatccttgtatatggtggcgatgttccacttgatcaggagggtgatctaccatgaccatgtccccaagttgaataagctggatcagggttcagctgttgcccattgggaagagttaaacggggagggagattatcgtaccccgccatcgccgatgaggcttctcccgcagacactccgggcggcggctgtcccatcccgggaggaggagagcaatcggcttgttcctgatcaccctcctccaagggcaaactctcatacgttgcattggaaaaagtag

SEQ ID NO: 13522 - DNA, 628 bp, Lotus corniculatus
  Predicted polypeptide sequence is orthologous to G1069, G2153
gattctctctagaaaaagaagaggaagaaaaagaagaaacattatctttcagcaaccctggctaatccttggtggactggtcatcaggttgggttgcctggggtagacccttcaggcaactcaccaaaactttccatcaacggaagcggcagccgaagcatcggtggtgatggcgaagggggaaatagcaacatcagggatgatgaagatgaagagagagacgccggcgatgaaccgagagaaggtgcagttgagattggaaaccgtcgtcaaagagggagaccgccaggatcaaagaacaagccaaaaccgcccatctttgtcacccgggacagcccgaattctcttcggagccatgtgatggaggtggccggaggagctgatgttgctgagagcgtggcgcagttcgcgaggcggcgccagcgcggggtttgcgttcttagcgggagtggcgctgtggccaatgttaccctacgtcagcctgcggcgccgggagctgtggtggcgcttcatggaaggtttgagatcttgtccttaactggggcttttcttcctggacctgctcctccaggctccacaggactcacagtgtaccttgctggaggacagggacaggttgtgggaggga

SEQ ID NO: 13523 - DNA, 458 bp, Lotus corniculatus
  misc_feature (379)..(379): n is a, c, g, or t
  Predicted polypeptide sequence is orthologous to G1075, G1076
aacacaaagggcaaacgttttacaatgttcctaaaaagagttcttacaacattcctagcaaaagaagacgaacttcagtaacaatcagtacttcttcacaaacaattcaaaggaaagaaggaaattcaccagaaaattaatatatatatatatatatatatatatatatatatatatatatatatagatgttaagattcaactactcacctttgtgccccgaagatcaactcaataagattgccttccaccggagtttccagcccaaccatcaactggtaattgaggcatgtttaggggtaaattgaagaacggaagccctgaagatgggtcagggaaagagttattaactcctccaccaccaccactgccactaccgncaccagcagatgattgaccttgttgcatctgaagagattcatcttcctccaagggcaacctctcatacgcaacattagt

SEQ ID NO: 13524 - DNA, 560 bp, Lotus corniculatus
  Predicted polypeptide sequence is orthologous to G1079
cgaaaattcagtgccaaggttcagctctcatctttctttgcaagggacaaataacatgcaagacccatatccttcttttccttttccttgcaagactcttccttttcagctctctcatttttctttgcaagtcccacaccaatcgagcataggaaagtgcaagttgcaataaaggggcttactggtaaatcgtggaaaatggctggagagatggatcttttgctatatttctccctggttcagtgactagagcaactgaatcattctctgtaatttttggttgaactattgtgtattttttcttcatatattcttctcaacttctatgtttttgggttgaatttgtctttgagcttcagattttcaacactggttccttcttcttaattttctctttttttttctttctgagttcaaaccgcccaacccgcccgagccacccgctaacccgtatcacccggacctgatacacccggagtcaaatcacggtcgggatcgatggtgaatatgttgattgaaacccgcctgaacccggagtgtttcacccgaacccgacccga

SEQ ID NO: 13525 - DNA, 536 bp, Lotus corniculatus
  Predicted polypeptide sequence is orthologous to G1108, G2394
gttgttggtaatgtaacatacagatgagacaaacatagagtacatttaaaatagactccaacataaagggcatgacaaacccacataagcaaaaggaaaataaaatcttgaatctggtagcactgaccatagcccagatatcccaataattacttaacatgacaacaatagcacaacaaaattaacaccttacacaaagctgtgacaaaatcagaccaggtcccagtcattctggtataaatatacaaatactacctatctaacttaacactccttattttcagcctttttaaagtccttgagctgctgattgtttctccactgttaatactaccaatcgatgagaaaacagcggagcgttcatgtggtgaaatatcatctagggatggaacatgtgggctcatttcagaaaggttggcagaactttcacaatttaaatcagacatatcaccatccttggataaaattaagcttctatggagtctgaaccttggccttgtccttaaatgctccaatgatgctaaaatgatcacata

SEQ ID NO: 13526 - DNA, 495 bp, Lotus corniculatus
  Predicted polypeptide sequence is orthologous to G1145
ataaaacctcatgataactaaaagcaagcaaatggatgcaaattgcatcacatagctatgcctgtgatactagaaggaaggtgtcaacctcaaaaaacaccaaaatatgcattctctgatactcatatctacaaaccactaacttatagttacatatctcagagtggagctgatgctattcggcgaagttgatatttaggttcaggaggtggtgtacatggaagcatctgctcaagctcctttcgtttccttagcctttcattttcctcttcaagacgtgagactttattctacagttcgtttgtgtatgcatgtttccttgctcttgaacgggcagcagattcccgattcttgatcatccttttctgcctcctttcaacagtcttccccaccatgtcctcaggagcgctccttttccttccgggtatctgcatatccgacactgttcccatcagaggtggaggcagtgccacctggttatcagcataagaaaca

SEQ ID NO: 13527 - DNA, 544 bp, Lotus corniculatus
  misc_feature (237)..(237): n is a, c, g, or t
  Predicted polypeptide sequence is orthologous to G1146
ggcccccctcgagttttttttttttttttttaaacgtgaatgttggctaattatatgcaaaactaatgagatgaaacttcccctcattgaaaaatgaagtgggaaatttctatgttagaaagatcttcaggcaaaattttctacaatgaagactgatagaacattctttacaatgccaacttttacaatatctataaaacctaatacttctaggaactctaaactaagttggtgatnggtttccaaggttcttcaaaagctaagtcttgtaatttttaatttccaactataagtgattcttcaacatttcaccatgaaaccaaacctacgtgaatctatcacaggaaacctgaccgctatgcatgaaccgcgactaatgtacatgctaatctgaagtgagcactgcattcaatgattgttccagttttctactatttgatgctctatcatctaccaattccaagtctaacagtaaaacatcactctcttcacattttctttcaaggctggcaatggcttaacaccacactctccagctactcgt

SEQ ID NO: 13528 - DNA, 567 bp, Lotus corniculatus
  Predicted polypeptide sequence is orthologous to G1146
acagttcaaccaaatatgtctcaaaaaaaatgttcaaccactaacatgagaaggcaagccaacaaaagcaagtaacaagttcatccacgaacataatcacacgaagtttttaacaaaagtcaaacaccaatgacatcagtacttcaaacaaccatatgctatcctaacagtagaacatcaccctcttgacgttctccttaagtgcaggtaatggcctcactgcagcgttggcaccaggtgcccgagtagttcgtccacccattccgcgaccagcagcagcactggtcatggagccactgtcagaagtttcaggctccatatagaaccttgctcggaaggctgcgagatgggcatagtatgctggaggcacaatagatacagatcgtgtgcaccttgcataggtgtagcacaggttgtgggtaaggctttgtaaaccatcagcagtgaagttgttctcgtcccacaggacgtggtaatgcgcaggacggcttgtgccctggattccagcatgggaacaaagataaaaatcgaactccgttggatggcagatcttggagtccaccacag

SEQ ID NO: 13529 - DNA, 495 bp, Lotus corniculatus
  misc_feature (49)..(49): n is a, c, g, or t
  misc_feature (201)..(201): n is a, c, g, or t
  Predicted polypeptide sequence is orthologous to G1146
tctttcacggcgcattcctttaatcagtgacaggcctacaattattttnggggcagatgtcactcatccacatcctggggaggattctagtccatcaatagcagctgttgtggcttctcaagattatcctgaaatcaccaagtatgctggtttggtttgtgcccaagcacatcggcaggagctcattcaagatcttttcanaacaatggcaagatccagtcagaggaacattaactggtggaatgatcaaggaacttcttatatctttccggagggctacaggacaaaagccgcagcgcatcatattttacagggatggtgtaagtgaagggcagttttatcaagttttattgtttgagcttgatgctatccgaaaggcttgtgcatctctggagcccaactaccagcctcctgtaacttttgttgtggttcagaagcggcaccacacgaggctgtttggcagtaaccatcatgacaagagttctgttgaccgga

SEQ ID NO: 13530 - DNA, 603 bp, Lotus corniculatus
  Predicted polypeptide sequence is orthologous to G1146
atgaaggaaattaacatttcatgcagatttttatacaaaaaatattgattgatagcactttgtttacaatgcctgattcgatttcatcttggccgactagagggttagcatctctaaagtctacacctatggtttgtctcccatgttctaggatcctaaactaggcctctaaaagtacaatgagaaaccttgctgctatgcttcaaagccactaatatacaagctacagggttgaggggaaaggaaggtgcattgcatgattgtgttttgcagcatttcactgtttgatgcacatgtcccccatcggccattgccaaacggccagacaatcttaacaataaaacatcactctcttcacattttctttcaaggctggcaatggcttcacaccacactctccagctgctcttgttaccttggaaccatgtccagtacctgtggagccattctcctgcagctcttccggtcccgcatagaaacgagctcgaaatgcggccaagtgtgcataatatgctggaggaacaacagagacagagcgtgtacacctcgcatatgtataacagagattgtttgtcaaagactgaatcccatcagcagtgaaat

SEQ ID NO: 13531 - DNA, 604 bp, Lotus corniculatus
  Predicted polypeptide sequence is orthologous to G1146
ctcatccagatgcaggcacaggccgcggccgtggccgtgcacgggcgccaccttctcaacaacctccatcatcgtcctctcattctcccgctcctgtcatcggcgctccgatttctccagcgcctgttgtttccgcgccgatttccgcgccatcgcccccgccgccttctccggttccggtcgacgctctgagttccgaggtcgagcagaaactcgcattgcgaccggcagcgccgtcgtcgacgaaggctattaggttcccggaccggccagggttcggtcgattagggaagaagatacaagtccgagcgaatcactttcagttgcaagtcgctgaacgcgatcttcaccattacgatgttgctatcactcctgagattacttcgaagaaggtgaccagagaggtggtgagtcagttgataaagatgtacaaggagtcggtgttggggaatcgcttaccggtttttgatggacggaagaatctcttcacggcgggtccgttgccgttttcatcgaaggaatttgtggtgaagttggaagatgataggccgaaagcctcgtcctcttctggttctaaaaaagagaaacgggagcggcaatttaa

SEQ ID NO: 13532 - DNA, 604 bp, Lotus corniculatus
  misc_feature (586)..(586): n is a, c, g, or t
  Predicted polypeptide sequence is orthologous to G1146
atttagtcaatatatcattatatctgatttaagcaggagcaccattcacctttagcattgcaaaatccgtctctctacatcgtcaacttaaattaaagccatatatagtagctgctagcataataatgaacacccaaccaaacaaagaaacggccatgtcgaagagagaaaattgcggttggtatatatgttcaataggcagctattctataattcctaattagttaatgttatgtccaacttcagcagtagaacataacatctttcacattatccttgatggcaggcaattctatctcaacattgctcctggttgcaccaccagcacccgcactagcagaacccatttccgattcgccttcgatatagctgcgagctcgaaaagcagctaagtgtgcataatatgccggaggaactatggaaactgatcgagtgcaccttgcatacgtgtagcataatttattggccagcccctgtagctcatcagctgtaaagttattctcatcatacagaacatgataatgggtaggtctgctagttccttgaattccagcgtgactgttgagataaaaatcacactcgcttnagtggcaatcgaagtgtc

SEQ ID NO: 13533 - DNA, 414 bp, Lotus corniculatus
  Predicted polypeptide sequence is orthologous to G1146
agcgacctcctacctttccaacactcagcacctcccgctctttcccacaagcccaccttccgagcctatcttcgctcttctcaccccggtgacgcccgccccaccctcccttcaagatgaagaccattttcaacggcgactgcccgtgcggggagaaggacgagtccgagtgcagcgggtgtgaaaaggttcgttcgacgtgtgcacggtggccgagagagttggagagggatggtggcgatgtctccaccgcggtcgcggctgtggccacgagcagtgcgcgtagaggagtacgggctaagaaaccacctacctggcacggacactgacaagctggggggtctccgtgccgctgtgtctttacacttcctcgtggacggatggcgaatgggcttgcctgtttccgacttgggt

SEQ ID NO: 13534 - DNA, 579 bp, Lotus corniculatus
  Predicted polypeptide sequence is orthologous to G1150
agaaggcaaagttatatttcaagaatagatatttcaagtctgcaataaaatgtctttaacatccattaaatttcatcaaccaaccatgatcctcctatggaattacataactttcagtaacagatatttcacttcatgtggatatggttgacaatgatggcacaggaacccctttattcgcctcacatttgcttatctgtgatggacggttgcattatttcacgtggtggccctagcttgtctgaggaagcagggttcattgcaattataggatatgaaaagctggcttgattgctggtcttggccttccttatccaagagaacaatcaatggcaacgtctcaggcactggcaacatgatgggagtttggatcttgcctcacccccatcttttcttgcttccaccttccacatgattgaggcttgattatgagtatgtggggtttgccatctaaggaaacatccagaggctgaataatacaatcattagacacaggattagtgcaaatacaaatttcaaagggataagttatgaaagagaagtgtgtggcgggttccaaactcctatctagcaagtact

SEQ ID NO: 13535 - DNA, 490 bp, Lotus corniculatus
  Predicted polypeptide sequence is orthologous to G1190
aggaattccaattcatgtataaaaactgcatatcatatgctttttgtgggatctcaaattttcaattctccacatgaatttacttggatattacacaacaaaaactagacaaacaagaggggtaccggatacatttggtgccatataaagaataagtatctaaatgaaaattttctatataacttaacaaaatcagattattgagttaccaattcttcactagataaaaacttgtaacttgattcttgacgtgtgtgtattatggaatgaatcaatctttttgcggagagtggctctgaattcgttccctctgcttttctacttgtggaattacgaacatagccatcccccctctctcactgcacaggttcctgagtttgtcatcttgaacctgagttggatgcctgccatagctttttctggcataccaacatcttctctttctcagcagcatactcagtttcatctttatgacacatccatcgcatac

SEQ ID NO: 13536 - DNA, 524 bp, Lotus corniculatus
  misc_feature (330)..(330): n is a, c, g, or t
  misc_feature (418)..(418): n is a, c, g, or t
  misc_feature (474)..(474): n is a, c, g, or t
  Predicted polypeptide sequence is orthologous to G1206
ggttatataagttacattaacaaaaggaatcactctatcattatcaaagcaagggactaattactctactgtgagagccattaaaaccctccaattaaattaactgaaaaaaactagtaaaacattctgacttcacaatgtttctatatggaccactcttaacattcacagcaaagtagaggatctccgatcatggcaaaatgaattagctttcttcaagcagcattcatccaatcaagaaaggttcaataaatctgttaagtccttgatagcttgatccacggcataaactatcatcttctttatctcaagtttatcttctctagcttngtggttcttgggaagctgacggaactcattagttaaacgcagacactcatggacattttctggggacacgaagtctgcagcaactttngtgcatgacttgagattcctcacttggtgtgggcatccagcaggaataaatactgnttccccaagattctgtttgaaagtccaaggttctacaccaaactcctcct

SEQ ID NO: 13537 - DNA, 565 bp, Lotus corniculatus
  misc_feature (342)..(342): n is a, c, g, or t
  misc_feature (389)..(389): n is a, c, g, or t
  Predicted polypeptide sequence is orthologous to G1242
ataaaaaatgaaatgactagaggattcttatcttacaaaagacatgccaaacttggaaaaagcatgacataaattgtgatttcaaccgctcaacaatgtattatggtgattaaatcgtaggttcatgttacagaccaagggcgccgaatttttgccccggtactgctctgaaaagaaatagttgatttgaacatcagaatagtgaataaaaaatttaataaaatggaactggctctcaatccacagtttgagttggcatatctacaaaatttctaacattctatttcatcataatcttccctaactaccatttcaaaggttacattcaggcctgcagaaatngagaccaagagccctggaacttgagaagccattccttaccaccaatngacgtgttaactattttttcttctttcccgagcttaaatagtcatccatagttaactgcttccgtttcttcagagatggactctccgcctgtcttggcactgcacgctttgatggggttgaattcttcgcggcgagtttcttttctttgcgagcttgtctctccctctcatcatat

SEQ ID NO: 13538 - DNA, 508 bp, Lotus corniculatus
  Predicted polypeptide sequence is orthologous to G1242
ggctaagaaggctaaaagcacattcatgggcgaacggttctttaaaacattttagcctaatacatgtcggctacggctacaaaagtgtaagggtgggactaaacatattcatggtactagttaaatctaaaggattggttcgtcgctttacaatattacaacaaccagtttcaacatcggcataacattatcaaactagcctacacaaatacaagaggggggtgggtcacacgaacttgggtcagcaagcctgatcattagtggtcatgtcagagcacatcaaaatcaccaaggcttttaaaacccaaccaccctatacttactctataagcaagtcggggtgtatgtccatttactttttttccttccccgggcttgcataatcatccatagttaatggcttgcgcttcttggtagaagatggagactctgtatgtctagccacagcacgcttggatggggtcatgctcttggccagttctttctctttacgagcttgtctctccct

SEQ ID NO: 13539 - DNA, 368 bp, Lotus corniculatus
  Predicted polypeptide sequence is orthologous to G1242
gagaaaagcaaaatcaattatttaatatgaaattaagaatgacatcaagcatatataattaatggactaatttcacttttagcctccagagtatcacgatgtgcaaattagctcctttatactaaaatgagtgaatgagtcctcaatgttcacatgatgtagcaattaaattaagttctgacatcagtgtttcgtcgaaaattaaaaaacttcaaatctagcttccaaatgtgtataagtgatgcggcatacacgtaagacggtcacatgacttgtatatgatcttcccctttcttcaaccaagatgaaccattgtgagaagaaatggggtcttcatggaactcttctctgtttcctcacgtatcaac

SEQ ID NO: 13540 - DNA, 574 bp, Lotus corniculatus
  misc_feature (33)..(33): n is a, c, g, or t
  misc_feature (45)..(45): n is a, c, g, or t
  Predicted polypeptide sequence is orthologous to G1272
aatagaaaaaaattagatgaaacatcaacaccntgatattatagntgtaaaacacagggttcacttgcaaaatatagtagtgtatccaaacatagctaaaattccataatccatgttcatagatacttagcctaccacaaaacagaaaggctcacttagcctaccacaaaacagaggctccaaacacatgagaaggcttgtgataaaagcctcccaatattcaagccctacggctaataagataaggtcttcaacataggttaacacagaaaagctagttaggaacttagttatatgtacagcattcttgtctaaggcgcttataggcctcaaacaaagaacatagagttgcaaacattatcctgcaatttgggcagttgagggacaggaacagctccagcagcactcagtccaccatggcttgatgatgtctcagatttgtcctcgaatttcatgaactggcccaactgggttgcagccaagtgggcatagcatataggagcaacaacagaaattgcagtggtgctcctctgatacacatatgatagactgtgtacaagctcctgcagttcat

SEQ ID NO: 13541 - DNA, 590 bp, Lotus corniculatus
  misc_feature (202)..(202): n is a, c, g, or t
  misc_feature (578)..(578): n is a, c, g, or t
  Predicted polypeptide sequence is orthologous to G1272
gtactctctctgcgttctcttcttcggacatggatccaaatgaacatgaaaatggaaatgggaatgggaatgggaatgaggatttgatgcctccgccaccaccacccccattgtcccagctgatgtggaaccggtcaaggttgacctccttgacctaccccctgagccggtgaagaaaaaactacctacccggcttcccatngccaggaaaggtttgggttccaaagggaccaagctgccccttctcacaaatcactttaaagtaactgttgctaacagtgatggacatttcttccagtacagtgtggctctttcttacgaggatgggcgccctgtagaaggaaagggggttgggcgaaaagtgattgacaaggtgcaggagacatatggttctgagttgaatgggaaagactttgcctatgatggggagaagactttgtttaccattggttctcttgctcggaacaagcttgagtttacagttgttctagaggatgttatatctaacagaaacaatggaaactggagccctgatggtgctagtacaaatgatagtgacaagaagagaatgagacggncttatcattcca

SEQ ID NO: 13542 - DNA, 596 bp, Lotus corniculatus
  Predicted polypeptide sequence is orthologous to G1272
atatcatcgaaaagccgcaggcaaaccatcttaaatattaacattcgataggtccaagacatgtgcaaaatggcctgtggcatgagcaaaagctatggcaacaagttcaacaaaccaaaataaacaacctagggccaacaaggtccagtttagatacatgaccaaactagagttccaaacagttttataaacaggcctcaacagaaaggaagcagagaagcctcaacagaaaaacatagaactgctgacgctatcctgcaacttaggcaactgagggacgacaggagcaacaccagcagcagtaagccccccatggctcgaagacgtatcagacttgtcctcgaacttcataaactgcccaatctgtgttgcagcaagatgagcatagcagattggagcaaccacagaaatggcagtggtgctcctctgataaacataagacagagaatggaccagctcttgcagctcatcaggagaaaaaccaatatcatcaagcagaacatggtagtgagtgggtctgcttgtaccaatcattccagcatgtgcgcacatatagaagtcattatttcgaggatggacaattttattatcaataa

SEQ ID NO: 13543 - DNA, 536 bp, Lotus corniculatus
  misc_feature (502)..(502): n is a, c, g, or t
  Predicted polypeptide sequence is orthologous to G1272
gatgacatagattaccatttttcattatcatcatcttcaaaaacaaggttatggccagttcacttttctgatatttcagatttcatatctcgatagcatatcacaatacacatgtgtaaatgacgcgcaggtattgaacaagatactgaaatagtggaatgcaaagaaatggttccaaggagttaaaaaagatcaaatactgtcaagatgctaacagaagaacatagaatgggccacagcttggtgaagcctgggtagttgggggacaggaatgggaccagcagatgtaagacttccagggctggaagaagtctcagagaactcatcaaacttcatgaatggtcccatctgagccgctgccaggggtgcatagcatatgggggcaacaacagatatggcagtggtgctccttggatacacataagatagtgagtgtacaagttcttgcaaatcatctgctgtaaatccaatttcatcatgtaatacatgataatgagttggncgacttgtcccaatcgccccagcatgagcacaca

SEQ ID NO: 13544 - DNA, 550 bp, Lotus corniculatus
  Predicted polypeptide sequence is orthologous to G1272
cccgcttcatttctaggaagatggattcgtttgaacctgatggtaatgggaaggaggagagtttgccgttgccgccaccgcctccggttctcccttctgatgtggtacctctaaaagcagaggaggtgcttcctgctgctccacctcctgaaccggtgaagaagaaaacacctgcgcgtcttccgatagctagacgtggtctgggaactaaagggacgaaaataccgcttctgaccaaccacttcaaagttacttgcaccaacaatgatggacacttcttccattacagtgtgaattttacctatgaagacgggcgccctgtagaaggtaagggtgtagggaggaagataatggacaaggtgcaagagacttatcagtctgacttaaatggcaaggactttgcgtatgatggggagaagagtctgttcactattggctcccttcctagaaacaagcttgagtatgaagtggtgctggaggatgtgacatcaaacagaaacaatggcaattgtagccctccaaacggtcatggggaggacaatgagactga

SEQ ID NO: 13545 - DNA, 530 bp, Lotus corniculatus
  misc_feature (480)..(480): n is a, c, g, or t
  Predicted polypeptide sequence is orthologous to G1289
gttaaaaaacgaatgatatatatattaggatcaattttatgccttgagttccaaaacttaaaactataaagtagtactcataacaaattaaactagtatcactatacatcgctataaagccccttcccggcacttataaagaagtacatacaaagccccttcccagcattgctatacaacctcacaaacccgatgtccaagcatgtgctccaaacaaagcagatctagtaaaacataacagcactcatttcaaattcctgcacttcagagggtaaataacaagagaacaaagtggagattcagaaagtgggaagtcctacacccctcaaaggtgcagtcttgaaacagaagaataccgacaatgaagttgataacacaaatattgagagcatatcagagttcaatattccccaaacctacaatgcccgcagaaggcaaataactgacgcagaaatagtcagctccttcagaaggataatngttcctaaaaacagcaccataatcagttccttcagttcagagggaaaatg

SEQ ID NO: 13546 - DNA, 562 bp, Lotus corniculatus
  Predicted polypeptide sequence is orthologous to G1380
ctcacagaattaagatcatattaccataatcttacatctgatcatccttttcattttttccgcataccataaatataagaaaataaataacaatataagagaaaaattagaaattaaaaatcacttttctaatgaatatcagaggcagagggcggtccggcgaatatcatcatcatcgccggcagccacgtcggcaacatcacacggcggcgcgttgagatcaaacggcaacggcgggcgaaacgatgaggatacgatgttgtcatcaccgtcgtcaacgacagatgaggaggaatcacagtcgctgtggcagtcttcaggtacaaccggcggagtgcgaggataccggcgggatgatgacggcggcgccgccgcaggcttcacggtgggaggacgggggccactgaaggactccacggtgctgctcatgccactcgatgtaggcctctgcggattactgacatgatggtggtcctgaacaacaccgccgttgttcccggcggcgtagtagaagggatccgcggcggcggggtggtggtagcagaaaggtgagagaggaaag

SEQ ID NO: 13547 - DNA, 499 bp, Lotus corniculatus
  Predicted polypeptide sequence is orthologous to G1380
ctcaccggtacaccaccatgcgtcgaggaagagtcgcagatccaacgccggagaccaaggagacgcgctttcgcggcgtcagaaagcgtccctggggccgattcgcggcggagattcgagatccatggaagaaggctcgcgtctggcttggtaccttcgattccgccgaagacgccgccagagcctacgacgccgccgccagatcgttcagaggacccaaggccaagacgaatttccccacccctgacgaaatcatcgccggcggcggcgatgaaatctcccagatcccaatctcacaccaccatggcttctcgaaattcgacccggtgaggccaaccaccagcggcatgagcagcaccgttgagtccttcagcggacctagggttccgtcctcctccgccgccgctagggttcctcgccggcctgttaacccggtcccaatcgaggactgtcacagcgattgcgactcctcttcctccgttgtcgacgatcaggattg

SEQ ID NO: 13548 - DNA, 534 bp, Lotus corniculatus
  Predicted polypeptide sequence is orthologous to G1380
agaaaagtagcaaacacaaacaccacatccatttttttcattattaatatattttggtgagtgttgttgaagaagatgaggtggtgcttccttccacaccctctctctcttccctctctgttcttcatcatctctagaaagacccatcaccattttaaactctgaaatgcttctctgacttcaaaaaactaatcttttctcactttcattatctgggtcttcttcctttttccattctctcacatatttgtatagatcggtgacgagatgaaaagaggcagaggagtagcagctgctgctgcggcggcgatggtggtggaggtgaacggatcggcggtgcttaaggagccacgctaccggggcgtcaggaagaggccgtgggggagattcgcagcggagatcagagacccgatgaagaaggcgagggtctggttaggcacgtttgattctgcagaggaggcggcgcgtgcgtatgacgccgccgcacgcgctcttcgtggaccgaaggctaagacaaactttcctctctcacct

SEQ ID NO: 13549 - DNA, 413 bp, Lotus corniculatus
  Predicted polypeptide sequence is orthologous to G1382
atataattatacaattacaaacaacaattacatataaagtcaacccggagctgcttcactcctacacagcagctcataaatagtgatatagacatgaaagaactatctgcattttcttacagaaaatgagctttttttttcacctttgaagctatacccgccaaaaagaagaaaccagagcgctactcataaatatttatttttattttttgtagttagttaacaatttcttggacccattagtaatcttcccatgttctgtgagcaaggatatgaggaatggtttaaagatggaccatcactcctattttctctagaaccataggaacttgagctattatttagaacaccatagtatcctggagctgggctagtatgaacaaacttgaaattggaagtgctagggtgagtat

SEQ ID NO: 13550 - DNA, 563 bp, Lotus corniculatus
  Predicted polypeptide sequence is orthologous to G1384
ggagtgataagctcatcaagaatattattgatgatatctgaagagagaaatagacagctaaatacaaaaggataatattacaaactagtactttaaatggaatgaatataacctagagatactggttcaagctgtatatgtttttttttgtcaaggaagcggtatatgtttgattccatctaaacaaagcatgaaaaaaaaaacccactggtgtgctcaccccacccgccacgagcatggaaatgatcacaactcgaacatgattgtctgagggatacatgtgttagaccaagaaaattgacatgaatatcagccagagccagagggagaggagctatggacagaatactgtgctggcagctgagtagaataaaccgaaggaactgaaacttcttgcagagaactcacagaagaagcaaacatagaagaatatgatgatgatgatgatgaggaagattgaagatgatgagaagccatggttgatgacacatttgcctgatcatataaactcataggagaatagtcataaaagttgcttgaattggaaccactggaaccctgaa

SEQ ID NO: 13551 - DNA, 410 bp, Lotus corniculatus
  Predicted polypeptide sequence is orthologous to G1417
gtttttttttaccaaactcaactcatatgcacccctaattcaaattatttgtttacatatataaatatataatataacaacaagccaagatcgaaggcctaatattctgctccttctgtacatatatatagattaatataaactacatagagtggttcaaaattcacacactagctagctagtagacctagttggtggagaatgtagtgcatgactgaggaagttgtggtgaaccgggaataatagcacttccattattgctattgttattaacatcactactactgttattatgaccatcactccctcttatgattgatgagattgctgctgccaatgctgcagtgaagttcggatccgaagcaatggctgcactcattgtttcaaccgttggtggtcgttgtcctagt

SEQ ID NO: 13552 - DNA, 423 bp, Lotus corniculatus
  Predicted polypeptide sequence is orthologous to G1417
gaattcggcacgagaaagcttcaatctggacccaaccctaccccaagcaacgattttttcttcttcctctttttttcctctctcttccactcccaaccaccatcccaacccaaccgccaccaaagccatgatttctcctccaaatccgagtcaagaagcacccagatcggagaattttacaccgatttgatacatgcaagctctgagctatcctagcaaggttttttttcaccaaaatccgagtcaagacgccggaccggacattttagcctctgaagatggatttttttttatgtaaatatcaatatgctgtgtaaaagtttccatttttaatgtaaagtttgattttttgatgtaaagtttgaatctttattaataaaaatttgtttttgtttctgttaaaaaaaaaaaaaaaaaaaaaaa

SEQ ID NO: 13553 - DNA, 297 bp, Lotus corniculatus
  misc_feature (37)..(37): n is a, c, g, or t
  Predicted polypeptide sequence is orthologous to G1419
cccaaacaaggtataatttatttagattcaatctatntggacaaaatcatgtatgctacactacctggagtcgtgtggtggtagttgtttacttcattccttaaccaccatacctcatcccttaacaaaatatatgtttctcacaagaaaccaaaagttacaacaatatgtaaccctcagacaaaaccttttcttttctacataaaagaaagacataaaggatgaaaaataaagccctacaattttagcaaaatccatgtgtggcatcgctataattctcagcgggtgggatagcaa

SEQ ID NO: 13554 - DNA, 519 bp, Lotus corniculatus
  Predicted polypeptide sequence is orthologous to G1451
acagaaacaaggtaacctattataatttaaatttacagtcattggctgttgatctatatagaccttggcagaatcactaccatgtcaaccattgatgtgtgtataagaatgttgggccaatccatacataaacgtcataaagattctgccaccataatggtccaactaaaattacttagaagcacaaagtcctagtaatgaaaagaacccatgggtgccacgccatttctcgaacttctcaactctggtcgactcgcataatcatcacaagagttgccatggttagaaagttggtgaccaggggaagaagtagaagtagcaacacttctgcccatttctggcacttctagtggagatagtatcttgatgtacgagacattgttcacaaactcctgccagggatcatcaccaagaagaagaatgtcattctccctgtcaacaaatacaagctgccagcctgatctcagagtcatagggtcctccagttggccttcagggccaaaaatgcgagcgagctca

SEQ ID NO: 13555 - DNA, 547 bp, Lotus corniculatus
  Predicted polypeptide sequence is orthologous to G1451
ttttatatcaagatagaatggaatgggaatgattttttgtctctgataatacatataaccttcacacatcgattgcctacggattaagtatcgtatatatggtcgctagcacatggacaagatgccatatagttacagtattagttatgaatggtggtcctagcatgaaaaacaggaaaacaaagacaaaagacgaaaagagtaggctttaaactacatttaggaagcacttctcaccatggacaagggattgagaagaagcaagggcaatataatgagatggaagaaatgtagactatgaaacagtcacatctttctcagtagtctacagaccctacagtggtcatcccagagcctaaatgtctcgggtcctgacggttcatgtaatcatcacagacgccattagagagccttgggttgggaactgagttcacaagctcgagaccggtgtaccccattggctgcattgcctggggcgaaagtatctggatgcaccatacactatttacgaattccggccagtggccatcaccgaggagaagaacgt

SEQ ID NO: 13556 - DNA, 480 bp, Lotus corniculatus
  Predicted polypeptide sequence is orthologous to G1480
tcattcacgtcaaacgcaatgactaattccctcaccgcacgcggatgctcacagtaaatgagcgacgactttcattctcatgggcgaggatcgaactccagacatataaacgtacacaaccgctttcattcagcatgtgggaacgacgccgtatccagagaaagggtcctcctccgtgagaagattcacattcacatcggagcggtacgcgaaccttcctttgagtcctgggcctagtttccgcataagctttcctcgaagcgtagcgaatggtcttctcgaaccttcgattcttcctcttctctctgtacctcaaaaccctagcttccctatccgccgacgagaatggcaccgcctccaccgccggcgccggcgttccatagcaacagtacgaaatctccgacatcgcgttcccatccggcacaacaccaacctccatcgacggcgacgacagagcgtggtagtgcgatttagcgttgt

SEQ ID NO: 13557 - DNA, 439 bp, Lotus corniculatus
  Predicted polypeptide sequence is orthologous to G1480
taggactagatatgatttataaatatgattggtgaataaacaaaccatacttagcattccagatttagatacagcagccatagccataagaggaagtgcaatgctaccacagaaaccaacaacattcattcaagcaacttacatttggcacaactgtagactgcaatagaacatgaatctatatacaaaacaaaacagcaaccaaaaagaaagacaaagagagaaagataaggaaacaagaaagaaatttaattacatatacacaaagtggcaagggtggtggtgagtgagtgagtgaatcaagcgagagtggaacaagaccatcatatccagtagcaccaggagcaggaagatcaggattgttattatcatcagagcgtaacgcaaacctggctttgatcctcggtctgctttccgcatacgctttcctcgaagcgta

SEQ ID NO: 13558 - DNA, 445 bp, Lotus corniculatus
  Predicted polypeptide sequence is orthologous to G1504
caggcacagattttcttcatcttcctctctcttctgcaaaattcatcttcttacacactctcattcctctttctccgttcgcaaatcactgtcattgtgctcaatttcctcactcaagctaaatcgtgtttaaggatattgccaaaatgaacgactcttggctcttggatgagatgcttgatgatcccaagttttttgatttccctatggaagatttggaacctaatgctatggaagaagactgggctgctcaatttaaacgccttaacgagccgtgttttgatgctttttcagtagtagcgccacttgggcattgtggcgaaacccaaaatgaaaaaccccaacttggaaagggtttccctgcttcttgtacttggatttccccaataaaacaacctcgaaagactagtggaccaacatatggaaaaaccattccgaaacagaa

SEQ ID NO: 13559 - DNA, 508 bp, Lotus corniculatus
  misc_feature (444)..(444): n is a, c, g, or t
  misc_feature (453)..(453): n is a, c, g, or t
  Predicted polypeptide sequence is orthologous to G1504
tattttttattatattgaagttatatatcgttggtcatgcattcatgtcgtggacgtgatgtggcaagtatgcatgtgtcagatggacacgtggattagggcttcaaaccgtgagaacgacagatctgttagctgcttagacagctgacttgcataacataagtgtcttaccaagtgaccatgatgggcttggtggccatgactagtgaccatgatggttagtccgtggtgtgttttatcaagtgaccttgatgggcttgatggccatgattagtgacaatgattggctaatttgtgtctaaccccgactgcggaactgagatgtagtggtccattgacaatgggtcaaccccaatcgttgagtcgtatttttcctggccgaccctttgaggttctggcattatggatatgtgaaccttcatgtgttttatcacattctaggtngtcttcttngttacttttgtaatcttgatcgtggttacaaaaatcagcaagagtctcttccttt

SEQ ID NO: 13560 - DNA, 512 bp, Lotus corniculatus
  Predicted polypeptide sequence is orthologous to G1510
tgggaattagcgttaataggaggtggcccattatatgctgtttttaaaaccctaaaaactagccagaaaaacgttttaattccatgaaatccgttatttccgtttctggcataacgccgctatggcgttcgcggccgcgatcgcgattatcgcggtggccgctatgtagcggcataacgatggcggtgaagcaaattcccgctacgctatagcgggtagcggccgctatcgccgctatttaacaacactgatgtgtaagttgttaaacggagggggcattacaaacttataccagccaaaattcacaagaaggggaaggtcatggtcctaagtataaccccagctttaggatgtccaaaacagagtcaatggctacactgtgatgaaactgcaaggagaagtggcaaggcccaaatcaagccgaaagccagaaactacgctttacccagacctttggctgcccacatgctgacttagttattcaccctttttgctgcccatagtgggatcct

SEQ ID NO: 13561 - DNA, 595 bp, Lotus corniculatus
  misc_feature (22)..(22): n is a, c, g, or t
  Predicted polypeptide sequence is orthologous to G1519
ttttttttttttttacatgcanactgacttgttagtataaatcctactagcaccttccaattatagctgtgctacaaataaatggtcattatttccaacaaaagaacaaagattcatcataaatgttatttaaagaatatggataaaactgaacagattctaatataaaattaaattctgtaaatattcatattatacagtcctagcaagacagaaaatgttgcctttcatgctatcttctttctatgtatagaagattgcagctaacaagaagcagattctagaagtctgaatgatacacacagactagacttgagtgtgttataggggtacggcaaagagggcactctggcttttcgttgcaccattctgtgatacagttccagcaaaatacatggccacaggacgtagctgttgggtgttggcgattactcagacaaagtgtgcatttgctaacaccactagttgcatgatactcggaagatgaagattcagagatccaacttcctttgtcagtatcaggagatgccaaagtaccttcctcattcaaaacaggtaaaccatgtcctgctgatgtatggtgggttgcatagga

SEQ ID NO: 13562 - DNA, 379 bp, Lotus corniculatus
  misc_feature (140)..(141): n is a, c, g, or t
  misc_feature (172)..(172): n is a, c, g, or t
  misc_feature (191)..(191): n is a, c, g, or t
  misc_feature (231)..(231): n is a, c, g, or t
  misc_feature (241)..(241): n is a, c, g, or t
  misc_feature (267)..(267): n is a, c, g, or t
  misc_feature (273)..(274): n is a, c, g, or t
  misc_feature (300)..(300): n is a, c, g, or t
  misc_feature (308)..(308): n is a, c, g, or t
  misc_feature (339)..(339): n is a, c, g, or t
  misc_feature (360)..(360): n is a, c, g, or t
  Predicted polypeptide sequence is orthologous to G1535
ggatagcaattaacaatgaacaaattttattaaggaaaatgtccggagggatgcgaacatgccctggagcctggagaacagaatttcaaaggccaggtatttaacgcacaattcagatttacaagtgtttatagttgtcnnatctctaaatttactaccgtgattcctaaanaaaaaccaattataccagntattgactcccaggtgtattctcaacagaactcgattaanaaatcttgtnatcagtgccagatgaagtattatgcnacaccnnagctagattattattcaaaatttacnagtaacangctcctccactaaagaaaaaaactatccaangcaggtttagagaagtgttanctaaatttgggtgattaaa

SEQ ID NO: 13563 - DNA, 537 bp, Lotus corniculatus
  misc_feature (245)..(245): n is a, c, g, or t
  misc_feature (489)..(489): n is a, c, g, or t
  Predicted polypeptide sequence is orthologous to G1535
cacttcactctccttcctcactctgcaccaggtggtctcactctccacgaagctagctagcaaggtcttcaggcacagaagtgaagtgtgtgttttgaagagaaaaaggaaaaaaaaatgtatggggattgccaagtcatgtcagatactctcttctcgtcaccgatccagaaccctaacttcaacttcatctccaccatgccttttcacccttttcctcccatgaaagaagaagattctatgtngggagggaaagaagagatggaaagtggttctgaaagtgaacaagttgaagacaagtccgggaacgagcaagagatcactgaacagcctaagaaaaaacgttatcacaggcacactgctcgccagatccaagaaatggaagctttgttcaaggaatgtccacacccggatgataagcaaaggatgaaactaagccatgatctaggcctaaaaccacgccaggtcaagttctggttccaaaaccgncgaacccagatgaaggcacagcaagatcgatcagataatgtgatactt

SEQ ID NO: 13564 - DNA, 489 bp, Lotus corniculatus
  Predicted polypeptide sequence is orthologous to G1539
aataattcatcatagaaggaaattaaagacaaaggaaatgaaacgctgaaatagaattagcatttctgtttgaaattgtaattatgaacttagtatcttaaaagaaaagttacagggaaatcacttcaaaattatcagtaaaatgcaccaaacaactacctaggaactggtcacttttacaacagcaaacgatggatcaagctcaaactggaaaaaagaagaagaagccagctacagtacatgacgaaataagctagacaggctagctacaattcccgaaaattttgcaattgaaatcatttgacttatagatcaatctacgatgttgaagaaaatgggtttgatattgaaaatgtcaaatagaagaaatcaatggactgaatcgaagcagaatccagacgtcagtatgtaccagtacccgcaatgtagcttagctacatttcaagtcttgtcagattcagagcaaaaaccattttgcccttctaacaa

SEQ ID NO: 13565 - DNA, 588 bp, Lotus corniculatus
  Predicted polypeptide sequence is orthologous to G1652, G2776
tttttttttttttttaaacgaagagtagtaaattatttttaaacatagtttctgttcatagatattacaattaacacgaaaacgaacaagtactactaaactaaaaaaaaaaacaaagaagtcaaaacttccaatttcacacactgcaacttggttcctgggtaattgatacactagtacggatcactgtcactgctcattggggacttcaagagcaatggcctgaggctattcacgagatcattcatggtcattccatacgcgtcacccatctgagcaataacagtaacggaaagagcggaattcccaaacggcaagacgctgctaccattgacagagaggtgaagattttcaaggtggtccagtattttgagctctgtgccattttctttctcgcagtggatctcaatgagcacctctttccccaatgctcttgcagcaatctcagggaggattgtactacagtcatcatgatcagaacttgtagtaattatatcacccgagtttgtggtgtcttcatttccacgtagatcgggtttcttgatcacaatcactttttcaacaccatttttcttctcttgtttctct

SEQ ID NO: 13566 - DNA, 657 bp, Lotus corniculatus
  Predicted polypeptide sequence is orthologous to G1652, G2776
gaattcggcacgagatcacatggtcaggatcacatcatagctgagagaaggcgtagagagaagctcagccagagcttaattgctcttgcagcccttattcctggtttaaagaagatggacaaggcttcagtccttggagacgctatcaagtacgtgaaagtgcttaaagagcgtttgaggttactggaagaacagaacaagaacagagcaatggaatctgtggtggtggttaacaaaccacaaatcagcaacgatgataattcatcatcctcatgcgatgatggtaccattattgggagtgaagaagctctcccccatgttgaagcaagagtgtcagagaaggacgtgctcctccgattacactgcaaaaagcaaaaggggcttttgctgaaaatattgtttgagattcaaaaccttcatctctttgtcgtcaatagcagtgtccttccttttggagattccatccttgacattacaattgttgctcagataggagcagaatacaacttgaccataaacgaactagtaaaaaatttgcgagtggctgcattgagatccatgtcttcataatatagatgtgtggtcctggttttgttgtgtggtggggatcgataataaataataataatgtttgagactaaaaaaaaaaaaaaaaaa

SEQ ID NO: 13567 - DNA, 586 bp, Lotus corniculatus
  Predicted polypeptide sequence is orthologous to G1655
cttcgattcaaatctctctcatctcatctcatctcatctcatcaatcaacaaacacctcaatctctctctctctctctctctattcccatggattctcttcaaccaaacacgataacagattccgaaacctcccctgattccaatcacaaaaaacgccgcaaaatcacccaccctcaaaaccccctcaatctcatgccctggcgatccaacgccgaccagcagatctactccctccgcctcgccaacgccctccgccgcatccccagacccgccgcgcaaatccgcgacaccgccgaccgcgtcctcgccgccaccgccaaaggcaggacgcgttggagccgcgcgattctcacccgccggaagaagctccgcatcaagaaggtcaagcgagccgcctccggattgagaagagcggcgatcgggaggaggaagcggttaccggctgtgcagaagaaagcgcgcgttctcggccggttggttcctggttgtcggaaggtgtcgttcccgaaccttctggaagaagccaccgactatatctccgccttggagatgcaggttcgagccatggctgctctcgctgagctt

SEQ ID NO: 13568 - DNA, 544 bp, Lotus corniculatus
  Predicted polypeptide sequence is orthologous to G1666
ataattacacatactttatgatctaaatcaatttcaattattctccctacatacatccttaattaaccactgcactaattaacaaaaatatcaattaacttaaatcactaaacccctaaagacaatgcagatttctagttagtctctttcagcacaccacgtaccctttcttcttggtactcactggagattttcacatgttgattaccacatccaaaaggttctaattggacgtttctgttattgtgtgtcaagtagtgagacaatattccagattatttcacccctgcacatttcaaactaaaacatttctagtgtgtggtatgatttgattcaatgccctcttcacttccacaatgctaaccttcttcccactcacatattccttcaccttcgccctcaactccgccacaaacacaccattattcaacgaagactgaacaccagtcacctctatcctcatctccctcagcatctgcatcacatccagaagcaaaccttccctgtgtggacactccagctccagcaatgcatcactctcaat

SEQ ID NO: 13569 - DNA, 583 bp, Lotus corniculatus
  misc_feature (12)..(12): n is a, c, g, or t
  misc_feature (268)..(268): n is a, c, g, or t
  misc_feature (283)..(283): n is a, c, g, or t
  misc_feature (300)..(300): n is a, c, g, or t
  misc_feature (384)..(384): n is a, c, g, or t
  misc_feature (424)..(424): n is a, c, g, or t
  misc_feature (430)..(430): n is a, c, g, or t
  misc_feature (432)..(432): n is a, c, g, or t
  misc_feature (435)..(435): n is a, c, g, or t
  misc_feature (496)..(496): n is a, c, g, or t
  misc_feature (499)..(499): n is a, c, g, or t
  misc_feature (507)..(507): n is a, c, g, or t
  misc_feature (520)..(520): n is a, c, g, or t
  misc_feature (539)..(539): n is a, c, g, or t
  misc_feature (552)..(552): n is a, c, g, or t
  misc_feature (556)..(556): n is a, c, g, or t
  misc_feature (571)..(571): n is a, c, g, or t
  Predicted polypeptide sequence is orthologous to G1743
ctcgagtttttntttttttttttttttataaaaagcttctctctttttattggtacactttcatttcttgggtttaattatatacaattgactagccctctccacaaattccacctcaaaaaggatttatgttaagaaataaaacccccaaaataaaaattatgaggggtaaaaaaaggaaagtaaaaagttaaaaaaagaaaaaactcaaagggaagcatcttcatcattcagtgtacaaaactgagaaacaccaaaagcatcccanaggcgttgattgtantcttccattttatgatnagggacaaagtgggtcctacaaagtggacaagttttctgatcatgatcaatccaacggtccacacacgcgcggtgaaaaatgtntctgcagttcgccatacacctgatctcctcttcctcgganaattcncncangcacaccgcgcaccccgccgccaccgccggaaaaggtactccggtaaggtctcggaacgtngcnacggggangaattcccggatnaagattgccgacaatgtangggtgggggtctngtgnggggaagtccccgtnaagccgcccgaa

SEQ ID NO: 13570 - DNA, 460 bp, Lotus corniculatus
  misc_feature (91)..(91): n is a, c, g, or t
  Predicted polypeptide sequence is orthologous to G1767
aataaaaatcagtttatagttcttgattcctttttttcattaatcaatacatgcaaagtccaccctgataaccttcaattaatcccatatngtcttacttaccaaactcaaaaaaagaaagaaaaaaaatcaaaatccatcaccacccaaaaacccactcacacacgtgccaaaagaacctcgaacacgtgcgaataactaacttggagagagttggagtcatgctttcttccccttcctccctccttcacgtcgtcaaggcctccatgcactggcccacaccaccgcctgctccttccacgtcaacaatatccctccatcggagcactgtgtcatcgaccacccttccttataccttctcaacaacgccctcacatcatcacaaacctcctcactaaacgccgccgtattcatccccgctccatgcatacgccgcgtccacttcgccgccgtctcctcc

SEQ ID NO: 13571 - DNA, 500 bp, Lotus corniculatus
  Predicted polypeptide sequence is orthologous to G1781
ggatcatcaccaagtttttcattttactgttttagatcaaaacattaaatccatcagcaccctctaaaaaatccagaaatcatcagaacaatagttacgaacaaaaaagacagaatcatctaactacatgtatcttctacagtttgagtttaaacaaaaaagtaagataactagtaaagaaatgaaaagttggtgggttaccaatgactcaatgagcaatgggtaaatttctcaaattgacagataattatttatatcagatgactagggatgcttaaactccttcctccagcttgtgtaatctgagcatcaatatgcatgggagtaaataaattcagctgagtgctttggtccactgtatataagcatgatcatggagacaagaatcctttgatgtgcacagcaccccaaataagtgtatgagaagagcctgtaaagttgtcaatttgagatgatcaatcattgaatcctcaatcttcatcatcagagctggcttcatc

SEQ ID NO: 13572 - DNA, 252 bp, Lotus corniculatus
  Predicted polypeptide sequence is orthologous to G1808
gaattcggcacgagctaatttccaaaaattccgtccctctgtccccatcatgctttccgccattcttccctccgaccctcttctcagcaacccattctccgccttcgccggcggtttcacgccgccgtgggactgccacgattaccccttatccgattacctcaaacccagtactgaacccaaaccggtaacttcaagttccggttctggcggaccgatcctaacccatgagaaacgttaaccggacccgga

SEQ ID NO: 13573 - DNA, 508 bp, Lotus corniculatus
  misc_feature (38)..(38): n is a, c, g, or t
  Predicted polypeptide sequence is orthologous to G1835
cattagacttaaacaaaaaataaaaaaggaggatcctngtttggactactgtttctccctcaataaataaaagcaacataataatattctacataatttgctgagatttgatggaaccaacatagaacctctaacagcctcctaaatggctcctctcatctccaggacctttttgtgacagtttgagtgcactgctggtacaaaagttgggctagctgcaggccggtattcagggaagaggcggcccgaccggtaccgaacaccgcaagcattgcatagcgtcttgggacccataggtccttctctccattgtggggtctttgtcacctcacaatgcatgcattttctggggacagctgaaccctgtgatgagaatctcttcatctcggcatcatccgaaagcatgaagagatcctttttcctctgtttctttgccttgttaagtagtttctcagcatcgcctgtttctaaatctgattcagaggcaggtgtgctttgatgctttcgc

SEQ ID NO: 13574 - DNA, 126 bp, Lotus corniculatus
  Predicted polypeptide sequence is orthologous to G1841
gcgggaagcacacgagatgtgctcgattttaattaccagaaatctactttgcaggggtccccgtcatacagcacgtaccaaagaggggaagaagaaagcagcaatctcacgaacagaacatagtcg

SEQ ID NO: 13575 - DNA, 544 bp, Lotus corniculatus
  Predicted polypeptide sequence is orthologous to G1852
cagtgatgaatcttcttttaataaataaagaagtgataaatgaaagttgtgaattacaattcatcctcaaagctataacaaaatacaatgaacattgacttgtgctttccacataaaactgcacaatttttaacatccttttcaaatcctaactttactatattgaacaagttagcatagagaagatatcttagacttcccattccctcatacacaaaaagtggaactttacctgaattacacagccctgtgtccctgggatgataattagagcttccagaatgtcttggtagcaactagaattttttccctgccatgtgagtccggttctttatcatgaatgataggcttccacctaactgcacgagcaatggaagctactttgttaattacttcaggggtatccctcaccacaacagttccctccgggcgcaacattcgatcaatttccaccatcaaatccacaatactacatctgcttttaccagaatctggatcttttactagtgaatcaatgctgtccacatggatcagatcataacta

SEQ ID NO: 13576 - DNA, 528 bp, Lotus corniculatus
  Predicted polypeptide sequence is orthologous to G1880
cataatggagtctactataaatgcataggtttggatgctcgttagcactgacttcgagataaaatgaaagcagaactcgagataaattaatagtccatccaattacactaaactgatatccaaacacacactatatcattcttctgcagcttcgccttctgtgttggctgaggacacgtaactcaccacaatggaagtttcttgatctgatgcaacagttgagttctgaaactgctgcttgcaagcttgacaagttatttccataacagtggagctaatcttcttcattgcttgctttctcaaatcttcagcttttccaagctcagcttgcgcttgtttccttatcctcttagcattctcaaactcaacctcagctatctcaatttggcgcttcgcttctctcctagcctcttccgcgtaagccttctccgccatcgccaacttgagttcctcaccagcaaactctttcagccttgccacttcgaaaatggaattatcacccacaacattattattattattcctttc

SEQ ID NO: 13577 - DNA, 516 bp, Lotus corniculatus
  Predicted polypeptide sequence is orthologous to G1919
aagagaaaaaaccaaacttctatttctcaacttctccatcacattcacatctatgcaaataattaaactggattatactacatacataccatcctcaaaaccaaaccaaacttaataattaaacataacctactataaataagaattacatctttgataatttacaattcagcataagaagccctagactatatcatccaagcaagaccaacgtcacgatggttccaactcaacaagtagtgagcacaacagcttcctaaaaccagaatcttaacctgcaactgaaacaactaagaagtgtacaatattgaattacagatgaaagctgactcgaacaaagacagtgacaccatcgcacaaaatacaaatgaattgtaaaaacaaatttagtgctgttatttaactccattctcgtggattttacaagagatgaagctgatagacaacacaaaaatctctgagctattcagacccagaaccactataaaggagccgggtatagtgaaactcattaaa

SEQ ID NO: 13578 - DNA, 478 bp, Lotus corniculatus
  misc_feature (444)..(444): n is a, c, g, or t
  misc_feature (446)..(446): n is a, c, g, or t
  Predicted polypeptide sequence is orthologous to G1927, G2184
tcaaaataattttattttcagaatatgttagaagtactattctcagtcattctggggagattccaaactaattatatatagcaccaaaacttgggacttacatagaattcaaggagagatgcatctccctaatactcttaaatttccaagagaaacccacaagaaagcacataaagcaacaataatggggaagaaaaggaatgaaattcccctcatgcccgctctcttcttagtagcagtgtctttacctgcagcaatgctggtgttcttgatcctcaccctgctgaagctagacattcgattcaaagcgcggtttaccagagcgttttcagcagctgatgcaggtgtagtaggtattgactccacaaaagcccaaagagcagaggagaatctacttggagtcataggaatatcctccacagtgctgctgctttgattttcatngncttcaggaggatagttgacagattcacatacg

SEQ ID NO: 13579 - DNA, 494 bp, Lotus corniculatus
  Predicted polypeptide sequence is orthologous to G1928
cgtaaacaaaaggaagtagatagaataaaattatatttatacaaaacaaaaaatatatatggggatcaagctaaccttgccactttcaaaaaaaaaaaaaaataaactaacctggccacggctttggggatgggtttggctgatcagggttcatgcaatttcccaggctagcaagggtgagaatatcactatgagagagaggtctaagacctaagaaatctctggtcaatccttcattatttcctcctttaacaacactggtggtgatggaatcaatatcttggtggttggagttgagaatcccaccaggaccaaaagtgtcctcaaaagaagttccttcaaacccagaagggaatgagtccataacatgatgaaggaaggatgttgaaacacctgtggtagcagcagcagcagtagttgttgtcatagtcaccatctggtcttcacatgtggacaaattcaaattaccaaaattaccacttgaaatgttgttg

SEQ ID NO: 13580 - DNA, 534 bp, Lotus corniculatus
  Predicted polypeptide sequence is orthologous to G1932
ctctatgattgattataacaaacgtgttcatctctaatgaaacatgaccatgaagattcaagagggaaaataacacaatttaattagaaaactgcaaaacgacgccgttcaaagcctacgatacatagatctcagttacgctaactcattattttcacggttcaaagccacagtggtggaggctcgttcaagtcgatggggattccacgccggatgagtccaagaaacgacgccgtaggggaaggttctgcaacttgagcgacggtgacgtaaggggcgctgacagcgacggtgactggcggaggctgaggcgggttgatgtctttgaggacgccggtgtggaggaactcactgagggcaaggccacgggaggggacggagggccagcggtggtggtggagatcagaggagggggcgttgaggtcgaggcagagaccagcagcgagcggagctggagggaagttggttttggccttggctccacgcagggaacgagcggcgccgtcgtaggctagggcagcttcttctggagtg

SEQ ID NO: 13581 - DNA, 444 bp, Lotus corniculatus
  misc_feature (210)..(210): n is a, c, g, or t
  Predicted polypeptide sequence is orthologous to G1948
ctctttcacatttcacacattacttacgaattctcataataatgaatgcacattctcgaattccattacactactagtaagtgacaaccaaaatgcaaaatggtatatgattaagcaaaagaacaattaatatgggctcaagtaaatttacaaagtttctgggccatcctgattcgaagcaggcccattactactgggctgggcttgatngttactttgctcatagagcttaacaagctcaggatccacattctcctcgggctcccaagtgggctgttccaaatcaacccacttaaccaacagctccaacttcccctcatccccaactctccggccaaccaccgcctccgccaccgcgtactccagccccgcctcgtaatccctcaccagatcctccgccacaaacctcgcattcacccactcgtttccaccaccgtccttcca

SEQ ID NO: 13582 - DNA, 525 bp, Lotus corniculatus
  Predicted polypeptide sequence is orthologous to G1950
aaaagttctaatcttccatctctaattggtttttaaactggccaacataacataccaataatgcataaataacccctttcaacatactatgtacctttcattacatagagcatatggcatgatctaacaagtcgtaagctctgatggtatacataaacaccaaaaacaagtaaaatctcactttaaaaacagcttctatgatcagggcaaagtacggaggaccactttttttcaacaaaagcaaccttaattggctgtattgtgctctcttggcatcaatgacaattttctaatttcttctggttgtattactcaagcatggccttggcagcatcgattaatattgctctaaactcatctgtagctcgaccgagcactgtgtacccttccttgtcctccacatccacatctgctccatgtcttataagaagaagggcgatctctttgttacggtcaattacagcactcattaaaggagttggaccagctctatctacagcatcaacctctgccccttcttcaatc

SEQ ID NO: 13583 - DNA, 588 bp, Lotus corniculatus
  Predicted polypeptide sequence is orthologous to G1950
gaaagcttggtaatatatcaatggagatggaagtagacagtgagaagaaccagcaagacacagtgatggtgaaagagaaggatctcttcaaagctgctgaagaaggtgacacctcaaccttccaagcatcgtcccctgaaacactctccgaatccctctctctaaggaacgaagacgctcgctcccttctccatgttgccgcttcttccggccactcccaggtggtgaagatattgttgtctgctgatgcatcagctagtgtggtaaatagtgctgatgatgaagggtgggcgccgcttcattctgcggccagcattgggaatttggagatagtggaggctttgttgagcaaaggagctgatgttaatctaaaaaatggcgggggccgaacagctttacactatgccgccagtaaaggtcgggtgaagattgctgaaatactcatctcacatgatgccaagattaatataaaggacaaggttggttgcaccccattgcatcgggcagcgagcactgggaactctgagttgtgtgaacttctgattgaagaaggggcagaggttgatgctgtagatagagctggtcaaa

SEQ ID NO: 13584 - DNA, 504 bp, Lotus corniculatus
  misc_feature (413)..(413): n is a, c, g, or t
  Predicted polypeptide sequence is orthologous to G2041
gaaacacaaacatcgaaagtgttccacaatgcaaaaactagagtctacataaataagtccactagcttgttaagtaggaaataaacagaactatcacacagaaactagacacaaaaactactcatagaagcttctccccataattaattttgactttagaatcaattgtagaaggatttccaaacatgctaatagcaggcttggttcccttagtgatgctcttgcggcaatgtttagcctcggctggtcccttttttaggaatcacttctattccaagattagagtagcctttttatttgtgactttcatttgtttgttgtagttttctcggtcttcattatcatatggaatgatttagaccggtcctctccaaccatttccctcagtgtctcatcttcaatcttctgagctngccacttagaagggtcctccacaaaggctcactgaaaatcatgcttgaaacccactctttcccgtggttttcggtacttatcttcctccaa

SEQ ID NO: 13585 - DNA, 389 bp, Lotus corniculatus
  Predicted polypeptide sequence is orthologous to G2071
gattaatacactatacaaactaatatttacattggacagaggttagaaacttacatagcctaataggcttgtcttatcatcatccaacataagagacaacagcatataagcaaatgaaatagtttattatacaagatgcaggtttaattaatgtacaactaaagttcctagttcctatacatataagctatcgccctatctattattgccatgggactgcatttatctcacatctggaatatacactccagtccttaagacataacaatggcttccttggtagagctgtcacttagaaacaaggaccaaccaactcacgttgtcttccactaccaaggacctgtaagtgtcctcctcaagcattgtcttttactatttccccatggctt

SEQ ID NO: 13586 - DNA, 441 bp, Lotus corniculatus
  Predicted polypeptide sequence is orthologous to G2106
ttaaaaaaattaagagtgaactagaaatatatggttgaaacaaagcataataaaactaaatggtcaaaggtcattattcactgctatcttattccatcacaatggtaagagatgaatagtatatatgaaagttaaataaaatgggcatattcctttggtccgtctcatataaatgttcattaaaaaatattactcttttgaaaaaaaatctttcactcgcttaatcgttactcataccctaatttcctagtcatcttttttggttgatgacattttgaaaattaacgtaattgataaaacattgttcataaatataggctggaagttccctcttctaagtatcaagctcgaaatgaaaaatgggggcagcaatggagctcaagtcaccgaatatgatgtcatcattttcagtgtagatacttgaatcttcattttcaaata

SEQ ID NO: 13587 - DNA, 502 bp, Lotus corniculatus
  Predicted polypeptide sequence is orthologous to G2110, G2574
gtgtttgaaatcctagaattacatatatatatatatctgagggtatgtgcattgggcttcttattctatacaaggaagagggtatttccctttaggaacatgacctcagtcattgaactaggaactcacaatcacccacttccagtttcagccacagccatggattctaccacttctgctgctctttccatgctatagtcaggttcttacacatctcaacctacaggtcactgtgctgcatctatgggaagtgcttctacaatgttcatgggtctgaatttcagttcttataatcaatcaagagcaacacaggccttcttaccaacccctaccccagattggttcccaacaatcactttagacctgacttaaacaacctctgagtcatggaattcttaagggagaggaggaggtcgatggagaaggacatgcttggaactggtgcatcattgtcaaaagcctcacattcataatcgtctgggacaccccaaggatctcactc

SEQ ID NO: 13588 - DNA, 522 bp, Lotus corniculatus
  Predicted polypeptide sequence is orthologous to G2116
agttaactaattacttcttccaaaactgtaaaatgaagtattaaactttttttcaaaataagctaatccaatcataaagttaaatcaaataaaaaattgaatagaaaaacaaaaaaaatcaataccttcaggtctcactcatgtcagtctatgaacaattcgttaaacagggtggtgacatgttggtcaatcaaatttgcatcaaaagggattgtcaattttattaacagaaacggagcgaccatcaggcatcagaacatgagaaaccctgtgacctatgtccagcccctgaaactggccgatagaatcacttgacaacatttccgacatatcatatggagtggataggtcaaacataggctgatgatggggagtagatacatcagatgagagtgaatgcaaatgtgacatttgcatagcctgaagttcgctccgcccatgttgtggttgatgtaaggaaaacggagcttgtgaatatgaaagatgatgcattcccaaagtaaaggagtcagcatgagttac

SEQ ID NO: 13589 - DNA, 475 bp, Lotus corniculatus
  Predicted polypeptide sequence is orthologous to G2140, G2765
actgaaagttccccaatacatttacaacccagattcacatgattcgtcttcagaaattacaaatccattagaagaatggaatgacaacactgcagtatatctagtctagtttacatggccattgaaatttccagttagctcccaatcccttatcatagtcagatatatgttattcatatggagatttaaatgttttcacaagaaatcttctaaagatgtagaactgaatatagaaatcctccttctctttctgctttctaaaatatcttgtgaaacagaaaatctatcaagcacagatctaagagcttgatgtacagagccagctagaaactgccggtactcggcatcttcgaagttctgttctttgcagctaattatcacaaagacattcttcatcctgcctcccaaggttgcaatctctgccctcattatcataagatgaagtgcatcaagtgcttgtcttatatcagacaat

SEQ ID NO: 13590 - DNA, 678 bp, Lotus corniculatus
  misc_feature (639)..(639): n is a, c, g, or t
  Predicted polypeptide sequence is orthologous to G2142
gcaaagttcgacgatagcaatgttagcatctctccaaccatgcttagtggcacccagaatatgatagatcctgatcagagcagggatattctcagcaagacagcagagaggcaacctgatttagtaagcaagggaatacctctgcccttggctatgcatgcaaacatgtctgttcctgtaagaagtgatggtgtacctgcccatcctcttcagggaacgctttctgatgcacaatcaactgaatgcccagcaactagtgagccacagaaccagcaggacgaactgacagttgaaggagggacaattagcatttcaagtgtatactcccaagggctgttgaacaatctaactcaagcgctacagagtgctggtttagatctgtcacaagctagcatctctgtacagattaatcttgggaaccgggcgaacataggaccaagcggtggaacctcttctaccaagaatcatgataaccccctttgtagcagtcaggcaattgcgcattttagagatgcaggcagtggagaagactcagatcatcaagctaaaaaacgaatgaggaaaacatacaactgattctgtgtggcttttttatgagccttcttttgcatccacatttcttacctgttgcaggcgcgncatatatcccttgtggttactgtacatccttccccgttt

SEQ ID NO: 13591 - DNA, 475 bp, Lotus corniculatus
  Predicted polypeptide sequence is orthologous to G2144
ccaataatctaagtagcatgcaatgaacaaagcaactcactccaataataattcagtaacagtctgttctatgattttacaatcttgaatcaatcatctcgtcgattgaatgacccctatagttagtatacataatgatacttgtattatataagaatagcttaccgattcttcttcctcttttctagccatagaaaatccaggtttccaactgagcctgataaatagaagacatggaaaccctgctgaatagcattagcatagataccgctcaagatcactgctaactgcgaatactatacttgatatatacactactaggctattagctactgatacggcaacttctgcacgctttcatagctccatcttcaattggtttgagtgcagagatgctgaatttgctgacgagtcataactcaaaagtgaggtttccggagtcatgaaattatggttgtcttcctccctcgcccaa

SEQ ID NO: 13592 - DNA, 449 bp, Lotus corniculatus
  Predicted polypeptide sequence is orthologous to G2153
cccaaacagagcaatctaggagcaagttagattaaaatggcaggtcttagtaggattcaatacctccgccagcaacttctggaggctgaggaagcagcagcccgagaaatggagcccaagtccaaccatggtacttcaaactcatttaacaaccaaggtggcggtggccaaaatttctctggtgcaaagatcaacagcggcgcaaactccggcgaccgcaacagctaccgcagagcttacaactatggaggtcgcactatcaacaatcagggcactttcaatggcaatggcaacggtggctttatagatggtgacttccatgccccaacaacaaactacaaccgttattagttatttgtaatttgtagatgttgggtaattaatatgatccactgggtgatgttgttctgctaataaagaagtggagttatagctccacgtacttgttt

SEQ ID NO: 13593 - DNA, 3476 bp, Lotus corniculatus
  Predicted polypeptide sequence is orthologous to G2207
gtttacatgaggaggagctatccatattctttttctcctcacctttaccagtccaagtttgattccacatgcaaaaagattaattgctttcatccactagaactatcatttcctgtaaagtgtgtatgagggtatctttctggtccaactctctttctttttgttggattgagactttgtagtcatccaattttttcatggaatatattctatttctgtgtgggagtgaaaatttgagtccgttcagcaaaaatcacatcttttcctattttgaagatctaatataatcatcatcatgttgttgtttctctgtttcttattcttcctccaatatcattacttactgacatcattgacaactttggacagacaacaacgtttggagactgaagactgaaaggttcctcaccctttttgacaaggtttttcagatctgtttggtagctgaaacatgggcttaaagattctagaagcaactgtgtgagtttaagggttgagaaagaagtagaagcaaccatcatggcaggtttctaaattgcggttggcaattgcaattgcggtcgtttcaacctgcatttgtccgcaattccacgacgcagcagtgacaacaagtgcaatttaaaaccctgattatgggggatggtgctgtgacaacaacatctgcagccatgatggaagctccaacaaatgaaacctcgatggattttgaatacatgagtgatcttctcttagatggttgctggttggaagcttctgctgatggatcaaatttcttgctgcagcaaagtcctcctttttcaagtcctctatttgacccttcattctcatggcctgctttagaaaccaatgagccaacccatgttgaggatcaacatgaatcacaagaagctcctcttggcaacacccaattagtgagccagagccagaacatggttaatgttgttgatggtaggtataataatcagtctgaaactgaaactcattcagttgtagaaggtacttctgatggggttaagaggtggtggattgcacctacatgtagtcctggacttggaccttccataatggagaagctgataagggccctgaaatggatcaaacaattcaattggaacaaagacatgctcatacaaatttgggtgccagttcctcgaggtgataggcctattctatcagctaacaatcttccattttcacttgattctgggtctgaaaaccttgcaaggtaccgagaaatctctgaggggtttcagttttcagcagaggaggactccaaggagttggtgccgggattgccgggtcgagttttccgggacaaggttcctgagtggactcctgatgtgaggttcttcaggagtgatgagtacccgcgtgtcgaacatgctcgagagtttgacatatgtggaacattagcagtgccaatctttgagcaaggtagcaggacttgcttgggtgttattgaggttgtgatgactacacagcagatcaattatgtccctcaacttgagagtgtttgcaaggcacttgaggttgttgatcttacaagcttgaaacattcaagtattcagaatgcaaagcaggcacgtgacaagtcgtatgaagctgcactacccgagattcaagaggtgctgagatctgcatgtcatatgcacaaattacctttagctcaaacttgggtctcgtgctttcaacaaggcaaagatgggtgccggcattctgaagataattacttacactgcatatctcctgtggagcaagcttgctatgttggtgatccctctgttaggttctttcatgaggcttgcatggagcatcacttgttaaaaggtcaaggtgttgctgggaaagctttcatgataaatcaaccattcttctcaaccgacataactatgttaagcaagacagactatccactgtctcatcatgccagattgttcggattgcgcgctgcagttgccatacgcctccgaagcatctatagtagtgcagatgactatgttctagagttcttcttgcctgtgaattgcaatgacagtgaagaacagaaaaacatgcttatatcattgtccataattatacaaaggtgttgccgcagcttgcgggttataacagataaggaattggagagaactagctcatcagttgaagtgatggcccttgaagatagtggatttgctaggactgtgaaatggtcagaaccccaacacataacaagtgttgcctcattggaacctgaagaaaaatcaagtgaaacagtgggtggaaaattctctgatctaagggaacatcaagaagattctattttaaaaggaaacattgagtgtgatagggagtgttctccttttgttgaaggtaacttatcaagtgtgggaataagtaaaaccggagagaaaaggcgagccaaagcagataaaactatcactctggaagttcttaggcaatattttcctggaagcctaaaagatgctgcaaagaatattggtgtttgtactacaactttgaaaagggtatgccgacaacatgggataaagcgttggccttctagaaagatcaagaaggttggtcactccttacagaaactccaacttgtcattgactcagttcaaggtgcctctggtgcatcatttaaaattgattccttctattcgaacttcccggatctagcttctccaaatttatcaggagccagcctggtctcagctctgaatcaaagtgaaaatccaaactcattaagcatacaacctgatcttggcccgttgagcccagaaggtgcaaccaaatcactctcttcctcatgcagccagggttccctttcaagccattcctgttccagcatgccagagcaacaacctcacacaagtgatgttgcttgtaacaaagatcctgtggttggtaaagactctgctgatgttgtgttgaagaggatcagaagtgaagcagagcttaaaagccacagtgaaaataaagcaaaactcttccccagatctctaagccaggaaacacttggtgaacacactaaaaccgagtatcaaagttacttattaaaaacctgtcacaaagcaactccaaaggaggatgctcacagagtaaaagttacatatggagatgaaaaaacccggtttcggatgccaaagagttggagctatgaacatcttttgcaggaaattgctaggagatttaatgtgagtgatatgagcaaatttgatgttaaatatttggatgatgacttagaatgggtattactaacttgtgatgctgatttagaggagtgcattgatgtttgtctatcttctgagagtagtaccattaaactttgcatacaagcttctagtggtatgagaagttaatagaatttaggtaacactggccttttaagattgtatattactaagtttaagataagatcctttgtatgtatatgaaaatcattcttatcaagtttgtagwttgaagacaaaaaaaaaaaaaaaaaaaaa

SEQ ID NO: 13594 - DNA, 382 bp, Lotus corniculatus
  Predicted polypeptide sequence is orthologous to G2226
tgaagtaaacattttatttatctcatggttaacatgttgacaatactgttcaccagaagtacacaaaataatgcttcagatggtgctggaagacttgagagacctattcggataagggaagccaacttgcatatagaaaaaggctggcatcaatggaagctcaaaactaccctaagtgaacaacaaatggcacttaattcaagaagaagcaaaaatcatggagggactcaagcatagtggctatgcttattaataagaggggtagaacaaagtatgaaaactctatgggttcttctaaatattggaccagtatacacaataaaaaaaaaagattagaactctaaattacccacagaagaaaactctaagcccaaacgaaaag

SEQ ID NO: 13595 - DNA, 430 bp, Lotus corniculatus
  Predicted polypeptide sequence is orthologous to G2226
ttcaaaccccacttcgtaagatactaagaagagactaacagagtttccaatactttgttcttcctctctgattgatcaagcatagcatctctgctttttgtgtctctatttccatgattttcagtgctgcttgaatcaaaggcaatttgttgttcattttttagcttcaacaggtgccaaacaatttatatcagtaatttggcatccttaaaggatcctcaccattgaccaaaatgggtctctcaagtctcccagcaccatctgaaggagtgttatgtgtgcttcttgtgaacactgtgatgtccatttccatattcaaaggcattgtcagaacaattctacacattgttggtatccatctttcttcaccagatgcctcccaaaacccacctgaatcatttgaagtccatctcagcccctctgagagtta

SEQ ID NO: 13596 - DNA, 486 bp, Lotus corniculatus
  misc_feature (365)..(365): n is a, c, g, or t
  misc_feature (381)..(381): n is a, c, g, or t
  misc_feature (471)..(471): n is a, c, g, or t
  misc_feature (474)..(474): n is a, c, g, or t
  Predicted polypeptide sequence is orthologous to G2227
gcggacgcgtgggtgccaaagcggcttcgtcgaagagatccacgccggccactccccggcggtctccctcttcgccgacggcatccacgcttcccgccgacaaggcttccgccgtagacgccgcaacgccggcagccgctcgccgtttaacccggtgattgtgctccgcggacccggcgacgacgctgccggcgccgacaacgacggaagcagcttcgagctgttctatgatgatggcgacggcaccggtctccgacccctgccgccgaccatgtcagagcttttgcttggctcgggatttgaccggttgctggatcaattctcccagatcgagattaatggatttggacggccagagaatccgncggcgtcgaaggcggngattgagtcaatgccgacggtggagatcacggaggcggaggtgcaggcggagacgcactgtgctgtgtgcaaagacgcgtttgagatggnttnggaggcgcgtga

SEQ ID NO: 13597 - DNA, 489 bp, Lotus corniculatus
  Predicted polypeptide sequence is orthologous to G2227
tctctaaaacaacatgagtttcgaaacgcaacccgaaacggcgtcgtactggtgctacagctgcacccgcttcgtccacctctccgccgccggcaacatcgcctgcccccactgcgaaaccggcttcgttgaagagatccaccccgaccaatcaccgaatcacgctcacgctcacggtctcagcccgttacctgaagatcccgtttcttcccggcggctaggtttccgccgcagacgccgcgacaccggaagccgctcccctttcaacccagtcatcgtgcttcgcggaaccgctgacgacggagccgatcaagaaggaggcgccgccgccgccttcgagctttactacgacgacggcgacggtaccggtctccgcccacttccgccgacggtttcagagtttctgctggggtctggattcgatcggatgttggagcaattctcgcagatcgagatgaacggattcggccggccggagaatccgccggc

SEQ ID NO: 13598 - DNA, 520 bp, Lotus corniculatus
  Predicted polypeptide sequence is orthologous to G2239
gcgtgaaaatgatagcctcccaccgctgggtggttcctgttttatataacttgggtttcggtccaaacgaaccatgggttgcccggcccattagatatacaaagtgatcagcccaagtgtcttatacattgacgcgcccgtgtcagaccaggtccaaataaattttgctaccgtaacaccttatcatacaaaatgtacaaattttgaagtggaaaaacaaaatctcgttcagagaatttagaaaaaaaatacaacgaattattgagatcgctcaaacaatagttaaaccggaggagggcgggcggaatcactggctcccagcggcatgatagggcgcggccgaggacgacgcttcatcgtcgctattccgcgtcctcggccgcggggatctaatcgacaatgccctcatcaagaacgagggagcctttgagaaaacccaccggtccgatttagacccctggtccaaccgcctcgaagccttccccctactgctaccattgccgccggtccggtaacccac

SEQ ID NO: 13599 - DNA, 516 bp, Lotus corniculatus
  Predicted polypeptide sequence is orthologous to G2239
ctctcttttcctcttcattttttcttcatcaattacaacacaatggaaagaaaatctcaaacactctcccttctcctcctcctaatctcgccgtcgatccccctcgccgccgcacagtccccaaacacaaaccaaaccgtagaccccgatttcaaagaattcaacccttcgtttgctataatcatcgtcatactcgtcgctgctctcttcctcatgggcttcttctccatctacatccgtcagtgcgccgattcaaaccccaacagcgtcctccccatcacccacgcgcgctcccggagggtggcgcgtggcctcgaccaaaccgtcatcgacacgttccctgtcctggaatactccgaggtcaaagcacacaagatcggaaagcacgcgctcgagtgcgccgtttgcttgagcgaattcgaagacgctgaaacgctgcgtttgatcccaaagtgcgaccatgttttccacaccgagtgcatcgacgagtggctggtttctcacaccacctgcccc

SEQ ID NO: 13600 - DNA, 467 bp, Lotus corniculatus
  Predicted polypeptide sequence is orthologous to G2294
agcggtgtttatgttttttacactacacttggaaaacccttcatgatatgatataacaagctttacatcaatgatgcataataccaaacaggtagaatcccctttaaaggggcaaaatttttgtttaattcctacatgaatttcatctaatatgcattacattggcacagtgtatactaatacaaattgaattcagtcacggtcagtaatatcttcaagttgttctaccactggaagacaaacaaattgaatttctgataagaaaaaaaaaaaattgatttggcttgaacccctctcagcaaaagttccacaaacgaatgtcactctcttcatacacatcattaaacaggtggtgggttgaatcaatatcatagaaagaagaagcacttagcatctgatcaacatacttagtggatggcagatcatccaggctgtaccaaggttccatcatagccattgattcaaaa

SEQ ID NO: 13601 - DNA, 536 bp, Lotus corniculatus
  Predicted polypeptide sequence is orthologous to G2311
gggcggaatttgaatgttgtcactggtcaaggctccaatattaagtctaggacttccaagcccaaactaacagcaccttcaactccagttcccaatcagcaaaatgctactccttctgtgcaaaatgttgctactcctaaggttccaactccatctcaaaattctgctgaaaaggatcacgaggccaaagttcctccgaggtacaatgcaatgatatttgaagctttatcgtcgatcaaggatgctgatggttctgatatgaatgccattgttagtttcatcgagcaaaaacacacaaacacacttcatcaaaatttcagaaaggcattaggtgcaaggttaaggaagcttgttcatcaggggaagcttgaaaaggtacaaaattgctacaagattaaaaaggacaccccatcgggaccaagattaccctctccaaaatcacctgtgccagaacaaaaggatttacggccacaacaatccccaacctctagttttgtgacatgtaatgagataataaaggatgcccgctgatactg

SEQ ID NO: 13602 - DNA, 377 bp, Lotus corniculatus
  Predicted polypeptide sequence is orthologous to G2371
tcaatgatagattgattgattcattaattagcagtaattataataattaaccaagtcgatacatagttgtaagctgtagacaaaacaattgagaatccaatctccaacatctagtagtagtaggattggtgaggtaccatgtgagggttggaattagaatgagaattagaagagtactgataaaaatggtgattggtatctgtgccctggttcataggcacagtgtcaccattgtaggagcattctggtccagaatcatcatgttcagcttggcattccatgttcactccaaaaagcctaagtaccctgcttgaacttgaactaggacttgaagaactcatgttccccatcgctctcgtcctttgcctctcaccttg

SEQ ID NO: 13603 - DNA, 521 bp, Lotus corniculatus
  Predicted polypeptide sequence is orthologous to G2379
acgttaaagcaaactctatatcgaagcccaaattaggcatagtacagtgctgagttaacttataaggctaaattaaatactagctaaaagaatccaaaattactccaggataaatttctatttgagattccctcgtcgtgacagtagtatcaggtgaagcagatatgtatgtacttttgccatgcttataaccaaaaaacgcctttccagcaccaacactgaaacatctcccacttggctagctatacatatcgtttgacccagatcgtttcccgcgcttaattctctcaagctgaacctgtgtgtccataaacatctgcatcctctgcaactcaagatctttagtaaactgcatcctctgtttctccaaatccaccatctgtttcactttctgttcctccattctctcatacacttccccaaacctctctatagccttcgccaacctactcaacccttccccctccgcttcctccacttcactccccctcccatcatcttcatcctcctcttcctcctcc

SEQ ID NO: 13604 - DNA, 453 bp, Lotus corniculatus
  Predicted polypeptide sequence is orthologous to G2382
atgaaagcacatattgggatgaaaggggttacagattggtgctgcaaattattaaaagtgcaccgccatttatggccggttactcttacagatttaatctacttcgaatcaacatcctggtggtcggatgacacaaagaagtagaaaaccttacgggtagcagctcatttcagctagtggacaaatcttttatcgtaaactgttgcactctattcagatgtcaccaacgtccccagattacacaacacctaaattattcactgagattctctgtagaagagtctgtctcatcctcatccacttcctgcatcttggcaatttcagcctcagccctttccaaaatctgcttcttctgcaactccaactccctgttaaaatccaacctcatcttctccaactccatcatctgctgcctcttagtgttctcaatcttctcatatattttcccaaact

SEQ ID NO: 13605 - DNA, 596 bp, Lotus corniculatus
  Predicted polypeptide sequence is orthologous to G2404
gaaacaatgacaattctgctgatatgggatatgaaaaactatacaccacttaaaggatgagaataataccataagttcaagaaaacaaaataaacattaggacttgtccaactagtgcctagcagcaactagtcgtttgcagaccggacagaaatttttctgttcaacccattgctgtatgcactgatagtgatagctgtgaccacagttaagtctcccaatttcctcttctacttcatactcttcctgacaaatggtgcaatttttgtctacttgagacgcatcatccgaaatctgaagcttccttatgttcttccgcatctcttcttctttcagtccggtgctgacatacccaatcctctcactgagctcaagtaattgctcatacgacatgttgtcaacatcaagtctcaagtctctatgacggtcttgtgaatttaatcgtactatacttccttgaagcattataatctcagaatctcttacatagtatgtttcaggttcttcaaagggtggcgtgaaaacgttttcatcagcactgtccgggaaggtgacgacagaatgtcgacaagaatatgaacgctctctctgtgcta

SEQ ID NO: 13606 - DNA, 564 bp, Lotus corniculatus
  misc_feature (534)..(534): n is a, c, g, or t
  Predicted polypeptide sequence is orthologous to G2404
ccaatttcattaagaaagtgaaaaatgacaataacctcatccaatccgaaaagaaagcatagtccaattgcgagaccatggacagatataacatgtatatataaatataatgcttctaagttttgaaagatgcaaccaataatgcttatattgcatatgaaaaaactatacactaatcttaaggggcaaaaaaataaaattagaactgtcagtgtcgaaccacaacttcttgcttgcatacagggcagaagtttttaagcactagccattgttttatgcactgaaagtgaaagcagtgttcacatttcaacttccccagctcatcatctgactcatactcctcctgacaaatggtgcactttctgtctagttgatgttttgatgtatcatttgaaatgaaaagcttaagtttccttatattgagttccatctcatcttctttaaatcccgtgttcacatacccaattttctcacccagctcaagcaattgctcataggacatgttatcaatatcaagtctccagtctctaaatngatcatgtgaattcaatcttccccccatca

SEQ ID NO: 13607 - DNA, 595 bp, Lotus corniculatus
  Predicted polypeptide sequence is orthologous to G2492
cagcttagcaatagcagtgatgttattaggtttcaattgaacttcagcaacatgcgtcaacacatttacagcatcagacatatcacaatgaagcttagtcacagaatcaccacgcccaagctcctgagcaaatccataggcaatatatgtctttggacccatgtctggctttatacaacccttgggcaacttcacagccaggttaagagcacctttgtatggattcgtatattctttaaagggtaaggaagatatgaattcagcacagtgacgaggtaaacgttcctcaaataaattagaaggtggccaatcttttaatttcaatatctgaggccaatcgagccaatcatcacgaccatttgtatacccagtaaagaactggtggatattaatctctccctcacaccaatctaaacaatcaattgccttcacatccaaatgtctatcgtgcttggtcttaaacatctgacggaatgcacgccacatgacaagaggctcccagcttaaaccagatgcatgttcaagaacattgctaacaattacaggctcgcctttgctccaatgcaattgaaaatgtctaaagtcctcatgctgt

SEQ ID NO: 13608 - DNA, 513 bp, Lotus corniculatus
  Predicted polypeptide sequence is orthologous to G2492
cagtttagtactattctcatactaggcggaaagtgttaacaaataacatgattacatgacatcaaatcagcaaagctaatattttgccaacgtactgcaacatagaatttcatgatctatccaatcacaagttccaaaagtacaatgctcataacagcatctgactgtaaacttgaatcagcctaagcaccctagttatatatacagggtgttatatttatatgtacaccatcacaagttaatatatggtgtttcaaaagacctcatcaaggtgtgctagagaacaaaatatggagtcttcctaagaatcatgattcatggaacccaagatcaccgaaacctacataagcaactcaattttgcacatcctgtgggaatattcatactgtcatcacaaatacacttaagatggaaccttggtttctctagaccttgcattctccaagtttttgaccacatcaaccacagcatgcacagtcattttcttcacctcgtatttgtcctcgactgacc

SEQ ID NO: 13609 - DNA, 501 bp, Lotus corniculatus
  Predicted polypeptide sequence is orthologous to G2520
tccttcaaaatactagttctctccatctgtttctgttaataaaatttgaaaatgtctcaagtcttaaaacacaaatacacacctgctacacattgttatacaaaacaaatcaggggagatgaatcctattgcacaagagtttaaaaatgaaaaccagattttcttttccagttgctacttgctaatataatgaagcacatgcgatcagatgcacttcctataaataaatgatattatactataacaaaggacatacaaacctacaatctgcaataattgactaggttgttaataaagaaaataatgtaatcaatcccactgaatgatcgatcactcattcccaatgagacttccaagccaagaattacgttgctccttcaaaacccccaccaatctgcatatgcagccatccaggatgtgatccctgagcatacccccttgctgcttgtgattcatatatcactccagcaatgtcaaatggctgggtaacaacatcttttg

SEQ ID NO: 13610 - DNA, 574 bp, Lotus corniculatus
  Predicted polypeptide sequence is orthologous to G2522
aaaccacaaaacaactaccttatgtaaatttcttccaaataggatataaacagtacttaatcaagaaaatgaaatcatcaaattaaaaattcctgaaagctacaaaaatagtaggacaaccccctaaagtcaatcatggctctaggtaacatttatcaaattccaaaagtcagctcacttctacactactgttggtacttcccattctgtcatcactcattcactactacattaaaattagatgagggaccatgagcctgaaatagaaatccagtactactactggtgaatgctaaataaattgtcacccgcgcattaaatcaatgtcgatatgggaattacgcatatccaatgtacgcgatgcaggccaagggctgggagatgagattgcagtcagattctggtttggggaaatgctattcactgcgactggattatgaactgcctgatgatctgactccatagaaacttctgcaccttctgaatcttcatttttcttgttcttcgtctttgatccaccccaaatgaagctcccaactatcacctgaaccagacttgctgcaataagcactcc

SEQ ID NO: 13611 - DNA, 364 bp, Lotus corniculatus
  Predicted polypeptide sequence is orthologous to G2559
gttaaatatatgtttttaattttatcattaaaaaacgtaacagaaaagtaatgtagtttattacaaccatgaagcaaatttcaaatgtatagcaacagaaaagcaagcagagttgggttcatttcttctgcactgggttgaagccccttaaaagctgaagttgaagcatgacagaaatttcttgggcacataaccgcgggtacgaaactttgcagcggtctcttctaccttgaggacttcctcccccttttgagcttcaatcagtgctttcttctcatctgctagtcgatgagtttcagcaattttgttttgcattatttcaacataatcagctttctttctgtccatattttcctcaattttt

SEQ ID NO: 13612 - DNA, 300 bp, Lotus corniculatus
  misc_feature (166)..(166): n is a, c, g, or t
  Predicted polypeptide sequence is orthologous to G2559
gaatagttcaattttattcagactgagtaaatggtaggtatatacacccccaatatgtataactattcacacataatagatttgaaagcactaaaaactcacaacaaacgacaattcacaactcacgactacagtggtacctggactaagtgaacgtggacaaggnaaatgcaacaacgatttttggtgaatcagggctagaggggttgtggtattagaaaaaactaaagggtttcttgggagctgttccagttgccctgtattttgcagctaactcctctgccttcagaagatcttccc

SEQ ID NO: 13613 - DNA, 540 bp, Lotus corniculatus
  Predicted polypeptide sequence is orthologous to G2559
acaaaatgaatagttcaattttattcagactgagtaaatggtaggtatatacacccccaatatgtataactattcacacataatagattgaaagcactaaaactcacaaaaagacaatcaaatcacacacatgtactgactaatgaactgacaaggaatgcaacaacatgtttgtgaatcaggctagaggggttgtggtattagaaaaaactaaagggttgtctgggagctgttccagtggccctgtattttgcagctaacgtcctctgccttcagaagatcttccccttgtcttggcctcaataaatgccctcttttcttcagcttccctgtggaccatagctattttgtttttcagtttctctacatatactgcctttttcttctccaggttttcctcaatctttctcaattcaacctccttagcagctatcttgctgttctcccatgctgaaatatctgaaagctgagggtgaggcttgttatctgcaattgacttttcactttcttcccatggcttgattagtgacagcctcttct

SEQ ID NO: 13614 - DNA, 560 bp, Lotus corniculatus
  misc_feature (18)..(18): n is a, c, g, or t
  Predicted polypeptide sequence is orthologous to G2592, G2713
ggaaaaaaatagggacantgggtacagataacagatgttctgtactttacaaactatgaggcttaaaatgtcttgatgcagtttcaccatcctatgaatgtctaaaatggagattaaacaaatcctatttgtctcaccacatataatatctattcacatgccaattttgtgtcgaagctagtcaagcaaatggcaaaagcctgaaatgcagacagcgggtaccgatagtccattgtaaacatgtccttgccaaccttcccgaactgaagaataatcttgtcagggtcagatggtggctgagatggtggtgccgctcctgttcctgttggaggagctccaccaccacttgcaggctgtgttgcagcaatcagctggaaattcttgaccgacgcgacagtcactcggcccctgaagttgagacaccagcattgcagctgttcatgccatctcggagacttgttcttaagaaccaagggtctctcctttccctcctcctcctcctcctcattgccagctccgattatgtctgagaacctggcgctgctgaactcggttgagtt

SEQ ID NO: 13615 - DNA, 557 bp, Lotus corniculatus
  Predicted polypeptide sequence is orthologous to G2592, G2713
aatcgaaactgaaaagcttgcatagcaatcgcaactgaggtgtctacaaactcatggtcaaaaaagaaatgttggtttacaaacaggcacgcaaaaaacacaacatagattccttgatggtagaacatattgcacacaaacaacaatatatacaacggagagaaggagggaggattttgaagctcaggtaaaccaaagagaaaaccagaaaatctattgccaatatcaaacctgtgatactgtgagagatattccaaccagataacacacctgcttgttaatgccggcaatcattcacaagcgatcttggtgtcaaagctgctgaggcatattgcaaatgcttcaaaggctgagattggatattggtaatccatggtgaacacatcctttccaacttttccgaattgtagaacaacattttcctgagcctgctcagaaactccatttctaggagaagcaaccagctggaaatttttaactgaagcaactgtcacccgcccattgaagttcagacaccagcattggagttgttcatgccacctaggggatttgttttt

SEQ ID NO: 13616 - DNA, 560 bp, Lotus corniculatus
  Predicted polypeptide sequence is orthologous to G2592, G2713
gttcagctatggcacaagatccaagtcagagtcaaagagtgacaccaccataaaggagagttctttgatggtggttgatgatgggttgaagcagagttgttgggctaacatgccaccagagcttctgagagatgtgctcatgaggattgaagcctctgagcataattggcctgcccggaagcatgtggtggcctgtgccggcgtttgccggagctggagagacatcatggaggaaattgtcaaaccgccacaaatctcaaccaagttgacatttcctatttccttgaagcagcctggtccaagggattctcttcttcagtgctatattaaaagaaatcgcagcaaccaaacatattatctgtttcttggtttaaaccaagcttcaactgacgatggcaagttccttctagctgcacgcaagtgtcggcatgcaacccacactgactatataatctctctaaaccatgatgatgtgtcgagagggagtagcacctatattgggaagttgagatcaaactttctgggcaccaaattcactgtgtatgatgcacaccctccaa

SEQ ID NO: 13617 - DNA, 559 bp, Lotus corniculatus
  misc_feature (379)..(379): n is a, c, g, or t
  Predicted polypeptide sequence is orthologous to G2592, G2713
atttttccggtcgaagtcaagtcgtgctgaaaactctttatctggacctttggctgataaaaaagacgggacactcgtgttgaaaaacaagtctcccaggtggcatgagcagctgcagtgttggtgcttaaactttcatggacgggtgacagttgcctcggtgaaaaactttcagctggtagcttctgcggaaaatggacctgctggaccagaacatgataagattatcctacaatttgggaaaattgggaaggatttgtttacaatggattaccggtaccctatctcagcatttcaggcttttgcaatctgcctcagcagctttgataccaagattgcttgtgaatgacgtgtatagacagcttcaatccacaatgantattgctgtttctctaaggctggtagaaaaccatggtttgaaggtcggatgtcatgtcgggaagcaatcttggaaaatgcttgggaaggtggattgatggtgtgaactgaatctgacaaagacagtgttgcacattgagtgttttagttagtttctgcaatcatgattcatccattctgg

SEQ ID NO: 13618 - DNA, 538 bp, Lotus corniculatus
  misc_feature (124)..(124): n is a, c, g, or t
  Predicted polypeptide sequence is orthologous to G2650
taatagaatacaaaaaagatactgtcaatcattatcatctttgaatccacgtaataatccatcaacattaatacattagaatccaaattaataaactaaagatccaaactacaagatgcaaatngttctaatgatcgacaatatttttggccaaattaaaacagcattcaaaccaacaaattccaccatcaaagtgtagcatcatcttcttccaccatcatgccatcatcattttgctaccagacaagcaatcttgaagaaggaaaacttgactccagcccttttagagttaagaagaactattggcagtgtcctgagtgttcaattttcagcaaaattccttgaaaaggttagtctctagttaagactattcctcagccaaaacatcatccaagaagacaaatacctcagtagtggttcatttcttgatttctagttctgtttcttcctccataatgtctctccaaaggcgtagcaaactaaagaaatgactagctataaacacagtgaaacaactactggcatgcaccaacaaata

SEQ ID NO: 13619 - DNA, 508 bp, Lotus corniculatus
  Predicted polypeptide sequence is orthologous to G2650
tagtacaattccaggtaatacatcaaaggcagtacaattatttcatacgatcgggggtaaatattcaacagcacagatcatcatctaattattcctttcaaataaagataatatgcaacagcaattttggaagtacttgaaatcaaaggaagctacttgaagtacttgaaatcaaacgaagccatcttcgcttagttctcttcagaataaacgtacaagggaaaaaggcataatcctgaaacggggcatttttgaagaaaaatacaaaacctcgacaggattttctctcctatggaacatcacaacagctcaaaaaggggcttgttcaccactcctgaagctcttagtaaaataatgaatgagaattatttttaatgaaaaaatatataatatccttcggcaacctggcagcccttccattacaacttttcttccctgattggttcccaaaaaaatcaccaaaagaatatgtaccttaagatattaaatacctatctcaataagatgt

SEQ ID NO: 13620 - DNA, 407 bp, Lotus corniculatus
  Predicted polypeptide sequence is orthologous to G2655
atattaaggtgatttctctactaggattttgatactagctttggcacaggtggtagacaagtagaggttacaagctgataaaggaaaaaaaaatagaggatagaaaggctttaataatatttcttcaaaatttaattcagcagaaactagcagcttcttctggaactgtgcttgataattgattcatagcagctgcaatttcatccacgtggggttcagctcacatccttcctctaccttcacactaacagaagcaagtaccatatcttccacagtagtaacattaagatggagaatgatgaaaccaagactttgcatcccaagaaccatcttcacaagcggcccgggttgcttcttggacagtatcttaatattggcatgaccatccaccaaggtcacctctatgt

SEQ ID NO: 13621 - DNA, 490 bp, Lotus corniculatus
  misc_feature (126)..(126): n is a, c, g, or t
  Predicted polypeptide sequence is orthologous to G2694
ctaaaatatacactttccaaaagttcattaaattaaagttgcaggattgttcttcaaagtaccattatcaaaagaaaagaaaagatcactgtcatataaacaagtagcatgcagattgtgcagatngtgggtatatgcccatatgcatatattcaataaatcactgaggtggtctattagacaggcagtgtgcattaaaattgtaagaaaggtagagctgagatcagataaccaggctagcagcaagaatattatactcccctggttcatgacaagtgatgttcatcatcaacccagcatgctcagactgaaacaaattgctcttcctggttttcatctcaggtttcaatatccattcattttcggtcgtagatgctttcaccagactcctcatgagttcaatttaaacatcaaaaagagagaaatgaggtcaatgtttcatcacaaatccaaatcaacatgaatttagagatttgaattcccacgagtt

SEQ ID NO: 13622 - DNA, 440 bp, Lotus corniculatus
  Predicted polypeptide sequence is orthologous to G2765
aagatgtctgctttcttttcatgtgatttatcagaagagtacatatccaaagtggaaagagtagaagcacaacacttcagtgtgtacacatgagtttacatggtacaagaaattacatttatcactcacttcctcaccacattcaaattacttgagaagggtgcttataagaaatcttctaaagatgatgaactgaatatagaaattctccttcttttttgggttcctatgacctcctgtgaaacacaaaatctattgagtacagacctcagagcttggtgaacagagcccgcgagaaactgacggtactcagcatcttcaaagttccgttcttcgcagctaataatcacaagcacattcttcatcctgcttcccagagttgcaatatctgccttgattatcataagatgaagagaatctagttcttgtcttatattaga

SEQ ID NO: 13623 - DNA, 497 bp, Lotus corniculatus
  Predicted polypeptide sequence is orthologous to G2771
tcatatatacttgagtttcgggttccagcacttcacatccgtaatgtactttttccagctccccccccccccccatcctcccgcataaggagagggtttatgctatgcctagtggaacaatgaaactaatgcttagattgtcgggaggtgtgtaagaaattaagaactgcttttaggatgacaaaaaataaaatttcatacaacacttgaaagcataaatgaagaacattgatcaattaagagcgcgggtgtgatctacaacaaaatctgatcagctccagagaatgccagaatcgtgtaactgaccaagcacttatgtattctgatagaatagaagaaacaatgggcatggatgtgggtcgcgaggcttgccgtatatcttgaaaattagcttacggaaaagttctgaacgagcttgggcatcacaattcaacgaaacatgaacatgaacatgtgaatgctgaaaagatgagatagcgcaggccaacaagcaattc

SEQ ID NO: 13624 - DNA, 583 bp, Lotus corniculatus
  Predicted polypeptide sequence is orthologous to G2783
tgttagagagatgatgcaaccaggacacggcatggctccacccaccatggtgcagcagcaaccggcgcagcagtaccaacagccgccgcctctgcagccgcagcaaccgccttacgccatgatgcctccccaggctcaagcgccgccgcctcacatgtgggcccccaacgtccagactccgcaacagcagcccgctaccgctgaggaggtccgcactctctggatcggcgatttgcagtactggatggacgagaattacctctacacctgcttcgctcacaccggcgaggtgacgactgtgaaggtgattaggaacaagcaaacttctcagtcggagggttatgggtttatagagtttaacagtcgtgctgctgctgagagagtgctgcagacgttcaacggggcgattatgccgaacggtggacagaattttaggttgaactgggcttctctcagtgctggcgagaagcgccatgatgatactcctgattatactatttttgttggtgatttggctgcggatgttactgattatctccttcaggagacatttagagctcgttataactcggtgaagggggct

SEQ ID NO: 13625 - DNA, 510 bp, Lotus corniculatus
  Predicted polypeptide sequence is orthologous to G2789
gatgcaattaatatcatcaaaccccacaaaaaatccatgaatttatacatccttcttcaattcatcaacaccgagatcaaagaaaggctttaattaagcgtaaactaagttataaaaggaagaaggagaatgaacagtgataaagtgaaaaaaaggacaaaaacaaaacaaaacaaagataataattaactgatctgaaaagcatgaaaacatttggttaaaaaggtgggcgagcactgccattccaataaccctcagatggtaattggcatgaattgagaagattttgaggcactccatggaagagtgaagcattaggatccggcatgagttgttgctgttgtggttgcgattgcggttgttgctgcggggttcccataatccctggtgaccctaatcctccgctacccgtaacggtagctggggtttcctcatcctccaagggcagtctttcataagcagcatttccaaaggaagcagccatgatgaccacaggacctgaggccagca

SEQ ID NO: 13626 - DNA, 589 bp, Lotus corniculatus
  Predicted polypeptide sequence is orthologous to G2791
atagaaaaagatcggatcaaggaatagaaagttgacagagttgcgattaattaattaactcaaagttgaaactagaaatagcatctatcaaagtcaaggcaaatacgacgtcgtcattgtaggtccacccgatgatagtgacgtttcattttcctagactttagaaattccaccaccacgtcattttctgcgtttcttcagcacgcacttcttcacgtccaacaaacaaagcaaaagacatttcaaaaaaaaaaaaaacaaaaaaaacaaagcaaaagtcaaccaacggacgctgcatctttgacaatgctgttcgcggacatgccgggagaagagggcccattatcaccgttggatccaattaccgggctagggttgttgttgatgttgtggcccgcgttcatcaaagggttcctggcgtgacacgtggcggcggagactgcggtggcgagggaaataggcatgaggcagagaccttttccctggaggtactgcatggcggagcccatgtcttcgtccatgagcttggccacctgctgctccgtcacggtgaggctgtcgttggaggatgaagctgtcatcttctggg

SEQ ID NO: 13627 - DNA, 509 bp, Lotus corniculatus
  Predicted polypeptide sequence is orthologous to G2850
ttcaacaaacctttaataacaaggacaactttacatttaattggcttcccattagacatatatctatgaacaatggccggcaatcacaggggtcaccttggggtcattatagctaaaggtatgttatattgggcaccatggcccagtgaaatcttcttcaaccactcgacataacagaaattttcccagcattttttttctcccttctttttctttaattaccacatatgattacatctcattggccaggataaggatagtagttaacaaaggccagagccaattaagatttctttcttcttaaccagcccaaagcatgaccctggatcatgagaaattctcacatgagcacaaggactataaacacaaattaccattaaaagcattggaaaacataaatggccaatttgggtcatttaatcgagtgtctaatttcatcccaagtgagagtgttaagtaagttagcccctaaaagaaagaaatactcacgtgatctccgatagcgatct

SEQ ID NO: 13628 - DNA, 575 bp, Lotus corniculatus
  Predicted polypeptide sequence is orthologous to G2851
gatcttaaacagaacattaattaccagtaataatcatccttctgaaccaaaggaggaataattgcaccacctcattaaatgcatacttagaaactaattaaaattacaaattaattaatgttttcacaacttatttaagtcaacctaattagattagggacaatacatgatgcatatatagcatcgtgagcaatcagccttttcattactttagagtgactgctcacgatgttatatcatcttaatatttcttccttctttattctaaaaaggaatgttaaaatccaccgacgccatatccaggtgcccagtaatcagctccattttcatttccaacatgttgggtacaagagactggaaccaagcacaaccctctactcctcaagtcttttggcctatctccatcctggtttggagctccctttcttttcaggccagaatcatttaacagctgaccggggtcctcaggaaatacagcatttctttctccatgtacatattgttgattcctcatgttttttgatccattacccaagtaaggagaactgagtgcctcaatttgaccttgcaggaat

SEQ ID NO: 13629 - DNA, 576 bp, Lotus corniculatus
  Predicted polypeptide sequence is orthologous to G2851
ctgggaaccctaactggtggaatatcaatatcaatagcatgaggccaccatctccacaaccacaagctcctcctttccttcccactccttccaactttctcaccccatatcccccttcttcttcttcttctcttccctttccttcttggccagaaaatcaagaggttcctgagtcatggagccagctactcatgagtggagttgtggctgaagaagataagggtgctatggcccagtttcagaatcaaatgctaactcaggctccaaatgcttcctttattgatgttaaacaagaaaactcgggaaacagctatgtgtatgggcatggaaacgaagaacttcactcagcaaagtcttgttggtctccaaaatcctgtgtgacaagttttagtagcaacatgctggacttctctaacaataatagggatcatgtgaggcttcatccaccaccagatctatcttctgagtgcaacagcaccactgcatctggtggggcaatgaagaaagctagggttcaaccctctacatctcaacctaccttcaaggttaggaaggagaagttaggtgacagaatta

SEQ ID NO: 13630 - DNA, 585 bp, Lotus corniculatus
  Predicted polypeptide sequence is orthologous to G2854
ctttttttaataaataatcagcaaacatttgtaatcatacaaaatccgcacagaacatggatgtcattaggaatcatagaatactagttttaaaaaagaaaaaagagcaacataggtcttccaaccaacggaaaataagtatcacataggattacagaagttgggaaaattggggctcaagatttcaactgtatcccatttgctgtggctgctgctgctgttgctgagctggttggtaatttgcatatcctggataaccggcatacatgttggggtcctgtccagcaggagcataaccataattttcataaccctgagcatatccataatatccagcaccgccagcactattattccactggcttggatctgactgagtctgtttgtttgaaggacttcggccccacgaaagccgaacattttgtccgcctaaaagtgtaccattcaaaacccgaagtgcctcctctgcgcagctcctgtctgcaaattggacaaacccacatcgcttgccttgtggaatcttcacatgaactaaatctccatacagcccaaaaacttgtctcaaatggtcatccgtaacattag

SEQ ID NO: 13631 - DNA, 563 bp, Lotus corniculatus
  misc_feature (550)..(550): n is a, c, g, or t
  Predicted polypeptide sequence is orthologous to G2854
aaatctaaacatcaaataagaatcaacaagcaattttttaacgatacaaaagtcggctcacataacttaaatgttaaaagcaatcaaaggggatcgggaaaaggaccagaaatggttttcaacgagacaagaaactcgctaagtagcatatgggttacaaagaacagaaatatgaagcactgatttctcaactatatcccatttgctgtggctgttgctgctgtggttggtaattcgcataccctggataactgccatacgcattgggatcctgaccagaaggagcataaccataattttcatatccctgaccatatccataatatccaccagcagccgcgtactggtttgaatctggctgagcctgtttgttagaaggactgcgtccccatgacagacggacattttgcccacccaacagtgttccatttaaaacccgtagtgcctcttcagcaccgctcctatctgcaaattggacaaatccacatcgcttggctgctggaatcttcacatgaactaattctccgtatgggctgaaaacttgcctcanatgatcatcattg

SEQ ID NO: 13632 - DNA, 625 bp, Lotus corniculatus
  Predicted polypeptide sequence is orthologous to G2885
aagaataaaaaatagagaatttccttttgttgctatgtgacagatgaatggtacaatgttcatatcaacaaaaattaatgattgactcaaacacagtaagatcataaaaacttgcactaaggaatttaaaaccctcaatacaggccctacccactaataagattagaggtgtcatctccttcctagagatgtcaccatttctgtaaaccaaaaaatagaaaaccctcaatacaaagacttgacaaaagagtatttcctcttttttcttcccttctagtgtattatgtatgacagttaatcttccaagataatttgtctggaaagatctttaccaatgccttcaagcaagcaactatctcctatgctttaattttttgcgtagctttcggctacattttaacacacctcacaagatgctccatatgcagtaactacagaaacgcctccaatatttggacattataaaccgagactgatggggatgtatgtattgttagcaaccatttacatcaaactgcagctacaaacaaggaacgtcagaatgttagatcagtgcatctttattcaccaataaaagaaacatagttgtaaacttataaacccgtcacgcataatacttagcata

SEQ ID NO: 13633 - DNA, 557 bp, Lotus corniculatus
  Predicted polypeptide sequence is orthologous to G2907
gttttttgagttaagattttactataatgattataataagacaattcatcagtttactctgctgttagatgttaagccatacaatgaacaacgaaacagatggaaactagcttctaagttgcagttggcatgaaaatatcttcgtccagcaatgcttcaaggtcaatgaggttatcaaattctcttgtttcttctgaattgttagaagtcctctcgtgctttacctgattttcttggatctcagttacaacattcaacagcctatggtattggtctctagcctctggatactgaaccattgacttaaccctagccaaggctatctgcaacctttgctctgtttgtttccttccttcctttaacaaatcatattcatcctctgtggaagattcaccttgtaccatatttccctctgaaactccctccgatttaaatccacgcaaaccacatccttttcggcgccaacgtaaaacaaccttttcaagaattccaactgaccaaattatcttcccatggttcttcctaacctggtgacctctcacatgagcctgaatttt

SEQ ID NO: 13634 - DNA, 502 bp, Lotus corniculatus
  Predicted polypeptide sequence is orthologous to G2913
ctcatccgacattaaagtttcaccatggttcataattacaaagttacctttaatcatctcctatgcattcaaaggtgtcagcatatgcatacacccatagcttaaaaaatcaaaacacccacaacaatggctcttaatatattcactatctagctatttctctggctctttcagatgtgattaaacattggttgttatgttgctttgtctttctcttctctttcacatacaaaatatgaactcttaaaacattcaagaacacaaaaaattcctcgtttgggaagaggaaaaagctgtgtcccaagtcaactcacaacaaaacatgctcttggggtggtagctgtgaacctgaacacaaaacccaactccctctatttctcatgtggaactacctggattattgcagagaagcaaaaagcatataaatcataggccatatatcttatatactttaaaaaatatatacaaatacatattataatataacatgtcaatcactaca

SEQ ID NO: 13635 - DNA, 535 bp, Lotus corniculatus
  Predicted polypeptide sequence is orthologous to G2913
gaatagctcagatgtgccacataataattactaaggtatcatagctgagatcctgaatacattacccacttccctccatttcttttatgcaatcacatgcacacttgagccggtgcatccaaaagttcttgagacataatacatatgaccaatctcaacctgaactcataaaacatacaaacagatagagagagattaaatagtctgagttcgcacttcatcctctaaaacaacttcagatccttccttatcctgatgctcagtcactctctgttcaagaatgaacgtacaatcataataacaatgtaacgtacaatgcctttaaaaatttatgaaaaaactaatgacattatactcaagtttattctctattagtgccattttcagcctccaggcccagacttcatcaaataacacaccttggagaaagttgcctcagtagtatcctgatccagctcgtttcttataacatccataaagccaataagctagaaggcttcttctctaatcaattagaactctatttaatgccttg

SEQ ID NO: 13636 - DNA, 408 bp, Lotus corniculatus
  Predicted polypeptide sequence is orthologous to G2933
gtgaatgagaaaatttgttatttaaaacttgtatgagattacaagctacatttattggagtttgaagagaagaccaaatgagaaaaataaaagtgctggccaacaaccacgtactgaactaaccaacttatacaattatatagacaaattaatagtacagtactgacttctcttttcaattaaaaaggaaagagacacatcagctaagtcgaggttgatttatgtttacataacaaatgttactcttcaatgccatgcccctcctcctaattgattagaaatgctttgcttcttctcatatattgacaaaagcttctcagttagaatacaggactctattctatgagctttttccacctggaaatgcaggttgtagaagacccttccttcaaaggtttcagaggaaga

SEQ ID NO: 13637 - DNA, 524 bp, Lotus corniculatus
  Predicted polypeptide sequence is orthologous to G2933
aacaataaggtaagatttttttatacatcgaaaagataaattacacctgtcaggatcctttgacctaactcatatgtccctcagctcctactacttgagttatcctacggggactaaggtcggggtttaattaaacatttatgtttagataacatacattaacttctaaaatccactaatatatacatattttgatcagagccgtgatgaagatcatttgatcttaagaattacagccaacgcctatttgattagaacattcttggcttcttctcatatattgacaaaagcttctgagttagaatatcagcctctaatctctgagttttttccacctggaaatgcaagttatagaagatccttcctccaaaggttttagtagaagaagcatttagcagtaaatacccattattttctagacacagcaagatctcagacagtggagtcttgtggtgagcctcataagaggaaatatgaatagcagcctcagtatcattgagccaactatttgaaactacgaaatc

SEQ ID NO: 13638 - DNA, 553 bp, Lotus corniculatus
  misc_feature (112)..(112): n is a, c, g, or t
  Predicted polypeptide sequence is orthologous to G2964
aatgtaaatcataacaggaaactcaacaattcagatacaagaagcaattgaatttaagaagttgaggtaaaggctcctcattaattacgatgaggtgaattaggagcagatngacaaaactctctagctagaaaatttgcacagttcaatcctcactaaaaacatgtaaactactgaattctatcacattccaggcctgcgtaattcatctgttccatgagcaaagtggcacctttccccaaaagtgcacgagccttgggcaaagttttcacacagcttagtcttcaagttgctcccaggggcagaatgctgtgagctaaagtttttcgctggaggcccagagacagaacttacacttagaataagttcatgaaccattgcactggcttggttgatctgatcaaaactgccttcaagctcgatatttttaaggttgggatcagagtcatgttcccttatggaaagtttagctcctgttacacgacagatttgcttggagttgacaccattttttccaatgatagctccagctagggaagcattgatactaatc

SEQ ID NO: 13639 - DNA, 493 bp, Lotus corniculatus
  Predicted polypeptide sequence is orthologous to G2981, G2982
attttgatttcaatagcactccttttgagctgcatgatgacaattatgttctcaaggcaatgaaatttcatgagagacctgagaatgataatataacacacaatcctactgatggaggtgaaggttctagcatgtcaggtttgtatcatgcacaggttcctactttagtttcaaacccggcagttaggccacctccctcgtcaccacaactacctggaatattaaaggcaagagttaagaatgagcactgatctgctattgtcatattgtcttgcctctttaggaatgtttgtatattgtgtaaaataatttgcctgcaattgtctgtctttatatttcgccaacatcgccaaagtcaatctctaggttagaagcaaattggtcctcttgcttctctctattcttagggattgattttgacattcattgctaatgctaacccgcatcaagtatttgtcctttcgtagctataatagagaaatttgcttgtatt

SEQ ID NO: 13640 - DNA, 464 bp, Lotus corniculatus
  Predicted polypeptide sequence is orthologous to G2989, G2990
actaatctctcatcatcatcataatctcatccataatataaactaacaattaaaaaccagagagaataaagaagaaaggtaaaaattaaaccactaattaaactaaacgggtaccatccttaatctaatgttctaaacatgttattatcatcatcattttggttcttccccatgaaagatcgatcaagattcaagatgaagatgacccattagcacgaactgttgctccaccatcgttctggaagtgatgatgaatgggatcctcagcaccatggttgcgatttccattgccattgatttcagaggcgctgctaatgttggtgataacagggtcatgattttccttggcaaaaaaactcttagcagaaccagcatggttgatatggtggttgatgttgttgttgttgatttcgttgctaccatctctcttcccaaaagtgttcttgttgttatgcatccaaact

SEQ ID NO: 13641 - DNA, 586 bp, Lotus corniculatus
  Predicted polypeptide sequence is orthologous to G2993, G2994
aataagaaccaaattgttatttcttgaggagtcaagataaagatggtgaacatgagagtatcaggtttgaaaacaattgttgtcacaaggtcaaggattttgaactcccaaacatgagaccacaactgctactgcatgtctgcatcaatccaccacgaatccatcgcatgactgtcaccccaatttaaaacattcagagctaacaaggttaatttctgtgaatgtgatcattaatcggtgctgctatttctgctgtgaggattgttaatatcactaagaagttgaaagccatatccaccaccattgatcttcttctcattcccaatctcagaggaagatctactcttgttgttgtgcatccaaaccttgaacacctctctggacacgccaatgccatcacaaaacttctggatcgaaccttcctcctctctctgcattctccaacccaatttctctgagaattccagcatcttccccttctgctcttcactaaacttggtcctgcacctcttcttcttgctcgggttctctgttccaagagctaactgcacgtgcggcggcgccgactttgatatctggctgtgaa

SEQ ID NO: 13642 - DNA, 576 bp, Lotus corniculatus
  misc_feature (554)..(554): n is a, c, g, or t
  Predicted polypeptide sequence is orthologous to G2996
agtgtggaaaaaaattggtgagaaattttattttatatttttgaaaaaaagaaaaagtggagattgatatggagtttgatgagcaagaagagcaagatgaagaaatggggatcccggagtcaccgccgccggtgccggcgagttacgacccgcttttgaactcagcaccgagatccaaaatcgcagaggtttcagcgcctgtaatcgggaggaaaggcggctcgtttaccccgccggtggcagcgggggttgtgaggtacagggaatgccagaagaaccacgccgtcagcttcggcggccacgccgtcgacgggtgctgcgagttcatggctgccggagatgaaggcacgctggaggctgtgatctgcgccgcctgtaactgtcaccggaacttccaccgcaaggagatcgacggcgaaacagtggcctcgtgccagaggcagcagcctccgcctcctccggtgcaccaccaccagtaccacagccaattctccccttactaccaccgtggacctcagcaccatgccgcctccggcggctacctccaccaccanctgacaacatctccgacggcgc

SEQ ID NO: 13643 - DNA, 460 bp, Lotus corniculatus
  Predicted polypeptide sequence is orthologous to G2997
ggaggaggaagaagaagaagaagaagaagaaggagaggtcgagatggggttcacggtggcgccgccgggattgactcgctaggaaactcagctgcgcggtccaaaacaggcggtggcatagaaccagaaggaggtgcagcagccaccgccttaggcgttggtcgcaaaaatgggtccacagggacagtcagatacagagaatgtcaaaagaaccacgccgtcggtattggcggccacgccgtcgatggctgctgcgagtttctcgccgccggacaggaaggtacgctggaggccgtaatctgcgccgcctgtaactgccaccggaacttccaccgcaaggagaccggcggcgaaatcacctcctaccagccacggccgccgcagcagcagccagcctaccaccaccaattctccccttactacccccgtgccgagccaccgccttccgccggctacctcc

SEQ ID NO: 13644 - DNA, 540 bp, Lotus corniculatus
  misc_feature (535)..(535): n is a, c, g, or t
  Predicted polypeptide sequence is orthologous to G2997
agaaggagtaagaaccctagctagatctccattaaaattttacattattacaaagttctcttgtctcactcataatcctattttgagactaaaattcagtgaagttggagaaaagaggatgataccaaaaatgcccaaccatgttcttgacctaaaaatggaaattaacaaagagatggaaattagggtttcttaccaagagtgtgcttgttgttatgcatccaaaccttgagaacatgtctcttgatacaagcttcctcacagaactgctccaccgcagcttcatcatgcttctggatcctccaccctaccctctccgcaaattccagcatcttatccttctgctccggcgtgaaccttgttctgtgccgtttcttcgttcctccgccgctgctgctcgggttcgacatgtcttcctcctcccttctgaacccgccggaacccgccggtggaagggccaagggccggtgctgggacagcggtggagtcaccagatggtggaggtagccggcggaaggcggtggctcggcacggnggtag

SEQ ID NO: 13645 - DNA, 507 bp, Lotus corniculatus
  Predicted polypeptide sequence is orthologous to G3003
catttcccaaaataacaagacctgccaatgaggtttaaaatccaaccaaggatccaaatatgtacatatccaacatccaagaagcaacatcatcaaatacatcatagagttgtttacactttacaaaatatgactactacatattccctatagctgcagaataccaaaaagatcaacaaaagacatcaacatggccaccaaccgtaggaggcctaccaaaaagaagtaactgtacaagctgcaactgaagcaacctcctactcggctacctgtgaatctgaaatggaaataaggagggggtaagtcacaaagacttagtgagggcctataaaccaccatgaactagaaggggaacatcatagacacgattttctctttaaaactcaggataaatatgacatttgatcaagtcaagtaacttaaatcactttcataaaacatatatgacatggtaaaagcttcatgctttactaactcaaatcactgtcactttgacatagagaaaac

SEQ ID NO: 13646 - DNA, 505 bp, Lotus corniculatus
  Predicted polypeptide sequence is orthologous to G3055
gctagtgctgctgcttcttctgctgggaatggagctaatgtcaagccttctaattggaaaaccaggatttgtaataagtgggagatgactgggtattgtccctttggcaacaaatgccattttgctcatggtgctacagaactgcacagatatggtggtgggcttatggagggagaaagcagagacactgcatccgctattgcggctgacactaaacagggtgtgccttcaaagactcttgctgataatgtggttgcatcagctactcctattgctcactcagatatttatcatattggagtcccatcacagaggccttccattgtgctgcagaggccagggcaaagaactcttcagaagtggaaaggtcccgataaaatcagtagaatatacggtgactggatagatgacatcgaatgaagttattaaccctgtcttcagaacgaggaaaatgagtgatcctcgcttgatgtattaccatggaacaaaatatgccaggatttcg

SEQ ID NO: 13647 - DNA, 576 bp, Lotus corniculatus
  Predicted polypeptide sequence is orthologous to G3060
taaagagagcatcaattaacaaataaaggacagtgcaatgggaaggttcaagtagctaagtaaagaaactcaaaacagcaaaacttagcatcagaagttctgtcagtaccactaagtagcaatgcacaacatattaataataataattatagtcctgactattacgacaatccacctgaataaaagaaagttcccactcctcatttccgcaattcagcaggtccatgtgcaaaatggcatcgttctccaaaagtgcaagttccctttgcaaaattctcacacagctttgtcttgaagttgttgcttccatgatggccatggccgccaggaccaccagcaccaccttggtttgatttaggtggtgcagacatttgcagggtcaacagcaaatccttcaccatgttactagcttccttaatttgatcaaagcttccctcaagttcaatgtttctaagatttggatcagactcgtgctctcgaattgatagtttggctccagtttgacgacaaatctgctttgagttcacaccacccttcccaatgattgctccggccagcgaagcttccacgctgatc

SEQ ID NO: 13648 - DNA, 635 bp, Lotus corniculatus
  Predicted polypeptide sequence is orthologous to G3060
tccaaaacccctttctcagggttacgattagggttagggttttcccaccttcttcgttcactttccttcagatctctctccaattgaagcttctcctgttccgaatcctctgttcgttgctctattatcccgatccggatctatggatttccgcaagaggggaagacccgaacccggtttcaactcaaatggaggaatcaagaaatctaagcaagaattggagtcattatcatctggtgtaggaagcaaatcgaagccatgtaccaagtttttcagcactgctggctgcccatttggtgagagctgccacttcttgcactatgttccgggtggttataatgctgttgctcatatgatgaatctagcaccttcagcacaagcgccacctagaaatgttgctgctccaccaccacctgtgcctaatgggtccacacctgcagtgaaaactcgcatatgcaacaagtttaacactgctgaaggctgcaaatttggtgacaaatgccattttgcccatggtgaatgggaactcggcaagcatattgctccttcatttgatgatcatcgtccgattggacatgccccagcaggtcgtattggtggtcgaatggagcctcctcctggtcctgctacaggct

SEQ ID NO: 13649 - DNA, 679 bp, Lotus corniculatus
  misc_feature (572)..(572): n is a, c, g, or t
  Predicted polypeptide sequence is orthologous to G3067
ggtgttttcactacttccacaagtggaagggcttttgaatctattgagattttaggccatgacccatcactgagaaaagcattgatagtatgcagagtcattgctggcagggtccatagacctctggaaaacattcaggaaatggcaggacagacagggtttgattcattggctggcaaagttggtctctattcaaacattgaggagctttatttgctcaatcctagagctcttcttccttgctttgtggtcgtttgcaaaccctgaagctaaggttaaagtaatgccagtttgcatgtttgggtacaatgtgattttttttaagttggaagaattgattctggaaaaagctactccgagtatcttttatggcagcagaattggttccggtagatctgaatgaattcaaacttgctaaatattgattgtttagtttttaagggataaggaggttcttcaccaagattttgaagaattttggttcaacttcccaagtcatgtgtgcttctttgtttattgaatgaatcacctattcatacatttgtaactttttttagtggcactgaaaattntcatctgcagaaggatgatgaagtgccctaagtacatgttgtaagatattgacatcaacctcagcttaactaattaactaccctttggatgtttccacttggaataa

SEQ ID NO: 13650 - DNA, 396 bp, Lotus corniculatus
  Predicted polypeptide sequence is orthologous to G3074
attaaatggagagcaaagtcaaagaaaaattattgtaaaggcactgcctaagagaggcatcaccatatgcaatacctacattagattagaatttctaaatttactatgccacggctatttttaaatggaacaatatctgcatttttagtctaaactataaggagagcattcaatgcctcctaaacttcctaaccatgcactatggatctgtctaacactagtaaaaaaacctatattctaattctccatcagaacttctacagaagtcatagttgaactgacacaggtttatctagacttcatcataatcttccacatcatcatcaatccttgtattcaagttagccagttgtatgggatcgatggccattttttccacatcagacaaggaccatc

SEQ ID NO: 13651 - DNA, 559 bp, Lotus corniculatus
  Predicted polypeptide sequence is orthologous to G3074
gcataaaatcaactccatatggaacttgatatacattataggcctacaacaagtacacaaagctaacataactggttaacatacataagctacacatgacgtgaacataggctaacatggataaaccatattgaatttttttcttgaaaaggacatcaagatcacttttttttttcagccaaaagcatgggacatgtttcgacagctagtggatactcataattgtccatgagcttttaactaactaataactaatagatgatattatttacccttcctcatcataatcttcttcatcctcttctatgtgcgtaccaaggtttgcaagctgcacagagtcaatagccatcttgtccacatctgatagtgaccaacccggaatttcttcatgctggctctctgttggaggttctgatatctcctgtttagctgttgtgcttgcctttttgtcctcgttttcgttggtgttggcattcagatcaagattatggaactctgcgctttcagcaggaactgcagcgttctcctttggtaactcctttgtctctgaactatcatg

SEQ ID NO: 13652 - DNA, 584 bp, Lotus corniculatus
  Predicted polypeptide sequence is orthologous to G3074
attcttcaaagcagcttacatctattaatatacttctgctttctgatagacaaacagaaaagtagaaaaccattttgtcaggcaatgctcaaataacacaacataatgaaatcaactagtagccaagctctaacaactgtttgacctgtactagcaaggtggatgtcgcctaaaaacatccattttgagcctaaaagtgcacaaagctctactaagtactactaacattagtgttaagaggaagctacatctgctacacaggaacattgacatcccagatatagaagaaatatgtaattcagattctctggttactagaggatagccatcaaaatactaatatgtactcattcttctgttttcaccatctttagctaatcccccaaaatgtacactagaacttacccttcctcatcataatcttcttcatcatcttctactctactaccaaggtttgcaagctgcatattgtcaatggccatcttgtccacgtcagaaagggaccagccgggaatttcttcgtgtttaatctctgtttccgcaagttcaggcaatgaggcctgagcagctgtgctagcaccttt

SEQ ID NO: 13653 - DNA, 435 bp, Lotus corniculatus
  Predicted polypeptide sequence is orthologous to G3086
ggcctcaacaaccgttgaataaatttatcttcatccccttttctttaatacaagaaggggcaaataattctatcatgtgcagcaacagaggaaagctaatctagattctagcttcttggaaccaaattattacaaatctgtacagagactaaacataagtcaacaaggggagatgggcagctccctcttggccattattatggctgctggtgtgaacatgtacacttggcttgacagtctgaaagcgtctgagctggctttggaaggtcctggatgtaatccacagccaagtccaacatgtctgctgggttggttggctggtccatgttggggaccagatctggtagtttcctcatacgctcactaattttagttcttctaaccctctctgcaaggcttcgggggtgagtggcaaaaccccgctgggcacgaatt

SEQ ID NO: 13654 - DNA, 325 bp, Lotus corniculatus
  Predicted polypeptide sequence is orthologous to G3086
ctctctttctctgcaagccggccttaacctaatcccaattctcactcccaattcgattcctctctttctccattcgattcctctgttgtgttaatcaatttcacccatcacaattcgaagaaaattccccaaaattttagctaatttggatcatttggtgcaccctgaaaatctccaatcttgttgatcactccaaagttctcatctttttcgattttggtgaggtgggtcgatccaatttggttccaaattcatctgggtttgatccaatttgggttttttttttgctggggctgtgattgaattgaaatggtctatttcgata

SEQ ID NO: 13655 - DNA, 481 bp, Lotus corniculatus
  Predicted polypeptide sequence is orthologous to G3091
aaaatctcttttattttctattccatatgtcgacataataaggagtagtacattgtcattggtcttcttccccccaccactatttacactaacagccccaaaacttaggtataattactctagaaacccaaaccctataacagtttcttaaccatatcatcattatcatcatcttaaactaggttgaaatttgaaaagagactttacttgttttgctacacaacacgcacgggttgctaactgcaccaccatcaactatttcacaggtgactttattttggctagttgctacacttctattgggttgattttctatatacatgaaaaccactacagaaaaagcataaagaacttgcagtactttcagcattagtacttatagaatcatgtagcaaatatataacctaaaaatacccacattatatctaatattctatgactagccccaccattggggctctgtgaggtattcccttcctcc

SEQ ID NO: 13656 - DNA, 569 bp, Lotus corniculatus
  Predicted polypeptide sequence is orthologous to G3091
ctttttggtttgactcaaagcctgcttgatcgttttcttaatgacatatacaccagctactattaaattaaatattaaacaattatgcgtgatgggttcgttcacgagagaggggttttgtttttatttgaacccaaaccggaaaagagggagctttttcttataaccctttccctttcttttccacaacatggaccttaaacaaagtacaaacccccctccaaaggctcctattcttttttcttttttattgaaaataaataaattttaataagcagggtttgcactttacccccaaaagaggtttgtattccaaggaataaaaaaaatgcttttgaggatgaatattgtatatgtaccaagtgggaaggagtgggcaattgggattattcattaggaaccaaaaggagccctatggggaatgccttttcttcttcttgcacttgaaggaggtggagaaggcgtggccggatacatgtcttgagttgagccttcacgcaattcttcttgctgtgatctagaggaggtggtactagtgtccattgtcatcatcaactcttcattcttta

SEQ ID NO: 13657 - DNA, 458 bp, Lotus corniculatus
  Predicted polypeptide sequence is orthologous to G3091
gaattcggcacgagcacaacttctctctcctcttctctctcaagaaaactccctcactctctcttacattcatctcaaacacacaaactctgttccaaccactctgtttttcatatggcatagaaaaccaagacaacaccactgtccgggaaatcaagcccaagaacaggagaatcatgggtgctggaggacctgaagaagatgacaacaggtggccaccatggttgaagcctctgctgaaagagaacttctttgttcaatgcaagtttcacgctgattcccacaagagtgaatgcaacatgtattgcttggactgtatgaacggtgctctctgctctctctgcctcggtcaccacaaggatcaccgtgcaatccagattaggaggtcctcctaccatgatgtgatcagggtctctgagattcagaaggtgctggacatcactggcgtccagacctac

SEQ ID NO: 13658 - DNA, 576 bp, Lotus corniculatus
  Predicted polypeptide sequence is orthologous to G3967
acgagccacagatgggatgttggttgatggagaagcttgcactttaccacagctggagctattggaagcaacagccagagcagttcacccagttcttcagtttggaggatcaggattggcattagcagatggcctttcaaaccttttaaagtgtcgccttccagcaactgttaggtgcctttgtcatccaagtgcacatgtccgcactctgagcatctcagttcttcgtgacattctgcataccggttcaaccaggtgtagtcctaaatcacagcgaatgaatggcatccaccatccctcttatcaatacttcaatttggatgtcattgactggctagctgacatagaaaaatgcttgacatgggaagctcacacacgactttccaatgggttgtctattaactttcttgacactgcagccaaagagttaggctgtactattgccgtatgaaaaatataaatgacaccaccatgtagaaccatcttattctgtgacaattttttactagacttacagatagagatgttatttatgcttatgggactaacgggtttgctaataagcaacatcgtcat

SEQ ID NO: 13659 - DNA, 749 bp, Sorghum bicolor
  Predicted polypeptide sequence is orthologous to G867, G9, G993, G1930
actactcatttcagactcagcaaccacctgcatcatctttctatcgatatcatcttgtcccagccctagcatagcaagcctagaacagtaaagtctcatcaataattccatactgtttctagctagcggcgaatactatccatcacaggccgcagagctgcagcaggcagtagagtacccaagcaaaaaagcaagaaaccaaaggcagcaagactccagggagcagcgcgagctgtagctctagctcatctcatcatgggtatcgagagcatgagccccacggcggcgccggcggaggattcctcctcctcctcctcgcgcttctccgccgcgtccacagccaccacggagtccggcgccgcgcagccacgggctgcttctgcagcaccgggcggcggcgcggtcgttgtcggccgggacgcctctctggcggacgagcaggccgtgacgtcgcagccgttggcggcgtcgacggcagcggccgtgacgcagggatcttcgcggttcaagggggtcgtgccgcagcccaacgggcggtggggcgcgcagatctacgagcgccacgcgcgggtgtggctcggcacgttcgccgacgaggaagccgcggcgcgcgcctacgacgtggccgcgctccgctaccgcggccgcgaggccgcccccaacttcccgggcgccggggcgtcggcgcccgagctcaccttcctggcggcgcactcaaaggcggagatcgtcgacatgctacggaagca

SEQ ID NO: 13660 - DNA, 758 bp, Sorghum bicolor
  Predicted polypeptide sequence is orthologous to G867, G9, G993, G1930
gcgagagcaagggcgtgctcctcaacctggaggacgccgcgggcaaggtgtggcggttccgctactcctactggaacagcagccagagctacgtgctcaccaagggctggagccgcttcgtcaaggagaagggcctccaggccggcgacgtcgtcggcttctaccgctcgtccgcggtcggcgccggcgccgacaccaagctcttcatcgactgcaagctgcgtcccaacagcgtcgccaccgcctcgacgacgacaggccccgccgtggggtcatcgcctccggctccggctccggcgccggtggcgacgaaggccgtgcgtctcttcggcgtcgacctgctgacggcgccggccgccaccgccgcggcgccagcggaggccatggccgccgggtgcaagagagcccgggacttggcctcgcccccgcaggcggcgttcaagaagcagctcgtggagctggcactagtgtagacggactaatgcgacggacggagcgatcgatctttctctttccctagtttagcagctagtcgttttctttttgcccgatcgctcaactcagatggtagcatcaccgttcaccgagctgaatttagtcccttctcggcaagcatctcacttagttcgttcgtttgtttatttcccatttcttcttgcattgcttcgatgtaaatcttctcctcaactgtatacttactgctaatggaggaaaaagaaaaacagccctagaaggctagatgatgatcatctgatctg

SEQ ID NO: 13661 - DNA, 819 bp, Sorghum bicolor
  Predicted polypeptide sequence is orthologous to G1274, G1275
cgatccccggagccgctacactataaatacaaagcttccccggcggtggtctagccggccatggcggcagtcggagcgcgcccagtgctgtaccaccacccggcgccggcgggcgacgccgcctccatgtcctcctacttctcccagggaggcagctccaccacctccagctccgcgtccgccagcttctccgccgcgctcgcgccgacgacgaccacgctcgccgagcagttcggcatctccgagttcctcttcgacgacgcgggagtcgccggcgcgccaggcgtgttcgccgatggctcggcccccgtcgtcgtgtcggatgccgccgccgctgctggtggtggtgcaatcagcgcagccgctgggagcgcggctgcggcggcggaggccgtgccggagcggccgcggacggagcggatcgcgttccagacgaggtcggagatcgagatcctggacgacggctacaagtggaggaagtacggcaagaagtccgtcaagaacagtcccaacccaaggaactactaccggtgctcgacggaagggtgcaacgtgaagaagcgggtggagcgggacagggacgaccccagctacgtggtgacgacatacgaggggacgctcaaccacgtcagccccagcacggtgtactacgccagccaggacgccgcctccggccgcttcttcgtcgccggcacgcagccgccgggctccctcaactaatcccgatggcccaccagcgtcgcgacgttccgctccggtccaccgcacagtgtttcgattcccagatggcagctagctgagctagctacactactacta

SEQ ID NO: 13662 - DNA, 791 bp, Sorghum bicolor
  Predicted polypeptide sequence is orthologous to G1274, G1275
agatcagcaggcacattaactgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagctccccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcacccagtacggcggcggcggcggtaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattc

SEQ ID NO: 13663 - DNA, 703 bp, Sorghum bicolor
  Predicted polypeptide sequence is orthologous to G1760, G152, G860
aaggtcatactcattatccatttcgttaccatgttttggttttctattcacttcaatctaatatgcagtaatgtcaaacaggaccatattttgaaaagtgaaattgaagagttacacaggaaggttaagtcctaaaagcaattgtcgttttttcttggttcaatggaagttagtgacatcttaatttatactgacattgaaacagggtagcctaattcaccaggaaaacatggaactcggtagaacagtagatgtcatgtcacagcaaaaagttgaactacacaggaagctccaggccagtgaaccaagaggtgttgctgatgcaagctctagcactccctacagctttagtattacaacacaatatgcagatgtccctgctaatcttgaacagaggcaatcacaacaaaaagagggggatcgacgcaaggaactgatggctcctgaactgggacttcaactgcactaagaagatgcagtacaagttcgaaaataccatggtgtgtttcaacaatttcatacagtgcagagcactctggttgcaatgagtatttgtgaaatatactagctgagtgagcaaaatggcttgtgtaaataatgtcacatgaggctcctccatattgaagatacactgggtttcactttggcatttgcatcatgtatatgtacttggtttccactaatgactgaactttgcaataag

SEQ ID NO: 13664 - DNA, 760 bp, Sorghum bicolor
  Predicted polypeptide sequence is orthologous to G1945, G2155
gtttgtttgtttgctttgttttctcctctttttcccccctttctgagtaacagggttctgcctcagaagccagtgtaagtgactgatgtgaggcaattgatccgttattcgagtggtgtgccttgatatctccagagataagctgtgaatcttgaaacaattgcattgttacatctttctattttgcttcactttatgcttttgtcagcactgtttgttgcaccttacgtccttacacttgtgactggtgttgtcatactggaaaacctgtgcaggtttttcaagggggttggcattggagtatgttttgagggaagtcagttcattttatgaataaggtatgagtccatggatgtggtaaataatgctatcctcagttagcaccctcaaatgcctacctcacagttggtcataagtctccaatccttgtatttggcaattactacaatatgttgtttgtttgggttaccttttttccatcctttttttcccagtgcagctggggggcaactgtattagttgttgatgttttagttttcacaggtctggtattttgagaaggaatatttcctgttcttgctgttccttttttttccccgctccccaattctgtttgctttggtcttggttctcacaggattatgctgtggatgctcaatcgatgcggattacatgctcgcaggaatagagactgttcagcatcagagctgcaagtgaaccgcgtattgtgcttgctgcatcttgatttttatatcaacat

SEQ ID NO: 13665 - DNA, 514 bp, Sorghum bicolor
  Predicted polypeptide sequence is orthologous to G1988
gcacgagggggagccgatccattcatccatccactgaacaccaccagctccgcgtcgcggaggccggaggtcttgcttgcttgggcgactacgacgaggcgacgtacaccaaggctccggagtccgccgatcgacgaggcagtcaggcaggaagcgagaagacatccattgggaatgggtgttgctagtgacgcggcggcgggcgggaagcgcggcaccggcaccggcacgcggtgcgagctctgcgggggcgcggcggccgtgcactgcgcggcggactcggcgttcctctgcctgcgctgcgacgccaaggtgcacggcgccaacttcctggcgtccaggcacctgaggcgccgcctgccgcgccccccttccgccgccgactccggggggcggcgtcgtccgcgtccagcagctcctgcgtgtccacggccgactccgcggagtcaaccgccgctgcgccgttggcggggagggctccggcgcgactgcggacgcgcgcggccgcggaggc

SEQ ID NO: 13666 - DNA, 715 bp, Sorghum bicolor
  Predicted polypeptide sequence is orthologous to G4
gaagctgcccatgcatacgatgaggcggcaaaggccatgtatggccccaaggcacgtgtcaacttctcggataactctgctgacgccaactctggctgcacgtcggcgctttcgttgctggcatctagtgtaccggttgccacgttgcaacggtctgatgagaaagtggagactgaggtggaatctgtggagactgaggtccatgaggtgaaaactgaagggaatgatgacttgggaagtgtccacgttgcctgcaagaccgtggacgtcattcaatctgagaagagtgtgttacacaaagcaggggaagtaagttatgattacttcaacgttgaagaggtggttgagatgataattatagaattgaatgctgataaaaaaattgaagcacatgaagaataccatgatggagatgacgggtttagcctttttgcatattagaagcatggttatggggagaagtaggaataacttcattctagatgttaggaaaacgcttcaacctgaagcgttgtagtcattcgtggttttcatcttactgagacatagctttatactatgagccaaccggtacaagaagttgtcctgtgtgttgagttcctgtactatagtaggaaatgagtccgtgtttaatgagttctcttggttgttaatattgcacatttgctcggctgaactcaagttagctcaagaaaaggaaaagtaagtacaccga

SEQ ID NO: 13667 - DNA, 876 bp, Sorghum bicolor
  misc_feature (84)..(84): n is a, c, g, or t
  Predicted polypeptide sequence is orthologous to G4
aatgcaacaaagctagctccacccccaaaggcctgtgctgatgaggttttcagtaacctgaacaatgacaacaatgatttgtcngcaacgtttgcgttcaatgacaataaggttcctgtgaagccagctgaggttgccagtttcctccctgcagtgaaacctctggtgcccagtaagagatctgcgactaacatgctttctgaccagaacagcaactcctatggctcttctgactttgggtgggacgatgacaccatgacctcaggctacacctttgctcccaataatgctataccagcatcttacatgcaaggtggagagtcaaagagaatgaggaacaactatggtgtagccatgtttcagggaaatggcgcccccagtctcgcacaagtcatgcctggttttgatcctgagatgaactatcagccattgccttatgttgagagcagctcatcagatgcatcaatggacagccttctaccacaggatggggcaagcaatggggatatctggagccttgatgagctgctcatggcagctggtgcttattgagaagctatggttattatcagtgtggcgtgttaacagcaaaaaagtggctcctacctgtggtgatgctggaggggcaagccagttgaatccgctacattttgtcgcggtagttatatatggtagattacatatatatgcttttgccagttgaactctatgaccatgtttatagtatgttgctgcgtggtgcgtctatgattggaagcgagtttgagactgattcaataatttaccttgcctatgcctgctggactgtagtgtgcgtactgcatgttatgtgtatatatatatatggtgtgcttatgtattgcaattcttttccgg

SEQ ID NO: 13668 - DNA, 776 bp, Sorghum bicolor
  Predicted polypeptide sequence is orthologous to G4
gacctgcacacgtaaacagacccaaaaaaaccctctcggaacaatgtgcggaggcgccatcctcgcggaactgatcccgccgacgcggcgcgtggcgccgaagccggtgaccgagggccacctctggccggcgagctccaagaaagccggcagcggcagcaacaagaggcaccaccacgaatacgccgacgacgacgattttgaggccgccttcgaggagttcgacgacgactttgacgtgcacgaagacggcgaggaccaccctgaccacttcgtgttctcgtccaaatccgctttctccccagcgcacgacggccagggcaacccaagaaccgcgccgaaacctgcagcacaggcacagcccgctctgctccttcgaggggagaagggtctggaaggagttgccgtgaagcctgaaactactatggacatgttcgacgtgggcagcttcttcgacatgaccttccccaccttcccagccgcgccggcggcggccatggagagctccttcgctggcagcagcgccacgtcggagacccggagccccgggaagaagctgagatacgacgacggcgactcgtccgaggggagcggctgtggctccgcgctggagctcgctgacgagctggcgttcgatccgtttatgctactgcagatgccctactctggcgggtacgattccctggacggccttttcgccgcacaggccgtgcagcaagacgtgaacaacgacatgaacggcgtcagcctgtggagcttcgacgagttccccgtcg

SEQ ID NO: 13669 - DNA, 827 bp, Sorghum bicolor
  Predicted polypeptide sequence is orthologous to G4
catttcgctctcgcaagccaccgatttgtttactgctcgctccggcgcgctgcggcggagcacccgacgacaactgaaccatgtgcggcggcgcgatcctcgacgacctccgcgagccggagctgcgccgggtcacggaccgggacatctggcagaagaagaagcccaagaggggcggcggcggcgggaggcgctcgttcgcggcggaggaccatgaggacttcgaggccgacttcgcggatttcgaggctgactccggcgattcggatttggagctcggggaaggggctgacgacgatgtcgtcgagatcaagcccttcgccgccaaggggactttcaatagtcctgaggaagctgcaagagcttatgatgctgaagcacgcaggattcgtggcaagaaggccaaggttaactttcctgatgcaccagcagttggtcagaagcgccgttctggctcagcttctgctaaagcacccaagtcaagtgttgaacagaagcctgtcgtcaaagcacctatgaccaaccttgccaacacaaatgcatccttctaccaatctgttaactacccctccaacaatccatttgttcagcatgccaatatgccattcgttccagcaatgaactttactgcttctgttgaggatcctatcatgaatctgcactctgaccagggaagtaactcctttggctgctcagacttggcatgggagaatgataccaagacaccagacatcacatccattgttcctatttccactattgctgaaggtgatgagtctgcatttgtcaacagcaattcaaacagctcaatgttgcctcctgtcctg

SEQ ID NO: 13670 - DNA, 902 bp, Sorghum bicolor
  Predicted polypeptide sequence is orthologous to G4
cactccgcatttccgccgcttccgcatcacgcagacaagcaagcatagctagcgaccaacccaccccaccgcccgcgagctcagacttagattcccctcgcgcaccgtcccgttcggccccacagcccagcgagagggcctgccagcagcagcagcaggcttcagccagccatgtgcggcggcgccatcctgtcggacatcatcccgccgccgccgcggcgggtcacggcgggccacctctggccggagagcaagaagccgaggaggggcgccggggccggaaggaggagggccgggccccccgtggaggaggaggaggaggaggaggacttcgaggccgacttcgaggtgttcgaggtggagtccggcgagtcggagctcgagtccgaggatgaggccaagcccttcgccgcccccaggaccaggagcgcgctctctttagatggattaaacactagtgcagttgttgttgatggccctgctgcaaattcagttaaaaggaagaggaagaaccagtttaggggtatccgccggcgcccatggggtaaatgggctgctgagatcagagatcctcgcaaaggtgttcgtgtttggcttggtactttcaactctcccgaagaagctgccagggcttatgatgctgaggcacgcaggatccgtggcaagaaggctaaagtcaacttcccagatgaggtttcgacgattcctcagaagcaccgtgctggtcctacccctctgaaagtgcctgagatggactttgaagagaagccgattatcaagccggcagtcaacaacatgaccaactcaaatgcatatcactaccctgttgtcgaccacaacatacccgagccatttatgcatactcaaaacatgtcatttgctcctttcgtgaattctgctgc

SEQ ID NO: 13671 - DNA, 760 bp, Sorghum bicolor
  Predicted polypeptide sequence is orthologous to G4
gcaaacctgaaaagttcgctagcgtacgactcgaccagagccaaccaaaccaacaagcaagcaagtagagagacaggcgcagagcgaagatgtgtggtggtgcgatcctcgccgagctcatcccgagcacgccggctcgccgcggtggcggtggcggtggcgcggcgtggcccggcggcaagggcagccagaggaaggccgacgacttcgaggccgcgttccgggagttccacgaggactctgacgaggacgaggagatgacggaggtggtggagagcaagcccgccttcatcttcagcgccccgtcgtccccagcgacgaagcccagggcggcgcgccaggagcagccgatccggcgccggaaggccgcgcagcagtacaggggcgtccggcgccgcccgtggggcaagtgggccgccgagatccgcgaccccgtcaagggcgtccgcgtctggctcggcaccttcccctccgccgaggccgccgcgctcgcctacgaccacgccgcgctcgacgtccgcggacccagggccaagctcaacttcccctcctcctccgccgccgccgctggggccccagccagccgcaagcgcgcccgcgcctccgacgccgccttcatcgacctcgtcgaccaagaggaacaagagcagctcacggcggcggcgacgacggccttgaagcacgaggccgccgaagaagcagccggcgagagctccggtgcactcccggacttctcgtggcagggcgtgctgtcggcgta

SEQ ID NO: 13672 - DNA, 813 bp, Sorghum bicolor
  Predicted polypeptide sequence is orthologous to G4
gctaccacccacccttgtatcccccatctccattgttagactcttggctagaattcttgccatgtgcggcggggccattctcagtgatctctactcgccagtaaggcagaaggttactgctaatcacctatggacagagagtggcagcagtaagagtgggaagaactggaaaaggaagagttcttgggagtttggtgaagatgactttgaggctgatttcgagggatttgaggatggtgatagcgaggaagatgtggattttgtacatgagggccaagagttccaaacgaacagttcgaatctcgtggtggggtccaatgttcatactgccaaagtcgccagcaggaagagaaggacacagtatcgtgggatccggcggcgcccttggggcaaatgggcagctgagatcagagacccacgcaagggcgtccgagtctggcttggcacctacagcaccgctgaggaggctgcaagagcctacgacacggcagcctggcgcatacgtggcaagaaagccaaggtgaacttccccagcgccatcacaaatcccgagaaacgccgccgggggcgtgtggctcggccacgaaagaagattgcatcccaggagacgctgaagctcaacgacgcctctgatgatcatgtcatctcagcaggcagcagcactgatgatgccattgccgtcaagcttgagttgccagagtcggcttctccgccacccatgtccagcgcatggcttgatgcgtttgagctgaatcaggtcaatgagttaagctaccttgaagttgaagaaactgttggtgagactagggtgac

SEQ ID NO: 13673 - DNA, 628 bp, Sorghum bicolor
  Predicted polypeptide sequence is orthologous to G5, G974
agcaccaccgccaccgctgccccagactcgcccaaggcctcggcgtccacgactaccacggagggcgacgagtcggtacactccgccggctcgcctccttcctccctcccggcgttcttcccgccaccgccgccgccgcagcagcagcatcccgagatggcaagcctggacttcacggaggcgccgtgggacgagtccgccgccctgcacctcaacaagtatccgtcctgggagatcgactgggactccatcctctcgtgatcaagatgaacccaacaacaacaacaacaagcagatgctcaatcacgcgcgctgtaatttttgtcaatggatttaattaattaaccgtggccgctccggatccgatggaatattagacatcggccgtagcgactacgagtagggtttaaggagttcgtcggacgtagaggacagggtttaagctcatcaagattttccatttagtcgtcaatatcattgttaagattattcgttagtgtcgtcgagtgtctcctggttgcttggccggttgttttttctctcccggcaaaggccagttgagggtgtgagtgtaatggagtatcatgtaactactgttggctagtactgaattcgaatttgctagtca

SEQ ID NO: 13674 - DNA, 722 bp, Sorghum bicolor
  Predicted polypeptide sequence is orthologous to G5, G974
actgctcgcttcatccagccttcatctccgtgctgcgcgcctgcgccccgcgaattctttacgctctcgagatctctctctagattctctcggcttccctcttccgaattcgtgcaagaaatccatggcggctacgacgatagattggcacggccgcaacgccgccttgtatggcgtggcggacagggacagcaaggagctggtgcgcgcgcttgctccgcccatgcaacaggcggccccgaccatctcgttcgcgtacccctgctccggcgtggagcagcagagcgcggcggcggcggcgggctcgtttctgggcgccggcggtagtagtggcctgctgactccggcacagattctccagctgcagtcgcgactccagttcctgcgccggccggcggcgggcggcgccacgctggccgcggtgaccacgcagcagatgaagcggcagcggcattgggggaagtgggtggcggagatccgcctgccgcgcaaccgcacccgcctctggctcggcaccttcgacaccgccgaggaggccgcgctcgcctacgacagcgccgcgttccgcctccgcggggactccgccaggctcaacttccccgagctcaggcgcggcggccagcacctcggcccgccgctccacgccgcggtcgacgccaagctccacgccatctgcaacggcacgacggacgtcgttgtgccgctgccccagagccagagcc

SEQ ID NO: 13675 - DNA, 727 bp, Sorghum bicolor
  misc_feature (682)..(682): n is a, c, g, or t
  misc_feature (684)..(685): n is a, c, g, or t
  misc_feature (688)..(688): n is a, c, g, or t
  Predicted polypeptide sequence is orthologous to G12, G24, G1277
tccccgaccagctcgacggcgcggcggtggccgataaccccgagggccacagggacggcggcgcgggggcggggctcacggccgccgccatccgcaagaaggcggccgaggtcggcgcccgcgtcgacgcgctccactgcggcgttggcgttggcctcgctggcggcggtgctgcctctccgcagccgctgtcgtcccaccatcgccgccgccccaagaaccccgacctcaaccgggagcccaccccggacacctcagacgacgagtgatttcgtcgtcgttcttcttctccctcatccatctactactctcctagtccttaggcaaaactactcacctaaggggtagctagctagctagctagacagcagtagcaagtaaagcaggcaaccagatggcgccagggacgcagcgcaaggtgttcggtggaatgcggatgagctcggaggtggccaataatggagccgcgacgtcgacgtcagggccggaaaccgtagtaagttgtaggaggagcctagcgtgctagccgtgccgtttgcccggagtcgacgtcgacggacggcgacggcgctgtcaaaggctctagcaccccagtagcaggagacagacgggtgcgtgcgtgcgtgtcagtgtatgcgggcatgtagctaagcaagacggctatgtccctctccccttcccntnnggntcgagtgaaagaaaaaaaaaaagatactcccggcaagca

SEQ ID NO: 13676 - DNA, 618 bp, Sorghum bicolor
  misc_feature (604)..(604): n is a, c, g, or t
  Predicted polypeptide sequence is orthologous to G21
gattagaaattgaaatcgaaaacgcagtcgcgtgcagaggtgttcctctgttcgtcctcgtgctcacttctcgattccattgcgatgctcacgtcccggtgatcaccggcggccaggggcttacagtggtatcagaagcttatcgatcctcggcctcacaatccctacccaccctcccgtagcgaatcggagttcatcggagcagcaggtcggaggcggaacgagttctcgcagcagcttcggccgccgcgaattaacctcgcttctgcgtcgatttctggttgtctcaccttcgattcgttacccacccaccccacccaccaaatcgaggtccggatctctcttcgcgcgcgtcgtcttccccatcggcggcggcggcttcttcaccattctctacggcgacgcgtccacctccaccagcgtcgtcgtcggcgtctcttcatcgactggggtctgcatcgacactagggttcggcggcgtgaaccactgtgagcttattcctcttcgctcactactttctgtgatactagcgtcgatttcgacctagggttgcgtagcaattgtctgcgtgtaaaattccgtaagtcggcttcgatttgctantggtggcgtgtggt

SEQ ID NO: 13677 - DNA, 657 bp, Sorghum bicolor
  Predicted polypeptide sequence is orthologous to G25
caattccagcgtccgcagaaaacacactcccatcccatagtttccactccacttcgatcctatcctccctcaactactcaaccaagaaacctttccccccttccaagttactcgaggaatccatgtgcggcggcgcaatcatcttcgactacatcccggcggcgcggcgccggctgtcatccgccgccgacttctggcctggatccgacgccgacgccgaggactctcacgcctcgctcacccctgcccctgagagagcgccgcgcgcgaagaaggcgaagcgtggccgcaagaaccagtaccgcggcatccggcagcggccgtggggcaagtgggcggcggagatccgcgaccccgtgaagggcgtccgcgtctggctcggcacctacccgaccgccgaggccgccgcgcgcgcgtacgaccgcgccgccaggcgcatcaggggcgccaaagccaaggtcaacttccccaacgacacctcctccagcgtcaccgccgtgccgacgacggccgccggagcagcagcagcacaggccccggccgttctcccggcgcccaaggtggaggcgcaggcgcaggtgtccgacgaggtcaaggagctgtcggaggagctgatggcctacgagaactacatgaacttcctcggcatcccctaca

SEQ ID NO: 13678 - DNA, 670 bp, Sorghum bicolor
  Predicted polypeptide sequence is orthologous to G26
taattgttcagatctgccatggcaatgatgaatttggggaaagctttgttgaggttaaagtatctgaggcagacttgagcagaaatcctgtaagattaactgagatcgagagctcggatggcgactgcatcttcatgagcccaagcagcagcaagtcattccgttgtcattatggcggaggtggaggtgaaggtgatcttatctatatctttttgggtccctcccgattagtctacaacatgaaagatggtactatggcaccatttgctgcagacataccagaggacaaacttagggaagcagatggtaaaccgatgaatccagtatggttatttccttatgaatgaacttgtgcatatcaactctgttagtctgatcctgtaatgagtcttaacgttagaagcactgatgccaattggggctaggggccatgatgtcttatttctcagagctgaaacaagttttctgttgttttatatggtctgttctgatgattttttagtagtaaacttatgtgtacttcttctgttttcaagttccaatgtggatttttattgcatttgcactcttgccttgtgggggagtctactagttcctatctagatgagcatcggtttcagatttgctggacaatattatgctgatgttcctctataccaaaattctctgc

SEQ ID NO: 13679 - DNA, 687 bp, Sorghum bicolor
  Predicted polypeptide sequence is orthologous to G27
gtggccgcgctggtgatcaagggccgcgccgcgcacctcaacttcccggagctcgcgggcgagctcctgcgcccggccaccgccgcgcccaaggacgtccaggccgccgccgcgctcgccgccgccgcggacttcccggcaacgcccgccaatgcagccggcgccgacgacgactgtggcccggacgccagcgccgcctccgaggacgtctccgcctccgcctcgccaccgccggcaacgacgctggacaaccccgacgacgcgctgttcgacctccccgacctcctcctcgacctcagacacggggcctcgtcgtgccagctgctctcgtgcgcgccgtcgtggtacgacgacgtgtgcttctctggcgccgccgccggtgcgttccgcctggaggagccgctgctgtgggagtactgagtccaataaaatacagtagaatattttgctcagtcgtcgacacgagaatcaaagttagaccacgcggcttcgagagctagctgcttcgttcgtgtgtggctatggactgtaattgcgtcagtggaccaggaactatggcgatcgatgtaaaccatgcatgcagctagctggaccagcagaaatggaacctaattagagccatttctcctttgcgtctgctcctccaaatttagaaagcaaaccatgttaaaaaaccaattcatcccc

SEQ ID NO: 13680 - DNA, 781 bp, Sorghum bicolor
  Predicted polypeptide sequence is orthologous to G38
tggctcttctctcacccccctcgcgacttttcttctcgacgagatctcgcgattcctaacgactcgaacaagcgcactacacacaccagccagcgagatagcgaaccctaggaacgcagtggccatctttggagcgcccatgacgctggatcagaaccaggccacgccgatgcagcccccggccctgcagcccggaagaacatatggagcagagggcaatactgtggtgcatggttccatcagaacaataggaagaagcgacctcgcaggtcacgcgatgggcctacgtcagtggcagctgtcatccagcagtgggctgagcacaacaagcagttggagtatgctcctgaggggtcaaaacgaccaagaaaagcacctgcaaagggttcgaagaagggctgtatgagggggaaaaggagggcctgacaatacacagtgtggggtatcgtggagtgaggcagcgtacttggggggaagtgggttgctgaaataagagagccaaatcgcgtcaacagactctggctgggtaccttcccaactgcggaggatgcagctagggcctatgatgaggcagccagagcaatgcatggagacctggcacgtactaacttccccagaccgcatgcagcaacctatgcccaggctgctctagtatcgacctcttcccaggctgctccaatggctgttggagctctttggcctggtacatcatgcgagtcgacaacaacatcaaaccactctgatatcgcatccacctcacacaagcctgaagcctccgaca

SEQ ID NO: 13681 - DNA, 575 bp, Sorghum bicolor
  misc_feature (560)..(560): n is a, c, g, or t
  Predicted polypeptide sequence is orthologous to G44
gcgcctacgaccgcgccgcgttccgcctgcgcgggtccaaggccatcctcaacttccccaacgaggtcgcgttcggcgccgccgcacggtgggcggcggcgcctgctgctgctcctcagcccagcgtgaccgtggccgggaacaagaggggccgggcgaggtcgccgcaggagcaggacgccgggtgcttattggtcagggaggtgaagaaggagcgggttcaggagcccgcagcggcggcagcgggttgtggctgggatggcaaggatacggcggcaagcggcggaggggcggactacttctgggaggacgagtcgctgaagggggcgatctgcagcctgccgccgctctcaccgttgtcgccgcacccgcacctggccgtcccgcagctctccgtcagctgagacctgagatgtggcagcaagacagcggacggtggtcgcttaattaactgattagttagtcttagtcttaatctattttttgagttctttgattatgctagagaggagtgtacaggtccaaatgtctttcgttctttaattaggccctgttcactnctgcccaaaagccaa

SEQ ID NO: 13682 - DNA, 575 bp, Sorghum bicolor
  Predicted polypeptide sequence is orthologous to G129, G136, G140, G146
gcacgaggctcagaagctgcccagagctaccaccactccatctcatccccacccttcctcctactattctccttcaaacagcaaaatctgtgtgtctcctgccagctaataagaaaaagagcatgcacatccgagaagagcaagctatgccatcaacagtgacaggcatcatggtgtcgaccctgacttcggcggggctgaagctgaaggagccggcgacgatgtcccctggtggctccgcgtcggttgctgctggatttgggtctgctgcagagaggaacaacggcaggggcaagggcaagactgagatcaagcgcatcgagaacacgaccaacaggcaggtgaccttctgcaagcgccgcaacggcctcctcaagaaggcgtacgagctctccgtgctctgcgacgccgaggtcgcgctcatcgtcttctccagccgcggccgcctctacgagtactccaacaacagcgtgaaggccaccattgagaggtacaagaaggcaaacagtgacaactccagcgctgctggtacgattgcagaggtcacgattcagcactacaagcaggaatctgct

SEQ ID NO: 13683 - DNA, 572 bp, Sorghum bicolor
  misc_feature (559)..(559): n is a, c, g, or t
  Predicted polypeptide sequence is orthologous to G129, G136, G140, G146
cggcacgaggtatcctcttccaattccctccctggatctcttcctgcatgcagagaggcactgccgcaccaccaccaccaccacccatgctcaacatgatgactgatctgagctgccggccgtcggaggtgacagagcagctggcggcgccgacgggctccggcgacaagcaggggaggggcaagatcgagatcaagcgcatcgagaacaccacgaaccggcaggtcaccttctgcaagcgccgcaacggcctcctcaagaaggcgtacgagctctcggtgctctgcgacgccgaggtcgcgctcatcgtcttctccagccgcggccgcctctacgagtacgccaacaacagtgtgaagtccaccattgagaggtacaagaaggccaacagtgacacctccaactctggcacagttgcagaagtcagtgcccagcactaccagcaggagtcctccaagctgcgccagactatcagtagcttgcaaaacgcaaacaggaccatagtgggagattcaatccacaccatgagcctcagggatcttaagcagctggagggcangctggagaaaggc

SEQ ID NO: 13684 - DNA, 496 bp, Sorghum bicolor
  Predicted polypeptide sequence is orthologous to G129, G136, G140, G146
gcacgagggatcggaggaaccaaactaggagtagagtcccctttcctagcttgcttgcaagtccaagaaactagcagagagaggaacaagctgcgatctccagcatggggcggggaaggattgagatcaagaggatcgagaacaacacgagccggcaggtcaccttctgcaagcgccgcaacgggctcctcaagaaggcgtacgagctctccgtcctgtgcgacgccgaggtggccctcatcgtcttctccagccgcggccgcctctacgagtacgccaacaacagcgtgaaggctacgattgagaggtacaagaaggtacacaccgttgggtcttcctctgggcccccactcttagagcacaatgcccagcaattctaccagcaagaatccgcaaaactgcgcaaccagattcagatgctgcaaaacactaacaggcacttggtcggtgattctgtgggaaacctgacactcaaggagctgaagcagctggagag

SEQ ID NO: 13685 - DNA, 699 bp, Sorghum bicolor
  Predicted polypeptide sequence is orthologous to G129, G136, G140, G146
gggcaggctggagaaaggcataagcaagattagagctagaaagaatgagctgttatatgctgaagttgactatatgcaaaaaagggagatggatctgcagactgacaacatgtacctgaggagcaagatcgctgagaataatgaaacggggcagccggcgatgaacatgatgggagtgccatcgacaagcgaatacgagcacatggtcccttttgactcgagaaactttcttcaagtgaacatcatgcagcagcctcagcactactcccatcagctgcaaccaacaaccctgcaactcggatgacgaaattaattacctgaagatgaatctgcggccaatgatccatgcacgcgagcatgcagttatatcatgtgtccaatcgagatcaagaatctactctacgtttgtataattattattaataatcgtgattagtacaactgtcagcagtatgtgtgtgacaactctacatatatgttgtgtggctgtacggcgaggtcttttgcgacaacatttgcagcagcagcagcatttggtgttgttcatcgatcgatcgcaaaaattaagcttgccaccactgtgtgtgcatttgtacgtgttaattcagctgctgtatctgttaattgcaccctccattagaacgcacgcgtatgcatacttatacttatttatgtatatgagatttgtgtgtgttatat

SEQ ID NO: 13686 - DNA, 590 bp, Sorghum bicolor
  Predicted polypeptide sequence is orthologous to G129, G136, G140, G146
gagatcaattacatggccaaaagggagactgaacttcagaatgaccacatgaacctcaggaccaagattgaggagggagagcaacagctgcagcaggtgaccgtggcccggtctgtcgcagcagcagcagcagccaccaacgtggagctgaacccattcttggagatggataccaaatgcttcttccctggcggccccttcgcgacgctggacatgaagtgcttcttccctggcggctatcagatgctggaagcgacggcggcacagcaccgccagatgctcaccactgagctaaacctcggctaccaactggcgctgcctaactctgacgctgccaacaataaccctcatcagttctaaaccgcatgcacgagaagcttttcaagcgaactgtgtgacccatggaagctggctgttgccctctagctgttcttggcttccataaccttattgtgatgtgtattgttgtgtacttgtgtgtgattctccttgctactctactgatggagaactaaacctaatcgattagacataatgatcaaatgctacagcatctatgaggctgcgatcaggttaagttaaaaacataa

SEQ ID NO: 13687 - DNA, 1186 bp, Sorghum bicolor
  Predicted polypeptide sequence is orthologous to G131, G135, G155
gcaaggtgcagctcaagcggatagagaacaagataaaccggcaggtgaccttctccaagcgccgcaacgggctgctcaagaaggcgcacgagatctccgtcctctgcgacgccgaggtcgccgtcatcgtcttctcccccaagggcaagctctatgagtacgccaccgactcccgcatggacaaaattctcgaacgttatgagcgatattcctatgctgaaaaggctcttatttcagctgaatctgaaagtgagggaaactggtgccacgaatacaggaaactgaaggccaaaattgagaccattcaaaaatgccacaagcacctgatgggagaggatctagagtctttgaatcccaaagagctccaacaactagagcagcagctggagagctcactgaagcacatcagatcaagaaagagccaccttatggctgagtctatttctgaactacagaagaaggagaggtcactgcaggaggagaacaaggctctacagaaggaacttgcggagaggcagaaggcggccgcgagcaggcagcagcagcaaggtgcagtgggaccagcagacacagacccaggcccagacaagctcatcatcgtcctccttcatgatgaggcaggatcagcagggtctgccgcctccacaaaacatatgcttcccgccgctgataatcggagagagaggtgaagaggtggctgcggcggcgcagcagcagcagccaccaccagggcaggcgcagcagcaagcgcagtccgcatcgcaggtctgccgccatggatgctgagccacctcaatgcataagcagagggcgatagcaaatcgacctctctcgtcatgaaccatgacgtacgattaccatatggttgccgtgcctctcccatcgaatggcgagcaatggcacgctcctgcaagtgattgctcgatcaccgatgattaaaaccctagcgatggcagcagcaattaagctaaactattgttatgtttgcaagaaagggtaacccgctgtgtaatctttgtctccagctagcatgtacgtaccaactgagatgcatgcatgcgtatatcagcatatgctttattactgctcagttacccttgaatctagcagtgcttttggtgagagggtgcagtttactttaaacatatgggtttgtgactgtaaatagtatttttaactaggagtt

SEQ ID NO: 13688 - DNA, 758 bp, Sorghum bicolor
  misc_feature (24)..(24): n is a, c, g, or t
  misc_feature (42)..(42): n is a, c, g, or t
  Predicted polypeptide sequence is orthologous to G131, G135, G155
tcgagtcgagagacgaaaaccacnctgatccttccttccccngtcttcctcctcccacacgtccccatcgccattgctgcgccgagagtgagcgggagagggtaggtgtcgaggcggcggagatggggcgcggaccggtgcagctgcgccggatcgagaacaagatcaaccgccaggtgaccttctccaagcgccggaacgggctgctgaagaaggcccacgagatctccgttctctgcgatgcggaggtcgcgctcatcgtcttctccactaaggggaagctctacgagtactctagccattccagcatggaaggcattcttgagcgttaccagcgttactcatttgaagaaagagcagtacttgacccaactattgaagaccaggcaaattggggagatgaatatgtccggttaaaatccaaacttgatgcacttcagaagagtcaaaggcaactgttaggagaacaattggattcactaaccataaaagaactccagcaactggagcaacaattggacagttctttgaagcatattaggtcaagaaagaatcagctcatgttcgattcaatttccgagcttcagaaaaaggagaaagcacttacagaccaaaatggtgtcctgcaaaagctcatggaggcagagaaggagaaaaacaatgctttaatgaacgcacacctccgggagcagccaaatggagcatcaacaagctccccatcactgtcaccaccagtagttccagattccatgccaact

SEQ ID NO: 13689 - DNA, 694 bp, Sorghum bicolor
  Predicted polypeptide sequence is orthologous to G134
actagtggcatcggctcccacataaaagatccacaccactcgagcagaaggctggtagtggaagggtaggctcttgcttgagctgagctcttgctgcctgtggatctctttgggagtggtgaacggaggatggggcgcggcaagatcgagatcaagaggatcgagaactccaccaacaggcaagtgaccgtctccaagcgccgggccggactggtcaagaaggccagggagatcggcgtgctctgcgacgccgaggtcggcgtcgtcatcttctccagcggaggcaagctccacgactactgctcgcctaggacctcgttgtccaggatcttggagaagtaccagactaactccgggaagatactgtgggatgagaagcacaagatcctgagtgcagagatcgacagaatcaagaaggagaacgacaacatgcagattcagctcaggcatctgaaaggcgaggacctgaactcgctgcagcccagggagctgatcgccattgaagagggtctccagaatgggcagaccaacatgcgcgagaagcagatggatcactggaggatgcgcaagaggaatgggaagatgctggaggacgagaacaggatgctgtcttttaggatgcatcaacaggctgttgatctgagcggcggcatgagggagctggaaatcggataccatcaggtccagcatgaca

SEQ ID NO: 13690 - DNA, 1055 bp, Sorghum bicolor
  Predicted polypeptide sequence is orthologous to G137, G145
gctgagggtagctgcagctggggctagctggaagggttgggagccatggggagggggcgggttgagctgaagcggatcgagaacaagatcaaccgccaggtcaccttcgccaagcgccgcaacgggctgctcaagaaggcgtacgagctctccgtgctctgcgacgccgaggtcgcgctcatcatcttctccaaccgcggcaagctctacgagttctgcagcggacagagcatcacaaaaacacttgagaggtacgaaaagcatatgaggccagatactgctgtacagaacaaggagaacgagttagtccagagcagtcggaatgagtaccttaaactgaaagcaagggtggataatttacaaaggactcagaggaatttgcttggtgaagatctggggtcacttggtatcaaagagcttgagcagctcgagaagcaacttgattcatccttaaggcacataagatccacaaggacacaacatatgcttgatcagctcactgatcttcagaggagggagcaaatgctgtgtgaagcaaataagtgccttagaagaaagctggaggagaccagcaaccaggtgcatagcaagtgtggagcacggtgccaacttactcggctacgagcggccactcccccccacagcaggccccatcacatattggcaatggattgttctttcatcccctggaagctgcagcagagccaaccctgcagatcgggttcgctcctgaacatatgaataacttcatgccgacatggctaccctgaagatggatctttgaggcaaaggaataaataaagatgcgatggccagcatcatctactactgcaagagtgacagtcatatatatatatatatatgacctagtttgtgtgtcgatgtgtcgaaacgcataaatttgtgatttgttatatgtaatgtataagcacaaacgaaacatgcaggactagttgcttgcttcgatgtatttgtgtgtatccgtgtaaagggccgtgcgcacagcatatgagtgatgagattttctctaataaggccgttatgccgccaatcgt

SEQ ID NO: 13691 - DNA, 737 bp, Sorghum bicolor
  misc_feature (661)..(661): n is a, c, g, or t
  Predicted polypeptide sequence is orthologous to G147
tcgaggaggagcaacaaggagggagagaagatagcacaagggcaccctcgccaacctcgaagctagtccaaactagtgggaggttgtgtgcagggatcgagcaagacgacaattaacctactgttgttgctgctgctgctgctgctactgctaggtaacaaccaaggcaagcgaccaggcagcaatccatctctcggcatccatggcgcggggcaaagtgcagctgcggcgcatcgagaacccggtgcaccggcaggtgaccttctgcaagcgccgcgcggggctgctcaagaaggcacgggagctctccgtcctctgcgacgcccacatcggcatcatcatcttctccgcgcacggcaagctctacgacctcgccaccaccgggaccatggaagagctgatcgacaggtacaagactgccagcggagaagctgccgacggctccggcgacaacagaatggatccaaaacaagaaaccatggtgctgcaacaggaaatcaatctgctccagaaaggactcaggtacatctacgggaacagggcaaatgaacacatgaatgttgacgaactgaatgcccttgagaggtacttggaggatatggatgtacaacatccgctctgcaaagatgcagataatgattcaagagatacaagcactaanaagcaaggaaggcatgttgaaagctgctaacgaaattctccgggaaaagatagtagaacagagtagtttgcttgat

SEQ ID NO: 13692 - DNA, 641 bp, Sorghum bicolor
  Predicted polypeptide sequence is orthologous to G154, G627, G1011, G1797, G1798
gatatacagcaagtcaaagcagatgctgtaagcttggcaaatagactcgaagcccttgaaaagaccaaacgaaagttcttgggtgaaaatttagaagaatgctccattgaagaactgcacaatttggaggttaaactggcgaagagtcttcacgtcatcagaggaaagaagacacaactgctggagcagcagataaccaagctgaaggagaaggagaggaacctgctcaaagacaacaaagaattgcgcgataagcgcaacctccagcctccaccggaggcgccaccagtcctgaaccgctgtctccctccttggccgcgtaacctgccggcgccaccgagcaacgacgacatggacgtggagacggagctgtacataggattacccggcagggagcgctcctccaacagggactctggttgagccacggattttcagctcggctaaaaggaataaaaactctctgaaagcatcatcaaagggcacatgccaatggttttacttgcaccttgtatacaaagttgtgctggaaatgtaaaaaagtatgtagtatgtggatgaaagaaacggctgggtagctagctgcaaacctgcaagcctttctggggcctgaaaatgaaaatccatacacggatacaccc

SEQ ID NO: 13693 - DNA, 563 bp, Sorghum bicolor
  Predicted polypeptide sequence is orthologous to G154, G627, G1011, G1797, G1798
gttgctcggtggcgccggcaggttacgcggccaaggagggagacagcggttcaggactggtggcgcctccggtggaggctggaggttgcgctgctgcagcgataagaacagcaggttcctctcctggaagtggtagaagtaagaaacaacagaggtcaggaattggttactagagtttcaggatactctgggcccatgcattatgttaccttctccttcagcttggttatctgctgctccagcagttgtgtctgtcaaaacaaaagtaggatgcatatcaacttgggcgaacagtatctttgttatcgtctatgtagtaatttcagaggctagggtttatgtgggaggtctggcatgaactaaccttctttcctctgatgacgtgaagactcttcgccagtttaacctccaaattgtgcagttcttcaatggagcattcttctaaattttcacccaagaactttctgcaactcgtgtaaagacaatgaatggctggccttttagctccgaggaagaatgccattaatctttagtaaaatacatgattgctcaccgtttggtct

SEQ ID NO: 13694 - DNA, 598 bp, Sorghum bicolor
  Predicted polypeptide sequence is orthologous to G175, G877
gcacgagggtcccgtcgctttgctttgtcaaggaacagccgtatcgttgccgtcgaccgctccaggcctccagccacctcaggtttaagtctgagttgcttcccttattgctgggacagtcaaccgcagcgcattcatggaggattggatgcttccctcacccagcccaagaacacagatgccaagcttcttcaacgaagaattcagctctgctcccttctccaacatcttcagtgatgatagaagcaacaaacccctggatgaaatcgagaagagtaaaactttcattggctcgagtgctcaagaaacctctcaagatacgaaagaccatccacagactgaatcaaaccttttcagcgcaaatcagaaatcaacctctccaggaggtcttgcagagaggatggccgcaagagcgggttttggtgtcctgaaaattgacacgtcccgtgtcagttcatctggtgcaccaatccggtctccggtgacaattccacctggtgtgagcccaagggaacttcttgagtcaccggttttccttccaaatgccactgtaagtgtctgtattcattgtgagatttttgtctgggtgatactgtga

SEQ ID NO: 13695 - DNA, 780 bp, Sorghum bicolor
  Predicted polypeptide sequence is orthologous to G175, G877
gcctacttggaaatataaaggtgcaaggcaaaggtgtcgaggctagatcagctgcttttcttcctgtatcagcgcatagtgatgcatctctcttggagtctcaagatgcagttgatgtctcgtcaacactgtctaatgaagaggagagggcaacgcatggtactgtttctatagagtgtgatggtgatgaagatgagactgaatccaaaagaaggaagctggaactagatgctttaggagctactgctatcactactacctccaccaccagtaccattgacatggggcctggagcctcaagagctgtccgggagcctagggttgttgttcagaccacaagtgaggtagacattcttgatgacggttatcggtggcgcaagtatgggcagaaggttgttaagggcaatccaaatccaaggagctactacaaatgtacacacccaggatgttcagtgcgcaagcatgtggaaagagcatcacatgatctgaaatcagtcatcacaacatatgagggaaagcacaaccatgaagttccagcagccagaaatagtgggcaaggcagttctggttccggcagtgctccatctgcaccacaagctggtggttctcaccgtatgcaagaatcagcacaagccagctttgctcacttcggcacgaccagtcctttcggctccttcggtctcccaccgagcagacagttgggaccaacaactggcaatttccgcttcgggatggttccgccgggcatgacgatcccaatgccctctctaggatcacttg

SEQ ID NO: 13696 - DNA, 661 bp, Sorghum bicolor
  Predicted polypeptide sequence is orthologous to G188
agccagcccattgcgcttctctggctctcctcgtcgcctccgctcctggcccaccacactttcgtccccctcttctcgcacctcctccctctcttctcctgctgcaggcgacagcgacggcctccttgcggcacgcgcccccaaggtggccgtcctcggccgttacggagcggcgtggatgagccccaccggtcgccgccgttgcgccttaccctcgacgctgccttctctttgcagatccgcatggcttggacgaaaccctaggtgctcgctggtcctcctcacgccgccacaccagctgcaggtacccctcgacggtgtcgtgattgggaaggagcagcctcaacacctcccgtttcctcttatttttggattttggttctatctctttgatttcttcctatgttggcttggattcctagacttttcccttctttggcctgtgatgaaaattccagacccaattgatcaacgatatcaactgatgttcattttcttgtgaggtactaggcatgaccagctacttatattatgatccctataagccaggtccacgtatccttaaatattttcatacgtctgatccccgtaattagctgtgcagattagttggcctaggatttcttcaaatcagaatcagcctttgtttaccgaggagatc

SEQ ID NO: 13697 - DNA, 862 bp, Sorghum bicolor
  Predicted polypeptide sequence is orthologous to G196
ctctgctgctgtcaatgcttcagaacttgccaccaaacagaaaaattggagtgctacctatgtgggaaaacaacattttcctccctcaccatcaagtttgccagatctttcaggggatctggattcacaatttagatgcctgcgtcaagttcaataccacctcgaatacttgtttgatgggtttttgcagtctgttcaggaagcatcctctgctgataagtttcacagccctgcttgcagtatcttcttgggcagagatgcagcatcgccgaagttacagttgctttcacctgctcaaaacaatggaagggattcgtctcctgtttcttgttctcagagcacagaatgtgtctcccagcattcacagaatgaacgcccatgggatatggctaatcagcagagtgtctcgttgccctctggaactgatgttccacccaatggagtcttgccatcttcttgtgctgattcagaggtttcttctgtttcatggtttcatggctctgatgatagcgctatgatgtatggaaatggaatggacacatactttacaaagagctgttatactcacagggagagattgacatcatcaagagagaatgggaaaatagcgccgaatcaatcagtgacatataaaagcaaccagaagtcagctccaggagcaagatttgtgtcttgcaaggagcaagctgccctagacagtagaaccaaagaaacaataataggtcaagctttgaagatgcatggatacattcaatcagacaggagaattgttgaaaagctcagttgccatacgcaaaaggaatttgtccggcatgacaatgaagcaagacaattatcaaagtacaaccaggatgtctgcttg

SEQ ID NO: 13698 - DNA, 780 bp, Sorghum bicolor
  Predicted polypeptide sequence is orthologous to G197, G255, G664
cacctcgatcgcactcgcagcagcagcagcagcagcaaccaacctccactgccgcccgcaacgcacccgagaggcgaggagggggaagaaaagcggcggcggctgccaaaaggaaggaccaggaaagcagcaggcaaggtagcagcatcggattggttgggtgcccggccggccgagcgtaccacaacacctccatcatggggaggtcgccgtgctgcgagaaggcgcacaccaacaagggcgcgtggaccaaggaggaggacgaccgcctcgtggcgtacatcaaggcgcacggcgagggttgctggcgctcgctgcccaaggccgccggcctcctgcgctgcggcaagagctgccgcctccggtggatcaactacctccgccccgacctcaagcgcggcaacttcacggaagaggaggacgagctcatcatcaagctccacagcctcctcggcaacaaatggtccctgatcgctggaaggctgccgggaaggacggacaacgagatcaagaactactggaacacgcacatccggaggaagctgctgagcagggggatcgacccggtgacacaccgccccatcaacgagcacacgtccaacataaccatctcgttcgaggcggcggcggccgcgcgtgaccgtgaggagaataagggcgccgtgttccggctggaggagcacaacaaggcgacggcggcggcggccgccgcgatcggccgcgatcatcatcagaaccaccaccccgccggcgactggggccaggggaagccgctcaagt

SEQ ID NO: 13699 - DNA, 949 bp, Sorghum bicolor
  misc_feature (40)..(40): n is a, c, g, or t
  Predicted polypeptide sequence is orthologous to G197, G255, G664
tcgctcccctgcccgccctgcgcagccgccgcccgcctcntcacacagcaaagcgatagccaaagcgaaagcgaaaagcgaggcaagaagcaggccgatggggcggtcgccgtgctgcgagaaggcgcacacgaacaagggcgcgtggaccaaggaggaggacgaccgcctggtggcgtacatccgcgcgcacggcgaagggtgctggcggtcgctgcccaaggcggccggactgatgcgctgcggcaagagctgccgcctccgctggatcaactacctccgccccgacctcaagcgcggcaacttcaccgccgacgaggacgacctcatcatcaagctgcacagcctcctcggcaacaagtggtcgctcatcgccgcgcggctcccggggcggacggacaacgagatcaagaactactggaacacgcacatccggcggaagctgcttggcaggggcatcgaccccgtcacgcaccgccccatcgccgacgccggcgccggcaccgtcaccaccatctcgttccagcccaacaaacccaacgccgccgtcgcagcgcaggcgccacaacatcagccgatcaaggcggtggcgacggccgtcgttaaggtgcccaggtgccccgacctcaacctcgatctctgcatcagcccgccgtgccaacagaaggaagacgaggagctgggcctcaagcccgccgtcgtcgtcaagcgggaggtgctgcaggccggccatggcggcagcctctgcttcggctgcagcctgggcatccaaaaaggagcccccgggtgcagctgcagcagcagcaacagccaccaccgcttcttggggctccggtccggcatgctcgacttcagaggcctcgagatgaagtgaatgaataagccgcccatggccatacgatcgatcgaaatggccagcagccgaatcttctccttcgtttggtttggg

SEQ ID NO: 13700 - DNA, 898 bp, Sorghum bicolor
  Predicted polypeptide sequence is orthologous to G207, G227, G230, G242
ttccgttcccttcccagttcccactccatctctcttctagttttcttcctcctcttctttcttcctgcaccctttggtactagccatcgctcccatccaagctcatcgtcctcacagatcgaccgacggatcaggccacacgcccccaatcaatactcactcaggactactagctagcttcgagtaagcaaacaaacatggcgtcgtcttctccgtcctgccgtggcggcggcaataaggcggacgtggaccggatcaagggcccctggagccccgaggaggacgaggccctgcagcggctggtggcccgccacggcgcccgcaactggtcactcatcagccgctccatcccgggtcgctccggcaagtcgtgccgcctccggtggtgcaaccagctgtcgccgcaggtggagcaccgccccttcacgcccgaggaggacgacaccatcctccgcgcgcacgcaaggttcggcaacaagtgggccaccatcgcgcgcctcctctccggccgcaccgacaacgccatcaagaaccactggaactccacgctcaagcgcaagtactacgccgcttccgccgccgacggcgatgcggcaaacggaggtgcagcggatgccgacgacgagcgcccgctcaagcgcaccagcagcgacggacacccggggctctgcttcagccccggaagcccgtccgggtccgacctcagcgactccagccaccacagccttccctccgtcatgccgtcagccgcttctgctgccgctgccgtcgtcacctcccagcagcagcagcagcagcacgtgtaccgccccgtgccgcgcgcgggcggcgtggtcgtgctcccggtggcgccgcctcttgcgccgcggccgccttctcctcctcctcctcctccgcc

SEQ ID NO: 13701 - DNA, 551 bp, Sorghum bicolor
  Predicted polypeptide sequence is orthologous to G214, G680
gcacgaggctctggtgaggaaatggtggtcaaggtaagaaagccatacacaatcacaaagcagcgggagcggtggacagaggctgagcacaaacggttccttgaagccttgaaactttatggcagagcatggcagcgtatagaagagcatgttgggacaaagacggccgtgcagatcagaagtcacgctcaaaagttcttcaccaagttggaaaaggaagctatgaccaatggtacttctccggggcaagcccttgacattgacatacctccaccacggcctaaaagaaagcctaacaatccatatcctcgaaaaagtggtctcagctctgagacaccaaccaaagattttccaaatgacaagtcagcaaaaccaaatatgcccttgagcaatggaaatgtacaaatggcaggtgatgcatctcttcagaaatttcaaaggaaggagttgtctgaaaaaggaagttgctcagaagttcttaatctcttccgtgatgccccatctgcgtcattttcttcagttaacaaagctcttcaatcatggtgcaccca

SEQ ID NO: 13702 - DNA, 778 bp, Sorghum bicolor
  Predicted polypeptide sequence is orthologous to G214, G680
caacctcgtcgctagccggcaccctattctccttcgcttccacagaacatctcttgtatggcttgaagcctgttcggcgcgatttcagcttcaggtgcgacaattcattgggaaaggaagcccttggctcatccattgtgtcgaggtcatgatcaatgcttgtggcgttcttgttgaggtcaactgccactgtagtcacttcatcttcttcctccttggcaacctccttcgagtcttctgcttgtgggggagaaaagctttgcggaagcttttctctactgaacagcgcatcgaaagccagacgaccctcttcagaaacctccttccatgaatcactagtgcttccactgcttctaaatctgcggtggttagtgtcaccagctgaagagttgctgcaggaggcttgcttcaccttctcattagcattgtcctccttaggaacattgtctgcatcaacatcactacttgaaggtgtgttagaaccacatgaagagcgatcctgctttttcttattcctgaatgcatcacttgtatcagctcctgtggtaggtgttgcatcagcattctggacaggaggtatctttaactctgtgtggagagacacctcgccttttccactcccatcagacactgaagaagcagcaactcttaaaccttcaaattgtccctgtttttgagcttcttggcattccttctgtgcattttcaactgggcaatctctgtctttctctgaaggtcttggaacatcaactgtgggaaaggcagcactaggagctga

SEQ ID NO: 13703 - DNA, 637 bp, Sorghum bicolor
  Predicted polypeptide sequence is orthologous to G217
aaatgaggagctctttaggcttcttgagcatgataatgcaaaatatcctcttgatgaaaaaactcaaaaagagaaaaagaaaggaagcaagcgtcagcaaaatggaggacctcttgtccctgaaattgaggattttgatgaagatgaacttaaagaggctagttctatggttgaagaggagattcaataccttcgagtggccatgggtcatgaaaatgaatcgtttgaggacttcgtgaaagcacatgatgcatgccaagaggaccttatgttttttcctaccaacaatagctatggtttagctagtgtttctggaaatgctgataaggtttctgctttgcaaaatgagtttgaaactgtgaagaagcgaatggatgatgaagcaaaaaaggcttctcggcttgagcagaagattaagctgctgacacaaggatatcaggtaaggtctggaaaactgtggtcacaggtccaagatacatttaagcagatggacactgctgcaacagaactcggatgcttccaagagctgcagaaacaggaacatcttgccgcttcataccgaatcctaaatttgactgaagaagtgaataagcagaaagcactagaaaggaccctccagagccgctatggtgagctt

SEQ ID NO: 13704 - DNA, 745 bp, Sorghum bicolor
  Predicted polypeptide sequence is orthologous to G222
tgcagtgcaactgcaactgcaagctctcgctctctctctctgctcgaacggcttgcttcgaacccacttgatcgctgcgtgcgtcgccggctccctcagctcagctctccccgtaccgtacgtgcgcagttctcggcacgctaccccatatatacccccggccggtctcggccggatagagatgcacaggcggcagtgacgacggacggactagggtagctgctcctcagctatccagatcgttcgttgccttcagccttgcttccttccgtgtcgggcggaggcggacgcggacgcgcgcagcagcagcgggaatgggacgccacgcggcctccggcggcggcggcggcgtgcagcagaagctgcgcaagggactctggtcgcccgaggaagacgagaagctctacaaccacatcatccgctacggcgtcgggtgctggagctccgtgcccaagctcgcagggctgcagaggtgcggcaagagctgccgacttcggtggatcaactacctgcgccccgacctgaagcggggcagcttctcgcagcaggaggaggacgccatcgtcggcctccacgagatcctggggaacaggtggtcgcagatcgcgtcgcacttgccgggccggacggacaacgagatcaagaacttctggaacagctgcctcaagaagaagctgcgccagcgcggcatcgaccccagcacccacaagcccatctccgccaacacggcggcggcggcattgga

SEQ ID NO: 13705 - DNA, 236 bp, Sorghum bicolor
  Predicted polypeptide sequence is orthologous to G230
gcacgaggacactccagcatgttgccttgcggaattaacttgctgagtttgagcagcaacccctgtatatgatagaaggatgtgggttgcggtggcatttgtgcatgttcaatgctgtatgtaatgttgatgtaattacagttttgtgtctaatgatcaatagaagttctctgccatggatcatggatggcagagcagctgtatctttgtttcctgtcaaaaaaaaaaaaaaaaaa

SEQ ID NO: 13706 - DNA, 767 bp, Sorghum bicolor
  Predicted polypeptide sequence is orthologous to G233, G241
cgcgaccaggacagtgctcccgtccccaaagacaaacaaacagggcaagcagcaagcacacgcctctccctcctcgccctgcctagctgcattcccccacacctcccctcgacacagacaagccaatctagcaaagcacacagctgaagcagacaacactcgtcggaggaggagatccagtagcaccaaataatggggagggctccgtgctgcgagaagatggggctcaagaaggggccatggacgcccgaggaggacaagatcctggtcaaccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaagaggacgccatcatcaccctccacgagcagctcggcaacaggtggtccgcgatcgccgccaggctgcccgggcggacggacaacgagatcaagaacgtctgggacacgcacctcaagaagcggctggagcccaccaccaagccggaggagcagcacggggcgcaggcaggtggcgccggcaagaagcacaggcccaagcgcggggccgccaagaagacgacggccgacgacgtcgccgtcgtcccagctaccaccgcgccggtgtcgcctgaacggtcgccggcctcgtcgtcggtgaccgagtcgtcgtccatgacggagcaggagcaggagcagggcaacacggggagctc

SEQ ID NO: 13707 - DNA, 656 bp, Sorghum bicolor
  Predicted polypeptide sequence is orthologous to G261
aaatgcagtcctgtacagatccacgaactaaggtgtctgagattgatgttaatatggagcctgctgttacagaaactggtctatcaagggaccaacctgtcgaggagcctcctcatgcagcaactggggtaaacgatggcttttggcagcagttcctcactgagcagcctggttctgatgcacatcaggaggcccaatcagaaaggcgagatggagatgataaaggcgatcagacgagaataggagatcgggaaaaattttggtggggaaagaagaatgttgaacagatgacagaaaagctggggcatcttacctcggtggagaaaacctgactgtttgtattacttgtagttgtaggtgaaaaaacagttagtacagaaacacataggacgttggtgcctctgacatgtactttgcagtgtatcatatcttcgccacctgcacctgttgactgacatcgaatttgtagtcatacttttttcccttgtactttggtcgtgttaagaatgatgcagagactagttgataatatacttttgttaggagtgctgcattcatacttggtcagtagacatttcttggtactgctgtccacagcttctatgatttttcaggtttgtcgacgtggctatatatgtagatgataatattcactt

SEQ ID NO: 13708 - DNA, 664 bp, Sorghum bicolor
  Predicted polypeptide sequence is orthologous to G270
cgacgcggcacggcctcagagcacggcgcgccggcgcgggacgacgccatgacgccgccctccatcttccaccaccagcaccgcctcctccccctcccctccgcttccccgactcaaattctaaacccattcgccgcctcgtcccgtcgcctcaaccatcatctcccgaaacccaaagtcctatccttacccccgcgtccagtcttctcctccgccttcgcggtcgccgccgttggcgatgacgaggatgttgtcgtcggggattgcctcgtgttcgatggcgacgctttcgaggaacaagacctggacatcctctcgtccccgccgccgccgactagcgcctcccgccaggactggagggcggaggccggcgagggagagagcctggtgccggagagatggagggatgccgaggaggagatcaacctgacgaagaaggagaagcgccgcatcgcgcacgggctgcgattcgggagccgcctcgagcggcgggcgcccccggccgttgccgcccctgatgaattccgcgcgtaccgcaaggggatgctgagcgcggagcgtgaacatgttgctcatgtatacggggggccgctggagagggctcttccgtcggaggtggaggaacctccacccccggagcctgggacgcgtgtgactccgagga

SEQ ID NO: 13709 - DNA, 767 bp, Sorghum bicolor
  Predicted polypeptide sequence is orthologous to G274
tgggtgatgaatgttgtgccgaccatcgcaaagatgcccaccctgggggctgtgtatgagcgaggattgatcggcatatatcatgactggtgtgaagctttctctacttatccaaggacatatgatcttatccatgctagcggtcttttcaccttgtataaaaacaagtgcagcatggaagatattctcctggagatggaccgcatcttgaggcctgaaggtgctgtcataatacgggatgatgttgacatcctgactaaggtgaacagcctcgctctgggtatgaggtggaacacgaagatggttgatcacgaggatggccccctcgtgcgtgagaagatcttatatgctgtgaagcagtactgggttggtgggaatcagacagctgtagcttgaagcaagcacgtttccgaggttctaacatgaggaattctgcaacccaaccttacccgacgatcaagaattaccttaggagtcatcctgtggcaaggaaaatggtcagcccttgtaggggtagcactgaagcagccaggataccgtacttggtggtgatcgctgcaaagcctgcaaccacataatgtcggtgacaaatttttggaattcttcgttggttgtgtactctattcaaaagcttgtatcttagaaaatttctctacggtccgtactgattcgagtgtaatttattaagtagagtagctttctgtaagcaagaaatacaaggttttttggacaacccaggtatatttatctacacctgaatgatcctg

SEQ ID NO: 13710 - DNA, 732 bp, Sorghum bicolor
  Predicted polypeptide sequence is orthologous to G274
atctcagaaagaaagcaagggcacagcacatcacttgacttcatttactagcaacaacctgagtggggcttgctggcactggcgagcggcgcggcgcggcaccacaccagagcacgctgaggagagagagagagagattcatgaggggatcaagaatgaatccaggtgaccgtagaacacggagcacgatgacaatagtaattgtgatgggtttatcctgcttcttttacatactaggtgcttggcagaaaagtgggacaggaaggggtgatagtatagctctgagggttaaccaagaaactgactgtacaatcttgccaaatttgcactttgagacccaccataccataagtggcactaatccattgatcatgtccaataaaatgattgagccatgccacatccgatacagtgactatactccttgtcaagaccaggaccgagcaatgacctttcctagagaaaatatgacatacagagaaaggcattgtcctgtagagaatgaggaactgcattgtctaattccagcaccaaaaggatatgtcacccctttctcttggcccaagagccgtgactatgttccatatgcaaatgctccgtataagagtctcattgttgagaaagctgttcagaattggatccaatatcagggagatgtgttcaaatttcctggaggaggaacgatgttttccaatggagcaaatgcttaccttgatgaacttgcatctgtca

SEQ ID NO: 13711 - DNA, 692 bp, Sorghum bicolor
  Predicted polypeptide sequence is orthologous to G274
aagagagagagagagagagcagccgcctcaggcctcacagcccacagcccccgcctcattcgctccgccgctggcgattggtgaagagagctccgaggtggtatcccttgtatcgcatcgcatagattccgggctctactcgtcgcggttccggcgaggtccgcctatccgcgccccgctctggatctccggttgatttgttgttctgcaaggtggtatggcacgaaacttgactgagaacaggaccagaaatacattaattgtgattgtgattttgggcctctgttccttcttctatctcttgggtgcttggcagaaaagtggttctggaggaggagacaaaacacatcagtgggtcattgagcagatgaaatgtgcacagctcccaaatctgagttttgagacccatcatagtgcatccaaccttccgaatgatactggtagttccaaaattgaacctttcaagccatgtgatgagcagtacactgattacactccttgtgaggagcaaaagcgtgcgatgagcttccctagagataacatgatctatcgggagaggcattgtccactggataaggagaagcttcattgcctgatcccagcaccaaagggttatgttactccttttcgatggccaaagagccgtgattttgttccttatgccaatgtaccacacgagagccttactgttg

SEQ ID NO: 13712 - DNA, 756 bp, Sorghum bicolor
  Predicted polypeptide sequence is orthologous to G275, G837
gaatggcatgggaattgactggtccaaagtgagaaatgtaatggacatgagagctgtgtatggaggttttgctgcagctctgagggaccaaaaggtctgggtcatgaatattgtgccgattgattcaccagacacactgcccatcatttacgagcgtggtttgtttggtatgtaccatgactggtgcgagtctttcagcacttacccaagaacttatgaccttctgcacgcggaccatctattctcaaagctcacaaagagatgcaaattgatggcagtttttgccgaggttgatcgtgtactgaggccccaaggcaaactgattgtgagggacactgcggacacaataaacgaactggaaagcatggccaagtccctgcagtgggaggtgcgaatgacctacaccaagggcaacgagggcttgctttgcgtcgagaagtcgatgtggcggcccaaggaactcgatgcaagcacgtgaaatatatgtgttgaagagaactgttaccaagtagggtaaaattagaggaatttttgtcactagatatgcatatgattcttgttgatgctgaaaggacaaactctttggtgtaactgtagaataatacacatctgttttcccccatttgttgtttcattctcaacgctgctgtaagatagtgtgctggaaatcactggtacattctgttcaattgggcagcttcttcagtttgtcggatagcagtcgaacaatcttgtgcataattgcatatgctatat

SEQ ID NO: 13713 - DNA, 752 bp, Sorghum bicolor
  Predicted polypeptide sequence is orthologous to G275, G837
gaacccaggacgcgcatccgccttccccttcctcgctcctcttcgagatccgcgcggagggccaccgcgaccactccggtcggttccggcgaggtgccgcgcggctgtagcagcacaaagcagacaaaggtgcgatttttttgggggttcttggtccagcagtagttggtggagataaatcgcgtgaaggtcggtgctctggtacatgttcgccaggcactaatggcatttggccgaggtgggaagatggacggccgccggccgtcctcgacgtcgtcgtcgttctgcacgaccaccacggtcgtcgtctttgtggcgctctgcctggtcggcgcgtggatgatgacctcgtccactgtcttcccgctggagatctcctcgaataagaagccggtggtgaagcagcagcctgcgcctgtcaattttggggcctcacaggacaatgctggtgaaggttctgagaaatttgaggacaccgacaacaatgatgccacgatgccggaggagccgaataacaaggatgccacgatggaagagaagttcactgagaagccagaggagaagcctgaagagaaggagccggaagtgccgacagagaaagctgagaccaaggatatgtttgatgatgcaaatggaaaatcagaagggcggtcagatgacatgaagaacgatggtgacggggagaagagtggggagaagaaagatgatgaaatcacaaatgagagtggtgatgaaaaacctgatggagagag

SEQ ID NO: 13714 - DNA, 777 bp, Sorghum bicolor
  Predicted polypeptide sequence is orthologous to G278, G1290
aaaaccgagttgctttagcgaggatattgttccccatggaggcaagggtagcaatggacattgctcaagttgatggaaccttggaatttacccttggttctaatgctaatctgcctaccgagattcagcggacagttgacctgaacgatactcctttcataatgaaggaagagcacttggctcggatgagagccctagccaaaacagttgaactcgggaaacgtttcttcccacggtgttcaaaagtgctcgacaagatcatggatgacgaaaccgagctggcttccctcggacgagacacatccacagagaagaagaggaggttccatgacctgcaagacttggttcacaaggcattcagcgaggacaaggaggagaatgacaggtcggcggcccggtcgtcttcctcgtcgtcgacgacgtcgatcggaatcggagccgtccggcctcggagatgaaaggaggcatgggttctgtttctgcctcgccattttggtagttgatgatccccctggtcctaacagttttagcatcgcctgatattctcccaatccgttggccacatagagatcgtaatcatgctcacttgtgcttgtattgtatagtattagtgcagaacctatactcctactaactatatactaggtgtaaatcggtactggagattgtaatggtagtagtcacagtgtggcgtagtcaaattcccgcgtgtgtgtccagcagctagctgctcgggattgtaaaggcgttttagcaattaacgaagatcctcagcca

SEQ ID NO: 13715 - DNA, 626 bp, Sorghum bicolor
  Predicted polypeptide sequence is orthologous to G280
gcaggagcgggggttcctgcatccacagtgaagagaggccgtggtaggccaagaaaggagaagacattggaaactggggacttgaaagttgcacagatgacggagggtcaacataaagctctgcctgcacaagctgtagaccaaggtgggcttatgcaaaatgaagttgaagctaggattttgcaatcctttggtactcctttgatggagaagagaggtcgtgggcgacctagaaagaggcctctggaaactgaaactacagaaacccaagttgatgcattggtgaagaagcgagggcgtggcaggccaagaaaggccaggccttttgaaactggatctgtggaaactgcagttgaggtgtctagggacttggcagaagatgggcctgaaaaagatggggatgttgtgtcagggaagaaagcagaagctcaaggtgtacttttggttgaggagatagacaatggcactgcagatgctggatgtttggtagtgccaagagaggaggtagcaattgctccaatggatgctggaggtgtgctattatctggagaggaggcagccgtcgctcccatggatgctgggtgtgcaacgccaagggttgatccgatggatgtgggcaccaagag

SEQ ID NO: 13716 - DNA, 662 bp, Sorghum bicolor
  Predicted polypeptide sequence is orthologous to G280
gagggctccagtggtgagcccgctgcagctcccgtcgtcagcgctgatgctgctgccatgcctgtcaagcgcgggcgcgggcgtccgccgaaacccaagaaccccgtcgccgaggacgcagctcccactgcggcttccgtcgtcagcgctgatgccaatgctgtgcctgtgaagcgtgggcgcggacgcccccccaaagcccaaggacaccatcactgtggccaccgaccgggccaccagcggcatgctcagcccacgtggccgtggccgtggccgtggccgcccgcccaagaaggccaaggtcgccgtggaagatcccagtggtgagcctgctgcagctcccggcgttgctgctgatgccagtgctgtgcctgtcaagcgtgggcgtggacggccccccaaggtgaggcctgcagtggttggggcgccgtctgagtcttaaaccacgcacgatgaatcttgtgatggtaatggttgcaaggtttggtagtagcctggctcatcaaattgagttctgcactaacttttgcagttggttaaatagcgtcggttaaagagtactctcagtaatctagatgtgtttctgtagtctgtacatcgaatggtgggtgatgtgtaatagttgactgctgctgagagcgatttaatcagtgctatttcct

SEQ ID NO: 13717 - DNA, 790 bp, Sorghum bicolor
  Predicted polypeptide sequence is orthologous to G291
ctgtcaggaatcgacgtgtcaactcagatgcttaaccaacaattcacagaaccattcttggctgttgtgatagaccccacaaggactgtttctgctggtaaagtggagattggagcttttaggacatacccaaaagattacaagccaccagatgagcctgtgtctgagtaccagactattccactcaacaagatagaagattttggagtccattgcaaatcgtactatgctttggatataacttatttcaagtcatccctggactctcacgtccttgatctgctctggaacaaatactgggtcaacacactattttcatcaccacttctaggcaacagggattatgttgctgggcagatctttgatttagctgataaactagagcaagctgaaggccagctggcacacagtcgatttggtggtatgattatgccatcacaacgaaagaaagagcaagaggagtctccactggctaaggtaacacgagatagctccaaaatcacagctgagcaggttcatggtctcatgtcacaggtcataaaagacatctttttcaactctgtccacccctcaatcaaggcaagcacaagtgctccagattcatcaagtgctccggattcatcaagtgctccagattcatccggtcctgagcctatggttgaagcctaagagttccagcgaaaggcaacattgaatatttgtgttatgccatcactaagatagttgcaatcatagctatctgattaagaacgtgcaagacaagttaaattatggaaaagaatcattatgt

SEQ ID NO: 13718 - DNA, 592 bp, Sorghum bicolor
  Predicted polypeptide sequence is orthologous to G307, G308, G309
gcagatctgcaacgttgtggcatgtgagggcgcggagcgcacggagcgccacgagacgctgagtcagtggcgcggccgcctcgtcggctccgggttcgagcccgtgcacctgggctccaatgcctacaagcaggcgagcacgctgctggcactcttcaacggcggcgacgggtacagggtggaggagaaggacgggtgcctgaccctggggtggcatacgcgcccgctcatcgccacctcggcatggcgcctcgccgctccgtgatcatggggtggggttttggacgctgatcaaggcacacgtcccccggccccgggcatggcgcagcctccccgagctcgccggcgcagttgaagctgtagacgtcaatgaacgctgaatgaattgcagttattaggcgaccgggccacggttctcgccggcgtgatgagatggactggacactttgactccgaccggatcgggcctgtgttcgttcttgtttccgatccccctctcttcccgttgcttcaatccgtcaactatggtagcccgtagcccctattgttatgtttaaatgtctattattattattatgtgtaattcctcccc

SEQ ID NO: 13719 - DNA, 610 bp, Sorghum bicolor
  misc_feature (600)..(600): n is a, c, g, or t
  Predicted polypeptide sequence is orthologous to G307, G308, G309
cgagcggcggcgcgggcgacgcggcggcggaggcgtacctggagcgcgagatctgcgacatcgtgtgcggcgagggcgcggaccgcagggaacggcacgagccgctgtggcggtggcgggacaggctgggtcgggcggggctggccgccgtgccgctgggcgccaacgcgctgcggcaggcgcggatgctggtggggctcttctccggggaagggcactgcgtggaggaggccgaagggtgcctgacactgggctggcacgggcggccgctcttctcggcgtccgcgtggcgcgccgcggaagagaacaatcagagtgacagctgcaacgcggacggcagcaggagcagcggcagcggcagcggcagcggcagtgaggagagcaatatcagctgcagcagctagggctaggtatcccaattcccgtcgtagtttttactgtaaattcggtgagggtagcgcggttggttattactgtaaaatcgcggtgcgtgcgcgcggtccaaatggtttgcatcggtcgtaaatggtagactgaaatgacatgaaattctgttaagcgtgtcgtcatagttgaataaacgacggcactgatcgaaangcgcccctgg

SEQ ID NO: 13720 - DNA, 664 bp, Sorghum bicolor
  Predicted polypeptide sequence is orthologous to G307, G308, G309
agcttcccctctctcgcccgcttcctccctccccctccccttcccttcccttcccttcaccactcccacttcccaaccctggatccaaatcccaagctatcccagaaccgaaaccgaggcgcgcaagcaattattcgctggctagctaggcctgtagctccgagatcatgaagcgcgagtaccaagacgccggcgggagcggcggcgacatgggctcctccaaggacaagatgatggtggcggcggcgggggcaggggagcaggaggaggagctggacgagatgctggcctcgctcggctacaaggtgcgttcgtcggatatggcggacgtcgcacagaagctggagcagctcgagatggccatggggatgggctgcgttggcggcgccggcgctaccgctgatgacggcttcatctcgcacctcgccacggacaccgtgcactacaatccctccgacctgtcgtcctggctcgagagcatgctgtccgagctcaacgcgcccccaccgccgctcccgcccgcgacgacgccgccggccccgaggctcgcgtccacctcgtccaccgtcacaagtggcgccgccgccggtgctggctacttcgatctcccgcccgccgtcgactcgtccagcagcacctacgccctgaagccgatcccctcgcc

SEQ ID NO: 13721 - DNA, 793 bp, Sorghum bicolor
  Predicted polypeptide sequence is orthologous to G319
atgccaaccgtagcatgatcacttgacttgacttgttcaccaccacaccgtaccgccgcctctccctctccctcgtcctcgtcctcgtccgcgcgcgcatatggccctgccactctacggctgcaggtcctgctctgtgcatgacgccatcgtcttctgcctctggtgcgcagcaggacttggaggcctggctcgccgacaagctggaggacgacgacgagcaggatcatcagctcccgccagattgggatgtcgccatggaaaccgccagactcgagaagatgctggcagacagctgctacactagtagtcagcctgagtcatcatcctctcatggcaatggcaatggcaatggcaaccatcagctcattttctcctcgtcgccggcgggctactgtcagcaacagcatcaacaagccactgctgtgcagccgtcttggcagaacaacaatgacgccggattccctttcggtagcggcgtgttgccggagaccgcaggtttcatgcagcagcagcaggctgcatcccagccaccgcagatgacgacggccgctgaccatgacaataagatgctgcaggacgccatggccaagaagcgaaagcgagaggagagggagagggccaaacaaagatataacgagaagaaaaagaacagaaggttctacaagcagatcatgtatgcttctcgcaaggccagagcagacacaagaaagcgagtcaaaggccgctttgcaaaggctcagcatgatgatgatccccagattcttgacggcccatcagcatccacagctac

SEQ ID NO: 13722 - DNA, 728 bp, Sorghum bicolor
  Predicted polypeptide sequence is orthologous to G324
attaatcccacgccaccctgtccctttccccgcgccaccgccctctccgtcgccgccgaccgaccgagcgccgctcacccaccccacgagctcccgcgcgggttcatgtccatctccccacgcgaacgcaccggaggacactattacccgcgcccgcacaaccctagccctagtacccaacatggcagcgacagacgccgccacggccgccgctcccctccggcatccgtctcgccacctggcgccgctgcggcggccggcgacggtggggtcggctcgagctcccacccagtggttccagctattagagaatctattaatgctcccgaaaaggtagttggatttataatatctggggaagagacaattactcaagaggttggcagtattgaagaatgccactcttcagaacaggggaatttgggtttccctgtagataattttggttcagttgggccatatcctgagagacctaaaatggcgggatcccttgaggctgaccatttggcttcaggttctactggacatcagggtaatgggactcagatagctgccaggaagaatcagtccgtgaatgccaatcacctcctgaatttccagtatgatcctatttctcggccacagcccagaggccctagaacatatcctcccagaagacaaaggaagatcaaaccttacaacaaggatctgttcctccaagcaaactataagtttgttgtgttggatac

SEQ ID NO: 13723 - DNA, 657 bp, Sorghum bicolor
  Predicted polypeptide sequence is orthologous to G326, G1337
tgtcagttgtcatcgaaaaatgtgagcaccgcgagcaacaaacggaagctgagctcctgtgcctcgacgatcgatggaccaacaacctctggaaaccatgtacccacatcaggaccagcactcaccagggagatctccttcggggatcaaacggtctccacccctgcagctgagaggcctgctgtgaggatcgacagcgagacgctcgcgcagaatagggacagcgctatgcagcggtacagggaaaagaagaagaaccgcaggtatgagaagcacatacggtacgagtcgaggaagctgagggcggacacaaggaagcgggtgaaagggcggttcgtcaagtcgaccgaagccctgaacgccggctatggcggatgagccatatggcctgtaaactgtggtttgctgtgtgcctgcgttacgtgcagtagcaatgttggtggtacggatgctatggcggaatcgataagcagtgttagagagccaagtttttgcgttgaagcaattgtggtcattgggcagtagtcaactccagagattgcacggtattgcttgtaagagacgaccccctgccatctcatcagtatgtagcttacatacagtactgatttaccatatgatgcatgtggtctttgcagtgaagtaacttgttttgtt

SEQ ID NO: 13724 - DNA, 613 bp, Sorghum bicolor
  misc_feature (23)..(23): n is a, c, g, or t
  Predicted polypeptide sequence is orthologous to G343
ccatcaaaggggtagatacattngtctttgataacaaattattatcacaaacaaaaacacaaaatcacacatatgttgctcatgtttgtcatccattgtcggtttcataaccttgtcttccttatcctttctttccaagggtagatcaactcttgtctccagtgatcatcttacgccacctaagtttggcatcacagatgctccttaccttgtcctgaggtttgaatgcttttagcttcagcaagttgagcttttatcctctgaagatcttgttttatgattgtgttttctatagaaagagcatgtatgctgccccacagtttattcaatgtgggatcgatataagaataagaaaaaccgatcccaaacaaaaaaatggtaatacaatcttttgtagcttttatgaattcagtctttgcgtctcccatgaaattagcttttacgcgttcccacggagaccgacgtagagcctctccgctagttggcggcgaggagccactgccgccgccgccgccgcttgggttccccgactggaatcgacgcgccgcgacaagaggacgatgcgcaagcgtcaggggtgcgcgtgccatcttccccgccagagatccaagaa

SEQ ID NO: 13725 - DNA, 622 bp, Sorghum bicolor
  Predicted polypeptide sequence is orthologous to G343
tcggagaagacgccgcagtggcggacggggccgctgggccccaagaccctgtgcaacgcgtgcggcgtgcggttcaagtccgggcggctgatgcccgagtaccggccggcggccagccccacgttggtgctcaagcagcactccaactcgcaccgcaaggtcatggagcttcgccgccagaaggagctcatcctcatccgcggaagccacagccaccgtgacgccgccgcagccgcagctgccgcggcggcggctgctgcaggatccgccgccgggccgaggccggagctcatcttccgtgactacggcgtgtgttaattagctgcatggccggcaagcttggcaaccgtctccggcacggagaggaagctcgatcgcgtcgtgcattgcattgcatgcatggagctgccttagatccttttgcgaaattctgccgtttctttctttctttctttctttctttctttctttctttctttctttctttccctgcgtattattccatgatatttttcatttctctttttgttaattattaaattgttggtacctactacctcctccgatccctgcttctgagttctacgagagatcaatgaattctgtggtataaatgtgatcg

SEQ ID NO: 13726 - DNA, 689 bp, Sorghum bicolor
  misc_feature (630)..(630): n is a, c, g, or t
  Predicted polypeptide sequence is orthologous to G343
tcactccttcactcatcccctcctcctcctctctctctctcctctcccctcacacactctcgtcgtcactgagactagcaaggctagctactagctcgtactgtcacttgctcgtttcaaggaactgccctgcagtgccaattaagtagctagtacgtcgtacggttagctcgatctttagctaactactacctctttgagttcgcgcgatggcgtcggagtgggaaatggccgccatgggggtggagctcggcatgggaatgggcacgtaccaccaccacaacgcctccagcatcaccaccgcgcccatgagcagccaccacagcggcgccgccagctactccacgccgcaccaccaccaccaccattactacgggatgccgcccatgggcggcgacgccatgcgcgtggacgatcttctcgacctctccaccggcgccggcgccggtgcccacgacttcttccccaccgcggccgcggccactgacaaggggcaccagcaccactcgggcgccatgggtgagccgtcgcccaccgccaactcctcggatcaccagacgtcgctcctctccttcgccgatgagttctacatacccagcgaggaagctgccgagctggagtggctatccnagttcgtggacgactcctactccgacatgccgaattactcgtcggccgcgcatgccgca

SEQ ID NO: 13727 - DNA, 727 bp, Sorghum bicolor
  misc_feature (32)..(33): n is a, c, g, or t
  misc_feature (60)..(60): n is a, c, g, or t
  misc_feature (71)..(71): n is a, c, g, or t
  Predicted polypeptide sequence is orthologous to G347
gacaaatccaatccgaaatcattctccccccnntcgcctcgcctcgccgagggaagagcnagagagaagcngacgccgcgttccttcctcccgcgtcgagctcgatcttcccggagccaccgcgggaggcgcagacgttgggacagcctcgcgcgcgcgtcccacgccggtatgcagagccagatcgtgtgccatgcttgccggaccgttctactctacccgcgaggcgcgtccagcgtctgctgcgccgtttgccaggccatcaccaccgtgccgccaccaggactggagatggctcagcttatatgtggtggttgtcgaactttgctgatgtatactcgcagtgcagacaccgtaaggtgttcatgttgcaacacagtcaatcttgttagaccagtgaataatatagctcatgtgaactgcggccagtgccggacaactttgatgtatccgtatggcgcaccttcagtaaaatgtgccatatgcaattatgtcacgactaccggagtaaatactgtggcacccactccatctgcgaggccaacatcaaatgagtcttcatatattggctcatctacttctgctcctaaatctcaacctcagaatgtaactgttgttgttgagaaccctatgacagttgacgacaagggaaaacttgtcagcagcgttgtagttggagtcacagctgggaaagtgtgactttcttgacacttcgtacattattatt

SEQ ID NO: 13728 - DNA, 805 bp, Sorghum bicolor
  Predicted polypeptide sequence is orthologous to G347
gaggcatgcagagccagatcgtgtgccacgggtgcaggaccgttctgctctacccaagaggtgctccgagcgtgtgttgcgcggtatgccatgcagtcaccaatgtgccgcctccagcaatagagatggctcgacttatatgtggtggttgccagacattattgatgtatactcgcagtgcaacaactgtaagatgctcatgttgtgacacagtcaatcttgtcagaccagtgagtagcatagctcatgtgaactgtggccagtgccaaacagtgttgatgtatccatatggagcaccgtctgtcaaatgtgctatttgcaacttcattacaaatgttggcggggtgactccggtgagacctttgccacctgcactacctgcatcaagtggaaattcatatagcatcccgtcaacttctgtgccaatgaatcaatcgcagaatgtaactgttgttgttgaaaacccaatgacagtagatgacaagggaaaattggtgagcaatgttgtagtaggggttacaagtggtgggaaaaagtaacatatcacaacctgtgtaactttgtttattatgtttaaaatatctgaaaaggtttaagaataccatgtatcatactgctgtttggcgatcggctgctcgacgaaggaatccctccctgaagagcatagtggcaaagcacgcggctttcgccattgcgatcgtgctagaacgagcgaaaacgaagtgcgggtgtggatggatactcagaaactgtagcttgttacccttgattcttttgtatgtaatatgggctctcccagaattcc

SEQ ID NO: 13729 - DNA, 580 bp, Sorghum bicolor
  Predicted polypeptide sequence is orthologous to G351, G545
ggcgcaagagtccgagctccgcttccggtgctccgtctgtggcaaggccttcgcgtcgcaccaggcgctgggcgggcacaaggccagccaccggaaaccgacgcctgtactacaggcacaagcgtcgtcgtcgtcagccggaggtgcggcggcgtcgtcgtcggggataacgacctcggccggcggcagcagcgggcaggggaggcacaggtgcacggtgtgccatcggagcttcgcgacggggcaggcgctcggcgggcacaagaggtgccattactgggacgggctctcggtgtcgctcaccgcgtcgtctgcgccatcgggttccgggtcgaccgtgaagggatttgatctgaatttggtgccggcgccggcggcgacggcggccaacgcggcgacaaggtggagagaggaggaagaggtgcagagccccttgccggtcaagaagaggcggctgtccggcccgtccctggaccttagtttaacgatctagagttccgtttgatgaggcatgtgtagagtttttcctaccttcattcgttattttagttggattttggtttggtgttttgacctggtg

SEQ ID NO: 13730 - DNA, 676 bp, Sorghum bicolor
  Predicted polypeptide sequence is orthologous to G351, G545
acaccaagcccgctgccccggcggcgacgcaagagtgcaacgtgtgcggcaaggcgttcccgacggggcaggcgctgggcggccacaagcgccgccactacgacggtaccatcggcagcgccgccgcacccgcgcgcgcgtcctcctcctctgcggccaccagcagccgcaacacggcgccgccgccggcggtcgccttcgacctcaacctgccggcgctgccggagcgatgcgccgtggcggaggacgacgaggtgctcagcccgctcgccttcaagaagcctcgcttcatgatcatcccggcttaatccttattaagctcgtccatcagctagcagcaaattaatcgatctgttcattgtagattaattagttgagttgttgtgcttgtacctagcttattgaattgttcatgtaggtgcttttagttggtggtgaatagttgtagtatatatcgtgtatatacaattatacgtacataggcactgttcattatgtattcttcattgtttagttacgtataggaggatagtaggagttaggagtaggtagaagcaaggatcaattctttctttcattggttgaattggtgtagtagtatatatatatatatatatatatatatatgcatgtaaataaatacaatacaataaagaaaaattgagaagtctacagt

SEQ ID NO: 13731 - DNA, 700 bp, Sorghum bicolor
  Predicted polypeptide sequence is orthologous to G353, G354, G2839
agctcgatcgcaagcccttagtttagttccattccatccccagctgaccgtcagggtacatatatggcgaagcacccgagagactccggcgccggcgccgtgccgctctccctcgcgctgtccctcggcggcggcggcgtggccgccgagcacggcagcaacaagaggcaccggcgcgcggcggcgggcggcggggacggcggcggcgagttcgtctgcaagacgtgcagccgcgccttcgggtcgttccaggcgctgggcgggcaccggaccagccacctgcggggccgccacggcctcgcgctcgggatgcccgcgccggcgaaggacgacgccaaggagaccaccacgaagcagccagcggcggcgtccgcgagccacctgtgccacgtctgcgggctcagcttcgagatgggccaggcgctcggcggccacatgcggcgccaccgcgaggaggccgccgccgccaccaccgcgcaggcgccgcccgtcctcctccagctcttcgtgtagagttttatttgcccgtacacggagaggccattcatcgggggatttctagtttgcagtagaggaattctttgcgtttcagtcgtccgtctgcacattgtagattcaacagtacaattgttggcatatttgccaattgattgatgattgattgattcattcattcatttagttacacatgtaaatacaa

SEQ ID NO: 13732 - DNA, 810 bp, Sorghum bicolor
  Predicted polypeptide sequence is orthologous to G353, G354, G2839
atatatatatatatcttgttagcttctaatcgagatcgagtagttcagctgattattcaccggcaagaacaagctgatcgacgagtgcaatcatttgatgaagaggtttgcagtgcaggagagcgagatggcgcgcgtgctgatgctcatgtcacactcgcacggccaggaccagtcgctgccgctgccggtgatcgccgccgggcgcggcgacggggcggcgccggagcgggtgttcgtgtgcaagacgtgcaaccgcgtgttcccgtcgttccaggcgctgggcggccaccgcgccagccacatgaggcgccaccgcgccatgacgggcggcatgcccatgccaccgccggcgacgacgaggatcgtcgtcgacaagaagccggacggcgacgtcgtcggcatcatccaccacgaccacggccacggcggcgtcaagcccggcgggctgtggctcgacctcaaccacccgccctgcgacgacgacggctgcgacgccgaggtggagtgcggccacattaatgccgccgccgccgccggtgggatcacgttccatcagttcctcgacactggcaccatggccgtcgactgccttggctactagataccaccaagctccatgattcttctccctgccacgtactactggtgcaccggccggcctccgttttttttctctggaatcttcttctccatttgcttctgcgtggaggggagaaatccacattttgtagcaatagtagaatgaaggtgcctaatgcatcatgattcatgaatgcatggatgatgatgtgcatgaaggttttgggg

SEQ ID NO: 13733 - DNA, 569 bp, Sorghum bicolor
  Predicted polypeptide sequence is orthologous to G361, G362, G370, G1995, G2826, G2838
gcacgagggcggaaacatataccaagcttgctggtcgcctcacaacctacgacgaaattaaacaagctctagccagctagaattcttcttgggggctcgctcgcagccggccatggcgaagccgcaggaggtgcgcagcgtcgactccttctcgcagctgccgttcatccggccggccccggcgccggcgcagccgagggacgccaccatccggctgttcggctgcgacttctccaacgaccagcagcggcaggccaagcagcagcaagacgccgcgtccgactcccccgacaacgccaacggcagcacggtcacgtccgagagcaacggcggcgccaagagcggcggcgcggctgcggcggccgcggccgctgcggccgccgagaggaagttcgagtgccactactgctgccgcaacttcccgacgtcgcaggcgctgggcgggcaccagaacgcgcacaagcgggagcggcagcacgccaagagggcccacctccaggcctccctcgccatgcaccgctacgtgcccggccacatgtacggcctcttcaactaccaccaccaccacc

SEQ ID NO: 13734 - DNA, 682 bp, Sorghum bicolor
  Predicted polypeptide sequence is orthologous to G363
gcatgagttagaaaacattttcttctttcctcttcacttttttcattttatctagatcctggcctgttcccccatggcggtggcacccaccaggctgcagtctccatccccatggtggcggcgcctccaggtgtggcgcatcaccatgagcacaaagatgtcaccatggcctcgtcaacggcgaagggcgttgttagtccttccgaaggttcatctcatacttggagagggcagatttgttctcatttttctaagacaatagctctttcagtactagagcaattgctagtggagtggttgctggcgcagccttgctatttgctactcccactaccggcagcggcggcagtggtgatgagacgggctcccagcccctctttgcctggttgcgcagcttgtgcgccttcttgtggctgcgcgagcgccttcgagctgcagaacttcctggggcagtagtagcaggcgaagaccgcatggaacctgggcagcgaccacggcaacccgttaactgatctttggctagttttgtgggattcgatagatttgttgatacgtatatctatcagattttgtattgatatattggtcaaaaaccgatatattttgacagcggaaatctgtaatcagatgtctagacagaccctaatattaaccatgaatattattttttaatgttttcttt

SEQ ID NO: 13735 - DNA, 695 bp, Sorghum bicolor
  Predicted polypeptide sequence is orthologous to G374
aaaaatcccatatttccgggaggttattgttatggcaacaacatgtgacatgtgtggttatcgcaattcagagctgaagcctgggggtgaaattccagctaagggaaagaaaattacactgcgtgttcaaaacgcacgagaccttactcgcgatgtcataaagtcagattcagctagcgtgaaagtacctgaacttgagttggagctttcaagtggaacgttgggtggtatggtcacaactgttgaaggtttaattgtgaaaatatgtgaggctctggagagaatacatggattccaattgggcgatagcacactggaatggaaaaagaagaaatgggaggattttaaggagagattatccaagcttctgagtttacaagagccctggactctaataattgatgatggattggcggcttcatttgtagccccggctactgatttgttagaagatgacagccagctaaccatggaggagtatcagaggagttgggagcagaatgaggaacttggcctgaatgacatggatacgtcctctgcagacgcggcttacaacacgaccagcacatgattttttttaaaaagttttgttgtgctgaatgtatttgttatgctaacttgtatcattatctatttactttggtaaactccccagtgtgtatactaatatcaacaacttatattcttctgacgat

SEQ ID NO: 13736 - DNA, 637 bp, Sorghum bicolor
  Predicted polypeptide sequence is orthologous to G378
ccgtcgacagtcagatgaacgcggcggactcgggggacatggacatggcggcgacactggcggacatgttcgatacgggcgccggcgccggcgccggcgctcctcccaagggcatgccggccgccgccatcgcggcgctccccgtcacggccttcaccgaggacaccgtcaccgacgcctccggggagcccatcggctgctccgtctgccttcaggacttcgaggccggcgagacggcgcggagcctgccggagtgcgggcacacgttccacccgccgtgcatcgacgtctggctgctccggcacgcgtcgtgcccgctgtgtcgccgcgcggtctagtctaggccgctagctgcgcgcgtttctcgacgaccatatgcgcgtgcacatcatcacacgtgtcacggaccaggagcagagtatagtaggctagtaggtagtagcagcctagcaggacaaattggttgttctctcttgcataccttgatttttctgtttgttttttgttcgtgttgggcacgcatgtacagatacagtacgtggctcacactgtcacacacacacgatgtgtaaatatgtatagaggtgaatgttgtaaataatgtaatagactaatagttgtagaattgagatttttt

SEQ ID NO: 13737 - DNA, 547 bp, Sorghum bicolor
  Predicted polypeptide sequence is orthologous to G378
gcacgagggaaaaagccctcgtctgactacgctgtgttcatctgctctgctacgactaagccagagctcccaccgtcaggtcttcttcttcttcccccccttcgcgtcctctcctctgcctgcgcgcgcaccgtcaagcgagcgagaaatcgtcatggacatggaggcggccgcgatcttcggcaccgccagcgcgtcgttctctccagcgccgtcgtcgtccaggtcgcgcggcggcggcggcggcacgagcatctcccggctgccggcgcgcgtcgccggcgccgtggtccggagcctggtcaccttcgtcttcgcggcagtgggcatggttctcggggccgtcacgggcgcgctgatcgggctcgccacggagagcggcctggtgcgtggcgctggcatcggggccatctccggcgccgtcgtgtccatggaggtcgtcgactcctccgtcgccatctggcgctccgacgagtccgggatctggagcgtcctgtacgtgcttgatgttctctggagtctgctgaccggccgcctggtacgcgag

SEQ ID NO: 13738 - DNA, 659 bp, Sorghum bicolor
  Predicted polypeptide sequence is orthologous to G378
cctactggattaatggccgctccctctctatccccttcgtcgtctcgtctcgtctcgcgctaggactcgactcgccccccgcctccctccggcttaaccctcaagatttctccctcctcccgcttctccttcccgcttgggcgggcgggcgggcgcggcaccttccggttccgggggccggcctatatatatacgctcgcgaccgtctcctctccatactctctagcatgctcggctcgctcccgggattgatcgagctcgcccgtcgtcgaagcgatggatcattcggtgccttccccctcctcttctccccggaccgccgccgctgctcccggcggcccctgctgccgctttgacgcgctgcggcgggcgtgcgccaggcacgccgccgtcgccgcgcgggccgccgggtggacgctcggcgcgctgctcacctgcgtcttcgccgtcgtaggctcactcgtcggaatcttcatcggtgccttcatggggatgtccacggagagcggcatgttccgcggggctggcgtcggagcagtttctggagcagtcttctccattgaggctgttgagtcctgcatcgagatttggaggtccagccattcgggaaatacagcattctctttgtgctggacatcatctctagcctcttcagcgga

SEQ ID NO: 13739 - DNA, 605 bp, Sorghum bicolor
  misc_feature (25)..(25): n is a, c, g, or t
  Predicted polypeptide sequence is orthologous to G384, G385
ccgtgcctactgcaaagctctcctngggctctgtagcaactgtgaacagcctcatcgcctgcaccgtggagcgcatcaaggctgccgtctgcgtggaaggcaacccacagtagccttccatccatatgatctcgaggaggggggcagcaaggttttggggaaatattagtggggagtcaagaacgcacctcagactctccttgccatgtggtgctcatactgcaagcgaaaattcagttcgttaggaaaaagaaggcgtcaccactatgcaaggggggatggttcgggtattgacttccccgttgatcaagtctactacagaaaggatgctgcggagaagatgctgtttctggatctctttcaatatttttagggtttccatttgctgctgtgtacttcgtcatgttcgtggtgtcgccgttgttcaggctaaggtgcctgtgcctgctcgtagctagagaacagagatttgttgcgtctttttttttttggatttgcaaagatttgtagaatctaggatcaatcatttcataaccaatgcttggctaaaacgtgcccgttgttgtttgtagctttttgctatttaaaacgatgcaattcaattt

SEQ ID NO: 13740 - DNA, 750 bp, Sorghum bicolor
  Predicted polypeptide sequence is orthologous to G390, G391, G438
ccacgcgagcacacccaccacctactcctactccccatggcaggagcgcgcacgggagccggctgctgctccacctcctctcctctcctgctgcactactaggcggtgcccgccggcgacgacgatggcgatggtcgcgagcagggagaggcggctctccccgccgggcggcgccgcccagggcgcgccgcaggtggacgcgggcaagtacgtgcggtacacgccggagcaggtggaggcgctggagcgcgtctacagcgagtgccccaagcccagctcgctccgccggcagcagctcatccgcgactgccccatcctcagcaacatcgagcccaagcagatcaaggtctggttccagaaccgcagatgccgggagaagcagcgcaaggagtcttctcgtctacaaaccgtgaaccggaagctgagcgcgatgaataagctgctgatggaggagaatgaccggctgcagaagcaggtgtcccgtctcgtctttgacaacgggtatatgaagaatcgactccacagtccttctgtagccaccaccgacacaagctgtgagtctgtggtgacaagtggtcaccacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattc

SEQ ID NO: 13741 - DNA, 833 bp, Sorghum bicolor
  Predicted polypeptide sequence is orthologous to G390, G391, G438
ctcccagaagcaggataaatggcagcggtcctggaaatgctgcttctgctggctcaaaggctgtgatgacgatcgtgtttcagtttgccttcgagagccatctgcaggacagtgttgcagccatggcaaggcagtacatgcgaagcatcattgcatcagttcagaggatcgcgctggcgctctcctcctcacgcctcgttcctcatggcagcagcatcagtcacactcctgctagtccggaggcaaccacgcttgccagatggatctgccagagttacagatttcattttggggctgagcttatcaaatccggagatggtagcggctgtgaaggagtgctaaaaaccctttggcatcatgccagtgctatactctgctgctctttgaaggccttgccggtgttcacgttcgcgaaccagtctggcctggacatgctggagacaaccctggtggcgctccaggacatcaccctggagaaagtgttcgatgaccaagggaggaagaacctgtgcgcggagctccccggcatcatggagcaggggttcacgtgcatccccagcgggctgtgcgtctccggcctgggccggccggtgtcgtacgagaaggcgctggcgtggaaggtgctcgacgacgacagcggcgcgcactgcatctgcttcatgttcgtcaactggtcgtttgtgtaatgcatctgccaggtccgtcgcgctcatgggaaatcggctgatcggtggcatgttttaggttcgaatcgccctttaattattgggatgtagtaaaatgatttcggtttgaagaaaaatgtgaaatggtagaaggacctgaatagcagt

SEQ ID NO: 13742 - DNA, 771 bp, Sorghum bicolor
  Predicted polypeptide sequence is orthologous to G409
gcgagctggcgcgaaggctcgggatcgcgccgcgccaggtggccgtgtggttccagaaccgccgcgcgcgctggaggaccaagcagctggagcaggacttcgaccgcctcagggccgcgcacgacgacctcctcgccggccgcgacgcgctcctcgccgacaacgatcgcctccgctcacaggtgatcacgttaactgagaaactgcaagcgaaggagtcgtcggcgtcagagccggaagagtttacagttgccactcaagagacagcctatgctcttttcgaagaagacaagctctgcctctgctccgagatcgccaccggcagcactgcagcggcggcgccagggagcaacgacagcccggagtcctacttcgccggtgcgtgctcgcctccgtcgtcgccagaggacgacggctgcggtggcgccgacgaccgcaccttcttcctcccggacgccctgctcgccacgggcgtggaggagagcctcgagcgcggtgccgaagaggacgatggcgctgggacgcagctcaacaactgggcatggttatggaacgatcagcagtattagggaatgcacgcatgatattattgcagtgcaaatttggtctcgagctttgctgatgttgatacggtgtattctgctaattggccaggtggttgatttatgcctccacattgttcactgacatttctcacatcagtaacgtttgaggtgtaaaatggccaaagctgggccggatatgtaactaaatggagaactaaattacttg

SEQ ID NO: 13743 - DNA, 817 bp, Sorghum bicolor
  Predicted polypeptide sequence is orthologous to G409
aattcatccaaaaaaagtctaaaaaaaaaacttgcagcggcatccaccaccggagctgccatcatcggcccgtccctccgtgtcaaccccctcctcagaagttctatttgcagttcggcccctggccggtccgcccggccaccggaaggagccgctcgccggaggaaggcccccctgtctccttgccctgcggcgggttcatggggttctcgctgtaccccatgaagacgtccacgcggctgctctggagcactagcttcttccgccataagctcagctcctcctcctgcttcctctgagcccgccacgatcgtgttgtcggcggcggcggcggtccgctgctgctgcgcggtcctagcatccgttcaagtttgtgtttgtgtttgtgtttgtgttcgtgtgcgcgcacgcgcgtaccggcgtacgggtttcaagattgggttttgttgcgttcttggggagaggaagggactagggcgcgggcaagaatcagcatagcatggatccgagcgcggtcagtttcgactcctgcggcgcgcggcggggcggcggcggcggcggcgcgcagatgctgctcttcggcggcggaggcagcgccaacagcaacggcttcttccgaggtgttccgatggcggtcctgggcatggacgacgcgacgcgcgtgggcaagcggcctttcttcaccacgcacgaggagctcctggaggaggagtactactacgagcaggcgcccgagaagaagcgccgtctgacggcggagcaggtgcagctgctggagcggagcttcgaggaagagaacaagctggagccggagcgc

SEQ ID NO: 13744 - DNA, 790 bp, Sorghum bicolor
  misc_feature (706)..(706): n is a, c, g, or t
  Predicted polypeptide sequence is orthologous to G409
ccctccaagcaaaaatatatattagcgaatattaaagcattttccttatagagatatatataaaaaattagaacaaaaaggtttttccttttcgcgactccgtcgtccaccaccaacctcctccgatccggccgccgtagcgtagccgaattgtcccactccgggactcgctcggtcgacgagagggtgtttccggcgagtgctctcggccgatctcctccgcgcggctgaggagatcccgcggtcgcacgggggctggggcgtgcatgatgggattttggttgattccgatggagactccggcgaggcttctgtggagcaccagcttcttccgccacaagatcgccgccatgctcgcctcctcctcctgcttcttatagatcccacccctcaccgtcgtcgtcggcagctagctcgctagcttctgtacatacgtcgacgcccatataaatattattagtcttcatcgatccactcccgattaagtaataattcgggcaaagaatctccaagcttttgcctcgacgatctttgcattgatccatggagtccggacggctcatcttcaacgcgcccggctccggcgccgggcagatgctcttcctggactgcggcgcagccggtggtcccggcggcggcggcggcggcggcttgttccatcgaggcgggagaccgatgcttggccttgaagaagggcgcggcgtanaacggcccttcttcacctcgcccgacgagctcctcgaggaggagtactacgacgagcagctgccggagaagaagcgccgcctca

SEQ ID NO: 13745 - DNA, 791 bp, Sorghum bicolor
  Predicted polypeptide sequence is orthologous to G419
agaactacccctggcgaccccagcgcggcctgccggagcgcgccgtcgccgtcctccgtgcctggctcttcgagcacttcctccacccgtatccaaatgatgtggacaagcacattctggcgcgccagacaggattgtcaagaagccaggtttccaattggttcatcaacgccagggtgaggttgtggaagccaatgatagaggagatgtacacggaagaagtcaaccagaaatcaaacgcgactccgcaaaaccctagcggcggcggcgtcatcaaacctgagcagatgagcacaacggcggtgcccgccgccattggaggagatcatagccacttcctagctactagtgctgggaaccctagcagctccatgatttcatcctccattttgatgactgctgctgactgcggtggcagtggcggtggcgaccatctgttcagtagttatccgagcatgcataggagtcacggcggcgccgtgtcgcttaccctagggctccaacagcagccgtttgtgtcgacgatgatgcaccaccagcgaccattgatgttgcatggtgacgagcaagagccggtgctgccgtacagagaccttatggggtctcagttgctgcatgatttcgcagggtagcttagctaggtctactaggagggtggggtaaaatctgttttaatttcatgactacactataaaaacacacaaattggttcctagcttgctactagctttccgccggccgggcaaatcatgcatatactgtatatttaatttctcgagcaaccatgtgct

SEQ ID NO: 13746 - DNA, 529 bp, Sorghum bicolor
  Predicted polypeptide sequence is orthologous to G427
gcacgaggcttggccgacaggcccgggtaatcttgggaaatttcatcaaccagaggaagcgaaactggcacaacaactcccagacgtcaaccctcaaatcaaagcgtaaaaggtgatggagggcaagctgcacaatgtaatgcacacctgctgacacatataccaacacgctaatcaaacgaagctcgacgaccatggcgactcacaaaaataaagaggatcggccgatcgattcaactgtatatctagtgattagtcagaggtgacaggttgatgacacacacatacacgtacactagtctgaccactggcatatttgtttgctgtgatttttgagctcatgtgctcagagcatacttcattcttgttattattattgtatagccatattttgtcccccagcgtacatacataatctgaggattaaaaatccatcccctgtgcacatatatagtgatctgatctgaccatcatctgctggcagaaagagagaaaaaacagaggttgcattaaaaaaaaaaaaaaaaaa

SEQ ID NO: 13747 - DNA, 728 bp, Sorghum bicolor
  Predicted polypeptide sequence is orthologous to G427
gtagacagtgagagcaacatgtttgatggaaatgaggggtcagatggaatgggatttggaccattaatgttgactgagggtgagagatccttagttgagcgtgtccggcaggagctaaagcatgagcttaagcaggggtacagagacaaacttgtggatattcgggaagagatattgcggaagcgaagagctgggaaactccctggcgacactgcttctaccttaaaagcttggtggcaagctcattctaagtggccatacccaactgaggaagacaaggctcgactggtgcaggaaacagggctacaactgaagcagatcaataactggtttatcaaccagcgtaagcggaactggcacaacaatccggcgtcatcctcgtcggacaaaagcaagagaaaaaggagcactgcaggtgatggcaacgcagaacaatcctggtagtgcactgttggggaacaaattatatgtaaataataatgcttctactgtgaagagtgtcatcatatttgttgctccagaaacgacccttcagaccgccgtttcctgagcccatattcatataaagacatcacacgatgaataatgttgcaagtagtcacataaactaaataacttgtatagtgaatgactagaaactagcattcatcgtttggtactgtatagtactatagtgtaattgtttggtcggactgtctcttgtataatggtgtaaggttcaaatgtac

SEQ ID NO: 13748 - DNA, 764 bp, Sorghum bicolor
  Predicted polypeptide sequence is orthologous to G428, G1594
gcgccgcctcgctctccgatgaaatggtagggtcctctgaggacgaaccatgctcaggagacacagaggcgactgacctgggtcaggagcacagctcacggttggctgaccgtgagctcaaggagatgctgctgaagaagtacagtggttgtttgagccggctgcggtctgagttcctgaagaagaggaagaaagggaagctaccgaaggatgctcggtcggcgctgatggactggtggaacacgcattaccgctggccataccctactgaagaggataaggtgaggctggcagcgatgactgggttggacccgaagcagatcaacaactggttcatcaaccagcggaagcggcactggaagccatcggaggacatgcggttcgcgctaatggagggtgtcacgggcggcggatcatcctccgggacgacgctctacttcgacactggcacgatcgggccgtgatcacactctgacgacatcagttgcagcatacaatttactgggcatgtagtgtttgcattgcagttcaactgcattgcgctgcactgcactgccaatgggggtaattgttggttgatgatatggagattagtcacatgaacgaaccaataaccgctgtcattttgtcgggattttattgtgtatatgggcgacaacgtgttcggtacactgcacacagtatgtagtactacaagggaagttgctgtccagtccagatggccctgtaaagactctgtctgaaagtaccataacaattacttt

SEQ ID NO: 13749 - DNA, 684 bp, Sorghum bicolor
  Predicted polypeptide sequence is orthologous to G431
cgcctccgaccctgaccccgcgcgccccagcccgtcacgcagccgcgccgccccgaccccgcgccgcccagccccgcacgcagccgcgccgccccaacccggcgcgccgcctgcccagccgcgcccagcgccgcctgccgaaatttcgtggtgaagcacctcgccaaggtcttcgtggacggcctcctcgaggtcgtggacctcacgctcgtcccctacggcaacgctcggatccacgccggcggagtgatctcgtgccagatgaaatggtagggtcctctgaggacgaaccatgctcaggagacagacgccactgacctgggtcaggagcacagctcacggttggctgaccgtgagctcaaggagatgctgctgaagaagtacagtggctgtctgagccggctgcggtccgagttcctgaagaagaggaagaaagggaagctaccgaaggatgctcggtcggcgctgatggactggtggaacacgcattactgctggccgtaccctacggatcgcacggcgtgctatgcacacctagaccgtcgctgggatcgcaagctggggcgtcccaaccctcgccggaatcgcacactggacagtcgtcgtgagctgcctgggagtgtttttatgtattaaacttgtgaagttggaataatatgcactcttgaacgtgtggtttgtaat

SEQ ID NO: 13750 - DNA, 672 bp, Sorghum bicolor
  Predicted polypeptide sequence is orthologous to G446
tctatgggatatcgaaactccagagaacatggtcttcccttctccattgaattcaaagcggcaatgtcttcctagttatgcagttcctggcctacaaattggatctgtaaatatgtcatcaattccaagggcacaaggaagtccttttggtaacttgcagcaaatgccagggagtggctcagacttagctttgctgcttctcaatcaatctggccagaaccttggtagtccaattgcctgtcaacaatcatcattttccagcattattcaaaatgctaagcacagctatttccctccatcgacatttggtgcttccactggttcaatgaagcaagaaaccatgccttcgaatgaagctccgcagcagttgaatgctcttggtattcagaaaggtgatcaagtaagctgtgaagtccagccaggtattgattcaatttctgcacgggagatgagtgttaaaccaagaggaccaagaagcacagattcatactcaagtcaaagcatttcggatcaaaacggcaagggcgagcctagaacaaaatctcgaaggagcaagaagagctcgtctcacaaaaccatttcagataaatctgagctttcttcactaccttctcagatttgtgacaagcagaggcatggttcagaaccaacattggttgactgtggagccga

SEQ ID NO: 13751 - DNA, 955 bp, Sorghum bicolor
  Predicted polypeptide sequence is orthologous to G447
gaattccgactgagagcaatcagaaacataccaagggaaacaaacatcaacgtcctcacaacaatggctaccaagatatttgtcctccttgcgctccttgctctttcagtgagcacaacaactgcagtcattattccgcagtgctcacttgctcctaatgctattatttcacagttcctcccaccacttactcctgtgggattcgaacacccggctctgcaggcttacagactacagcaggcgcttgcgaatagcatcttacaacaaccatttgcccaattgcaacaacaatcctcggctcatctaaccgtacagaccatcgcagcgcagcagcagcagcaacagttcctaccagcactcagtcaactagccctggcaaaccctgtggcctacttgcaacaacaactacttgcatccaacccactggctctggtgaacaatgctgcataccagcaacaacaactacaacaggtcctgccaatgatcagtcaggtagccatggcaaaccctgccgcctacctgcaacaacaacaacttgcatacaacccactggttgcggccaatgctgcggcatacttgcgacaacagcagctgcaacaaatcctaccagcactcagtcaactagccttggtgaacccggccgcctacttgcacacacagctgcttccattcaaccaactcgctgtgacgaacaccgccgcatacctgcaacaacaacagctgcttcgtgttaatccagtggtagctgctaacccattgtgcgccgccttcctgcagccaagacaattgttgccattcaaccagatatctttgatgaaccctgccttttcatggcagcaacccatcgttggaagtgccatcgtctagattacatatgagttgtacttcataacaaaggtctcatatatcggcgtgtgcaacttccaataaataatcaatatattgtctgagaatt

SEQ ID NO: 13752 - DNA, 801 bp, Sorghum bicolor
  Predicted polypeptide sequence is orthologous to G447
taactggtataagtgatatggatcctgtaaggtggaaaaactcccaatggcgcaatattcaggttgcatgggatgaagcagcaccaactgagagacgcaccagggtttccctttgggaggttgaacctgttatagctccattcttcatttatccctcgccattgttcactgcaaaacgtccgagacaacctgggataacagatgatgatagctcagaaatggacactctttttaagcggaccatgccatggtttggtgaggagattggcaagaaagatctgagtactcaaaacagtttagttcctggattaagtttagtccagtggatgaacatgcaacagacctcctctctcaccagcacagttatgcaaccggaattgctaaattcattagctggaaaacctgtacaaactctggctgcagctgatctatctaggcaaattagcttccagccccagttcctgcaacaaaataacatccagttcaacacttcgttgctacctccccaaaaccagcagactgaacagttagcaaatgtaatagctacaccaaaccaattgggaagtgttatagtaccacaaaaggtagttccaaattgcagttctgaacagaaacagaatccggtaactcaaccactgcaagtcagccaaccaatgattagtatggcacagcctcaacttgtccatactcaactccagcagcctcaagtcattctccaggctcagcctcagcaacctcaagtcattgtccaagctcaactacagcaacagcaacctttggttcaaaatcacaccaccatac

SEQ ID NO: 13753 - DNA, 592 bp, Sorghum bicolor
  Predicted polypeptide sequence is orthologous to G450, G456
tcgtaagtagtgaccacatcagcaccgctgactggatcaaccaatttcccctcattcatgttgttccctgattccctatgccaacggggtgacttaccagatgtggtgaaggtgctgaacatcttcttcagagcaatagagaggtccttgtagctgttgtacatcttcaggtccaccttgcgcaggtagggcgcgccgtccatgctgaccttcacgaaggcggagctgttgccgctggcgttggcagcggccgactgctgcttctcaggttcctcttccttcttgctcttcacagactggacggtcatgacgttcctgcggtatgatcggactggtggccaacccacagcttgtgccctgatatgcaacacggagttctagttaactatcacttgattttgtgggtaacaattgctctagtcatagcttgaaatagatattctttactatgctaactggaagatccatcgagattccagccaagatcatgcatgtttaatttataattcttgtttgcaccagctcagctttctgctaataatgtgtataatgacaaatgtgatttggttaaggccaccatgaatcatgacca

SEQ ID NO: 13754 - DNA, 588 bp, Sorghum bicolor
  Predicted polypeptide sequence is orthologous to G450, G456
acccagcgacacccaccaccaccaccaccagcagctaccgacgacgaccgagcacagccaggcagcgcaggcgcaggctcaggcgcagcgcagctcgtcggattcaattcgttcttgagccaagttgcaaaccgcggccgttgcccacgagcgccggccgcaccggagaagctacctaaggagaagcaatggaggtcgccgcagcatcagcagcagcgagcttcggcttgaaggccgccgacgacgttgacaacctcagggccacggagctcaggctcggcctgccaggcacggaggaggagccccagcaggtccacaaggcggcggcggcggcggtggagctgccgctgctgccggccgcgacgacgccgccggcgccgtctacgcctaggggcaagaagcgcgacgtcgtcggaagcgggaacgaggacgcgcccaagaagcgcgacggcaacgccgacgccgcgccgcccgccgccaaggctcaggtggtgggatggccgccggagaggtcgtacaggaagagctgcttccagcagcagcaggcggcggccaagagcaagcccgcgccagcggcgccggcggacg

SEQ ID NO: 13755 - DNA, 620 bp, Sorghum bicolor
  Predicted polypeptide sequence is orthologous to G450, G456
tcagcggggcagagtacgtgcccacgtacgaggacaaggacggcgactggatgctcgtcggggacgtcccctggagaatgtttgtggaaacctgccagcgtctccgtctgatgaaaagctctgaggtggttaacttagcaccaagagctgctgaatgaagcatgtccaccgcttcaaagggaaaatggcctcttttgcttgctgaggcagtgaggctcttcatgcatcagagagaaacgtgtacagccatcgacttctactttctgttttggtttcagcatgcttttgatgagttgagaaaaggttgggagccgcctgtagcgccaccgggttcgtggtgtatatatatagttgtcatatagatgtgcaagatttttatgcttttgagtatatcacacatatattatttgtcatacggggaataaggccatcaggtacatggagctccccacctgttcttgcctgttgctttgctagctcgtcgtatcatgtcatgtgatgcgcaatgcaggtaaggcgtctggcatgggtaggtctcgtgcgcgtcgtgtaatggtttttgctccaagttttgtgtcttggacgctgtaaaaattgtatggtccgcttggcttttcagc

SEQ ID NO: 13756 - DNA, 888 bp, Sorghum bicolor
  Predicted polypeptide sequence is orthologous to G450, G456
aagcctcctcctttacatttgcaagccagccggcctcctcgtcctggctcgcaagcaaagcaaagcaaacgaagcagaagcagggaagaagaagaaggcgagagccgagaggtgaggagctaggccagtggcgcctgcagcagcaatggcgacgacggacctggggttcgaggagacggagctccgtctgggcctgcccggcggcgggggagaggtggtcggcgaagggaggagctctgtcgtctcctccgggaagaggggcttcgcagagaccatcgacctcaagctgaagctggagccggcgactcccgcggccgtattgaaggcggcggaggcggacgagcatcaggacggtgttgccgccgccaaggaagacgccggctgcgtggccgccgcggaggaggccgccgtcggcgggaagatgaagaggtccccgagccagagcagcgtcgtcaccgccgccgccgtgcaggctgaccccgccgagaaaccgcgcgcccccaaggctcaggtggtgggatggccaccggtccggtcgttccggaagaacatcatgtccgtgcagtccgacaagggcgccggcggcagcaaagacgccgacaagtcctcgccggcggcggcagctggcggtggtgcggcgttcgtgaaggtgagcttggacggcgcgccgtacctgcgcaaggtggacctcaagatgtacaagagctaccaggagctgtccaaggcgctcgagaagatgttcagctccttcaccattggaagctgtaggtctcaagggatgaacggcatgaacgagagcaagctggtggatctgctcaacggctccgagtacgtgccgacctacgaggacaaggacggcgactggatgctcgtcggcgacgtgccgtg

SEQ ID NO: 13757 - DNA, 813 bp, Sorghum bicolor
  Predicted polypeptide sequence is orthologous to G450, G456
cttcctccccaccggcggtccggcctccctcgctcgcccgcacgaagaagaggaagccgccgagcgcggagcccagcacgccgccgccggccatgtcggtggagacggagcggagctccaccgagtcctccgcggcctccgggctcgacttcgaggacaccgcgctcacgctcaccctccgcctcccgggctccgcccccgcccccgctgccgtcgcggcctcctcgtcctcgtcctcgtcctccgccttccccgacgccgaccgcaagcgcgcctcctccgacgccaaccccgaccgctcctccccgctcgccgcttcctccgacgctgcaccggcacccaaggcgcgggtggtggggtggccgccggtgaggtcgtaccgcaagaacgcgctcgccgacgtcgcgggatccagcaaggcaaaccaggccgccaagttcgtcaaggtggccgtcgacggcgcgccctacctgcggaaagtggacctccaggcgtacgccggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgtttgtggaaacctgccagcgccttcgtctgatgaaaggttcagaggccgttaacttagcaccaagagccgcccgatgaggcgcactccacctgttggtacgcactggcttcttgaaggaaagaggaaactttgctg

SEQ ID NO: 13758 - DNA, 760 bp, Sorghum bicolor
  Predicted polypeptide sequence is orthologous to G450, G456
cccttcctcacaaacgcgcagcagaggggccgagacccaagaagaagaagaagaaagcagaagcagcgacagcgagcaagcagaagcttagctagcgtggaggtgcccaaggcgagagggacaacgacggccgcgacaggctagctagcaaccagctgctagctcctgcggagccgaagccgatggctggcgccgacgtcgacgtcgggacggagctccggctcggcctgccgggaggaggcgccgaggcggccaaggccgcgaagaggggcttcgaggacaccatcgacctcaagctgaagctgcccaccgccggcatggaggaagctgccgccgccaagccggagccggcagccgagaaggccaagaggcccgccgaggcgccggcagctgatgccgagaagccacctgcacccaaggcacaagctgtgggttggccaccagtccgatcataccgcaggaacgtcatgaccgtccagtctgtgaagagcaagaaggaagaggaacctgagaagcagcagtcggccgctgccaacgccagcggcaacagctccgccttcgtgaaggtcagcatggacggcgcgccctacctgcgcaaggtggacctgaagatgtacaacagctacaaggacctctctattgctctgaagaagatgttcagcaccttcaccacatctgggaacaacgtgaatgaggggaaattggttgatccagtcagcggtgctgatgtggtcactacttacgaagacaaggacggcga

SEQ ID NO: 13759 - DNA, 552 bp, Sorghum bicolor
  Predicted polypeptide sequence is orthologous to G451
gcccttcgacatgttcatcagcacctgcaagaggctgaggatcatgaagggatctgaagccagaggactcggatcagtcaagaacaactgaggattgtcgcagatcgagatgcacggcttgtgcattcgtgagcagattcttttgttcttttggggtttcttgtgttgtccaaagcgtgtttgtctgccaacaatggagcagcaaaccaaaagcatggagaacgactgacgagaagatgaagctgcttgggttgaaggagagacagagctttgtgcatccaagtgcatgcgtggaagaatgatgtgtggtcactttgtttgttttgttttttcttttgtggtactacttgtaggtgttattagcaacacaaaaaggagtggagagtcgagttgaatctccatgtgtgtttgtacaaagccaaagatcactcttctttcttgtcttacttaagttatatctacccatcaatcaatcagtacttgattgcttctgtaagtgcaagtgctgcaagctaaggggggaaattgggcctttaattccccccctgtgag

SEQ ID NO: 13760 - DNA, 670 bp, Sorghum bicolor
  Predicted polypeptide sequence is orthologous to G451
gcggcggcggccaagaaggctgaccagcagcagcagcagcagggaggagggctgtatgtgaaggtgagcatggacggggcgccgtacctcaggaaggtggacctcagaatgtacaaggggtacagggagctcagggaggcgctggacgccctcttcaccaagtccttctcggccgccgcggcggagggcggcgaccaccagcacgccatcgcgtacgaggacaaggacggcgatctcatgctcgtcggagacgtgccctgggatatgttcatctcctcatgcaagaagctcaggataatgaagggctctgaggccaggtgatcgttgatgcataaacagaggctatggacacatcacgacatgggaaacggatcgaagagcacagatcgtgcctgaggaaggagctgtgtcgtggcttgagctctccagtgttgtacaaagagatgtttgtttctgaatccaagagggagaaaggtctctgaaggcgtgtatataaatcttagctagctgttttgtttcaagtcatgttttgtatgagcgaaggctgtaaaaaaaatgcaaaatgaaatgagaaatttgactaaagctggtcattttcctctccacatccttcgaaaaaaaattctcttcacaggttctcctctctgtatgagataaattacttcctgtc

SEQ ID NO: 13761 - DNA, 562 bp, Sorghum bicolor
  Predicted polypeptide sequence is orthologous to G464
acccttgcctcagcacttgagctcatgttcatgaagccgtccatcagtctttgcacttctagtagttctaagtctctaaagctattggacaactcatcggagtatcagctcacctatgaggacagggatggggactggatgctagttggagatgtaccctgggagatgtttgtaggttcagtgaagaggctcaagatcatgaggacctcagatgccaacggtctcggtccgcgattccaagggcctcacaaacctacagcagcttgcacaagaggcaggatatgaaaaccaccgatgggcgttaatttggtgctagagagctataccgctggtgaagcttgaactgtgtttgataccacgtaacagcagcccatatctttggcatagttgtgagattacttgtgtctagtggaaatagtagaagttttttttccttcttcttcttcttcttcttcttcttccctttggtgcactcgttgagctttttctcatgggctatgactaggagcatagccccctctcttctgtccacactgtttttacctgtgaggcattgtcgccc

SEQ ID NO: 13762 - DNA, 656 bp, Sorghum bicolor
  Predicted polypeptide sequence is orthologous to G470
gcacgaggcatcgaccaaccaggtggctgagcagcacatgcaactttacaatctcccatggaagatcctgtgtgaggtcatgaatgttgaattgaaggctgagccggacaatgatgaggtttatgcccagctcactctgctacctgaatcgaagcagccagaggagaatggctctagtcaggaggagatgcctgctgcacctcctgctgcacttgcaaggccacgtgtgcactccttctgcaagacattgacagcctctgacaccagcacacatggtggtttctcggtgctgcgtcgccatgcagatgaatgccttccaccgctggatatgagtcgtcaacctccaacacaagagcttgtggccaaggatctgcatggtgtggaatggcgctttcgtcacatattcagaggtcaaccccgaaggcatcttttgcagagtggctggagtgtttttgttagtgcaaagcgtcttgttgctggggatgccttcatctttctgagaggtgataatggggagctgcgtgtgggagtcaggcgtgccatgaggcagcaagcaaatgttccgtcttcagtaatatcaagccacagcatgcatcttggtggtcttgctactgcatggcatgctgttaacactgggaccatgttcactgtctact

SEQ ID NO: 13763 - DNA, 525 bp, Sorghum bicolor
  Predicted polypeptide sequence is orthologous to G470
atctcctcccgtctcccctcctctcctctccttcctccgcccacaaaaacatttgggttctcccccttccgactgctactgccgctgcctcctccccctttccgcctgccttcgctctcccccctttccgcgccccccccacttctcctccgtctagggtttcccccgcccgccgccgccgccgttgcccgatccgaggcagatgccgcccgcagcagccatggcgctgccgtcccaggccccgtctaactcaggggatccgctgtacccggagctctggcgcgcctgcgccggcccgctcgtcaccgtccctcgcgtcggcgacctcgtcttctactttccccagggacacatcgagcaggtggaggcgtccatgaaccaggtcgccgggaaccagatgcgcctctacgatctgccctccaagctgctctgccgcgtgctcaacgtcgagcttaaggcggagacggacaccgacgaggtctacgcgcagatcatgctcatgccagagcccgagcaaaccgatgt

SEQ ID NO: 13764 - DNA, 722 bp, Sorghum bicolor
  Predicted polypeptide sequence is orthologous to G470
aaggagccgcacaaaggttcataagcaaggggttgcgcttggcagatctgtggacctctcaaaattcactgactacgatgaactcaaagcagaattagacaagatgtttgaattcaatggcgaattagtatctgccaacagaagctggcagatcgtttatactgacaatgaggaggtccagaagatgaactcaaaatcatctgcgccaaggaaggaggagcctctaacagtgggtgaaggatgcgccgccacaaatgagtaggatttgcctgcctgcagcaagcaattttagataactaggttgtgtgaaggaagccgacgatgcatgatgaactcatcgtgccaggtgcctgggtcccaaccaagtaactcctgaaatcttttgcttgtccgtagcgaggttttagttgtgaacgtagtagaactgtctccatttgcttctccgcagtttgctcttggcagcaagtttaagggccaagtcttattactattgttattgctgatttgctcttctgccttctgatgtaaatatttatgtactcagtcccagcctgtagtaagtagtaagtagcaagcagtggcagtacctttggtattaaccagcagctattcgcggccttttaatcccctgtaagtgtagctctgtagcgcgagataaatggcaaacactggtatatgtatgtctgatcttcccactgaatgtattataagagttatagagg

SEQ ID NO: 13765 - DNA, 701 bp, Sorghum bicolor
  Predicted polypeptide sequence is orthologous to G470
acaaagttcacttgctacgatgagctgattgctgaactggatcagatgtttgactttgatggtgagctgaagaatccatgcaaaaattggctggttgtctacactgacaatgaaggcgatataatgctggttggcgatgacccctggaatgaattctgcgacatggtccacaagatcttcatctacacaagggaggaagtggaaaggatgaacccaggtgccctaaactcaaggtccgaggatagtctgtctgactcgcagggaagagggttggcttccaaagagccgccccgaggtggcccgtctacttcgactcccaattccgagagctgctaatttttccagtcagtgaggtcttttgaagtggtggatgaagcagacaaaagcatcagagtgaccggaagaatgagaaaagggacgagtcttgtagtggtgtagtaggtactttgtgtgtatgcctccgggtaagccccgcggtactcagtttgtagatggtgcttgtcctggtggtgccagtttcccgttgtaagctaagtttttgggtgtgccctgttctaggggtaagttattgtagcagagcaggacagaccgagagagcaggcaagaaaccgctggtgcgcctgcttggccctcttttcccttccgaagcccgtgtaaatagccttggccctgaatcgtagtaatgtattgtcgacagccgt

SEQ ID NO: 13766 - DNA, 830 bp, Sorghum bicolor
  Predicted polypeptide sequence is orthologous to G470
ggatgcatatgaacagacctgaaggatacaatgaaatgttatctggatatcaacaacctaataaagatgtacagaatccacagggtttctgttctttacctgatcagattgctgccggtcgtcctaatttctggcacaccgtaaatgctcattatcaagaccagcaaggcaatcacaatctattccctggttcatggtccatgatgccttcaagtactggctttgggttgaacagacagagctatccaatgatgcaggaagttggtgggttgtctcagagtgctacgaacaccaagtttgggaatggagcttatgctgcactacctggtcatggcattgatcaatactcttctggatggtttgggcacatgatacctggtgctcgcatggacgatgtccagccacgcgtgattaagcctcaacctttggtccttgctcatggtgaagctcacaaaatgaaaggcaattcatgcaagctttttggaattcaccttgatagcccagccaaatctgaacctttgaaatctccaccaagtgttgcctatgatgggacgccacaaactccaacagcagctgaatggcggatggttgattcaattgaagcagacagatgttctgatccacttaagatgccaaagcaactcgatgctacacaggtagatcctgttccagagaaatgttcacaagtttcaagaggcacacagtgcaaatcacaaggtggatcaactaggagctgcaagaaggtccacaagcaaggaatcgcacttggcaggtctgtggatcttacaaagttcaatggctacacggaattgattgctgagctggatgag

SEQ ID NO: 13767 - DNA, 844 bp, Sorghum bicolor
  Predicted polypeptide sequence is orthologous to G484, G2631
aaaaaaaaataaccccaccttcttccaccctcgtattgtccccggctcaccgcgcgccctaaccctagctcctcgattccactctgccccgagccgaattctcgcccgaattcgctcgcggggggcactcgctacctcgcccgccttccgtcgcgcggattcggtgccgcgcctggagatggacccgatggacatcgtgggcaagtccaaggaggacgtctccctccccaaatcaacaatgtttaagataattaaggagatgcttcctcctgatgtacgagtggcaagagatgcacaggatcttcttgttgaatgctgcgtagagttcatcaatctcctttcatctgaatccaatgaagtgtgcagcagagaagagaagaaaacgattgctcctgagcatgttcttaaggctctaagtgatcttggcttcagagagtacattgaggaggtttatgctgcgtatgaacagcacaaacttgatactctggattctccaaaagccagcaagttcactgggattgagatgacagaggaagaagctgttgctgagcaacaaaggatgtttgctgaggctcgagcaaggatgaataatggagcccccaagccaaaggagccagaacaagatccgccacagcaaccacaagcacaaccccaacttcagctgcatactcaaacacagcaacccatgcaatctcaactgcagttgcattcgctaacacagcattccctccaacctcaactgcagctgcagcctcagtcacagccacaacagctgccacaagtgcagctgcaccctcagccgcagcagcaaacccaagtgcagatgcaccctcatccgccgcag

SEQ ID NO: 13768 - DNA, 695 bp, Sorghum bicolor
  Predicted polypeptide sequence is orthologous to G502, G519
attccaaagctctccagctagtcgtctcctccaaccagcagagaggccgcgcgcgaacgaagcgaaggccccagcacagcaatcagctgagctctcctcgtcctcgccctgctcgtctcgaacctcgaagctctccaatccgccggtcgatcgccggaggttgctaaggtcgtgccggatcgatcgatcgacgacgaccgagatcgatcgaatggactgcggtggcgcgctgcagctcccgcccgggttccggttccaccccaccgacgacgagctggtgatgtactacctcctccgcaagtgcggcggcctgcccctcgccgcgccggtcatcgccgaggtcgacctctacaagttcgatccatggcagctcccagagaaggcgtatggtggggagaaggagtggtacttcttctcgccgagggaccgcaagtacccgaacgggtcgaggccgaacagggcggccaggacggggtactggaaggccaccggcgccgacaagcccgtcgggtcgccgcgccccgtcgccatcaagaaggccctcgtcttctacgccggcaagccgcccaagggcgtcaagaccaactggatcatgcacgagtaccgtctcgccgacgtcgaccgttccgccgccgcacgcaagaagaccaacaacgccctcaggctggatgactgggtgctgtgccggatctaca

SEQ ID NO: 13769 - DNA, 803 bp, Sorghum bicolor
  Predicted polypeptide sequence is orthologous to G502, G519
cctcctcccctcttcctccattagcagcagcagcgtcgaccagcagagcacaagccggcagcgattgagcgagggaggaacacgatgagcggcggcggtcaggatctgcagctgccgccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtcgaggccgaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcgcgagtaccgcctcgccgacgtcgaccgctccgcccgcaagaagaacagcctcaggttggatgactgggtcctgtgccgcatctacaacaagaagggcgggctggagaagccgtcggcggtcgccggcggcgaccacaagccgatgttcgcagcggccgcggtgagctccccaccggagcagaagccgttcgtggcggcgccgggcgggcttcccccattcccggacctggcggcgtactacgaccggccgtcggactcgatgccgcggctgcacgcggactccagctgctcggagcaggtgctgtcgccggagcagctggcgtgcgaccg

SEQ ID NO: 13770 - DNA, 792 bp, Sorghum bicolor
  Predicted polypeptide sequence is orthologous to G502, G519
gccacccaccatcgacagcacccagccgccggagcgcgagcttctttacacagcaggccggagaaacacaggcagccaaagccgccaccgcttttaccgaccgaccgatcggtgttgccgccgcctgtcgggtttaagcaaccaaccagaccaagccatgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcaccctcgggatcaagaaggcgctcgtcttctacgccgggaaggcgccgcgtggggtcaagacggactggatcatgcacgagtacaggctcgcggacgccggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggacatgaccacctcgcactcgcactcccactcgcagtcgcactcgcactc

SEQ ID NO: 13771 - DNA, 815 bp, Sorghum bicolor
  Predicted polypeptide sequence is orthologous to G502, G519
tggagcacaggggcaggacggtcggcatcaagaaggcgctcgtgttctaccacggcaagccgccccgtggggtcaagaccgagtggatcatgcacgagtaccgcctcgctgacgccggcggcgcccgcgccaagaagtccggcaacggcacgctcaggttggatgactgggtgctgtgccggctgtacaacaagaagaacgagtgggagaagatgcagcagcagaaggagaagaaggagatggaatcggaggcgtcgctctcgcactccgacacgcggacgccggagtcggagatcgacgacgacccgttcccggagctggcctcgctgccggcgctggacgacatggtgggtctagccccggccgccggcgccatcctgcccaaggaggaggtggaggacttcggcgaccttggcggcgacgactggctcgcggggatcaacctcgacgacctgcagatgcccggggacgccgacttctttggcaacatgctgtcgccgatggccgccaagatggagcaggacgccggcttccccttcttctgagatcctctgcgactccgaggacggattcagctcaaccgtgtatagttcagatttcttcaggattcagagaaaacaaacaaaaaacaaattctgctaatatctggttgtagtggtgtagtgcagaagtagcagtatgctggtcagttattaagattgaagttcattgtagtactctactgatgctcatcacttgagctgtgataagtgacaacattctttcgtttgtgctctgcaaattcttcaatgctcagaatatattgattcagatgg

SEQ ID NO: 13772 - DNA, 757 bp, Sorghum bicolor
  Predicted polypeptide sequence is orthologous to G502, G519
ctcgcgaaggggtcgaatcggcggctgatttgacttcgctcgctcttcgagcaaagtgaaagtgatccgagcagtcacaggttcggaagcggcgggtcggccggagccggaggagaaacgtaaccaagtcgaggagatatgagcggcggcggcggcggaggccgagcgccggcggcgcagccgcaggagctgcagctgccgccggggttccggttccacccgaccgacgaggagctggtgatgcactacctctgccggcgctgcgccgggcttcccatctccgtgcccatcatcgccgagatcgatctctacaagttcgacccctggcagctcccaaggatggcgctgtacggcgagaaggagtggtacttcttctcgccgcgggaccgcaagtacccgaacgggtcgcggccgaaccgcgccgccggcgccgggtactggaaggccaccggtgcagacaagccggtgggcacgccgaagccgttggccatcaagaaggcgctcgtcttctacgccggcaaggcgcccaagggcgacaagaccaactggatcatgcatgagtaccgcctcgccgacgtcgaccgcaccgcccgcaacaagaacaacagcctcaggttggatgattgggtactgtgccgaatctacaacaagaaaggcgtgccggagaggccggccggagccggcggggccgaggcgagcagccagcaaggcgcgcacgggtcgatgggctcgccgccggagcagaagccgtccgtgc

SEQ ID NO: 13773 - DNA, 680 bp, Sorghum bicolor
  Predicted polypeptide sequence is orthologous to G504, G1425
tgttggccttctggaagatcatgcctctctctctctctcccttgtaacctatatctttcgtccttgagctagcctctcatagtctcatctacttactacagtagtctcagtagtcagtaggtagctagtagctagaaggtaggtagatcgagcagtataatccaagaggcagcagcgacatctcgccggcggtggcggccatggcgagtggtggcggcagtagcagtagagtgcccggcggcggcggcaacctgaacctcccagctgggttccggttccaccccactgacgaggagctgatcgtgcactacctcatgaaccaggccgcctccattccgtgccctgtccccatcatcgccgaggtcaacatctaccagtgcaacccctgggatctccctgcaaaagcattgtttggcgagaacgagtggtacttcttcagcccacgggaccgcaagtaccccaacggcgtccgccccaaccgcgccgccgggtcagggtactggaaggccaccggcaccgacaaggccatcctgtccacgccgacgagccagaacatcggcgtcaagaaggccctcgtcttctacggcggcaggcctcccaagggcgtcaagaccgactggatcatgcacgagtaccgcctcaccggcggcacgaccgccgcagcggccgatgacaagaac

SEQ ID NO: 13774 - DNA, 843 bp, Sorghum bicolor
  Predicted polypeptide sequence is orthologous to G504, G1425
cttgctagtctctatctccttccttccttaagagttcgagattttctctctttctctctctagctctctgacagtcgtctctccctctgagctctccagtgatctcttatcagtcggccattcccagtcagccattgataattggttttccatggcggcggcggccatgcctagccccagccctagccgcagcagcagtagctgctgcagagtggccgccgtttccaaacctaaacctcccagcggggttccgtttccaccccactgacgaggagctcatcgtccactacctcatgaaccaggccgcctccatcccttgccctgtccccatcatcgccgaggtcaacatctaccagtgcaacccctgggatctccccgccaaggcgctgttcggcgagagcgagtggtacttcttcagcccacgggacagaaaataccccaacggcgcgcgccccaaccgcgccgccgggtcggggtactggaaggccaccggcaccgacaaggccatcatgtccacgcccaccggccagaacatcggcgtcaagaaggcgctcgtcttctacggcggccggccgcccaggggcgtcaagaccgactggatcatgcacgagtaccgcctcgtcaccgccgacgccgacggcaagacaacggcggccaagcgcagaggaggatctatgaggctggacgactgggtgctgtgcaggatccacaagaagagcaacgacttccagttccagttgttgtcggagcaggagcaggatggctcttccaccgtagagcaggaatccccaaagtcagaatcacttgagcaggagcagttccagttccagttgcatcagacaa

SEQ ID NO: 13775 - DNA, 706 bp, Sorghum bicolor
  Predicted polypeptide sequence is orthologous to G504, G1425
aattccttccccgtttctcctagctactccctcctccgatcgatccagggtgcgagagcagagctctggttattagtttagtttagtctccctcaagctcgtggcgcagcagcggattcgaattcgttgagaggaggtggattagcagccgaggcctgcagctagctatctagggttttgtagtgagagttcctcgcagtcgcaggcttcgcttggtagcgtcgtcggccggccgggagccaataatgatcatggcgaacccggacatgctgccgccggggttccggttccacccgacggacgaggagctcatcctccactacctccgcaaccgcgccgccaacgtgccgtgcccggtcgccatcatcgccgacgtcgacatctacaagttcgacccatgggaccttccatccagggcagcgtacggggacaaggagtggtacttcttcagcccgcgcgaccgcaagtacccaaacgggatccggccgaaccgcgccgcaggatccggctactggaaggccaccggcactgacaagcccatccagagcagcgccaccggcgagagcgtcggcgtcaagaaggcgctcgtcttctacaggggccgcccgcccaagggcaccaagaccaactggatcatgcacgagtaccgcctcgccgccgacgcgcacgccgcacacacctaccgccccatgcagttccgcaacgc

SEQ ID NO: 13776 - DNA, 781 bp, Sorghum bicolor
  Predicted polypeptide sequence is orthologous to G505
ctccactctctcccggaaaaatccatccgtccataaaacccaaaaagtctcatcaggtttagttgcaaagcagcgatcaaaagcaggcctagacgacggcgatcctcagctcagtagccaggcaggagatggagcacgacgtgcaccaccaccaccatcagcagccggaggaggccatggagctgccgccggggttccgattccaccccaccgacgaggagctcatcacgcactacctcgccaggaaggccgccgacccccgcttcgccccgcgcgccgtcggcgtggccgacctcaacaagtgcgagccatgggacctgccaccggcaccacacgtgacctgcttctccaacacgctggagggccacttcctgaccccaccaacctgcctcctcccctccgccgccgccaccgcctcgccgttcctggcgagcatggcgcagtacgacggcgacgcgggcgtgggcggcatggtgcacgagctcctgcaggaggccggcgggtggtacagcaagctgggcgagagggagcggctgagcggcggcgcgtcgcaggacaccggcgtcacctcggaggtgaaccccgccgagatctcctcgacgcggcaccacatggatcacgaggcctccttttggggcttctgatgaactcccccgtcttttccgttatcgttaaaaaattggattagaattagtcactggattggaaatggagattgtattgtgctattgaatgaatactgttatgtgcaaatggggcaaaaaaaaaagttgtgaacaaa

SEQ ID NO: 13777 - DNA, 672 bp, Sorghum bicolor
  Predicted polypeptide sequence is orthologous to G509
ccgcacacgccaccaaaggaggactgggtgctgtgcagggtgttccagaagcggaaagacagcgagcaagacaacggcggcggctcctcgtcgccgacgacctttgccggcgcatcgcagtcgcagggggtcctgccggagccggaccagcccaccagcatgatggacgcgtcgtacgtagtcgaccagccgggctctaccgccggaatattcgctgcaccgccgcatcatcatcaggagaacctgatgagcctcggtattggtggcctggacgcgttgctgatgaacggagcgatgtggcagtacacctcgtcgtcggttttcgatcacttcccgcagcaggaagtgaccagctcgccgacgatgatggggctaggcagctccaggggaggaggaggagacggcggctgcagcagcagcttcttctacgacagcggcttcgaggacatggccaacattgggggcatggggttcccacagggatggactggctgagaggactgatcgaggaggcacgtaccaattgcaatgcgtacgtacgtgcaggtgcagccatgggagatggactgggcattgtgaaggaaatgattgaattgattccattagtactagtaccctctagtattattgtacagtaggtacttagcgtgaggttagattactagaaatttt

SEQ ID NO: 13778 - DNA, 617 bp, Sorghum bicolor
  Predicted polypeptide sequence is orthologous to G509
ccacacaaactcatccggctacagcaagcaacatcaaccatatagcagtagtagtagatgtgtgcagtgcagccaattccttcttactcctcgatctcatctgtcccctctctctctcatcactccccccttcttctcttcttcagatcaacgtgctgcagcctgcatatataggttcatttgtctcatccatatagttcgtcgtcgttcttcgagctccaatatatacagattgctgtccagatatacaaacttaagttaggaggagaaggaattgaagatactatatatatatatatatatatatataacaggaaataaggtgtagtagtagctggagcaggagctagccatggggctgagggacatcgagctgacgctgccgccggggttccggttctaccccagcgacgaggagctggtgtgccactacctgcacggaaaggtggccaacgagcggctcgccggcgccggtgcagccatggtggaggtggatctgcacacccacgagccgtgggaactccctgacgttgcgaagctgagcacgaacgagtggtacttcttcagcttccgcgaccgcaagtacgcgacggggctgcgcaccaaccgcgccacca

SEQ ID NO: 13779 - DNA, 796 bp, Sorghum bicolor
  Predicted polypeptide sequence is orthologous to G526
gcttctcctaaacccaaccattcccgattcacaccagagagagaagctgacaagggaaggaaggagagaggtccagcgagctcaccgctccggcctccggcagactagcagtaatcgctagtgacaagttcgttgttggcggagctagccatggcgtcggaggtgtcgtcggagatcaaccagaaccagggcggcgaggaggagacgcggctggaccccccgccgggcttccgtttccaccccgccgacgaggaggtagtgtcgcactacctcacccacaaggcgctcaacagcagcttctcctgcctcgtcatcgccgacgtcgacctcaacaagatcgagccgtgggatctaccgagcaaggcgaagatgggcgagaaggagtggtacttcttctgccacaaggaccgcaagtacccgacggggatgcgtaccaaccgcgccaccgccagcgggtactggaaggcgacgggcaaggacaaggagatcttccgcggccaccgcgtgctcgtcggcatgaagaagacgctcgtcttctacacgggccgcgcgccgcacggcggcaagacgccatgggtgatgcatgagtaccgcctcgagggaagcctgccgtccaacctccgccgcggtgccaaggacgaatgggctgtctgcaaggtgttcaacaaagacttggcggccaaggctgggcaaatggcaccggcgcacgccgtcgggggtggcatggtgcgcagcgactcgctggccttcctcggcgacctggtgttcgacaacgccgacctgcccccgctcatcg

SEQ ID NO: 13780 - DNA, 795 bp, Sorghum bicolor
  Predicted polypeptide sequence is orthologous to G526
gccccttgccttctttctcacccacctctctctctttcacacacgcctctccatctctcttcctgcctgaggcagccatttccgcttccgatcgtggagggaggcttggagtggaaggaggaaaaggaggcagctgctggttttcggtgcggcggagatgtctgaggtgtcggtgataaaccaggcggaggtggaggatgcgggtgccgccgggcagctggacctgccgccgggcttccgcttccaccccaccgacgaggagatcatctcgcactacctcacccacaaggccctcaaccaccgcttcatctccggcgtcatcggcgaggtcgacctcaacaagtgcgagccatgggacctcccaggcagggccaagatgggggagaaggagtggtacttcttctgccacaaggatcgcaagtacccgacgggcacgcggaccaaccgcgccaccgagaccggctactggaaggccaccggcaaggacaaggagatcttcaagggccgcggcatcctcgtgggcatgaagaagacgctcgtcttctaccgcggccgcgcgccgcggggagagaagaccggctgggtcatgcacgagtttcgccttgagggcaagctcccgcagccgctcccgcgctccgccaaggacgagtgggccgtgtgcaaggtgttcaacaaggagctggcggcgaggaccgagccaatggcggcggctgtggccggcgccgagctcgagcgcgtcggttcgctgggcttcctcaacgagctcctcgactccgcggagctgccggccctcat

SEQ ID NO: 13781 - DNA, 866 bp, Sorghum bicolor
  Predicted polypeptide sequence is orthologous to G536
cgccggagctcgacgaggacgacagcacgcagagatccggcctactgcaagttttgaaaaccgaactgtaagatggcatcagcagagctttcccgtgtgaaaatgtgtacatggccaagctcgcggagcaggcagagaggtacgaggagatggttgagttcatggagaaggtagccaagactgttgactctgaggagctcactgtggaggagcgcaacctcctgtctgttgcatacaagaatgtcattggagcccgccgcgcctcatggcgcatcatctcctccattgagcagaaggaggagggccgtggcaatgaggaccgtgtaacactcatcaaggactaccgtggcaagattgagactgagctcaccaagatctgcgatggcatcctcaagctgctcgagtcccaccttgtgccctcttcaactgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcacttaacttctcagtgttctactatgagattctcaactcacctgatcgcgcctgcagtcttgcaaagcaggcttttgacgaggccatctcggaactggacaccctgagcgaggagtcctacaaggacagcactttgatcatgcagctcctccgtgataacttgaccctatggacttctgacatctcggaggaccctgctgaagagatcagggaggcacccaagcgtgactcgagcgaggggcagtaaagccggctt

SEQ ID NO: 13782 - DNA, 783 bp, Sorghum bicolor
  Predicted polypeptide sequence is orthologous to G536
gctgaatttagcagtggaactgaaaagaaagctgcctctgaccagtcacttatggcctatcagcatgccatggttgtcgcctccagtgagctctcacctgcccaccagatccggcttggtcttgctctcaatttgtcggtcttcttttatgagataatgaactctcatgagagagcttgccaagtggcaaaacaagcattcaatgaggctcttactgagataaattctggtgaaggggtttacaaggatagcacacttatgatgcagcttctgaaggacaacttagcattgtggacatcagaactaaccggaggtgaagcatccaaggataatgatgtcgacatggagggttgattgatatgagctcaaggaacacagaacacacgcaaagtatccaatttgcgctgctagcgaacccgggtcctcaagtttttctgcatcggaattcggaagatccccacttatttttctgaagttttctgttcctctgtttcggccatcgtttggccctagagtcagtgtccctactaagtgtttctcagaggtctggactggtgaccatccaacaagctttggtcatattttgtgagcttgtgctggtgaccccccagctctgatgttatgttgcttctttttttttcggtgcttcagaggcatctttgtacaccgatgacaaaatgtatctcttatcaatacattaaaagactgtcgctgtcgttattaatctagctatcctgttccaggtgatgctatatcggcaatttacattgatgagagtgagtt

SEQ ID NO: 13783 - DNA, 834 bp, Sorghum bicolor
  Predicted polypeptide sequence is orthologous to G536
caacgcggcgtttccgcacgctcccaggggatcctctgcgccaccgcaaccgtgtaaccccggccgtgccgccgccggcgatcccgatccgccgacccgacccgtcccgtccccccgctcgcagccatgtcgccgtcggagccgacgcgggaggagagcgtgtacatggccaagctggcggagcaggcggagcggtacgaggagatggtcgagttcatggagcgcgtggcgcgctccgcgggcggcgcggggggcggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgaggccgagctcgcccgcatctgcgacggcatcctcgcgctgctcgactcccacctcgtcccgtccgccggcgccgccgagtccaaggtcttctacctcaagatgaagggcgactaccacaggtaccttgctgagttcaagtcaggtgcggagaggaaggatgctgcggagagcaccatgaatgcttacaaagctgctcaggatattgctcttgctgatttggcaccaacccaccccatcaggcttgggctggcactcaacttctcagtgttctactatgagattctgaactcccctgatcgcgcttgcaaccttgcaaagcaggcttttgatgaggcaatctctgagctagacagcctgggagaggagtcctacaaggacagcactctgatcatgcagctcctgcgtgac

SEQ ID NO: 13784 - DNA, 814 bp, Sorghum bicolor
  Predicted polypeptide sequence is orthologous to G536
cacccatcgtctccgctccgcgccactcgcatcgagatcgagactacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaatgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacagataccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacc

SEQ ID NO: 13785 - DNA, 614 bp, Sorghum bicolor
  Predicted polypeptide sequence is orthologous to G550
gacccttagcactgcttcaccagcatccacgaagtccaattgcttcacaccaggaaagcgccctagagactgcaacgaggaaggagataccaaaggaaatggcaaggtgtgggtgccaaagacgatccgaatcgatgacgtggatgaggtggctaggagttctatcttgtcgctaatcgggatcaatggcgacaaggcaggcaaagatggcaaagggtgcaagcttgcaagggtttttgagcagaaagaagaggcaaggacggcaactcactcagtcatcaatggcttgccattcttgcaggggaacccagctgcgctctcacggtcattgaccttccaggagggatcttgagcatcatatgaacctcaattctgtgaagacaagccgtttagcgcggcacagctgaaattttgtacattagaggattgtaatctaggtgtgggcaatggaggggtgtataacatagctcatagctgcaagcggaccttgaaactatacaatagatatttgtagatagcaatatatatgggtcggggtcggggaaggataaggagagcaagtttccttatttgtggataataaataatattataaagattggaatatttggtgc

SEQ ID NO: 13786 - DNA, 704 bp, Sorghum bicolor
  Predicted polypeptide sequence is orthologous to G550
gagcaccgtgccattcgtcttggctgcagtgcagaggggatccatgggcaaagcggccctgaccctctgaaggaagtgggaagcagctgacgcgctcttgctcttgcgccggcctgcacccacagggacgttgcgcatggcaccgccagcagtccagtacctctggcagttcttgcagaagtggcgtggctggttgatgttgtagttgttatagtagcagaacttggtgtccatgctgttgcaccgggggcaaggcaggatcttgtcaggcttcttgagcttctccttctggttggccgcctcgccctgcttttgtctgccgaggagttcttggcagccgacgagtcttcagtgtccgcaacctcctgctgcggaggcgagcctgtggaatcctgaagggtgttctcttgccccttcagatcagtcgtgccgctgctgccgctttgttggatgtcctgcaatcatgcagataagcttgttgagttcttgacctactgaagttcttgcaagagcgttcaagtttgcgggtagaaaaaatagaattcacaggaacggttggatcagtgaattttaatgttaattattttctttctaactccttgatagctaccacaacagctgttgatggtgtgattttaacactaaagcatggtgatgtaattgatcccgtatcattcgtcgcgtgatgttctgaattagagctc

SEQ ID NO: 13787 - DNA, 809 bp, Sorghum bicolor
  Predicted polypeptide sequence is orthologous to G550
gtgtgcccagctccagccgaagcagcaaattcttcagaaaattgcaccacaagcagtaatgttcaatggaatgtgccaccaattgtccctgtactgccaccgggattctgcggtccgattccagttcctgtaatgccgccttcggtttggccattcattactccttggcctaacggagcatggaacgcaccatggcttggacctagctctactgtgccatcatcgtctccaacaagcagcagcacatgttccgaaagcggctctcctgtcctaggaaagcactctagggactccaaacctcaaggagatgagaaggcagaaagatgcttatggatccccaaaacgcttcggattgatgaccctgtcgaagctgcaaagagctcaatctggaccactcttgggatcgagcctggtgatcgaggcatgttcagaccattccagtcgaaacctgaaaggcaggaacagatatccggcgccgctcgagccctgcaagcaaatccagcagctctgtcacgctcgcgatcttttcaggagacaacatgatagagtattactgaacttgtgtgatattattcaaagacgatgctatattaagaaaaaagaaaagctctatattctgtacaatgattggcaacgtaggtgctgctgctgtccaaggcagcaggcacccttactgtaccattggaagagtacatcctcaaattttctgttgtttccttgtagagcatgcaccaacatattgggttcatgatcaggtttccagcgtgtgcttggttgtacaagaataatgttaatagcttccctgagtc

SEQ ID NO: 13788 - DNA, 573 bp, Sorghum bicolor
  Predicted polypeptide sequence is orthologous to G557
gccgcaccgcgggggacaaggagcagaaccggctgaagcgcctgctgcggaaccgcgtgtccgcgcagcaggcgcgggagcggaagaaggcgtacctgacggagctggaggccaaggccaaggacctggaggtccgcaatgccgagctcgagcagcgggtgtccacgctccagaacgagaacaacacgctccgccagattctgaagaacacgacggcgcacgcgagcaagaggagcagcggcggcggcggtggcaagggcggagacggcggcaagaagcaccacttcgccaagagctgatgagaatgagagagggagctggtccgtgctcgcctgatctgaccattgttggcgtgttgctgttgctgatgacgtcttcttctctttttttttttccttcttcttttctactgtacttgtgttggtctaccctcgctgatggactgttttaactgttgtttacgtagcaatcccgtctctccgaccgttggtaggactactcaccactactggtagtttttttggtagggtgtcagaacgccgtgtaatttcttcttgtattgtacctgtaatt

SEQ ID NO: 13789 - DNA, 715 bp, Sorghum bicolor
  Predicted polypeptide sequence is orthologous to G557
agacccaaaccgacaagcacccagcaaatcgaggtcgctaatacagagtgaacacgctgtccttattcctcttgaagctcctttccaaccatcacctgacctgactcatagttgatcaaggcagacgtaatcaaagtctagtcactgactcacactttggccaagtcttgtgatggtggaacatcgctgcctgcgcctcatacacttctaataacagctacttatctccataatatccgttgctgtatacaacttcagcttctccattcaaacaaaccacacatcacctaatcacacggaaacaaacacaaaatggagcaacaaggatcaacagcttcccaactcttccagtctccagccgactctctcatgtcagctcctgaagacgcctacacatcactcttcgccgctaccacccctagcgcaacttcaacagtgaaccccatggacatgttgacaccaaagtcttacaacaacgatgactctctactaccaatgatcaagcaggaggagggcgttgtatcaacaccatccccttctccagcccctgagaagaagaccaccaagaagagaaagtcatggggccaagtcctccccgagcccaagacaaacctccctcctagaaagcgagcaaagaccgctgatgaaaaggagcaacgccgagttgagcgcgttctacggaaccgtcgcgcggcccagtcttctcgtgaacgca

SEQ ID NO: 13790 - DNA, 652 bp, Sorghum bicolor
  Predicted polypeptide sequence is orthologous to G558, G578, G629, G1198, G1806
acatgctgcagatggccaccgcggtggacaggctcaaagagctcgtcggcttcgtcacccaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctagatgcctgcggtggccgccagccaaaagctcactggtgaggtgaccgcaccaaagaacacgacgacgacgacgaagagtagtagcagttcgctgtatactttcccaagtggagaacgaagaaatcgacctcgctgggtttggatgaagaatgcaaggcttctcactcaatcagcggcggtggccgcgtttctcagcaacagcaagtcagcaagtggtgtgcgtttgtcaggcgattagagaataaacggaaatcgattgaggtctttttatttggcgggcggaaagacgtgtacatatcttgttttggtacccggccggggcctcctagaggcgtatgattgatgatgatgctggccttttataactactagagttgagggtatatatatacttatcatatatgtaattacctgtaactagtgttggtcaaa

SEQ ID NO: 13791 - DNA, 635 bp, Sorghum bicolor
  Predicted polypeptide sequence is orthologous to G558, G578, G629, G1198, G1806
ctactggtgacgtcctccgctatccttagttgaaggaagaacttcacccagacatgcggtgaggtgattagtaataagtattgatttaagggagatcattttgagcatgttatgatggagctctactctggatatcttgaagatcatttcaacctccacaagctaagcatcggcagcgccgcctcgccgccggagtacatgacgtcggcgtcgccggcgcagttcgcagcggtgcccctaagaatggggtacgggcggccggcgccgtcgactgcgccgccggcgccagtaatggcgggcatgtggagcagcgaggccttcaaggtcgtcgacagcggccacggcaccagcgcgtccaccgtcatggaggccgacaccaagttcgagacaaggctagaagatgttcaggtagcacttgagccaacaagaagtacggatcaggaaacaagcaagccgccagagagggtcatgagaaggctcgcgcagaacagagaggctgctcggaagagtcgcctgcggaaaaaggcctacatccaccagctagagacaagccggatgaagctggcccagttagagctggagcttcaacgggctcgacagcagggtgcatatgcaaatgggaacatgggagactc

SEQ ID NO: 13792 - DNA, 630 bp, Sorghum bicolor
  Predicted polypeptide sequence is orthologous to G558, G578, G629, G1198, G1806
tcatgggtcaaatggcccttgcccttggcaagctgtccaaccttgaaggttttgtgatacaggctgataacttgaggcagcagactcttcatcagatgcaccggattctgacagttcggcaggcagctcgatgtttcttggccattggcgagtaccacaaccgcctccgtgccttaagctccctctgggtttctcggcctcgagagatactgggtgcagatgaaggcaattgtggggagataagcattgcggcacaagcatctcaaagccaattttcatccttctgattcacgcatgatttggaactaaccttcgtcttaggagcaagagagaaacgactgggaagttgaaagagaagttttggatgccatcagatgtctgagaggcacagagagctggaaaatgaatgaagctttagaacagggagtgtttctgaaaatgtgcggaacctgtaggagcaatttccaggacgtgaaattgtttagttcactggactcgtgtccagtactgcacgttcttttggttctgtccagtctagattctcaaacagctctgcctttggttctgtccagtcagaattctcaaaacagctctgcctaggtaacgaaagaattcattctgcaactctac

SEQ ID NO: 13793 - DNA, 776 bp, Sorghum bicolor
  Predicted polypeptide sequence is orthologous to G558, G578, G629, G1198, G1806
atgccgagcctttgggccacctcagcacgccatccacacagatgtgaacagcatgcaaccttctcgagttaccgactttggggcacttgcgcagtcagctggattccgaatagaagatcttgctaacctcaatgcaaatgctttgttcaatctgaagccaaatacccatacaattaacaacagtcctcttcagtttggaagttacggaaaagccgtttacgaaagaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaacaaacatgtaaatgagttgagggctgctgtcaatgcacatgccggtgataatgatcttcgtggtattgttgatagcattatggcacactacgacgaaattttcaggctcaagggtgtggcagctaaagcagatgtttttcatgtgctgtctgggatgtggaagacccctgctgagagatgtttcatgtggttaggtggcttccgatcatctgagcttcttaagttactggcaggtcacctagagcctcttactgatcagcagcttgttggtatacccaacctgcaacagtcctcccagcaagctgaagatgctctttctcaagggatggaagcgttacaacagtcgcttgcagaaactctagcatctgg

SEQ ID NO: 13794 - DNA, 825 bp, Sorghum bicolor
  Predicted polypeptide sequence is orthologous to G558, G578, G629, G1198, G1806
tacccgtcttcgctgatttctgccgctccaattccatctctttcctgcttagaacttcttcctctgcttctccccttcatagcttttggtgccttgtcatcggcgacctaaccgccggcggccggataaactaagctagccccttggctccaaaagtcgtctcccgtagagagcacttgctcacctgctcctcacgcccctctgctggaactggacttgcgcggtgtggagatccatccggacctggttcgatttcttcatttcgggaaggtgtcgccaccatgattctcagttaaccacagctaaatgccttttcttaatctttccgggtcgggaacatgcagttaaatctgaccagtagctgttgttggtaaaggttgcttctgtgtccagcgggtggatcactggactgtgggttgtgttaactgcaggctggcttatcagcctacccataaggaaagcgaaaaagagacagcaaagcaatttgttgtctcattcttaggagctggcgagtactcggcatggcagatgctagttcgaggactgacacctcgactgttgtagacatggatgataagaatcaaaggttagagaatggacagggtggagctatggtcctgccttctaattcatctgatcgatctgacagatctgacaaacctatggaccaaaaggttttgcgacggcttgctcaaaatcgtgaggcagcacgaaaaagtcggctgagaaaaaaggcatatgtgcaacagctagagagcagtaagctaaaacttgcaagcctggagcaagaactccagaaagctcgacaacagggaatcttcatat

SEQ ID NO: 13795 - DNA, 833 bp, Sorghum bicolor
  Predicted polypeptide sequence is orthologous to G558, G578, G629, G1198, G1806
ccacccgcaccgcaagccaggcacgcggcttctggaagcttccctctcatctggttggttggtcacccacgacccaaatcgcccgcccgcggctcctccgccgccagccaggcaggtgtcgtctctgccctcggtacgaccgccggattcgggcgctggggtgggttgtttttggtctcccccaccggccacacacccacaccagcctcggccccgccgtctctccaagaccttggtcgactcctccgcccgggcatgcccccccaccgccgatcgcacacggtcgtatgattgcaatgaatcctgagatcgtactaccgtcttggaaacaattttcggcatcggtcaatcctgtgaaacactagaccgctcatcaccttgcaactggaaaggagagagcaaagtgatttgctgtctcctggtgatcgatgctcttgaggcctagtgatggctgatgctagctcaaggactgacacatcaatcgttttagacgacatcgacaagaatcagaggatggagaatggaagtggtgcggttctaccttctaattcttcagataggtccgacaggtctgacaaacctctggaccaaaagacaatgcgacggcttgcccaaaatcgtgaggcagcaagaagaagtcggctgaggaaaaaggcatatgtgcagcagctggagagcagtaagctgaaacttgcacaactggagcaggaactccagaaagctcgccagcagggaatcttcatttccagctctggagaccaaacccatgccatgagtggaaatggagcattgacttttgacatagaatatgctagatggctagaggaccaaaa

SEQ ID NO: 13796 - DNA, 849 bp, Sorghum bicolor
  Predicted polypeptide sequence is orthologous to G558, G578, G629, G1198, G1806
aagacggttttgccattaatgactggttttggatccttttgctggagatgtgcatagtgtgaggagagagccagggtggaggatggtcagagccttcataaggccttcaggtggggctctgctggagacgacgaccgccgccgccaccatcacagggcatctgagctcccccaaggtctccggagcgcctctagctccccaccgacgacgatgatggcagcctcttccaccatgagcaaggaatcagcaagctacgacatggcggaattcgaccagtcagcaatctttctctaccttgaggatggccacgatcaagaacaacaacgacagactctgaacatctttccatcgcagccaatgcatgtggccgagccaattcctgctaagggtgttagcatgggcatggtgacagccagcatgcttcccaatggcaactcttcttcacccaagagacaagagcaaggtggccagcacaggagtgtcgctgctcctgcaggccccgttgtgccgttgcctagtaacaacttagccaaggataacaggaatagccttactaagaaggaagaaactagcggtggaaagggtgcagcatctgcaggtattgttcaggagagagtgaaagaccctaagacactgaggaggcttgcacagaatagagaggcagcaaggaagagcaggcttaggaagaaggcttatatccaacagttagagacaagtaggatcagactcagccagctggaacaacaagttcaagtggcaagagtacagggtgtcttcttgggcactggtgagcagccaggtttttcttctgccccttcaccagctgcagtatttgacgtggagtatgga

SEQ ID NO: 13797 - DNA, 609 bp, Sorghum bicolor
  Predicted polypeptide sequence is orthologous to G559
gtcatttcctctcgcttctgctcggttgcagcccagcgtagatcttattcttggccgagaatcctcaagctctccaatttctgttcttgcgccgcttagcaattccgccccgaaattcttttgcggcgcagtcttcacccgaatcttgggtcgtaggttcgtagctaagaagatgaacaaggacaaggctccgatgccgggagatggcggccccagcgacggcttgccgccgcagtccacgcgccgtgccggggcgccgccctcgtcgtcaaccccaccaccggagtacgacatcagccgcatgccggacttcccaacccggagcaccggccaccggcgtgcgcactccgagatcctgggcctccccgacgacctcgacctcagcgctcccggaggcggcgacggaccatcgctgtcggacgagaacgacgaggagctcttctccatgttccttgatgtggacaagctgaactcatcgtgcggggcgtcgtcggaggccgaggctgagtcctcgtccgccgcgggtggcggcggtgagggggctgagctgggccacgcgcccaggccaaggcatcagcatagccagtccatggatgagtccatgtcgat

SEQ ID NO: 13798 - DNA, 605 bp, Sorghum bicolor
  Predicted polypeptide sequence is orthologous to G559
gatgaactttggtgccatgccacgctcgttgggaggcaaccagcagatgttccacaacaaccaagcgatgcaatccatgctggcaacgcaccagctgcagcagctccagctccactcccagcctcagcagcagtcgcaacattctcagcaccagcaccagcaccagcaactgcattcgattcaggcgcagcaacagcagcagcaactgcactcgctgcaggcgcagcagctccagcaggtggcgagagacctcaagatgaaagcgcatctggccggccaaggccagtggggcgatgggaagtctgggagcagtggcagctaagctttactggcactggaatattttggtgcacgtggtggttaggaatggagatcccttgttttggtgatgttgctgtgcaagtgtagttatcgttaactcagttatctacctataggctcagttcagcttcagttttatcgttaactcggtgatctataggctcagctcacctgcaacgtacttcagttcagaaactcggatggtaacagatgtttatctgttggattttgtttgtatctctttgctagtttaagggttaaaatggttggaatttcagggcttc

SEQ ID NO: 13799 - DNA, 560 bp, Sorghum bicolor
  Predicted polypeptide sequence is orthologous to G561, G562
gcacgaggccggtctctctctcctccgcgccacacgcatctcctgctgattgaatcaacttggcctcgcgactccggctgatccgtggcgcctcgctgccgagcggaaccatcacctgatttggcgagactagcagataaaatcatggctcaggatgaagctgtggctacccagaagactggaaatacagcatccccttctaaggattatccaactccttctccatatcctgattggtcgaccatgcaggcatattatggccctggtgtcttgccaccaacatattttgctccagcaatagctccaggccatccaccgccatacatgtggggtcctcagcctataatgccacccccttttgggacaccatatgctgcagtatacccacatggtggagcttacccacacccccttgtgcccatgatgtcaactccattgagcatggagcccgccaaatctgcaaacagcaaggagaaaaattccaataagaaacttaaggaaatagatcggactgcagtgtctgctggcagtggtaacagtaaaagaacaatgtcatccag

SEQ ID NO: 13800 - DNA, 618 bp, Sorghum bicolor
  Predicted polypeptide sequence is orthologous to G561, G562
acaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctgatgacgatccggctaatattacagcacagcacatgcatgtggcctggggatttcacaagctcatgctgcgcaccataaatgtcagagttattacagacttagtacaccagtttaggcactgattccagtaaagtaactgaggacaccggtaattttatctgctccgctgagtgccggactgcgacctctcctagtgtaccagtgttgtaacatagggtgttgtgctgcatgccaacctttaaacttcgagatcgtcctccttgggaccattttcggcgtaataacaaaatatgttcg

SEQ ID NO: 13801 - DNA, 781 bp, Sorghum bicolor
  Predicted polypeptide sequence is orthologous to G561, G562
acatcaaccgaatggccagctaaggacgacaaggaatcaaagcgtgaaaggaggaagcagtcaaatagggaatctgcccgacgctcaaggctgaggaagcaggctgagactgaagaactggctagaaaagtagagttactgaccgcagagaacacatcactccgaaacgaaatcagcaagctaacggatagctcccagaaactaaggatggagaatgcggctctgatggagaaactagcgggaggtacatcagaccaagcacaagaagcgtccgcaggccaccagacgacggccaccgcgccaccaccgtcggctcgggtcgtcaagaacttcctctcgatgatggacgtcgaaggcccatcgagaggtggcggcagccggcgcacggagcacggtgcgcccaggctccgccagctcctgagctcaggaggccctctggcggctgacgccgtggccgcgagctgatccgcgtccgtccttccctttgtgctgagcgcgtgcacgcgtgtggcctggcgattttttttgaagagcgcccaagctgccccgcgagactaaacgcacgcacgacctgtaaattacagtagctatatgtgttccatgttccagacggggcatcgttccggccactctgctgtgagaaccgagatatggatgccgtctggctgtgttggtgttttgttcactgagcttttgactccgtgttgtctcagttgctgcgccgatgcaaactgaatcaactgacacgatgtagcattactaataataaccaacgcgatgt

SEQ ID NO: 13802 - DNA, 832 bp, Sorghum bicolor
  Predicted polypeptide sequence is orthologous to G561, G562
cgccccgtccacttgcacgcataggcatacgcacctcctcgcctcgcctccccaccgcggcgccgccgccgcctctcctttccgagtcccgcctcctctggcggtgcgtgtttccccatccgccgatcctcgcgacgccgcctcgacctcgaccccgacccggcgcggccgccggttccaggcattcacaaaaaaaaatggggcatgatgaagctgtagttactcagaattcagtaaaagcaccgtcaccacccaaggatcagccagctatttatccatgccttgattggtctactatgcaggcatattatggccaaggggtcttaccaccagcattctttaaccctggaattgcacctggtcatgtccctccaccatatgtgtggtgtccacagaatatgccaccagctgcctttggaaaaccatatgctgcaatatatccacatgctggtggcttcctgcatcccttcatgcccctaatggtaaacccattgagtgcagagccagctaagtctgcgaacagcgaggataatagtttaaataagaaactgaaggaaattgatggaactgctgtttcaagtggtaacagtgaaaaaacaagtggggattacagcctagaaggatccagcgatggaaacaacccaaaggtgagcggaacgccaaagaaaaggagctttgatgataggactacatcagaaacatgtggagtttcagcaactaatggtaaaccaggagaatcaggaagattagcaactttgcccaatgtgcacattccagatgcaacgatgaaaccaagtgtgagcaccggtagtgacttccaagttagtggtgc

SEQ ID NO: 13803 - DNA, 707 bp, Sorghum bicolor
  Predicted polypeptide sequence is orthologous to G562
tgaggaactagccaggaaggtagctgacctaacaactgagaatagtgctctcagagcagaacttgacaacctcaagaaggcttgccaagacatggaagcagaaaattcacgtctattgggtggaatggctcactcccagggaccaagtgtcacaaccacattgggaatgagcattgacccaccaaaggtgcagcatcatgatgatgagggccagctccacaagaaatctagtaataacagcaacgggaactatgcgggagtcagccacaaaccggaggctaacactaggtgagagagacaaaggtggtgaggaaagtgacaaagatgagatgaggtgtttcttatctaaccacaacacccatcatcaatcagtgtgttttttcttagcaaagctgtcgttttagtcctcacagcccgctgggggccatgtagagtcgccccactgcagccatgtattatttatggctcgtcgcggtgtgctttgtgtctttgtgtgttgtgtaaacctattgatgtagctattgtaacaaacctagagagcctagagtttttaatgtttgctaactcctgatgagggatgtaaccggccaatttggtgcctgatcgatggttagatgaaatgcgagcaaatatcatttgatagcctgcctcgctttgttgtttggatggttgcaactttgtgggagagaattttatatgggttattg

SEQ ID NO: 13804 - DNA, 667 bp, Sorghum bicolor
  Predicted polypeptide sequence is orthologous to G571
tactggaaaaaaatatgctgtgtcgtcggcgtgcgcctgcagcagcggccgcagcagcacctagcagcagcctgtagtgcttgccgcgcgcagttgcagcgacgatccgtccaccggtccgtcgtccgtccatggtgagcggcggcagcatcaaggagcagcagcacgagatgaacatctccttcgggatgatgaaccaccaccaccagcagcagcctccgtcctcctcctcttcctcctccatgcacgccgccgctgcgagcttcatgagcggcaaggaggcgtcaggggcgtatgaccatctgggggaactggaccaggcgttgttcatgtacctggatcacggcagcagccatgtccatggcggcacgcagcaagagcatcaaaggcagacactcaacatcttcccttcccagcccatgcatgtggagccgtcgccgaagggggagattagtttagtcctgtccccggcgccggtgggatccaagcagcctgctaggtcacccgaccatcaccatcaccagcaccagcaggcggccatggaggagttggcggggagcaggaggcagcagcaggagcaccaccacctgcagcaccaacccttcgctgctgccgctgctgagccggcagcacccgtcgggatgatcaaagatgtcaagccactggc

SEQ ID NO: 13805 - DNA, 827 bp, Sorghum bicolor
  Predicted polypeptide sequence is orthologous to G571
atggcagcatgagaagggatcctgaaggatatgacacgtcatccgatctggaccaagccctactcctctactttgatgggcagcaagttaagacatcaattcaagaacaacaaccgcagactctcaacatcttcccctcccagccaatgcatcatatcgagccatccccgagggttccatggcttcttcttcagtggtggcagcacaggtcgctgctgccccttccaagaactcgcaggcgccgtcgttgatgggaggcggcgggccgcttgctgccgccggcaagagctccaaggcagcaatcaagagagaaggcggcaccgctggcggcaagcatggcgccgtgggagcttcgagctcggatcaggaggggccccggacgccggaccccaagacgctgcggaggctcgcgcagaatagggaggccgccaggaagagcaggctgaggaagaaggcttatactcagcacgctctggaccaccagccggacggccaatctggctagaggcccggccgggtagacgtacaactgatctacggcatgggatggaaatggaatacatacgcggccggctagctactagcttagctatatagcctatatgacgtagtaacatagaaagcgttaaactatatacatcacatgcaaatgtatcggtgatatttatagatacaaaatagtatcatatagaagtgcaccagtggttctcttttcaaagttgcaacaattccaaagcagattaattattagtgaggtatacatatgtgtttgaactttgaagggagaaccatcgcttctgaatgaaaatgattgtgatatgatattc

SEQ ID NO: 13806 - DNA, 711 bp, Sorghum bicolor
  Predicted polypeptide sequence is orthologous to G583
agggctgcgacgacgaaagcgcaagcagaggccgctcacgcccgccgcccaggccgagcaggagcaccgcaagcgcgtgctccgcgagctcaattccctcatctccggcgccgccgcggcgcccgacgaggccgtcgaggaggaggtcaccgacaccgagtggttcttcctcgtctccatgacgcagtcgttcctcaacgggtccgggctccccgggcaggcgctcttcgcggggcagcccacctggatcgcctctggcctctcctccgcgccgtgcgagcgcgcgcgccaggcctacaacttcggcctccgcaccatggtctgcttccccgtcggcaccggggtgctcgagctcggctccaccgacgtcgtgttccagaccgccgagagcatggccaagatccgctcgctcttcgggggcggagcagggggtggctcgtggccgcccgtgcagcctcaggcgccgtcgcatcatcagcccgcggccggacccgaccaggcggagacggacctatggctcgccgacgcgccggtcatggacatcaaagattccatgtcgcacccgtcggctgagatctccgtctccgagccgccgccgccgccgccgccgccacagacccattttgagaacgcgagcacgagcacgctcacggagaaccccagcccatccgtgcacgcggcgccaccccagccggcgccggccgctgcacc

SEQ ID NO: 13807 - DNA, 614 bp, Sorghum bicolor
  Predicted polypeptide sequence is orthologous to G591, G793
ccacagtatcgcggagaggctaaggagagagagaattgcagaaaggatgagggcattgcaggaattggtccccaacacaaacaagacagatagggcagctatgctagatgagatccttgattacgtgaagtttcttaggcttcaagtaaaggttttgagtatgagcagacttggtggtgctggtgcagttgcacagctggttgctgatattccactctcagttaagggtgaggcaagcgacagtgggagcacacagcacatatgggaaaagtggtcaactgatggcacagaaaagcaggtagcgaagctgatggaagaagacatcggggcagcgatgcagttccttcaatccaaagcgctatgcatgatgccgatctcgcttgcaatggcaatctacgacacccaacattcccaggatggccactcactgatgaagcctgagcccaacacatcctcgtagtatagtaacatcaaccctagcgtgcatttcaaccccctaatactattaggcaccgatatatccaaaaaaaaaaagtgtatgatatacggagcgttccaatgtgctaaccgtgagataggaaaggaccttaaattggtatatgatgtagcctacc

SEQ ID NO: 13808 - DNA, 667 bp, Sorghum bicolor
  Predicted polypeptide sequence is orthologous to G592
ccggcgcctggacggacgagccgtcgccgtcgccgacgtccggcgcgaagcgcccccgtgactccggccccgcgacgcagaacgtgcatcagcagccgctggcgccgcagctcagtctgcctagcggcaacaacggcggcggcaagccggcggcggcctcggcggagatggcggcgatcgagaagttcctgcagttccaggacgccgtcccttgcaaaatccgcgccaagcgcgggtgcgccacccacccgcgcagcatcgccgagcgggtgaggaggacgaagatcagcgagcggatacggaagctgcaggaactcgtgcccaacatggaaaagcaaaccaacactgccgacatgctggatctggctgtggactacatcaaggatcttcagaagcaggtcaaggtgctgaacgacggccgcgccaactgcacctgctccgcgggcaagctgctgcaggaccagttcaccagttagccgccgccttttctcggtgcgatgcgatgcaatgcgtggccatggccgcaaggcctgactgacgcctcgcctccgcgccggcagctcgctttctcctcctcgttgaagttgaaatagtaccagtgtacttgcttacatagttttacatgaggaggtaaggaacgtaaacaaggatggatataataggaatg

SEQ ID NO: 13809 - DNA, 785 bp, Sorghum bicolor
  Predicted polypeptide sequence is orthologous to G592
ctactggctcgcacagttgcacgcaccgtccagtcaaaagtcctcgggacaggccaggcagggagagcagagcactagagcagcagcaacacaacacatcacgattcacgagcgatcgcccgcctactcgcggcagcagccagccataaacctgaaccgcctgacgccggcgcaccacggggcgatgcgtccgccctccgtgcaggggcaagggctggcgcggtacggctccgcgccgggctcgctcctggccgccatcgccgagtccgtgacccgcggcgaccccgcgccgccgccgccgcccgtgagccggttctactccgccgagtcatcggggctcacctcctgcgagtccagctgccgcaccgacggcggcggcggcggacgtccgcctccgctcgagcgggcgtacggcggctccggcgagatccgcgtgcctccgccgccgcagcagcagcacccgctggcggcttccacgctgttccgccacagcagctcccccgccgggctgctctcccgcctcatggccgacccgcacggaatggctgcgcaactcacccgcggagcattgccgagagggaaagaagaacaaggattagcaagaggctgaggaagctgcaagatcttgtgcccaacatggacaagcaaacaaatacgtcagacatgttggatcttgctgtagattacatcaaagagctgaaggaccgagtagagaagctaaaacacgaccaagcaaactgttgttgcctaggagtagccaacaagggctgctgatgctggagaag

SEQ ID NO: 13810 - DNA, 731 bp, Sorghum bicolor
  Predicted polypeptide sequence is orthologous to G597
ggtggaactgtaacatacgagggtcgatttgagatactatcactgtcaggctcattcctcctggtggagaatggtggtcagcgtagtcgaactggaggactcagtgtgtccctggctggtcctgatggtcgtctgttgggtggtggagttgcgggacttctcatagcagcttcaccagttcagatagtactgggaagcttcaattctggaggcaaaaaagagtcaaaaaagcatgctccttcagaacccacatcagtgccactgaaggtcgctccgaccaccgggatgggacccaacagccctccttcaagaggtacattgagcgagttatctggtggcactggaagcccaccaccactgcatcaaggcatggctgctagcaataataaccaaccgccgttcctgtctagcatgccttggaaatgagcttgcatcctcttgaccaattccaggcatataccattatgagcgaactgcctcccggtcaggaatgcaggatgtagcaatttgcggttcagtagcgctcgttctctgagtagctcttatgtagtataaatcagaagcttgggtaggaagagaattgcatctggtaaatttgtagctcctattgtaggtttcaccctgaattcctgtgctaggtgtattgagctgtaaccatgtgatcctttgagcgttatcaaatgttatttagttaaatgttctaccaaggcatgtggattgaatcagaagtt

SEQ ID NO: 13811 - DNA, 837 bp, Sorghum bicolor
  Predicted polypeptide sequence is orthologous to G598
ggcaggcactggcacgctcgcacgcacgcacgcaccagcaccacatgcatggtggagcctagcacgggcagctagctatagctccccgccgccggcgacgaccaccaccaccacatgttgcatgagcagcaggcaccgccatcaccaccgccggaagtagaagcagcgccaccgcccgtgccatcggcgccgagcccggccaggaaccaccaccaccacgacggcgacggcgacgtccacgatgtcgaggtcacgacgttccgcgacatccaccctctgacgcccgacgtgccgacgccccccgcgcgcaccaggtcctgggacaccgccagccaccgctccttctcgtccgaggagcagttcatgacgatgagccgcgagttcacggccatggccgccgccggggcgaccatgcagacaggcggcggcgccaacggtaacggcgggtacgacggcgaccagctcaccagcatcggcgaggacgagctggaggagaccaacccgctggctatcgtccccgacagccaccccatcgccacgcccgccaggtccagggcgtccgccgccgcctccgcctccgggctggaggtcgtgccggcgccgacgccgacgccgcagcagccgcccgcgcacgtggaggccagccaggtgaagaaggaggaggtggagaccaaggtgtcggcgtggcagacgaacgaggtggccaagatcaacaaccgcttcaagagggaggaggtggtcatcaacggctgggagaccgagcaggtggagaaggcctccgcatggctcaagaagatcgagaggaagctggacgagcagcgcgccaaggcggtggag

SEQ ID NO: 13812 - DNA, 739 bp, Sorghum bicolor
  Predicted polypeptide sequence is orthologous to G598
acaccaccaccccggagtccacccaaagcattcgatctccgacgagccgcagatggtttcgcggccgctagaggcttagcgttgaggaggaggaagcagtgtgccacatgttgggtgaacagacggcggctagcactagcagcagcagcggcagcggcagcggcagcgtcgagcatcaggagaggatcgtcgaggacaggcggttgcagccggtgggggagaacgaggaggaggaggaggagttcagggacatccacgcgctgagcccgccgccgacgccgagccagccgtcgtcttaccgcctccgggcgtcgtgggggtcagccgcgggcgggagcaggcacaggtccatccgctccatctggagcgaaaccgcggccgccgagcccttcccgactatgagcagggagttctcggccatggtcgccgccgcagccaacgccgcagccagcgccaactccaacggtgacatcgtcgacagggacgtcgtggacgccatgggcaggagcaggatcggggaggccgaggaggagctggaggagaccaacccgctggccatcgtgcccgacagcaaccccatcccgtcgccgcgccggggcccgcccacccctggaggcgccgacgtcgcgctgatggccgccaacggccacggccatggccacggcaacagcaacggcgaaggtgggatgtccgtggggcaggtcaagaaggaggaggtggagtcccagatcgccgcgtg

SEQ ID NO: 13813 - DNA, 646 bp, Sorghum bicolor
  Predicted polypeptide sequence is orthologous to G600, G2768
aaaattccccaatcccgccgccagcctccccacgcgcctcggaaccctagccccggcgacgccttcggatccggcgctcttatccggcggaatcgcccgcccgctcctacccccggtcgccgcgttccggcgtctcggctacccggcgtcatctacccgtcttcgacacctgcgatcgcctcttcgtagatcgaatttgttcagtgattcttctcgttccaattcgttgtatttcatctgagatctgaaaaaattattcgggccatctcgaaatagagagcccttattcgtgaggaaaagagacagtactcgccatccatcatgggtgttgtgtattatcaatataagagtgaaaaggaaatctgttctatgcctgtgccccatgcttttatctctgtgtctgaactcaagcagcttatcatgacgagcggtaagcacggccgtgggcgaacccgcggccgtgccacagaggatattgtcatctccaacgcccacactggcgaagaatatgcagatgaaagagcatccgtaccacagaacacaactgtgctggtccgcagaatttccattcctgggcaactgtcagagaagatcgtcttgtcccccacgcggaaagtcgcagaagaatgttctgtaccttgtaagt

SEQ ID NO: 13814 - DNA, 744 bp, Sorghum bicolor
  Predicted polypeptide sequence is orthologous to G600, G2768
ttttgaagccaaatgaagctgcttttgagaaggagatagagggcctacctaccacacgttctgttggtgatcttccaccagagctacgctgcccattgtgcaaagaagtaatgaaggatgctgttctaactagtaaatgctgctttaggagtttctgcgataagtgcatcagggattacctaattaataagtcaatgtgtgtctgtggtgccacaagcatattagccgatgatcttctccctaacaaaactctaagagaaaccatcaaccgcatattagaggcaccaccaactagcagtacggaaaatgtgggaagcatggtgcaagtacaggacacggagtcagctctacctgtgcaacctaagcttaggtctcctgctgtttctgctgcttcaaaggaagaggctaaagcatccacacctgtagaagagtctccagatgctgagagcctcaatggagcaaaagctacaaatatcgatgcgagttcttcagataagaaagccacaacagttccggatattgctgaagggacgatggattctaagaaggcgaaagaagataaaccagtggaaacaactccagtggcaaaagattctcaagaaaagtttcctgcaggggaacaaggtgaaaagccttcgttcctgtttctgtttgtagcttgctctttcctgtattgtagcttcccttaaaaataagtcctgaagaatttatacttaagttttccttgtcacaaataacatttgg

SEQ ID NO: 13815 - DNA, 651 bp, Sorghum bicolor
  Predicted polypeptide sequence is orthologous to G611
tgatgcatacagaatgggtgacaagctgaaatttgccaaccatgcccctgacccgaattgctatgccaaggttatcatggtggctggtgatcatagagtgggcatattcgccaaagaaagaatcctcgctggcgaagagttattctatgattaccgctatgagcccgacagagctcctgcttgggcccggaagcctgaggcttcgggagcaaaggatgatgggcaaccgtccaatgggcgtgcaaagaagctcgcccaaaacacaagaggctgaatttgattctgattctttcattgctgggccacaaatttggcagctattcaaccaagatagaacctgtcattcataggacccaatttatttaaacttgtcactgtaactcgaatgttttatttgcttgaattctccatggcagctggtcctgccatctgtagaattagctggcgggcgactgatctgatgtaacatgagttgctgataggtagcgtgtgcccctttagagcctgattcatgtgggggcacggtcagagcgtttctgaggcaactagagctgtttttgttgccgcaaaagtagcatgttaagctgctttagtgcaatttatcggctagttgtacaaggtgaattgcattaaattaggcatacttggcgt

SEQ ID NO: 13816 - DNA, 764 bp, Sorghum bicolor
  Predicted polypeptide sequence is orthologous to G611
aacatggtgcagcgatggcgaagagacctctcttgaataaatccatctcgggcgactttgcagaaactgaacaagactacatggagcaagacatggttgccagaacaagaatctatcgtcggaggggccgcaatcggaagctgaaatatacttggaagtctgcagggcatccaactgttagaaaaagaattggtgatgggaagcaatggtacacacaatataacccatgtgtgtgccagcaaatgtgtggtaaggattgcccctgtgtggagaatggaacttgctgcgaaaagtactgtgggtgttcgaagagctgcaaaaacaagtttagaggctgtcattgtgcaaaaagtcaatgcagaagcagacagtgcccctgttttgcagccaatcgtgaatgtgatccagatgtttgtaggaattgctgggtgagctgtggggatggttcactaggtgagccacctgcaagaggtgatggctatcagtgtggaaatatgaagctccttttgaaacaacagcaaaggattttgttaggaaggtctgatgttgcaggttggggtgcattcattaagaatcctgtaaataaaaatgattatcttggagaatatactggtgaattgatctctcacaaggaagcagacaaacgcggcaaaatttatgaccgggcaaactcatcatttctatttgatttaaatgaccagtatgtattggatgcttatcgcaagggggacaaattgaagttcgcaaatcactcatctaacccc

SEQ ID NO: 13817 - DNA, 819 bp, Sorghum bicolor
  misc_feature (82)..(82): n is a, c, g, or t
  Predicted polypeptide sequence is orthologous to G653
ggagaaggtgtttagcgggacgcagcagaagtgcaaggtgcgcaccaagacggtgtacccgatggaccagctctccaccganggcgtcgccctccaccgctcctgcttcaagtgccagcactgcaagtccaccctctccctgagcaactattcctcgttcgaaggagtgccgtactgcaaggcccatttcgagcagctgttcaaggagaccgggagttacaacaagagcttccaatcacaatcacccgcaaagattactccggaaaagttggcccctgagctgaccagatcaccaagcaaagctgcaaggatgttttcaggaacacaagacaagtgtgcgacttgcggtaaaaccgcatatcctcttgagaaggtaacagttgaagaaaaggcataccataagtcatgcttcaaatgctcccacgggggctgtgcgattacaccttccaactatgcagccttggagggcatcctctactgcaaacaccatttctctcaacttttcaaggagaagggaagctacaaccacttgatcaagtgtgcttcggtcaagcgcgctgctgaagcacagccagaacaaccagcctccgattcctcctgatcgtgccatttcaacagtgggggtttgaaggcgagagttgggaagcctcctgtttttacttaaaaacgcatgctgtatgtcattcatctatgccctgaggataccggactatctattttggtatcctttgctgtgctagctggatcacatcggtgaaccatggaactgatgtcatttccaatgaaattgttgtgcatcaagtagtgaaatcttcacgg

SEQ ID NO: 13818 - DNA, 638 bp, Sorghum bicolor
  Predicted polypeptide sequence is orthologous to G670
gcacgagggtagattcattctactgggatggtactaatcctagcagcagtagcagtactgggagcagaggaagcaacagtatgggctttgaaccacagagcacgagctcaattctggagaacagtgtcttcccatggacaaacatcggacaagaaaaagatacaagggctcacctagtagaggaacttaagtggcctgacttgctccatggaacctttgccgagacgaccacagccatgcagaaccagagccagacgctctatgatgacgtgatcaaggcagagagccaattcagcatggaagggatatgtgcttcttggttccagaatcagcagacacagcaacagctgcaggctgcacccaacatgtatgacaaggacttgcaaagaatgcaactgtcttttgagaatatctaggcactatgttccacctcatggaacagagctgatcagcagaagcagaaacttgtattcagagatttgtgggaagaactatgctgaattgcttacatagatacattaagttgatacagagattatcctccacagctgttcctcagttgaagacctggcaatatcaaggaaaggacagccctggcattagaagtggcagcagaatgcatagaaaagtacgttcta

SEQ ID NO: 13819 - DNA, 745 bp, Sorghum bicolor
  Predicted polypeptide sequence is orthologous to G670
gaaatctcctatctgcaaccgtgcagttgctcaattctagcctcagctgaagcccaatcatccagtggtatataagctacttcaaactttgcaatttcccactccttaagccatcatcgatcattgaagaagcttcgtgctactggagaaggtgttcgccctgcataattgcgggctatatacattccacaggcctgtaagctctgtgaatttggagctctcaggttctgcattgcattgagatggggaggcattcttgctgctacaagcaaaagttgagaaaggggctctggtcccctgaggaggatgagaaactcatgaatcacataacaaagcatggccatggctgctggagttctgttcccaaactcgctgggctccaaagatgcggaaagagttgtaggctgaggtggataaactatctgaggccagacctcaagagaggggcattctcccaagacgaagaagagctcatcattgagctgcacgctgtcctcggaaacaggtggtctcaaattgcagcacagctgccagggaggactgataatgagatcaagaatctatggaactcgtgcatcaagaagaagctgaggcagaaaggcattgatcccaacacccacaagccccttactgaggctgatcgcagcggagcagctcccaccgtcagcaccgagagaacctcagggtccagcgatgtcaacccatcaagtgctggtgctctggggaacttgagccacctcctcag

SEQ ID NO: 13820 - DNA, 831 bp, Sorghum bicolor
  Predicted polypeptide sequence is orthologous to G670
aagaagagtggccttaagcttgccggtgccttcctccaatcctgatatcagtagccactagttgctgccgttctcccacaagctccactatcacacaccactgtaggagctcatatagctcctccacaatcatcgcaccctagagccataaatcgttgagagggattcttagaaccagaggattacctgtgaagaattccgtgctgctcctcaagctgtgagctgtgcagattgcagagctcagcttcagtttcagcattgctttcaatggggaggcactcctgctgttacaagcagaagctgaggaaggggctctggtctcctgaggaagatgagaagctcatgaaccacataaccaagcacgggcatggctgctggagcactgtcccgaagcttgcagggcttcagaggtgtggcaagagctgcaggctgaggtggataaattacctgaggcctgaccttaaaagaggtgcattctctcaggaggaagaagaccttatcattgaacttcatgctgtactgggaaacaggtggtctcagattgcaacaaggttgcctggaagaactgataacgagattaagaatctctggaactcaagcatcaagaagaagctccggcagagaggcatcgaccccaacacccacaagccccttgccgaggttgaacacagcaaagcagcgccaacaatcagtactgagagaacctctgagtccagtgatgttgacccttcaagtggtggtgcacttggcaacttgagccatcttctcagcgagacagcacaatcaccagagctgctgccagtgctcggtaagcatcgcaaagaaactact

SEQ ID NO: 13821 - DNA, 587 bp, Sorghum bicolor
  Predicted polypeptide sequence is orthologous to G715, G1646
cttgggagaccactgcccggcagccgcgaggaactcactcctgcaagatagcttcatatacagccatagccggagtacgtatatgtagctacgcaacctcagttcaggcgagctagctagccacaacgccgaccaggcgagaacgaagagaagcatcgatcgattgggtcacaagctcccagcaacttttaatccaaatccatggacaaccagccgctgccctactccaccggccagccccctgcccccggaggaaccccagtagtgccgggcgtgcccggcgcagccggccctccgccggtgccgcaccaccacctgctccagcagcagcaggcccagctgcaggcgttctgggcgtaccagcgccaggaggcggagcgcgcgtcggcgtcggacttcaagaaccaccagctgccgctggcccggatcaagaagatcatgaaggccgacgaggacgtgcgcatgatctccgccgaggcgcccgtgctgttcgccaaggcctgcgagctcttcatcctcgagctcaccatccggtcctggctgcacgccgaggagaacaagcgccgcaccctgcagcggaacgacgt

SEQ ID NO: 13822 - DNA, 635 bp, Sorghum bicolor
  Predicted polypeptide sequence is orthologous to G715, G1646
ggccgacgaggacgtgcgcatgatctccgccgaggcgcccgtgctgttcgccaaggcctgcgagctcttcatcctcgagctcaccatccggtcctggctgcacgccgaggagaacaagcgccgcaccctgcagcggaacgatgtcgccgcggccatcgcgcgcaccgacgtcttcgacttcctcgtcgacatcgtgccccgcgaggaggccaaggaggagcccggcagcgccctcggcttcgcggcgtccgggaccggcgtcgtcgggggtggcgccccgggcggggcgccggccgccgggatgccgtactactatccgccgatggggcagccggcgccgatgatgccggcctggcatgttccggcctgggacccggcctggcagcaaggggcagccgatgtcgatcacagcggcagcttcagcgaggaaggacaagcagggtttgctgcaggccatggcggccccgctagcttccctcctgcgcctccgagctccgagtgatcgccatgatgtgtacgtcacgcactcacgctgtgtgtatacactctactatagcaaacatggtaatggagctgcatacagaacgaataaggcgtgacgcgtgtcagacagtgagagtacgtagtaatttgta

SEQ ID NO: 13823 - DNA, 677 bp, Sorghum bicolor
  Predicted polypeptide sequence is orthologous to G715, G1646
gaaaagcaccatcctcttcctcttcctcctccgcccccaatccccctcctcgtctcgccacaggccacaaccctagctgcccccgaatccatggatcccagcaaatccagcacccctccgccgcctccagtcatgggcgcccccgttgcctaccctccggcgacgtaccctcccggcgcggccgccggcgcggccgcctacgcgccgcagctctacgcgccgcccgcagctgccgcggcccagcaggcggccgccgcgcagcagcagcagctgcagatgttctgggcggaccagtaccgcgagatcgaggccaccaccgacttcaagaaccacaacctcccgctcgcccgcatcaagaagatcatgaaggccgacgaggacgtccgcatgatcgccgccgaggcccccgtcgtgttcgcccgggcctgcgagatgttcatcctcgagctcacccaccgcggctgggcgcacgccgaggagaacaagcgccgcacgcttcagaagtccgacattgccgctgccatcgcccgcaccgaggtgttcgacttcctcgtggacatcgttccgcgcgacgacgcaaaggacgccgacgcggcggccgccgcagctgctgcggctgctgctgccgggatcccgcgtcctgccgcgggagtaccggccaccgaccccctcgccta

SEQ ID NO: 13824 - DNA, 750 bp, Sorghum bicolor
  Predicted polypeptide sequence is orthologous to G740
caaggccccatggcctataatgctggtctcagcaacactggcgccggacgaagcgtgccaacctccaacagtgcctacactaccaatatgagtggtcctaggtatggggagtcagcgaaccagtttgcgcagcaagcaaacacgtatattggggcgtccactccagtgtcggcgacacggaatgtgcagacctgcatgtcttgcgggtcaagtggacacaatgcgcaaaactgccctgcaggcatgtataagcagcaacctgcggcaagcacagcaagctcctatggctcttcgcaacctcgcaacactggccccagaccgtgtttcaaatgcaatcagatcgggcactttgcggactcttgcccacttctggcccctgctccccagcagcagcagcagcagtatcggagcggtggcgcttcatcaggtggttatggtcagcagcagtatcggagcggcggcgcttcgtcaggtggttatggtcagcagcagtcctatcttggagctaccaactactgaaagtcagtatccatcgaatcaggcgtgatgttggttttgcttagatgcctgtcctgaatggcatcgctgcgtctatgtaatgtagatacctaatgttccttttgtgtttgtgtgaagttggaaccatgtatcggtacttctatatgtttttcgtcttatatggtgtgttataaatcctcgttgctgtgtcagttctgttgaatccgtggtttgtccagctttgcatggtgc

SEQ ID NO: 13825 - DNA, 695 bp, Sorghum bicolor
  Predicted polypeptide sequence is orthologous to G760
ccttgccagcatgttgggctctatcccagctccacctgcaatggcctcagaattcccgccatcgacagggaaatctgttgggatgctctcggctgtcagctcaagctcaattcgtgttactgctggcatcatccaacttgatggcctcactttcagcagtggctccgatcggtggcccttgcagaagaatggagacttgagtttgcttgtgtctttcgccgtggagagcgacgtgtcatccaagcttcctgttggtcttgaggatgctactcggattagcactgttcccatggtgatgcgaagtggcttttaccttttctttatgtcggccatgattctcctgttgagctacaaagtagggtcgtgtatctacagcaggtgagttgaaggtgatggcgcctctggtccggtctgactctgagggctgtttattttgattttatacgtgggtcatcccctcagtgatgaggggatagtagtcgttcgacactatttgtttatttaccattctgacctgtcaaaacatatagcaataaacttttgaactggtgatggtggccatgccgggaccatgtcctcatcaggcaaagtagtgcactgtgaacttggggctctgcccttattattgtaaccaaaacttaactgcagtatgtttatgttctgtcgtgtggaagaaaagctattttttctggtgt

SEQ ID NO: 13826 - DNA, 601 bp, Sorghum bicolor
  misc_feature (51)..(51): n is a, c, g, or t
  misc_feature (77)..(77): n is a, c, g, or t
  Predicted polypeptide sequence is orthologous to G773, G1412
tgggccatgcacgaataccgcttcctccccgccggcctcaacctccacggntgcgccgccaacgcgcctccgcccantaatgtgagctcccttgccggtggtggcgcggcggccgactgggtggtctgccgcattttcaggagggccaggccggcccaccgcgcccgccttgttggcggcagggaagaagaagaagagcacgcggcggaggagagcccgtcgtccccgtcgtcgtgcgtcaccgacgcctccgaggccatggaccaggaagaggatgacggcgacgaagggagcagctgcagcgtcgcctcctctaattgagactgagtagaagagttggctagcccgtcgatcaaatcacgggcgccatgttctaattgccgtagaaccctcatcagtacctagtagcaatcaatagagagaagaagatcgagctccaacaaaccatgaacaacaacaacaaccaaaaaaagaaaagaaaagctaagagctttggtgctatgttgttgttggagactcgtcgcgaaatccaatccagagtgttaattagcgagaaattaatcagttccctttcggcaattaatcaccatttcatacctgt

SEQ ID NO: 13827 - DNA, 798 bp, Sorghum bicolor
  Predicted polypeptide sequence is orthologous to G782
ctgtaaacagcctcggatgaactgtgctcagcgctcttgcgttcacaccagtctgctgtttctcttctcccgttcaccccgcgcgcgcgagaattagagcgaccgccgccctacacccctgctgcccatgtcttcgtcggggcctttgccggcgaccggaacccaccatggcagtcaaagggcagagtgtaaagcccagggttcaacctctgcacgcaaggtacaaaaggctgatcgagagaagatgcgaagagataaattaaacgagcagttccaggacttgggaaatgcacttgatccagaccgtcccaggaacgataaggcaactatacttggtgacacaatccaaatgctgaaagatttgactactcaggtgaacaagctgaaagctgaatacacgtcactttctgaagaagcacgtgaggtaaatattagtacaaagaaacaggtcaactgcagaaatgttctgactcctgatacacatttctactggtacttgtagttaacacaagaaaaaaatgagcttagagatgagaaagcttcactgaaatctgaggttgataatttgaataaccagtatcagcaacgaatgcgagtgttatacccgtgggctggaatggagccttctgttgtcatggggccacctccagcatatccctatccagtcccagttcacctaccctctggtgctgtacccatgcatccgcagttgcaaacataccccttcttccacagtcaaacttccggaaccatcccaaatgcatgcatcccttacatggcatatacacagccctgcca

SEQ ID NO: 13828 - DNA, 800 bp, Sorghum bicolor
  Predicted polypeptide sequence is orthologous to G782
tgccaaaatctgagtgtgtagtgatggacaaaattaccagtgagacaaacaatctgactgacaagctacagagtctcaacctggagaagaaccaggcttcatggcaagactttgggaacctgactagcatagcttccaccacaaacagacagaaagaatggtattgctacggaacccaggctcatggaaagacaaacaagaatactgcgaaggctataccatctccagctcgagcataccatcccatgactcctactatcaagaaatatgctttggatggagaacaacgatgctggaagaaggttcagatcgccccaactgaaaacccacatccagaaactgttgccatcgcctcgtcaaaagcaccacctgaggagcatcaacaaggtggtgaaaataccttggcgcacagtttatcaggagatcagtgtgaagagcaaaagattgtcgggaaagcctgtccacctgcgcccgtttcgacaagtaaagcctgctcagaacccctgcctggtatgcttgctattggctcaatgctggtcccgattacgacgtccagttagtagtaggtccaaaggcatctcttgttaacctcaaggcgtctcttgtaagtagcacggtttcattttgagcttctgacgttataggctcgtggcaaccatggagtgagtggtcttcagtttaatctggcaaactaggaaccacttataataggatttggaaggttcaggttttcttttgaccttttcagttcagcactgttcttccttttgaatcttcagttgccatgtctgaagaacctt

SEQ ID NO: 13829 - DNA, 739 bp, Sorghum bicolor
  misc_feature (614)..(614): n is a, c, g, or t
  Predicted polypeptide sequence is orthologous to G783
cctactggcatcctcttcctcggtcctccccagcaatcgaagacaagggcagagctgaaccgagccaggtcaaatctggccgcaccgcgtagcttctctctcatcctggcctcgattcgtggttgttttgggaaggagaggtatcggatcaggtcccttgatcactcatggtgcccagggacagggcgcatagcgccacaactgccaccgcggccccggcggagaacctcgttcaagggcctatcctgaacaacaagtgcgaaaagaaggctccaaagaaagtacataaatctgagagggagaagcgtaagcgcgacaagcagaatgatctctttggcgagctgggaaacatgctagaacctgataggcagaacaatgggaaggcatgcatattaagtgacactacacggatacttaaagatctactttcacaagtagaatctcttcgaaaggagaacaatacgctgaagaatgaatctcattatgttgccttggagagaaatgaactactggatgaaaccaatgtgatccgtggtgaaatctcagaacttcaaaatgagctgaggatgcggctagaaggcaaccctatctggagtcatgacacttctagatcnaatattacagcacctcatcctgcgaccacagtatttacattgcaacattcagcacatccacaagtcattgcaacaatggcacttcctctgcaacagccagcagtcgttgagcaatcttatgctgc

SEQ ID NO: 13830 - DNA, 820 bp, Sorghum bicolor
  Predicted polypeptide sequence is orthologous to G789, G1494
tgctcatgccgcgctgcggtggccgtgctgctgctacggacctgcctcataaaagctctcctgcttgcagcttgcacggaggcgggggtagaagacgacttcgcaaggcatctctgctcgagcggagcagtactccgttcaggagacgaggcgttctcctccggtgggtctggaagcaactatgggggatccgggctgccaagtgacagcgtccatgtccacaagaggaaggggaggtgtagagacgactcagatagtccgagtgaggatgccgagtgtgaggaggcaactgaggagaccaaaccgtcgcggcgacatgggccgaaacgccggactcgtgcagctgaagttcataatctctcagagaggagaagaagggacaggatcaatgaaaagatgcgcgcgttgcaagagctgatcccgcactgcaacaagactgacaaagcgtcgatattagatgagacgattgagtatctcaagtccctccaaatgcaagttcagatcatgtggatgacttctgggatggcaccaatgatgtttcctggtgctcaccaattcatgccaccaatggctctaggcatgaattcaggttgcatccctgcagcgcaaggcctaagtcagatgccaagattaccatacatgaaccaccccctgcctaatcatatccctctgaactcatctccagctatgaatccactgaatgctgcgaaccagatgatgcaaaacggtcacctcagggaggcaagtaatcacttccttcacctagatgggcgaacagcggtggtacctcaggtaccaggaccccatgtttatggacatc

SEQ ID NO: 13831 - DNA, 770 bp, Sorghum bicolor
  misc_feature (559)..(559): n is a, c, g, or t
  Predicted polypeptide sequence is orthologous to G791
cctactggacgaccgcttccgccccagtccccaccgccctcgaccccgattcccccaatccctgccgcgaccgctgaaccctagcctactccggccatctgccgctggccccggcgatcccccgccatggcctcccccgagggaaccacgtgggtcttcgactgtcccctcatggacgacctcgcggtggccgccgacttcgcggcagcccccgcggggggatttttctgggcagcgccgccgtcgctacagccgcaggtggtgcaggcgccggtccagtctgtcgttgccgcgtcggctcccaacccatgtgtggaaatcagtagctctgtggactgtggtcagggaaaagaacagccaacaaataaacgtcctaggtcagaaagtaccgcagaaccaagcacaaaagcatccagggagaaaattagaagggataagctgaacgagagattcctggaattgggtgccattttggagccagggaaaactcctaaaatggacaagtcagctatattaaatgatgctattcgtgtagtaggtgaattgcgtagcgaagcanaagagctcaaggattcaaatgagagcctacaagagaagattaaagagctaaaggctgagaagaatgagctgcgagacgagaagcaaaggctgaaggccgagaaggagagcctggagcagcagatcaagttcctgaatgcccgcccaagtctggtaccacaccacccagtgatctcagcctctgccttcactgctccccaagggccggcagt

SEQ ID NO: 13832 - DNA, 832 bp, Sorghum bicolor
  Predicted polypeptide sequence is orthologous to G791
caaggagcctggcagcaataaacgtttaaggtcaggatccaatgatgtgccaacatctaaagcttctagggaaaaaatgaggaggaacaaactgaatgataggtttcttgaattggggtctacattagaaccagggaagccagtaaaagctgacaaggctgctatcctaagtgatgctactcgcatggttattcagcttcgttcagaagcacagcagctcaaggaaactaatggtagccttgaagaaaagattaaagaactaaaggctgagaaggatgagcttcgtgatgagaagcagaagttgaaattagagaaggagagtttagagcaccagatgaagcttatgacctcaactccagcctacatgcctcatccgaccctgatgccagcgcctttccctcaggcgcccttagcaccattccatgcccaggggcaagctgcagggcagaagctgatgatgccctttgtcagctatccggggtacccaatgtggcagttcatgccgccatcagaagttgacacctcgaaggacagcgaagcgtgccctcctgttgcgtaattgcttcggtcgactggccacgcttgcaccatgtgaattaatcacaactgaagcccccccctagtcgttgatccattgattgggtataactatttgttcttatgtggtagttcattggtaacgaagtaaagctgctgatgtaagcgtcctactatatagaggctactactgctgccccttcaatggctgtacaatttttgtggagaaaagaagaatgttcgttcttgttctccatagcaacaatgtgacgctatctatatgtcatatatattc

SEQ ID NO: 13833 - DNA, 815 bp, Sorghum bicolor
  Predicted polypeptide sequence is orthologous to G791
agcgctctcccggtaccggctcgttctcgacctctcgtctcgctctcgcccgcccgctcgaccgaccgaccccgcggaaccctagcctcgcctagactttccccgaccgcgaatcccccccggccgccgcgacgatggactgcgccgtaggcggagaccccgtggaggacttcctcctcggcggcgccggcgacgacggggatctcgccatcttctgcgacggaggacttgggattgagggtgtcaatggagatgcttgtggatttgaccaatctaatttagggaaaaggggtagagatgagccatcttcatctggtccaaaatccaaagcttgtcgtgaaaaaatgaggagggacaagctgaatgacaggtttctggaattaagttcagttatgaatcctggtaaacaagcaaagttggacaaagcaaacatcttgagtgatgcagcccgtatggtggcacaacttagaggtgaggcagaaaagcttaaagaatcaaatgagaagctgcgggagaatatcaaggaccttaaggaggagaagaatgagctccgtgaagagaaagtgagactgaaggtagaaaaggataggctggagcagcaagtcaaagctatgagtgtagctcctacaggatatgttccccatctccctcatcctgcttcataccatcccgctgcttttactccatttgtgccgccacagcaagctccagccaacaaaagtgctccaatccctgcagcattccctgggatggcaatgtggcagtggttgcctccaaccatcgtggacacaactcaagatccaaagctctggccg

SEQ ID NO: 13834 - DNA, 759 bp, Sorghum bicolor
  Predicted polypeptide sequence is orthologous to G791
gagtccagcgcaccacctggcaccaaggcttgccgtgagaagctccggcgagacaggctcaacgaaaggttcaacgagctctgcgccatcttggagcccggcaagccaccaaaggctgacaaagttgccattctaagcgacgctgcccgtcttctgaaccagctgcgtaccgaggcccagaagcttaagcaatcaaatgaatcactccaggactccatcaagagtctcaaggctgagaagtctgagctgcgagatgagaagacgaggctcaaggccgagagggagaggctggagcagatgctcaagggcgtcagccacgccgcagtggcggctccagcgcccttcgtcccgcaccctgctgctgcagccgccgctccatctttccacccggcggcggcgtttgctcaggctggtaagttcgtgccgtaccccagctacccgccgccggctgcgttctggcagtggataccgccgacgtccctcgacacgaccaaggaccccgcacactggccgccggtcgcctagtcgatctacctaccagctcgccatggcatcattgatcggtgatgcgttgcccgccgtgtgtactgagcttcttgctgtgtcgtatagaatttgaccaaagcatgcctggagaacaacttcgggtgctgattgtgtagcagtgtgttatgcttgtggacgtggcgtgctaaaattcaggcgatcaaggccgattggataagtctatgtaacagccataatgtaaagcaatgaagg

SEQ ID NO: 13835 - DNA, 794 bp, Sorghum bicolor
  Predicted polypeptide sequence is orthologous to G805
ctcttctccttcctctggccatcgtcctcgctgcaacgcactagatttgtcgacgaacccaaccagaactccataaaatagtgtcgatcaccacgagcacacacctccgtccctccctctccctctttctctctctctctctctctgtctctgaaaaaaaaattgcctccaacggcaagcaccacaagcacaagctctcgcttccttgatctcactctttcgctagctcttgctagctccaacgccgccgccgacggcgctgccgagcctccatcgccccacgtcatcactccaaatcaggtcagcagtcccacaagaacagttcgtaggtcagcaaatccattactagtaccgatattcctccagctccctgaagagaaaacaccatctttggtatataccatggtctaatcggctatggacgtcaccggagatgccagcggaggtcgccgccccaacttccctttgcagcttctggagaagaagaaggaggaacagccttgctccacgtccccagcagctgttgtgggtgctggggctaatgggtcggcggggtcgggagagatgctgcagatggagaaggtggcgccgccaaagcgcacatcgaccaaggaccggcacacgaaggtggacgggcgcgggcggcgcatccggatgccggcgatttgcgcagctcgggtgttccagctgacgagggagttggggcacaagacggacggcgagacgatcgagtggctgctgcagcaggcggagcccgcggtgatcgcggccacgggcaccggcaccatcccggc

SEQ ID NO: 13836 - DNA, 814 bp, Sorghum bicolor
  Predicted polypeptide sequence is orthologous to G805
gctccgctaccccgccttcatccatcaacccgtcttctctctcatcatatcatatgagcaaggattctttccaacctacaatcttctttccctgatagctagccagccagccagctctttcttggactctctctctctaccaccacacctaaccttctcggagctagacccacagcaagagagaagacgctggagacatcaaatccgttcctccactctcttccaaacaactaaaccgctccatttacgcggccggctagaaaacatacacgccaagatacatacttctgtcgatgtgtatatataccatggcttaattgaccatggacgtcgccggtgacggcggaggcggccgccgccccaactttcccctgcagctccttgagaagaaagaggagcagccgtgctccagctcggctgcggtgggcacgtcggcgggaggcaacgggaatggatcgggggccggaggagagatgcaggtgcggaaggcggcgcccaagcggagctccaccaaggaccggcacaccaaggtggaaggcagggggcgccgcatccggatgccagcgctgtgtgcggcccgggtgttccagctgacgcgagagctcgggcacaagacggacggcgagaccatcgagtggctgctgcagcaggccgagccggcggtgatcgcggccacaggcaccggtaccatcccggccaacttcacctccctcaacatctccctccgctcctcgggctcctcgttctcagcgccggcccacctccgcgccgccttgcctagccccgccgccgccgcacggttcggccgtgctga

SEQ ID NO: 13837 - DNA, 577 bp, Sorghum bicolor
  misc_feature (540)..(540): n is a, c, g, or t
  Predicted polypeptide sequence is orthologous to G811
gggagaaaatctgttttgccctgttttactatggatttctgcaagaaccgaaaaggctaaaactttgtacatacaggacgggttccgcaaggttgatccggaccggtgggagttcgcgcacgcgtcgttcctgcgcggccagacccacctcctgcgcaacatcgtccgccgcggcagcagcggcagcgccggaggcggaggcggaggcggcggcggcaagaggaaggacgcaccagcgtcggtcaaccccgtcgagccttccgcggaggacatcgccatggtggccacggaggtggtgcgcctcaagcaggagcagcgcaccatcgacgaccgcgtcgccgccatgtggcgccgcgtgcaggagacggagcgcaggcccaagcagatgctggctttcctcctcaaggtcgtcggcgaccgcgacaggctgcaccgcctcgtcggcgacggcggcaccgccgccgcgccggggccagataataacgggttcgcctccgggggcgccgccgccgccgaggagggcggcgagaagcgggccangctgctgctcgacggtgacaacatggtggcgctcggc

SEQ ID NO: 13838 - DNA, 220 bp, Sorghum bicolor
  Predicted polypeptide sequence is orthologous to G811
gcacgagctgccctcctacttcaagcaccgcaacttcgccagcttcgtccggcagctcaacacctacgggttcaggaaggtggacacggaccggtgggagttcgcgcacgagtcgttcctccggggccaggcgcacctgctgccgctggtcgtgcgcaagaagaagaagaagaaggcggccggcggctgccgggagcagctgtgcgaggagggggaggag

SEQ ID NO: 13839 - DNA, 627 bp, Sorghum bicolor
  Predicted polypeptide sequence is orthologous to G831, G1202
gcacgagggtatcctaaggcctggaggttattggattttgtctggaccaccaatcaactggaagaaacactggaaggggtgggacaggactaaagaagacctggatgcagagcagaaagccattgagtcagttgccaagagcctctgctggaagaagatcaaggaggagggcgacattgcaatctggcagaagcctactaaccacattcattgcaaggccatccacaaagttatcaagtccccgcccttctgttctaaccaaaacccagatgctgcctggtatgacaagatggaagcgtgtataactccactcccagaggtcagtgacttgaaggaggttgccggcggtgcgttgaagaaatggccggagaggctaactgcagtgccgccccggattgccagtggcagcatcgagggggtcacggaagagatgtttgtggaagatactgagttatggaagaagagagttgggcactacaagtccgtgattgctcaactcggccagaaaggccggtaccgcaacttactggatatgaatgcaaagtttggcggcttcgctgcggcattggtaaatgaccccttgtgggtcatgaacatggtccctactgtggggaactcaacaaccct

SEQ ID NO: 13840 - DNA, 708 bp, Sorghum bicolor
  Predicted polypeptide sequence is orthologous to G831, G1202
gaatgcaaagtttggcggcttcgctgcggcattggtaaatgaccccttgtgggtcatgaacatggtccctactgtggggaactcaacaacccttggggttatatacgagcgtggcctcattgggagctaccaggactggtgtgagggcatgtccacttacccccggacctacgacctcattcatgcagattcagtgttcacactgtacaatggcagatgtgaggcggagaacattctgctcgaaatggacagaattctgaggcctgagggcacggtcatcatcagagatgacgtggatctgttagtgaagataaagagcatcacggacgggatgagatggaatagccagatcgtggatcacgaagatggtccgctcgtccgcgagaagctcctccttgttgtgaagacatactggactctcgatgacaacaaacaatagcaataacgtggaataaaagagttagaatgattattgacatgatcggcaaatcttgtgactgcctcaccgtttgccctgtgaatctggtggagtttgttttctattttcattttgggtattcattttggggggatagttcacataatggagatataatctccttgtgttaagatataagagggaaacccggcacagattttgacataaaaaacagacattgggcaaagtggggtaaatagaaagtacaatattgggatcattttcgtctc

SEQ ID NO: 13841 - DNA, 670 bp, Sorghum bicolor
  Predicted polypeptide sequence is orthologous to G839, G1196
tgatcttcacatgaagcttctctacctggaaaacagagttgcatttgctagattgttctttcctgctgaagccaaggtcgctatgcaaattgcacaagcagacaccacagaagaattcggcggtatagttgcagcaagtacttctggtaaactgagggaggtcgaccttaatgagacgccagtcacacaaaacaaaagactccgttcaagggtagatgcactgatgaaaacagtggagctgggccgtcggtacttcccgaactgctcgcaggtgctggacaaattcctggaggacgacctgccggacgggcttgaccagttctacctccagaggggcactgctgacgagcagaaggtgaagaggatgcgcttctgtgagctgaaggaggacgtgctgaaggcttttagcaaggacaaggcggacagcagcatgctctcgggcctgtcttcgtcctcgtcgtgctcgccaccccagaaatcggccaagaggtgatcaacggactagtttttgccgtatactagttcgtaatcacggtcttggagacttgaatccggacagcatatagggacatgtacacctatgtatgtatagtgcttacaaatggtgtaagtagaagtgtagaactacatataggaaagaaacaggcaagaacaccgtgcaaaaagataa

SEQ ID NO: 13842 - DNA, 569 bp, Sorghum bicolor
  Predicted polypeptide sequence is orthologous to G839, G1196
gcacgaggctgatcatgacaagagggtcagaaacatcctcaaggccttggattctgacgatgttgatcttgttggcctgctgttaaaggagtcgacggtgaccttggatgatgcgtttgcgatacactatgctgcagcctactgtgagcccaaagtgtttgcggaattgctgaaactggattctgctaacgtgaatcggaagagtaatagtgggtatacaccactgcatatagcttgcatgaggagagaaccagacatcattctttcgcttgtggagaggggagcctctgtgctggagaggaccctagatgggcgtgatgctcttactatctgcaagagactaacaagagagaaagactgcaataggaagttggagaagtacgaggagaaaagtaaggcttacttgtgtatcgacatactggagcaagaacttaagaggaaatcctttattttggacccgatctctatagaggagtccattgccacacctttgttggttgataattttcacatgaggctcataaacttggtaaacagagttgcgtttgcacgaatattcttcccttcgg

SEQ ID NO: 13843 - DNA, 652 bp, Sorghum bicolor
  misc_feature (638)..(638): n is a, c, g, or t
  Predicted polypeptide sequence is orthologous to G839, G1196
ttgagctagggagacgatacttcccacattgttcagacgttcttgacaagttcctcaacgaagaatccactgatctgatcttccttgaaactgggactccagaggatcagcgagtcaagagaatgcgcttttctgaactcaaagaggacgtgcgcaaggcattcacaaaagataaggctgcagtggcagccatagcttcctcagcatcctcgtcttcatctccgaggtgtgaggggaggggtagatccaataggaaattgaggccatctcggtgatatcagtagttgaggcgcaatctgttcagtagtcaggacacatgactctgaggaccgcggtgaaggacggctttgtagtatgttgttttgacgacgtgtagcacagtgaagcgattgggcccagcctgacgagaattcccagtagctgttgtgttttgacatgtaacactgtttcagtagataatttccacgtgctgatcgtcatctttgcaggcactacttgtcttgcttgttaaaactgcttttggggtgggaagtagaacattggtgctattgtgctaatgtatctggatcctctcaaaggaaatagttgtgtgcctgtcgatatgtaaaaggatatacgtccttatagaaaccagaagnttattgcagacaaa

SEQ ID NO: 13844 - DNA, 664 bp, Sorghum bicolor
  misc_feature (508)..(508): n is a, c, g, or t
  Predicted polypeptide sequence is orthologous to G849
aaaaagaaactgttgggccaccgccgcgctaggccaggtgctgaggctttccttggtttcttcgccggcgacgagcacccaccaggtgtacacccatgtccctttactggatccgcccctgtaggtgctgatatactgaaatcaacatatgatggtgcgcaagagattggtttatagatcccgtggccgtcgaattccaactatgccacgtgttccaaattcagctcggggaaaacgctctaccacaagaaacaaagatgagaatgatatgtgtgcatttgatttgctcgcaactgtagcaggaaacttattagcatatcaggacaattcatcgaatgttcctaataccaatgcagcaaaagctaaaaaaaggaaatcatttaaggaagaacacttcgacgaaattctgcctctaaaagatgtggctatggagaaagatgtgggttctgggagtgtcagtgcctttcctaggctagctaacaactgcttggcagaaaactcgtcgacnagaaatgaagctgaatcaatattagagtcactaacaatgaaatcagatatgttagcaaaaattcctgagtgtggatctcatggaatacaccatccaggaccctccagatcagtagagcctgaacaagtgcagaaagctgaacctaaagtgatcaga

SEQ ID NO: 13845 - DNA, 649 bp, Sorghum bicolor
  Predicted polypeptide sequence is orthologous to G852, G2633
gtgaagggcctgtcgcccaaggtgctcacgctggtggagcaggagtccaacaccaacacggcccccttcgcgcagcggttcgcggagacgctggactactatactgccatcttcgagtccatcgacctggcgctgccgagggacgacagggagcggatcaacatcgagcagcactgcttggctcgggagatcgtgaacctggtggcctgcgagggcgaggaacgggtggaacggcacgaggtgttcggcaagtggaaggcgcggctgatgatggccgggttcaggccgtccccgctcagcgcgctggtcaacgccaccatcaagacgctgctgcagagctactcgccggactacaagctcgccgagagggacggcgtgctctacctcgggtggaagaacaggcccctgattgtctcgtcggcatggcactagacattagtgttgacttcagagaatgttgatctgatgggagaatgtttcttgtaactttctaagaacctcgtagtagtttagatatgtttggctgagcactaaaactatatataggaagcctgtagtgatactgagtcggagtagaacacctatagcctgatgctgtgatggcagtcactaccagcctgataatgtgtagtagtaagtttgggtatat

SEQ ID NO: 13846 - DNA, 666 bp, Sorghum bicolor
  Predicted polypeptide sequence is orthologous to G852, G2633
cttgcaatggctgggtttagaccatacccgttaagtccagtggtgaacagaaccatcaaaacactgctcgacagttaccacagctattacaggcttgaggagagagatggcatcctttatcttggctggaagaacagaaagctggtcgtatcttctgcctggtgctgatatttccattttttttgaagaagctttgttaaggtgctttcgcggctttgtgttcagcacatgaatccaaaggtggaacctaaacttaaatatgatgactaaacaatcataaacaagctggttgcttccttactgtttgttgcccagctttgcaactctcccatgctcaccatcatctcggactagctggttcatctctgatgtacttaccatatgactcagttccatccttatataggtgcaaacagtagtttcatcaccctcttgtactggtcttaatacttaccatatgactcagttccatccttatatgttgctagaatctggtatcagcttccgaatctggactgctgaatcatgtatgttccatttagccaggatttgatagtaggcacaaggagtgccattagattgtgtatgtacaacctgcttcagttggtgtattgtacgtacttatacagtctgggtgatttactttggtactatgactggttttgt

SEQ ID NO: 13847 - DNA, 864 bp, Sorghum bicolor
  Predicted polypeptide sequence is orthologous to G852
gccctcgtcgtctcccacctcgctcggctcctcttcttcgcctgttctgctccgcgccctcaccctccgcagccagtttgctcgctcgctcgccgccgcgcgctgagccttctccacccttcttcctccaagtcctccgcagattggaccgcggcccgctgctgccccgtcggcggccccccgcaccgccccgatcatatcctcgcaggtgaattgttcaggctgaattaatcggtggaagctgtgcattggctgtttttatctcagatcatagtgataaattgacctgagagactgagatttgtgagagaagtaatgtctttcgttaggcaagcagacccatcaacatcctgtacggagaccacttacatccacaaatttgtgccaccaggatcagttttcccagcacaaagatttgtctctggcaccgacttggttcactacggacctcaaccatataatgctgagggctacaaacagtctgctttcaatgggacagtacctcatgaatttcagaacttttacagtactgatagctatgctgaatctcactttaatgaagcaacatattctccagcaatctccaatatatctcagcagaactctcaatctttatcagacaatcagacctctgatcttgaagtagagtttgatgaggatgagatgagactgaagcttcaggagcttgagcatgctttactcgatgatggcgatgagatcttttctgacttctcagggagcattatcgatgagtggaatgatagcattaagaaaaacaatgaatggagcaataccatgaaggatattgtgagtccagactctccaaaagagtcatcacctgagtcaagcctctgctgtcttgac

SEQ ID NO: 13848 - DNA, 824 bp, Sorghum bicolor
  Predicted polypeptide sequence is orthologous to G861, G1140
tcgccagcaccagcatgaagcaggtaatcgatcggtacgactcccattccaagaatctccaaaagtctgaagcgccgtctcagctgcagtcacatattgatgatggcacttgtgcaaggctaaagcaggagcttgctgaaaccagccttaagctcaggcagatgagaggagaggagctccagaggctgagcgtccaacagctgcaagagcttgagaagaccctcgaatctggcctcggctctgtactcaaaaccaagagccaaaaaatccttgacgagatcagcggtctggaaagaaagagaatggaactgatcgaggagaattcaaggctgaaggagcaagtgacccggatggcaaggatggagacgcagcttggcgtcgattcagaaattgtgtatgaggaagggcagtcatctgaatctgtgacaaacacatcctatccgcgcccatcaacagacactgacgactgctccgatacatcgctcaggctagggctaccattcttcagctcgaagtgatggaaaatcaggaaacttgacatgttcagtagcggagcggtgctgattacttgccctctccgttctggattggggagcaggattgctggattagtgaccaacgcgtcgcatcaaaataaggcattctgagtgctgtatgatgtgtgtattctgaaagtgagactgcttttgttatatacaggcagcatggtaataatacaacgggtacccgctaggatgctacctgcagtccgtgttctgtcctctgttttttagtactcgtataatccccctgcaaaccatgtttacctgcagctcatgctttgt

SEQ ID NO: 13849 - DNA, 793 bp, Sorghum bicolor
  misc_feature (733)..(733): n is a, c, g, or t
  Predicted polypeptide sequence is orthologous to G861, G1140
ctactggcccttttcttgccttcgcctttcctctcgctcccctcctctcctttcgcatccccatcgcatcacaccacgactccacaccgccggttggcttcgctgctccgacctcgatcttccacctcccgcctccgcctcgtgaagcgcgtggggactgggcctctggggttcgcctctcggcgcggcggccgagtgcctgcgtcctctacggagagggatcggcggcggggatggcgagggagcggcgggagataaagaggatagagagcgcggcggcgcggcaggtcacgttctccaagcgccgccgcggcctcttcaagaaggccgaggagctctccgtgctgtgcgatgccgacgtcgcgctcatcgtcttctcctccacggggaagctctcccagttcgccagctccagtatgaatgagatcattgacaagtacaacacacattctaaaaacctggggaaagcagaagagccttctcttgacttgaacttagaacatagcaaatacgcaaatttgaacgagcaacttgtggaagcaagccttagactcaggcagatgagaggtgaagaacttgagggattgagtgttgaagaactccagcaattggagaagaacctggaaactggtctgcacagggtgcttcaaacaaaggatcaacaattcttggaacagatcagcgaccttgaacggaagagtacacagctggcagaggagaacatgcaactgangaatcaagtatcccagatacctccagctggcaaacaagcagttgctgatactgaaaatgt

SEQ ID NO: 13850 - DNA, 579 bp, Sorghum bicolor
  Predicted polypeptide sequence is orthologous to G866, G883
tggacctcacaatccccacaacccaagaaagcagcagcagcagcagcaccaccaccaccaccaccgcgcggatctgacctccaactccaagcagcagcagagcagagcaggggcaagccatggcggtggacctgatgtcgtcctgcggcggccgggccggggcgtacgagcagctggcgttccaggaggcggccgcggcggggctgcgcagcctggagctgctggcttcgtcgctgtcgtccccgtgcggagcggggcagcgggccgagtcgccgccgctcgggcagatcgcggaccaggccgtgtcccgcttccgccgcgtcatcaacctgctggaccgcacggggcacgcccgcttccgccgcgcgcccgtcgccgcggtggagacggagacgacgctccaggccgcggtggaggagccgcagccgcctcagaagaaggccgccctgacgctggacttcaccaagccggtcccggtcccggcggcggcggcgaccaagccggcagcgccggcgccggcgccggccgtgtccggtacctcgacctcgttcctgtcgtccgtgaccgcgggcggcggcg

SEQ ID NO: 13851 - DNA, 815 bp, Sorghum bicolor
  Predicted polypeptide sequence is orthologous to G866, G883
atctcctcagactcaagagagccccaagccaagatctgcgcgggcaagtcaccggcgaagcaccggctcccatggccgtggacctgatgggctgctacgccccgcgccgcgccgacgaccagctcgccatccaggaggcggcggcggaaagtctccgcagcctggagctcctggtgtcgtccctgtccacccaggccggcgcgccgcacagggccgctcaccacctgcagcagcagcagccgttcggcgagatcgccgaccaggccgtctccaagttccgcaaggtcatctccatcctggaccgcaccggccacgcccgcttccgccgcgggcccgtcgagtccccgccgcgggcggccgcggcgcctccggtccccgctcccgctccggctctctccctggctccgttggctcacgtggcgcccgtcagcgcggcgcagccggcgccggcttcccagccgccgcagagcctgacgctggacttcacgaagcctaacctgaccatgtcgggcgccacgtccgtcacctccacgtcgttcttctcctccgtcacggccggcgagggcagcgtctccaagggccggagcctgatgtcctccggcaagccgccgctgtccggccacaagcggaagccctgcgccggcgcgcactccgaggccaccaccaacggcggccgctgccactgctccaagagaaggaaaaaccgcgtgaagaggaccatcagagtgccggcgatcagctcgaagatcgccgacatcccgccggacgagtactcgtggaggaagtacggccagatgcccatcaagggctcccct

SEQ ID NO: 13852 - DNA, 644 bp, Sorghum bicolor
  Predicted polypeptide sequence is orthologous to G878, G884
tcattttcaactcctttttcaaacgaattttccctttcactgtctttgtatccataggaccccagttgaccatgtgattcaacaattcagatgatgggaaattagtgataaagacatttgtgcccttctcctcaattactcacttgtttttgcctggctatgactcgtcaacttcacagggaattgctccaaaaggtcagttccaagatgtgcacagcggagctcttgaaacaaaactgtctggctctcttactacaactgagattgctgacacgtctgttatggaatctatggatgtctcatcaacactctcctccaatgagaagggtgatagggccatgaatggtgccgttccttcaaccaatgacatgaacgaagacgagactgaatctaaaagaaggtttggaccttgttaccaaccaagtacataattataactaccatactagtcaacgaattctcatttgttcctttgactcttctccaggaaaatgggaggtttctgtcgctagtaacactgccaacattgtcactgatatggcagctatggcatcaaggactgcccggggagcctcggattgttgtgcaaacaacaagtgaggtcgacatccttgacgatggctaccgctggcgcaagtatggac

SEQ ID NO: 13853 - DNA, 611 bp, Sorghum bicolor
  Predicted polypeptide sequence is orthologous to G881
ccgaggccgcccgcaccggcgcccgcaccggcgccgcaccgcccgcagctgcagctgctgcagcaagagggtgtcgcgatgaacgttgagcagcccgtggccgcggcggcgtcggagatgatccggcgcaacctcgcggagcagatggcgatgacgctgacaagggaccccagcttcaaggcggcgctcgtcaccgcgctgtccggccggatcctcgagctgtcgcctaccaaggattgacagacgcatcggatcggatcggttcgattggcatcacatacacgagattcttgctcagattgtcgtgcacccacgcagcaatcgtcaacaactgcgctggctgctttctctgttcatcgctgttagagcaaaacagcgataacagaacaagacatcaggatctgtagtgctgcacgaggaagaggaacaaccggagtccatggaagggagcagagatcattacgccgggtggtcgacgatgtaacatgcgaaatagtagcacaggacatgttagcatgaaattgtacaatccctagtactttgtagttgtaggcgaactgttcatccaattgatcaaatgaaatcattacaatttttttgagtttgaattg

SEQ ID NO: 13854 - DNA, 659 bp, Sorghum bicolor
  misc_feature (610)..(610): n is a, c, g, or t
  Predicted polypeptide sequence is orthologous to G896
gcagctgcaccattcttttcgacgaaggaaacggcaacgcgaccccagggccgcgggcgctgacgcgctgtgctgcgttttttttccccatcgagacaacaagacgaggccagccacgcgcaaaccgaatccaccaacgccaaacgaccgcatcaagtcaccaaccaatccacttcgccggcgagcggcgatccgtctcatctcgtcgcgtctccggcgccgacagccacgggcaactcggctccgagatcggcgggcaggatgatgatgctgatcgactgctcggggtgccgtaccccgctgcagctgccgcacggggctccctgcatccggtgcgccatctgtggggccgtcacgcacgtcgcccccgcccctcccgccgaccccaaccgcggcgccgtacagcaggcgccgggatgggggccgccgccgccgccggtgcacgggcggaagcgcgccgtggtgtgcgggatctcgtatcggtactcgcggcatgagctcaagggctgcatcaacgacgccaagtgcatgcggcacctgctcatgacgcgcttcaacttccccgacgactccatcatcatgctcaacgaagaacaaaccgacccctacnaaatcccaacaaagcataacataaggatggccatgtattggcttgtcca

SEQ ID NO: 13855 - DNA, 665 bp, Sorghum bicolor
  Predicted polypeptide sequence is orthologous to G896
cattgatgcttgtcatagtgggactgcacttgatttgccttacctctgcagaatgagcaggagtggtcaatatgtatgggaagatcaccgacccacgatctggtgtctggaaaggcactagtggtggggaggctatttcatttagtggttgtgatgatgatcagacctctgcagatacctctgctttgtcaaagatcacttcgactggtgcaatgacattctgcttcatccaagctattgaacgtggacagggcaccacctacggtagtatcttgaactccatgcgttcgacaatacgcaacacaggtgactcagcgggtgtcggtggtggtgctgttacatcactaattacaatgcttcttactggagggagcctttctgctggtggtctgagacaggagccacaactgacggcgtgcgagacatttgatgtctatgcgaagcccttctccctatgacgcgttcatggtattgcccaatgtattatatagcacctcccgtttcacgttatcatcgtacatttcactgttagatgtcctccatccatcgcgattgttaacaacgcgtgggattgccctttattcccatgccctcgcaatgttcagtgcacagttgtaaaaggagaatgcactttgacggctcagttcacttgtcttataaaccgt

SEQ ID NO: 13856 - DNA, 844 bp, Sorghum bicolor
  Predicted polypeptide sequence is orthologous to G896
cctactaacaaacgcaaggcaggtgccccagctcgctccgggcttagttagcagccaggcagccatgaacttcggcggaaatggcaacgcgacgacgatccggtgcaagtactgcagcgcgtgcctgaccgtgatccccggcgagcgcgccatccagtgcgcgcaatgcaactgcgtgacgcgcatccggcgcggcgaccgcatcccgccggcgcggccgccggcgcacgtgccgccggcgttccagcgcgcccgcggcaagaagcgcgccgtcctgatcggcatcacctacgccggcatgcgccgcgggtgcggcgagctcagggggcccatcaacgacgtcaagtgcatgaggaacctcctctgccagcgcttcggcttccccagcgagtgcatcatcatgctcaccgatgaccagagggatccgttcaggctgccgaccaaggagaacatccggatggcgatgcactggctggtgcagggctgcagctacggcgactccctggtgttccacttctccgggctgggcgcgcaggtggccgacgacgacggcgacgaggcggacgggtacgacgaggccatctgcccgctggacgcgttccagaggggccccatcctggacgacgagatcaacgaggccatcgtgcgcccgctggtgcacggcgtcaggctgcacgccgtggtggacgcctgctacagcgccacggtgctggacctcccctacgtgtgccacatgtccaggaacgggttctggcagtgggaggccgagagccccccgtcgggcgcctggaagggcaccagcggcggccacgccgtgctcatcagcggctacagcgagggcaaa

SEQ ID NO: 13857 - DNA, 805 bp, Sorghum bicolor
  Predicted polypeptide sequence is orthologous to G896
taccgagcgagggagctctgagctagctagcaacgcgtagcaactcggccggctagtagcttggatcgccatgaacatgggcggcaggaccccggcggcggcgacgacgacgatccggtgcaagtactgcagcgcgtgcctcaccgtgtgccccggcgagcgcgccgtccagtgcacgcaatgctgcggcgtcacgcgcatccggcggtccttgtcctcgcggatcccgctgccgccggcgatgacgaggccggcggcgcccatgggcgccttcccgtgctcccgcggcaagaagcgcgccgtcctgatcggcatctcgtacgccagcgtgcgccggggctgcggccagctgaggggacccatcaacgacgtcaagtgcatgaggcagctcctctgccagcgcttcgccttccccagcgactccatcatcatgctcactgatgagcagaaggacccgttgaggctgccgaccaaggacaacatccggatggcgatgcgatggctggtgcaggggtgcagcagcggcgactccctggtgttccatttctccgggcgaggctcgcaggtcgccgacgaggactgcgacgagctggacgggtacgacgaggccatctgcccgctggactcgttcgacaagggccccatcctggacgacgagatcaacgagaccatcgtccgcccgctggtgtacggcgccaagctccacgccgtcgtcgacgcctgccacagcgccaccgtcctcgacctccccttcctctgcaacatgtccaggaccgggaactggcagtgggaggatcaccgtccc

SEQ ID NO: 13858 - DNA, 747 bp, Sorghum bicolor
  Predicted polypeptide sequence is orthologous to G898
acttcaaagctagatagatgacctacttgtgtactttcagctatttagtgtgcataaggttcttgttaatgctcaatcctagcttacagataatgttatttatggaactttgtcctttcagtggcttgttttaaattcatattttccttggccaaccaagtcttggaacacatgcttacatattattatggtgtgatatgggtatgttcacgttcttgctagctgccagcatttaatatctatgattattcaaatgctgtcattgtaaacttctagcatcatgttatgttctgtaatgtaggtgatattgactcactggcttgctattttactattctggagtacatttcgaagatttcagcaaaaaggctgccctgtgtttgatgcttgtcccaattgcttttacattgctcttggcattgaactctaactatgagtttctattcgatagtcaaatgccgtacaaaccggcaaagagcctgccaaggaggtccccaaggaaacatttttcacctgcccaatatgttggaataagatggaggagccttccacaacgacttgtggccatgtcttctgcgacacatgcatcaagcaggccatcaagattcagaagaaatgccctacttgcaggaaggggctgaaaatgaatagtgctcatcgcatttaccttccgaaagcttctagttaaggttgattggccttatcaaagaaacttctggtaacataaggctgtgcaatatacagtta

SEQ ID NO: 13859 - DNA, 750 bp, Sorghum bicolor
  Predicted polypeptide sequence is orthologous to G898
agcagtacgccaccggctactgatgaacctcgcattggcatgcttagttgccccatcgatgtggaagccatcgatgatgatgttgttatctattcttcaagttcactccctcaagcaagacaacagtcgaccaggacagcagttgtgataatagatgatgattctgaaacaaacccagaaccagcaggggatgctcttcatgagcatgtgaacacactgctatctctgggcataaaccgtaggcacgagcctccgagagcaaccaacgcccgccctgtaataagtatagtggacacaccagaagtcaacaccttcaaggcaccccctgaacctgtgaaggaggtcccgaaggaaccaaagttcagctgcccaatctgcatgaatgagctaactgaagcagcgtccaccgtctgcggccacattttctgccagaagtgcatcaaggctgccattcaggcccagaagaagtgccccacctgccggaggaggcttactccaagccagcagcaccgggtgtacctcccattgactgagtagcccagtgcagtcgttttgctacaagttctgcagcgcctcacctttttcatcccatcgtgggcttgtggcgggtgtactttggaggtatttaggggcttatcattagcatagagtattacagggaattaacaagtggttttgccctcggcattcaaggctggatcatcagtaaagtatatcctagcatcaacatcatcagaatgttggtgtttg

SEQ ID NO: 13860 - DNA, 708 bp, Sorghum bicolor
  Predicted polypeptide sequence is orthologous to G904
tctgcgcaaagcaagaaccaagaaaccagagaggcgagacgaccaagaaacgagagaggcgagacgagagaccaagaagctcttctcctccgcgctcgccgatgggagcggtgagcagttcgctgctccggcgcggagcaggggcggcggtccgagctccgccgatctctctcgcttcacggccagaggccgcagccccgccggcgccagtcctctccggggccgcgcatctggtctttgaggcctcgctcgcctgtccgtggaactgggatcccaaagctcccggcgccctctccgacgggaacttcgttctgaacctggatggggcggcggtgatgcgtaggcggctccagttcggcctcttcgtcgccatgaacgagctcgcggacggggagggggccgcggtgcggaggctacagatctgcacgagggcagagatagcggactggatcccctttgtaagacaggtgggcatactccgtgaaccccaagcttctgatgacggagattgtctcttttgtctcgaacctctcacgaaggatcgactgcgcagtctaccatgtggccacacgtttcatacgtcgtgcctagagtaccatttcatcaagaacagacttatggagaacagaggttttcgggctgcatgtccggtttgccgcgatgcggtaattcagtcagatttctaggactgttattgggctatatgtc

SEQ ID NO: 13861 - DNA, 762 bp, Sorghum bicolor
  Predicted polypeptide sequence is orthologous to G904
agttcggcgcctgcaactcgcagtgtcacccgacaacctcctcttcttctgctccgtcacggcgtcggtggccgccgccttcgccctcgtctcgctgtgcaggcacctggcgcaccggcgaccacagcaggagccctccgcgtacgacggcggcctcgcggcaagctcaggaggccgaggctccgccgagtcgtcagaagaagaagatcagctcctgccgctgagcgccgccgccgcggcgctccccccgttcatgtacaaccggctggtgaggcacagcggcaagggcgcgagctggacggagacggagtgcgcggtctgcctcggcgtcatccaggtgggcgccatggtgaagctgctcccggcgtgcagccatgtctaccaccgcgactgcatcgacctgtggctgtcgctgtcgtcgcgctccacgtgcccgctctgccggtgcagggttggtgctgcctcggtggccggcgccggccaggagacgacgacgcaccggcagcttgctcaagctcaaccttcccctgcatagatagataaaatcctcacgcgccggcatgtagcagatgtttgtactactaggccagtttcaccgctcactcgtctgtaaagaccaagctgccgcttgtgctgtatatactatgcgagtttgcatacagtttcattagaaacgtgagcatatttacatctcagctattaggggttcgtgatttattaagttgagattacggaaaaaaaccttgtttgtactgttgaaaa

SEQ ID NO: 13862 - DNA, 617 bp, Sorghum bicolor
  Predicted polypeptide sequence is orthologous to G911, G1113
aggtgcggcggctgggcaactgcacccacgcgttccacacgcgctgcatcgaccgctggatcgacctgggcgaggtgacgtgcccgctgtgccgctcccacctgctgccgcgtcgacgcgccggcatacttggcatgggcatggcacgcctcggctagtcgtccgtccgtgttcgtccctgattcattctcttgccacgtaagatacgtgcccgcgtggttggcttcaggccgcgcggccggtacgcgtacagatgccactggtgccggataggggcggaccaaccgcgaactgattgcgcgcgattaggacgacgatcgactaaccaccaccctgatgttgttgtgtcgatggatgggcgcaagacaaattaactggaggttggcataaagcatacttgacgcgatatattattgtgtgccggcgttggacgggcaacgctcttgtattattatatatcagaagaaaatcaagttacaaactgttttggcttcggggcgcaaccgtgcaaatgatgtccacgccggccagtaatttggtgcctgctctggtgtgtggagcgttcagcttcagagtattgtttaaatcattatttggaaaatcattcaaataaaaat

SEQ ID NO: 13863 - DNA, 958 bp, Sorghum bicolor
  Predicted polypeptide sequence is orthologous to G912, G2107, G2513
cacagctctagcaggaccgaccaaaggcacccgcaccatccgcggctcaagcaagcagagaagtgatcagaagagaagatgtgcccaatcaagaaggagatgaccggagagtcgagctccccctgcagctcagcctcgacctcttcggagcaccaccagacggtgtggacgtcgcgaccgaagcggcccgcggggcggaccaagttccgggagacgaggcacccggtgttccgcggcgtccggaggcggggcaacgccgggcggtgggtgtgcgaggtgcgcgtgccggggaggcgcggctgcaggctctggctcggcaccttcgacaccgcggacgccgcggcccgcgcgcacgacgccgccatgctcgccatcgccggcgcgggcgcctgcctcaacttcgccgactcggcctggctcctcgccgtgccggcctcgtacgccagcctcgccgaggtccgccacgccgtcgcggaggccgtggaggagttcctgctccgtgaggtggtccaagaggacgatgcgctttcggccacgtcctcgacgccgccgtcgtccccgtccagcagcgacgacggaagcacctctgatggcggggagtcctctgaatctgattcgtctccggccgccaccggggcctcgccgttcgaattggacgtgttcaatgacatgagctgggacctgtactacgcgagcttggcgcaggggatgctcgtggaaccaccgtccgcggtcaccgcgttcatggacgaaggcttcgccgatgtgccactatggagctactagagactctgaggccgttgtactctgaaattttcggtttctaaagcttggcctctaatggctagttttggcagtgtaacggttacttcatttggtaatgatgagacagaccaagtttgggaaaaaaaaaaaaaaaaaaaaaaaaaaaaaaaaaaaaaaaaaaaaaaaaaaaaaa

SEQ ID NO: 13864 - DNA, 1046 bp, Sorghum bicolor
  Predicted polypeptide sequence is orthologous to G912, G2107, G2513
caacattctagacaccactcgaacgatcgccacttcaccaccgccgccgccgaatccatggagtacggcgtcgccgacgactacgggtacgggtacggcgggtacgacgaccagcaggatctgccgtcgtcgtcgtccgtggacggtgacgagtacgcgacggtgctgtcggcgccgccgaagcgccccgcgggtcggaccaagttccgggagacgcgtcacccggtgtaccgcggcgtgcggcggcgcgggcccgcggggcggtgggtgtgcgaggtccgggagcccaacaagaagtcccgcatctggctcggcaccttcgccaccgccgaggccgccgcgcgcgcgcacgacgtcgccgcgctcgcgctccgcggccgagccgcctgcctcaacttcgccgactccgcgcgcctgctccgcgtcgaccccgccacgctcgccacccccgacgacatccgacgcgccgccatccagctcgccgaggactcctcttcctccacgccggacgcctccgccgccgccgctgccgtggccgtggcgtcatctgcctccgtcggccaggccacgccctcgtcgtccgcgtaccaggccggggacgacgccacgggggctgcaatgtatggcgccgagtacgcggcggcggcaatgtatggcgctggcatggacttcgaccactcgtattactacgacgggatggtgggcgggaacgagtggcagagcgccggcagcagcgggtggcatagcaacgtggacgccggcgacgacgaaggcgccggcgacatgtcgctctggagctattactgagctctgcactgcaccagcacaaattcaggtgctggggctggcgctgataggggcaggggagtctgaatttgaattcaaatgttcgtagtagtatacacgagggaacggcgaaagggcgcgcaagaatgcatttgccgttcttctgcctttttttttggtgggagagaataataaaagacctgcaactctgccaagagtttatactatttttttaaaacataaaaaaaaaaaaaaaaaaa

SEQ ID NO: 13865 - DNA, 844 bp, Sorghum bicolor
  Predicted polypeptide sequence is orthologous to G921
gtctcctgagtcctcctcctgaccccctcggcctcgacagctgcggagagacagacgcacacgccgcggtcatcgatgctgctcatggactcggcgcgccgcgccggctgctccccgtccccggtctgcttggacctcagcgtcggcctttcgccgtcgtcgccggggagcagcggcccggaaacgacagctgacactgacgacaggcttgaccgtcccgccgctggctgcagggtggcatcgtccctgtctgacgagcaggccaagaccctggaggccaagctcacccaggtcagcgaggagaaccgccggctcaccgagatgatcgcctacctgtacgccagccaggtcgcgcggcagagctccagctcccccgacaccaccagcaggaagaggagcagggacagcctggagccgccgtcgaattccagcgacggcaacgccaacgccaaggcggagcccggcgaccatgccgccgtcgagagcgccctcagcgacgagggcacgtgcaggcggatcaaggtcaccagggtctgcacccggatcgaccccgccgacgccacgctcaccgtcaaagacggctaccaatggcgaaagtacggccagaaggtgacccgcgacaacccgtccccgagagcctacttccgctgcgcatacgctccctcctgccccgtcaagaagaaggtgcagaggagcgcggaggacagctccttgctggtggcgacgtacgagggcgagcacaaccacccgagcccgacgcgcgccggcgagctccgcagctccgcctccgcgacggccagcggccccgtgccgtgctccatctccatcaactcctccggcccga

SEQ ID NO: 13866 - DNA, 745 bp, Sorghum bicolor
  Predicted polypeptide sequence is orthologous to G927
gattttaatatttgtatggagaaaatatttcctatcaccattgttctttatggaagctaaaggttgtggttgctgctgaacttgcatttgacgttcgaattttttagcaagtgtcccatcgtgcttatggtctacattttgctccctcataacaatattgttaccagctgcttgggttctttttctctatcgatattatcgttggtactcacaattccttgtgcatagttcctctttcttcaaatcaattgtccctaaagttccaatgccaacattctggttaagattctgctccctcatattttcaccggctgctttgtttcttttcttctattgaaatcgttgttgttactcacgattcattgcgcgtagttcctctttgttctgatcaatggccatcaatactacatatgcagaacctaattgaacctaataaaaaaatgaatttgaatttaagaaatgcttattttgactgacctttaatgaattcatggatgaggatggatatcaaatggtggtccacaaagattgtcagtagaggactccacaaagatcggtagaagaggaccaaccgaatctataatattgtacaggatagaagaggaccaacacaatctgtaatataggaagcagatgtagttcggttgaagaggacaccaactcaatctgtaatattgcatagaaagcagatatacgtgcacgtgagactgaacctgtgggattgcttgaattatgagtgaggatt

SEQ ID NO: 13867 - DNA, 746 bp, Sorghum bicolor
  Predicted polypeptide sequence is orthologous to G927, G1334
aatgctcctgcatcttgttcttgcccaacctggtacggtgcttgctatgctcactccactttttattttgctgctgctcttcattgtagcatactccagtagctgggtggtggttcggttaggtacggtgccctcacccacatccctcgtcaacgtcgccagcaccagcaccagcaaaaccagcaagatgatgagcttcaggagcaccacccacgatgggttcgtcggccacgccgccgtcaatggagccggagcgccggtgccgtggtgggcgggggccccgatgctgtgcggcgagccgttgggtctggggaggccggtggtggcggccttctcgccggaggaccactgccgggacggccgcttccaggtcctccagggaccgccgctggatcctctcgtgccgtcgctcaaggctcctgtcgcacaccagcaacagactgagaaggggctctctgctgagctcctcaacctctccgtggctcatcaaggtaaagggaagaaaggttctgagcactccgccactgttgctttgcaatcaccattcgcaatatacaatggtcgttttgagctgggccttggtcaatcaatgatttccgctgataactcttatgctgaccaacactatggcctgatttctccttacccaatgggggcaacgcctggaggtcgtatgcttataccactgaatatgccaacagaagcaccaatttatgtgaatgctaagcaatatgacgccattatgc

SEQ ID NO: 13868 - DNA, 727 bp, Sorghum bicolor
  Predicted polypeptide sequence is orthologous to G929, G2344
ctttttttttttttttttcgattgacacttatttttattttcattttgtacaatatctacataagcagaagtcaggtggctaattaagtcatacctgagctcaggcctttctactttacaagcattaaactaatcttatcctatccccgtgacccctattctttgtgctggtcgtgcacatccgcaacgctgtgttcaatctcggagtgcatgccgaccagttcagggtgcgcgagtggatcagcttgatggtgctcctcggtcatatgatcaggctgactcacgtggcctgcatcgtgacttgactcctcctgcgagcccttcttagagtcgtcgagatatgcttcactgtccgcgcccattgacgcgttgttgtcgcctgaagacgcctcgtcctcgccctcctcgccattcttcttgcgttgaaatcgaccgctcttgccgcgccgcctgtttgtggcgtgtttgtggcgagattcgtgtaaatatggcttgcgttgttttggcagtttgttttcttgttcgagtttagcgcgttgttgtcgtcgcttcagaatgcggtggtattgtttggcattgacgtataacggttcctctactacttcaggctgtgctactcgttgtgtatataaattgaggttcatatagttgtgtgccgcattttcctggatagatgtgacatccgcgtcagcaaaatcgaaataacgcaatgcacactccgggcacg

SEQ ID NO: 13869 - DNA, 773 bp, Sorghum bicolor
  Predicted polypeptide sequence is orthologous to G929, G2344
ttatgtaaatgccaagcagtaccatggtattttaagacgacggcagtcacgtgccaaggctgaacttgagaaaaaggtggtcaaagccagaaagccataccttcatgagtctcgtcatcagcacgcgatgaggagggcaagaggaaatgggggacgcttcctaaacacaaagaaaagtgacaatggtactcccaatggtagagctgagcctaagaaaggagatggtaactccgagcatctccatgtccctcctgacttactacagctacgacagaacggggcttgaagtagcgttctggctctggcatcctagaacagcagtttctgcccacaggcataggcatttgaaaccggactcgtagctccacagtatgcgcagccatatctgcggtaacgctcgttcacctgaatgagctttgtaccgaggtaggcatgcaatgcaatctgggcgcaggagtccatcaggtgtccaatgccatatgggtgtatgctgtttcaggcaattcattcttggctttcacgttccaccacccatgtgtagcgctagtgtgttgtaagtgaaactaagcttgtgctctgtattgggccgttcggcgaaactgtgaaacatctgtataattaagatcgaactctggattaactcggtagtgctttgtctggtttttcttttagcttttgaactgtaacacggccacagctgaactcatgttggctttgttcgttgctcagcaacgtcggtcttgtactcttgtactgagtattcatgtgcttgc

SEQ ID NO: 13870 - DNA, 738 bp, Sorghum bicolor
  Predicted polypeptide sequence is orthologous to G929, G2344
aatgccatattaagaaggcgtcaatcccgggctaaggctgaatcagaacggaagcttgtcaagggccgtaagccctatcttcatgagtcacggcatcagcatgccttgaaaagggccaggggagctggaggtcggtttctcaattcaaagtcagacgacaaggaagagaactccgactcaagtcacaaagagaaacagaacggagttgcgcccaacaatggccaaccgtcaacccctccgtctcccaacggtgcatcatcagctaatcaggcaggcagtcgtgaatgatgattcagaactcacaaccgaagagattttagcccctgacgctagatgtggcatcagttttgtacagtaagtgctagcgggcagcagcgggatggtgtcagtcggttgttgtaggacatgttccatagaaaaaacatagatgagtcgacaggttttggagtattggtctggtcctctgtttattcacctttctgtacaattttagtattattgtgccccttcccctggatagcttcggtcagcgcttaagaaagttaagtgtgtagcatattggcttattttttttgctttgcttggacttggagatttggtagtggagttcataaccctactgtcctgcatcatcattcgtggggcaaattataatactcctagctggctatgtgtatgttgatgacaataaaccctaatgtaggacatgtgaccacctcatctgaatctagctttgtt

SEQ ID NO: 13871 - DNA, 619 bp, Sorghum bicolor
  Predicted polypeptide sequence is orthologous to G938
aaaagaccaccgaaacacccaacggcggcctcgtgtatgctttcgcccattcctgctcgccccgtttctccccttccatcctgcttccttctctctttttttcactcccgatttccaaatctcaaacaataaataaccagaagagaagcgaatcttctcctccatcaacccagcaaatcgctcgttcgagcgtccattcgactgagaaattatcgtccgtcgcccccggctggctctcccgttcgccgccagggcccaatttcgtgtggacaggttgccgtgatcctttgctggatggggcagcgcagctagccacaagaggttgcctaggtttgagtttaatcgggttaccaaagtggtagttctcatggatcaacttgccatgcttgcgacggagctgggtgactcgtcggactttgaggtggagggcatccagaacctcactgagaatgatgtcagcgacgaggagattgagcccgaggacctggcgcggcgaatgtggaaggacagagtcaggctgaggaggatcaaggagcggcagcagaagctcgccctgcagcaggcagagctggagaaattgaggcccaagccgatatccgaccaggccatgcgcaagaag

SEQ ID NO: 13872 - DNA, 777 bp, Sorghum bicolor
  Predicted polypeptide sequence is orthologous to G938
caaccaacccaatcagtcattgaacaatctggatttcagcctgcccatggacgggcagaggtccatcgctgagctgatgaacatgtaggacaacaacttcatgacaaacaagaacctgagcagtgacagcgtcaccatcatggagaggcctaatgcgatgccccagaggatccagatggatgagggtttctttggacagggcaatggagtcttggacgatgtcaatagcatgatgcagcaacaacagcaggcaccagtgcagcagcagcagcagcagcagcagcagcagtttttcatccgtgatgacacgccatttgtgagccagatgggcgacatcaccagcacatgggagttcaggttcggttctggtttcaacatgtctagcaccgttgattacccaggcgcggggcagaagaacgatgggaccaattggttctactgaagaataagtttgtaggtctgaaaaacctcgtcataagctttggatttctccatggtgctccatggttctcgtaagttgtcaagtctataggtctttgtcatataggttttgcagtagctgcaagacggctggaacttggaactggtttatacttgtatgtccgtccagccataaaccttttatggaaacttaatgttattcctagttttaattgttagttccaatgctgttcatatatatggctgtcaaaatgcttgtgcttgtttctgtatgtgatgttgtactacctgttatttggtgtctgaatgaagtgttgtcttgagtaaattgtgctc

SEQ ID NO: 13873 - DNA, 698 bp, Sorghum bicolor
  Predicted polypeptide sequence is orthologous to G987
cctactgggtgattctctgtcctgtggccatatcgcaattgtcacgatcgatgcgacgcgactcacatcgaatcagtatcacagtaatcgtggaaccaaaaatcaacgaggagtcgtagtggaggtgaagatggctctcgtccttggtccttgttgcagcaggcggcaggcaaaccatggcattgcccccgcggtccgcagagaatcccgcgccgttccccacgcgtcaccgagggtaaacaaatcccccagttgacaaacagagcgctgcagcagcggtcctggcccagcgcgagaaaactcttttgctcttggaatcttgctgccgctgccccccaatcggcgccgctttcttcctagtctctgcaaggttccgcgcatcaccatcggagacttgggatggagggcaccgcgtcttcttggagccgcgactagggaagccgcggctattgatgaccacagaaactcaagtgagcatctgaaacagattaggaagcattcttctgctactggagatgctggccagagattggcgcactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgtttgcaata

SEQ ID NO: 13874 - DNA, 597 bp, Sorghum bicolor
  Predicted polypeptide sequence is orthologous to G987
gaggattgggaattcatctcagatgagtccctcaactatattagccggatgctcatggaggaggatatagatgagaaagtcagcatgtaccaggcggagtcagcggcactgcgtgctgctgcaaagccgttctatgacattcttgggcacaagtttccaccgtctcctgatcaccagccgatcccttggtccatggacagccccagtgagagtagcagtagcatttgtacacaatctatggcaagtagtgtcactagcagcagcattggtggcacagtggatagcaactggcgctacgacgttggacgcagtgagcagttggaagcttatcaaggcttgtgtggtcagtcttctcaaccgcttgttggtacatctagtgatgcttccaatgcagtggatgggctagatgaccctttgatcacgaatggccagatccctgagtatttgtttgagagccttccaacttgggatttcaggagaggtattgaggaagcccagaagtttcttcctgttagcaatacactagtgattgatttagaagctggtggtatcacaagacctcaagaagcaaggaaagatgtttctttgaatgccaaa

SEQ ID NO: 13875 - DNA, 718 bp, Sorghum bicolor
  Predicted polypeptide sequence is orthologous to G987
gaaaccactgctggttcacgtcccacctctctctggtctctgcgctccgcctttcctcttatccttccccgtctcgcgcgtctcgggtctctcttctttctctcgcctccctcccggttcgagtcgcacgcaggtcgtgggcaccagtgcatttttatgcgccgcgccgctggttttggggcgcggagtccacatcgatggtcatggacgctggcctgcacgagccgtgcgcgctgctaccgggatccaagcgcgacggccacatgccaatctacccccaaatcgccgccgccgcaaatgggttcacggcggaggagctcgagtcgctgctgttcctgtcgcccgatggggttgcttcggccgcgggcggcgttggcggcggcagctatctgaatgtcgcgcccactactgtggttccgcccgcccgcaccgaccgccgcgcgtcgccgccgccctcggtggcgcagccggacgattcggaggcgttctcggacatcgtgctgggctacatcaaccgcatgctcatggccgaggacatcgacgataagttcgagcactacccggagcaccccgcgctgctcgccgccgagaagccgttcctcgagatcctcaccgaacggccctcgagctccggcggcagcgcggttgacagccccgacggcagcagtgtcggcaactcctgctacagcgcgggctcctgcacctgcgccaccgccac

SEQ ID NO: 13876 - DNA, 658 bp, Sorghum bicolor
  Predicted polypeptide sequence is orthologous to G987
gcctttgctgcatcaacacctgccggctgcaggcaagtaaaagcatccctcttagcttctcccttctactgcagtcctctgcccccggcctgcagatcatggaggaagcatggtggcaggaatgtctgcatggttcttgagagttgcataagcagcaaagcagttcatggatggttggatgacaatggccagttgagcacttgagctgctggtcctcatcaatcatcagtttgtatttgtccatgcctcttgtggccgtcttccctggctggcttccagttccggaaggcccggtgaggcgtggacagagaccggcaagtcagagatcggcaatggtgagctcctgcaggagcctactccttatttaccagtttaaggtttccctctacctgttgttgctcgtcttccttcgctccttcttatctgtcccctctgtaccggtgagagcagaagatttcagtagaagtcttgctttctggagacagtttcagtgttggttttggaatatgctactgtgatttgctcgtgtttaccctcgctaaagatagcttgtgtgacctttatttgtgttgtcgaatctgcaatcattttgatgatctacttgtaaaggacgtgatgactattgtcatattgttggacaatttttaagtgaaaactc

SEQ ID NO: 13877 - DNA, 663 bp, Sorghum bicolor
  Predicted polypeptide sequence is orthologous to G1017, G2567
tgtcggccttcttgaggatgaggagagtaagatgatcaagggtcctggtgggtacatgagaggcagggggaaggtcaagatcacggatgttgttgaggccgcaagccttgcggccagcggccaaccatttgaggtggtgtactacccgagagctagcacaccggagtttgttgtcaaggcagcatcggtgcagaacgcgatgaggaaccagtggtgccctgggatgaggttcaagatggcatttgagacagaggattcatcaaggatcagctggtttatggggaccatagcttctgctcaggttgccgacccaatcagatggccaaattcaccgtggaggcttcttcaggtgacatgggatgaacctgacttgctgcagaatgtgaaatgtgtcaatccatggcttgtggagattgtatcaagcattccacccattcacctgggaccattttctccacctagaaagaagttgcggatgccccaacatccagactttccatttgacggtcagctgttgaatccaattttccacggcaacccacttggtccaagcaacagcgctcttcgctgtttctcggacattgctcctgcaggcatacagggagcctggcatgctcaatttggtttacccctaacagaccaccagcttagcaagctgcacct

SEQ ID NO: 13878 - DNA, 752 bp, Sorghum bicolor
  Predicted polypeptide sequence is orthologous to G1017, G2567
cgggctccggcgtcatccagaacagcccgaccaagaaccacgcgtcgtcggagcggctgccgtggtgcgtcggggacggcggcagccagcagcaggtctccgagctcgggcttgagcccgggcaatgcaaggtgttcgtcgagtccgacacggtcggccgcaacctcgacctctcggcgctgagctcgttcgacgagctctaccgccgcctgtccgagatgttcggcatcgagggcgcggagctgcggagccgcgtgctgtaccgctgcgccaccggtgaagtgaagcacgccggcgacgagcccttcaggtaacaacaatcgtgtccacaacgatttttcgctgctgacacaaggatcatacgagcttaagcacattgctctgccatttcagcgatttcgccaggtcggcacggaggctcacaatactaaccgatgctgggagcgacaacctcggaagctaaacgaggagcagctgcagcagtgagatattccagccgcgagtattatgatgttctttggtactattactgttagcatgtactactactgtacaggtgaggccgtgaggcgtgagctatgatggttttgttcaaagtccgttccaactctgaactctgaagagagatttcgccatggacatggcagctcgtaggcaatgctgcaatgattaggcagcagctcgttcttgctccttctctgtatccaacaaatcactgtaaaacgtgggggtaaccctagtactagtactca

SEQ ID NO: 13879 - DNA, 447 bp, Sorghum bicolor
  Predicted polypeptide sequence is orthologous to G1020
gctcaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactaggcacaccggagtttttagctgacgaattagtagttacttttttttcctttttgccttcatcaggaatgttacttctggttgtttggtcctgtattcttgttctgtagactatgagattgggagccttgtaaatagttttttttttccgcgaagacggaaatgatctgagatctgttcgtctgtctggacggatcaagccggcgttggtacgggcttagaccatggagtattgattatattagtagtataattcctaagtttactgagaatata

SEQ ID NO: 13880 - DNA, 771 bp, Sorghum bicolor
  Predicted polypeptide sequence is orthologous to G1020
ccaaccaaaattccattcgcccacctcggaggccggcgagaaacgcaggcagaacccggcggcaggcaagcaaagcacgcgcgtccaccacagccacagagagcaaagacacaaggcagctcggtgtatggcacccaagaggagcatcagcgaggaggtcacggcggcggcggagctgccggtgccggagccggagcaggggaagccgaggctgcgcggggtgcggaagcggccgtggggccggtacgcggcggagatcagggacccggcgcggaaggcgcgggtgtggctgggcaccttcgacacgcccgagcaggccgcgcgcgcctacgacgccgccgcgcgcaggctccgcggcccgcgcgccaccaccaactacacctaccccgacgccgtcgtcccagcgggggcgccgtgcgccgccgctctggttccgagcgccagcgccagcgccagcgcccgggaagagtcttgttcgtcctcgttctccaccagggacgacgactaccacccgctggcagtgaccgtagcggtcgctgcgccgccggctccgtcgcagtcgcagtcgccgtcgtcgctcgacctaggccttgggctcttcccggcgatggtggccgcccagccgtacctgttcctgaacccgatgcagttggcgccggtgaagagggaggcggagcggagctgctactcggggtcgtcgtcgccgtcgccgtcggtgctgggactgggactcgacctcaacctgcctccgccggccgagatggtcatgta

SEQ ID NO: 13881 - DNA, 738 bp, Sorghum bicolor
  Predicted polypeptide sequence is orthologous to G1020
gccggcgcaggcagcttgcctgcggcgaaggccgtcaccggtggcggcggcagccggagcagcaacagcagcaccgtcgagtctttcagcagcggcagcgacgtgcaggcggcgcccatgcaggccatgccgctcccaccgtctctggagctcgacctgttccaccgcgcggcggctgcgggcacgggcacgggcggcgccgccgtacggttccctttcaacagctaccccgtgacgcacccgtactatttcttcgggcaggccgctgctgccgcggcggcagggtgccacatgctcaagctggcaccgacggtgaccgtggcggccgtggcgcagagcgactccgactcctcgtcggtcgtggatctgtcgccatcgccgccggccgccgtgtcgacgcagaaggccgccgccgcgttcgatcttgacctgaactgcccaccgccggcggagatggaggcctagccgccggagtttttagctgaaaaaatgactgcctgtagtttctttctttcgtcgccttttgcccgtagaggaaagcttagaagagaaccctcatgttcgacagagggcggaggacatttttgtaaatagtttttccgctggggacctagctttagctgatgataaaagcttgtattgtcacccaagacaggtcctgccggcgttgttatggaccggattattatattattattatgtattttgatagtcaagagaaacgcctcagaaaaatcc

SEQ ID NO: 13882 - DNA, 655 bp, Sorghum bicolor
  Predicted polypeptide sequence is orthologous to G1033
tactggactcgcttcaagcaacgccgcagttcgtgcacacatccaaaccggcaaaccctcgtcgtgatccggccccaaggtctcgagataaaggcgagggcgaagtccagcggcggcgactccaggctttcggtgaagaagggcaaggctcagaaggacccaaacaagcccaagaggcctccgagcgcgttcttcgtcttcatggaggagttcaggaaggactacaaggagaagcaccccaatgtgaagcaagtctctgtgattggcaaggcttgtggtgattctgacaagtccaagtctgaggtgaatgacgaggacgaggagggtgacgagtgatggatgacggatggagggagctctcgcctgcccaagtgcttgcagtcagtagggaaattctcatcgtcgtgggcctaaccgggcttttgctgctccttttagcctctggaagctgtctgtctgtctttctagatgcagtagactagtagtagtcgccgctcgctctctgagttggtagtcgcaagtgttgtccgtccctgaagtgatgcagtttagctggtagtgtgttcgctttttcggcacttgaccgcttgttggaatggcatgggatgtttagcctgcagtctgtacttacccacgagcatctatgatgcctctg

SEQ ID NO: 13883 - DNA, 684 bp, Sorghum bicolor
  Predicted polypeptide sequence is orthologous to G1033
gaattcaggcaggagtaccaggcacagcaccctggcaacaagagcgttgcggccgtgagcaaggcagcaggggaaaagtggcgtgctatgtcagagcaagagaagcaaccatatgtggaccaagctgggcagaagaagcaggactatgagaagactaaggcgaactttgagaagaagagcacaagctcaaagaaggctaagactgatgatgacgatggctcaaagtctgaggttgacgatgaggatgacgaggacgatgagtaaatactgtctccgcagtcatgagatagcaaatcgagtgttaggtccccaactagcttaccggcttgttatctttaatgttaagttgtttggaacaggtgtttatgaaggggatctattagtttcgtgaggttgttagtttagtgcattagcaaagaaaaagctgaatgctgctagctgttctgttgcttttcttttgttgctgctagctgttctgttgcttttcttttgctaaccacttgtcacaactttctgtacctgtttcattgactaatctagtgactagtcagttattggtttaatgtttggttttgattttatatattccttttttgcatgcattctgtccgccctacggaagttgaggtgatctgttctgtatgaatggtgaatataattgcttgcctgcttgtggctcgtttc

SEQ ID NO: 13884 - DNA, 628 bp, Sorghum bicolor
  Predicted polypeptide sequence is orthologous to G1033
tcatggaggagttcaggaaggactacaaggagaagcaccccaatgtgaagcaagtctctgtgattggcaaggcttgtggtgacaagtggaagtccctgtctgatgctgagaaggctccctacgtctctaaggccgagaagctcaaggttgagtacaccaagaagatggacgcctacaacaacaagcagtctggaggccccacagcgtctggtgattctgacaagtccaagtctgaggtgaatgacgaggacgaggagggtgacgagtgatggatgacggatggagggagctctcgcctgcccaagtgcttgcagtcagtagggaaattctcatcgtcgtgggcctaaccgggcttttgctgctccttttagcctctggaagctgtctgtctgtctttctagatgcagtagactagtagtagtggccgctcgttctctgagttggtagtcgcaagtgttgtccgtccctgaagtgatgcagtttagctggtagtgtgttcgcttcttcggcacttgaccgcttgttggaatggcatgggatgtttagcctgcagtctgtacttacccacgagcatctatgatgcctctgttttaacaatctcagaactcaatagatgcctgttttaagt

SEQ ID NO: 13885 - DNA, 654 bp, Sorghum bicolor
  Predicted polypeptide sequence is orthologous to G1037
ttaggaatatctggcagcatgttgttaggaggaaattcagtaactgtgagcgtgctaacattgatggctatgaggagtgcaccaggccatcaaatgcagattttgatcatgtacacagccaaattacaggtgggacacctgaccaaagtgggaggtccagcaagaagaggaaggaatatcatagtgaagaggaagatgaaggagaagagagtaatggccaagagaacgatgatccttcagctccaaagaaaccaagggttgtttggtcagttgaactacaccgaaaatttgttgctgctgtcaatcagctaggaattgacaaagctgtgccaaaaagaatacttgagctcatgaatgttgagagactcaccagggaaaatgttgcaagtcacctgcagaagtatagactctatcttaaacggctaagtgctgtggcatcgcaacaggctagcattgttgctgctttcggaggcaatgacccctttatgcggatgggtgcctgcatatgaccgccaccttccacatatctgcatctgcgttcatctctcattgtctgctgtgcaactagtgttaatcttaggtgaaattgtagctgtgcgcctatctatgctgctcacagccaagaaaatactgtaactactaggttgttctgta

SEQ ID NO: 13886 - DNA, 767 bp, Sorghum bicolor
  Predicted polypeptide sequence is orthologous to G1038
cttcgccttcgcccggtcgcccccccggctgcgagcgcgagggcgcggaggggctagcgcgctagcggcgccatggccctgaccgacgccaccgcgttcccctacggcctgcgcgtcctcgtcgtcgacgacgacccaacttggctcaagatcctcgagaagatgctccgcaagtgttcctacgaagtcaccacatgcggtttagcaagcgttgctctccaaattctccgagagaggggaaacaagtttgacattgtaatcagtgacgtcaacatgcctgacatggatggtttcaagcttctcgaactcattggacttgagatggatctacccgtcataatgatgtccatagacggagagacgagtagagtgatgaaaggtgtccagcatggtgcttgtgactatctcctcaagcctgttcggatgaaggaacttcgaaacatttggcaacatgtgtataggaagaaaatgcatgaggtgaaagagattgaaggtaatgacagctgtgatgatctccaaatatttagaaatggtgtggagggatttgacgagaggggcctatttatgagagctgactctgataccatgaggaagagaaaagacatggataaggaccatgcagatcaggactcaagtgatggagctactgttaagaaggctagagttgtctggtctgttgaccttcaccagaagtttgtaaatgctgtcaaccaaattggatttgacaaagttgggccgaagaaaatactggaccttatgagtgttcc

SEQ ID NO: 13887 - DNA, 878 bp, Sorghum bicolor
  Predicted polypeptide sequence is orthologous to G1048
ctcgccgtccgtcccgatggacatcgacctcttcgccgacatcgacctcgacgccctcctcgcctccttctccggcgaacccgccgccgtctccgacctcatcgtcccgtccccgcctccgccggccccggcggcgcacgatgcggcggaagcggggtcgccggagtcggtgacctcccgggcgaacccggccggggaggtgggtctctcggagatcgagaggttcctgatgcaggaaggggaggcggaggcggagttgggcggggaggtcgaggggatcagcgtggaccagttcttcgacgcgctgtacgacggcggggaggggaaagatgaaggggaggcagaggcgggggcaagcacggatgcggactccggcagggacgaggtggtggaagtcgtgacgccggaggcggagacggtggaggtggatggcgatgatcccgtcagcaagaagaagaagaggcaaatgaggaacagagattcggcaatgaaatccagggagaggaagaagtcgtacataaaggacttggagacgaagagcaagtatttggaggcagagtgccgccgcctcagctacgcacttcagtgctacgcagctgagaacatggtactgcgccagagcttgatgaaggataggcctgttggtgctcccacagccatgcaggagtctgccgtactcacggaaaccctgccgctggtttccctgctgtggctggtgagcatcgtctgcctcttcctgatgcccgttctgcccaaccgaagcccagctgctccaagcagcggcggaagagatctcgtgatggcagccggaaagacaagcagtgaaactccagagatactggaactcatcctccatggaaggcgttgcaagagcacga

SEQ ID NO: 13888 - DNA, 768 bp, Sorghum bicolor
  Predicted polypeptide sequence is orthologous to G1048
gcatcctcgttggggacagcgagggcgagggtagccccaagctcactggtgagaagagcgcggatagggcgtgcgcgggagaggatgaggtggtggtgggtgtggattgcggcgatgattccaacagccagaagaagtggagacaaatgaggaatagggattctgccatgaaatctagggagaagaagaaattgtatgtaaaagatctggagatcaagagcaagtatctggaggcagagtgctgccgcctaagctatgccctccagtgttgcactgccgagaacatggtgcttcgccagagtttgctgaaggataggcatgccggtgctcccacagccatgcaggagtctgccgaactctcggaaaccctgccgctggtttccctgctttggctagtgagcatcttgtgcctattcctggtggacgacatgcccaacagaagcctggtggctccaagaagcctcgaaagagatcttgtaaagctagccaggacatcaataaacggtgtaaagatgaccagaatgacaaacaacagtgacaatcctggggctttgggactcatcccccttggaagacgctgcagaggcacaagggcgaggatcaagtcaccttgggttccttggcatgcagtagctgcttgctaagccgccagtcatcatgcgaaaccttttgaggtgttgttaaacataacatattggcacatgggacgactgtatgcatcgttgctgtgaaagtgtgaatctttgttccgctcttttcctgataccc

SEQ ID NO: 13889 - DNA, 694 bp, Sorghum bicolor
  Predicted polypeptide sequence is orthologous to G1051, G1052
atgcaagcagtctctctcaggcactaatgccatgcaaatgcagtgtgtgatgtgccccaccaggccatccccatcaccccatgcatgtgcactcacacacacacacacacacacacacaccatatatctctccacctacactctgcctgctggctgcttgcaaccaataaccatatacatacacactatcagtatacatcctcaaagtctcaaacacagctagcaaagcacactagtcctagtccagcactctagcctctagcacgagcagcggcggtacaaggcgtgtccggcggtgccaagaagataagctccagaacagaagcgatggcgcagttgccgccgagggcgccgagcgccttgccgcaggaccactggtcggcagcgggggcggagttcctgggcttcgccgcggcgaggcggggcgcgcaccgccgctcggcgagcgactcggccgcgttcctcgaggtcgtgcctatggacgacgtcatcggcggcggcggcagcggcagcgccggcgacgacttcgaccgcctcgacgacgagcagctcatgtccatgttctctgacgtcgacgcgccggccgtctccgacggcgccggggagagggccggggacgcggcgcagctcatggacgtcggggacgcggaggacggaatggccgcctcgtcgccggccggtgcgcgggcggctg

SEQ ID NO: 13890 - DNA, 895 bp, Sorghum bicolor
  Predicted polypeptide sequence is orthologous to G1051, G1052
cgcagatcgagctccgagcgagcgagcacgcactgccggccggcgcgggcgatcgggagcgcgccgcggtgcacattgttgttggcgcgcgcgcgcgcgcatggcgcagctgccgcccaggatcccgaccgcggtgcaccactggccggaggggggccagcacggcgcggcggcggcgtgggccgatgacttcgccgagttcgacaggctcgacgacgaccagctcatgtccatgttccccgacgaggccgccgccggcggcgggtcgtcgtccgcgctggggtctgagaacggcggcagcagcgacagcgacggcgataagcgtgtcggcggtacctcggcgggaggcaccatcgccggcaatggcaatgcctgcgacggcgagcagaacgaagccggggacgcgcaggcgccggcgacggggcaagctgccgccgcttccacggagctgatccgggaccccaagagggtgaagaggatccttgccaatcggcagtcagctcagaggtcgcgggtgaggaagttgcagtacatctccgagctcgagcgcagcgtcacaacactgcagaacgaggtgtccgtgctgtctccccgcgtggcatttctggatcaacagcggaccatactgaccgtcggcaatagccacctcaagcagcggatcgcagctcttgctcaggacaagatcttcaaggatgctcatcaagaagcgttgaagaaggagatcgagaggctgcggcaggtctacgagcagcagaacctcaagatgtcagccggtgccgctgcttctgaccacgggccgccgccacctgtgcgcgcagagaaagagctcatgagctgatcgagctagccaatccacgccctgtcggccgctgtgcagtccgccgtatcgatcatt

SEQ ID NO: 13891 - DNA, 505 bp, Sorghum bicolor
  Predicted polypeptide sequence is orthologous to G1064
gcacgagggccgtatcatctgtggagcaaacaaagcgcacggaggcgcgttcttgtggcgtagtacagcttctcctcctcccacactatacctgtacctttaactcttgtttgttagcggctaatttcagagcttctgttgggaactggggggaccatttagatttagtgcgggggtttcctcggccccctctttccatgggagcttggaagctgctggatctctgcaagtgaccatgagccagagtgagtgctttttcttgcgatttctcatcgtttagttggtgattcttgattgccgcggagaaggcatcatctttattacttcctgggagttgacctgggttgggcgaatgggtgatcagagcagcggttcttgtttcttggccatgggtctcttgattccttctgaatttctgatgatgttaggcggatgcttttttatcgagagaatcgagaaaataaaacatcggattacaattgttaaaaaaaaaaaaaaaaaaaaa

SEQ ID NO: 13892 - DNA, 613 bp, Sorghum bicolor
  Predicted polypeptide sequence is orthologous to G1068
cagcagatgccagtgccacagcagtacgtgtgcagcccggggtacggcccgcgcgccggcctcgccaccgccgcgacctcgtcggcgatgatgatgaagcagctgcagcaactcatgccgatgcagcagcagcagcagatgtggcagtaccatgtctctcagtaccagcagccgaggccggaggctacgccttccccggtgtcgtcagcggcggcagcagcagcctggcatggcatttcgtcgtcactgcggccgatgggcatgcttgctcccccgccgatgccgccgtcgccacggtcgccgcagatggagcttttctgcgcgccgtaccaaggtggcaggcagcctcagcagctgaggttgatgtagctgggcacccttctgctgctgattagcttattggtgctacatattcagacgtactaatttatagagaagtatatactacttagcagtaaaaaaaatgggatgttgcaaaaaaaaaagagagatccataaaatgttaccagggtttttatatgcatggtaccagaggagaccgaagagggagggctcaactgtaattaacaggtttaatttctggtgcagttgcagaattaatgtagtagtagcc

SEQ ID NO: 13893 - DNA, 686 bp, Sorghum bicolor
  Predicted polypeptide sequence is orthologous to G1069, G2153
gcccgcgggggccggcgcggcggccatcgcgctgcgtggccggttcgagatactgtccatgtccggggcgttcctcccggcgccggcgccgccgggggccacggggctcgccgtgtacctggcgggagggcaggggcaggtggtgggcgggagcgtcatgggggagctcatcgcgtcgggccccgtcatggtgatcgccgccacgttcggcaacgccacctacgagaggctgccgctggagcaggacgccgaggagggcgccgtgctctccgggtcgtccgagggcggcgccaccgcgcagcagctggagcagcagcagagcagcgggggccccgtcgtgccgccgtcgtccatgtacgccgtcccgcagacgccgccgcacgacatgttcggccagtgggggcacgcggctgtgacgcggccaccgccgacgtcgttctagctagcgctagctgcacctgcaccggcctgccgccgtatctctctacctcttgctagttagagatttccacttcttcactaggtattagctactagtactctagtcgctgttacattagctcgactacccacgctgttaattaatgtgccatggcatgcatgtgtgtcttttcccatttcttctagctatttggagcctgtggaatcaatgtacaattcatatttgcgtatatcggaattggtca

SEQ ID NO: 13894 - DNA, 830 bp, Sorghum bicolor
  Predicted polypeptide sequence is orthologous to G1075, G1076
tcccctccagaaaacaagcaccacacaaaccctaaagaaattcatcctctcctcgctctcgccgtctactattttcatcatcaccaccaccaccgtaccacttcttctactcgcgccgccgaattattaatattatcgctctcctcctaccctagaaagatggcaggcctggatttgggcacaagctcctaccttcaccagcagcaccagcaccaccaccaggtgcccctccacctccaccacgacgacggcgtcggcgcggggggcggcggctctgacgatggccaggactcgctgtcgccgggatcaggcggcggcggtgggggtacgcccagctccgccggaggcgccggaatcggcggcggggagatcgtcgctcgccgcccgcgcggccgcccgccgggctccaagaacaagcccaagccgcccgtgatcatcacccgggagagcgccaacgcgctgcgggcgcacatccttgaggtcgccgccggctgcgacgtcttcgaggcgctcaccgcgtacgcgcgccgcaggcagcgcggcgtctgcgtgctctcggcggctggcaccgtcgcaaacgtcacgctgcgccagccgcagtcgtcccagacgggaccgacctcgccggccgtcgcgacgctccacggcaggttcgagatactctccctcgctggctccttcctcccgcctccggccccgccgggggccaccagcctcgcggccttcctggctgggggccaggggcaggtcgtcggtggtagcgtggctggcgcgctcatcgccgcggggccggtcgtcgtcgtggccgcgtcgttcagcaacgtcgccta

SEQ ID NO: 13895 - DNA, 627 bp, Sorghum bicolor
  Predicted polypeptide sequence is orthologous to G1078
cgaccggtgggggaaggtgctcgaccgcgtgcactgcgtggacgtgctcaaggcgatcaagagcttcgcgggggcggcccgcgcgatccacgcgctccagggcgacgagctgcgggtggcgcggcgcgtgaggcagtactcccgggagctggaccgcaagtccaggatgctgcggcaggtggagaagagctactacgactcgtacctgcccggggtcatgtcgatgtggcactgggggaggccggcgtggagggaccacatgcaggcgcgcgacgcgggcgacgaggtggcgcagcgcagggacgagatcgcggcttgccggaagatggtggaggacgagatgcggaggcatgccaaggccatcgacgccacgaggacggccacggtcaccggcgtgcaggggaagctgcctgccgtgttccaggccatggccgcgttctcggcgtcgcttgcgaattcgctggaggccgcgtgcagagctccacagcagaacaccaacatgcagtagtagctactgtccggtcattcttttttgcgtttgcatttttggttttcatcgtgttttcagcatctatcatacaaaaatatacagaatacaaagagagaccatagaaatacgaataagac

SEQ ID NO: 13896 - DNA, 473 bp, Sorghum bicolor
  Predicted polypeptide sequence is orthologous to G1079
gcacgaggggagattgatgagtacttcttgaaagcagcagcaagtgggaaagacgttgtgattcttttggactctgctggtgggcggcctgatgccttagagatagaggcaaagaaaggtgcgggaaaaaattccaaatctgcgaaggttttctccacgctttcttggagctggtcttttaaatctcagcaggctaacagcgaatcctcagttctgaattctagtgattcctctggatatggttaccatggcaagacgctggagaagctttatgatgaggagcaaaaactctacaagttaatcaagaatttgcaaggcttcagtataagaaacatgtctcagtgctacaaaagctagaatcaggggaacatgatagactgcatgcagaaagagtacgggatgctattgaagaactgcagactcggataatctcattggaggaagctgtgagtttggcgtgtttttccatatca

SEQ ID NO: 13897 - DNA, 557 bp, Sorghum bicolor
  Predicted polypeptide sequence is orthologous to G1084
ttttttttttttttttttttaacagaggacatgtgaacggaccaatttgaaggattctcgtacaagaccccatttgtaagccagatcgactacagccaattaaggcatggcaactagcaaaatgctccatataacatgaaagtatgacatctatgccgtccccggattgcggacttctggtctaggtcatctccccattcattggcttcagcagcagtactcttgctggcaacaagaaacctttctacagttttagtgttgtttctcctcacgctcaaagctcagagattatgatacaagcatgactggtccttgagcactatacaaggctttggagaaatgggatgtgctgcttccaggttagaagatgaggaggctgtcaagatgtgctctgaatgtcaaagtgaagaaattcaaccaagcgcgggtaaacggcgggagtaactatgactctcttaaaagcctccctccgtcttccacttccactcctcgttcttgttcacacagcagcagcctcctggaaaagagagggaaaggccatctccctcactctcact

SEQ ID NO: 13898 - DNA, 759 bp, Sorghum bicolor
  Predicted polypeptide sequence is orthologous to G1089
attttccccctctgcagctgcacgggcacccacacaattcatccaacgcccaccgggcctcaacaatctccccaccagccgccgccgccgccgccgcatcaagcgatagaactaggaacccctccccaagaatctcaagaagacaaggacgccgtccagtcgccgccagccgcctcgatgggatgcgggcagtcaaagatcgatcaggaggaggcggtgagtcggtgccgggagcggaagcggctgatggccgacgccgtggtgtcgcggaacggttttgctgccgcccacactggctacaccgtccgcctcaagagcaccggcggcgcgctatccgatttcgcccaaggcgaggcgcccgaccctagcctggtgtcctcccatacccaccacgctcccgctgtggcggcggcatctatctcgactccgccaggcccttccgcagcttccgtcaccagcccctccccgccgccgccgccgccattcgccgacttctctcattctagcctccaaaggtcctcctccactcccaatattcctatgccggagccgagggccgccgccaaaaaccgccctcctgccgatgctcctatccgagaggaggatgaggacgaggaggaagacgatgggcatatcaagaccgacagcgacgacgatgacagtgatgaagacgacgatcaccatgagcatgacgatgttaatgtggacggcatggtgcatggacagcaaccaaagcggattttgatgagtattgtggga

SEQ ID NO: 13899 - DNA, 621 bp, Sorghum bicolor
  Predicted polypeptide sequence is orthologous to G1108, G2394
ctactggatctaataaacgttgccgcaccgccgctggagactgtgaagcggaggaggaagaattcgagtccaagtcttggagctgcccccgcttgggtggagtggatctggccttctactctaggggaaagagcaaagcacattatcttgtaaaaattagcattttcctacatttatctcaaatcaaatcatctctgcttctgggaacagcaacctgtaatttcccatgcaacctcttggttgatggatgctcttcctgttgaatcagaaagagaaagtcaaacagatagtcaccctttactcatggagcatgtgattggcatcccaagggatgatgttgcttctacatcaacacctcgccgagacaacaatgatggcatggatcacttgcctcgtgattcagaaagttcttccggaacaactgctgcatataactccccgaatactcctatagcaagaagagatgataatcgccgtcgccgtcaacagagtctgaattctggcttctggatatcaattgaactagctgtaaatcttagccagattatagctgctatctgcgttctgtctgtgtcaaggaatgaacatcctcatgctccattgtttgagtgggtcattggt

SEQ ID NO: 13900 - DNA, 722 bp, Sorghum bicolor
  misc_feature (46)..(46): n is a, c, g, or t
  Predicted polypeptide sequence is orthologous to G1108, G2394
catgcttcaagctcagagcatcttgatgagggcggcatcctcggcncaggaactaagaaggaaagagttgtttcagctgaagatgctgtgtgctgcatctgtctaacaaagtatggagatgatgatgagctccgtgagcttccttgcacacatttctttcatgttcaatgcgtagataaatggctcaagataaacgcagtgtgcccactctgcaaaacagagattgggggtgtggttcgatctttcttcggtttgccatttggccgccgccgtgtcgataggatggctggaagaggtgtagcttgctcaagattcaatgtatagaacaatgttgcttttctgtgatatcctctcttacgcataaagagccatgctcatgttgttgcaatggtttgattgactgtcaagaaaagcactgtgtgattgacttcaagacaatgacacctagtgaggaacctgatgctcctaggcgcaagtttctgcagaaatgtgaaggacctaaggtgctggcgtgctgctatactctgatgtaacatttttccaaggatgtaaatgaggaacatgaagttcacttgccaggtatattgcaagcaacttcacaggtcttctagcatcggccttggtgttctttactgccagttctgtgattctctttatcacggcagtgcactgcaggcttggtaaaatgtgaaataaaaggcaattgcctatatttcgaaccc

SEQ ID NO: 13901 - DNA, 794 bp, Sorghum bicolor
  Predicted polypeptide sequence is orthologous to G1108, G2394
aaatgctgtgcttgctaatcctaggattattgcgctgtttgaccacttcaagatggccctggattgtttctttgccgtctggtttgttgttggaaacgtgtggatattcggtggccgttcttctgctgctgatgcaccaaacttgtacaggttgtgcattgtgttcctcactttcagttgcattgggtatgccatgccgttcatcctctgtgcaatgatatgctgttgtcttccctgcattatatctgttatgggttttagagaagatacaaacaatacaaggggtgctacctcagaatctatcaatgctttgcctacatataaattcaaaaccaagaaacgccgccatggttcaggaagtgaagctgaaggacaagaaggagggatagtggctgcagggactgacaaggagcgatcgctttctgctgaagacgctgtttgctgcatttgtcttgcaaagtatgcgcacaatgatgagctccgtgaacttccatgtgcacactgtttccacaaggattgtgttgataaatggcttaagataaatgcactttgccctctatgcaaatctgagatagcgggctcgtctggtacttctgatgctcgtcaattagatcagaacgccattcctgtgcaggagatcgaaatgcattaggttggtctgctctctcagcttttcacataagaatacatctgattgtggctccccgtcttcatgtataaagttggagattgatgtatggaatgtagtgacacatagttttttttaatcactgctatctggagaagttacagct

SEQ ID NO: 13902 - DNA, 842 bp, Sorghum bicolor
  Predicted polypeptide sequence is orthologous to G1108, G2394
gcgaggaaggcgactccttcctcgcggccgcccgcctcgaccccgaccccgaccccgatcgcttcgcctccgcgcgccgccgccgcgcgcgcagtgtccatcaacacggccgccctccgtgtgtggggcgcatctggtgctacctcgccgggctagggttggctttacccccgtctaccttttccgtctcgtctgacgcgcgcaggctccgtgcacgcggtcgtcggctctcgctccggttctgactgcgcgccgtcccccgcttgctccctcctgctacgggtgggccactgctgccgtcgcgtccaccgacgaattcccctacagagcaactatcttggagttggagatctatacctgaagattcatttgaaatctggaagcttctgttgttgggtacagagaaatatttcctgccttttgaggaagactgcagatcttctaaatgtgaaatttgcttcttttcttgtctactcctgaatgctgatgaactcagcctctcacgttacttagctcaaggtcgtactggtacggacactgaggatggagcaagcaacaggtgtaagtggtcctgagcacataattgatattccaagggaaattggtccttctgcttcggtttctcgtagtgttggtagagagaaccatgaagaattgaatcccgtggacaggccttcaacaagagctctagtacctgccttgcaggcaccatcagcaataggtgccgtacctaatgcagggcagacttcaggcactaggagaaatgataactatgttcgtcggcacagaagccctttgaattctggactgtggatttcaattgaagttatcgtcaatgtgag

SEQ ID NO: 13903 - DNA, 678 bp, Sorghum bicolor
  Predicted polypeptide sequence is orthologous to G1146
aaccacaatgatcagaattcaattgacaggagtggaaacatactcccaggtactgttgtagattcgaagatctgtcatcctactgaatttgacttctacttgtgtagccatgctggcattaagggcactagccgtccagctcattatcatgtcttgtgggatgaaaacaacttctctgctgacgagttgcagactcttacaaacaacctctgttacacttatgcaaggtgcacccgctctgtatcgatcgttccaccagcgtattatgctcacctggctgccttcagggctcgtttttacatggaaccagagacttctgacagtggatcggtggcaagtggtcctgcaggccgtggacctcagtcagcatcccatagcactcgggcccctggtggtgcagctgttaggccacttccagctctgaaggataacgtaaagagggtcatgttctactgctgaggctaggctggggcgcttatggtaccctcacttgtaaatatgtttggagatcgtaataatctggcagctgctactttgggtgctgtactgttaccatttactgtactggtctacgtttcttcctcgagcaccgcatgtatgcactcatgctattgtgtccacggatcatgtatgcacgctgtaacatagtaataccctcggttgtgtgtgtatgtacgt

SEQ ID NO: 13904 - DNA, 599 bp, Sorghum bicolor
  Predicted polypeptide sequence is orthologous to G1146
ctgcctggtactgtggtggactcaaagatctgccatccaactgaatttgatttctacctctgtagccatgctggcattcagggaacaagccgccctgcccattatcatgtcctgtgggatgagaacaaatttaccgcggatgggttgcaaactctcaccaacaacctgtgttacacgtatgctaggtgcactcgctcagtatcaatcgttcctcctgcatattatgctcacctggcagccttccgagctcgcttctacatggagccggataccactgacagtgggtctatggcgagtggtgctacgacaagccgtgccccaggaggggcacgcaacaccagggctggtgttggaaatgttgccgtgaggccattaccggccctcaaggaaaacgtgaagcgtgtcatgttctattgctaagattgacgctgtgagcaagcaattatcgggctttacctaagacttttgagtatttttccaagtacctgcactgttttggtgatggtggcacactgttatgcaccactgaagttaataatcagaagctgtgaattggagctaccttttatatatctggtattgtaaactggtttgcggta

SEQ ID NO: 13905 - DNA, 619 bp, Sorghum bicolor
  Predicted polypeptide sequence is orthologous to G1146
ccaagatttgccatcctacggaatttgatttctacctgtgtagccatgccggcattcagggaacaagccgccctgctcattaccatgtcctgtgggatgagaacaagtttacagctgatgagctgcagactctgacaaacaacctgtgctacacgtacgctaggtgcactcgctccgtgtcaattgtgcccccggcatactatgctcatctggcagccttccgagctcgcttctacatggagccagatacctctgacagtgggtcaatggccagtggggcccgtgggcctccaccaggtggggcacgcggcatcagaggggccgggagtgttgcggtcaggcccctacccgctctcaaggaaaacgtgaagcgtgtcatgttttactgctgagctgcattcaccaaggaatcctggagtattccatgtatccgcactgtttcggtgatactatcggacactgaatttatgcattaagacttccagttcattcaagtgatctggggattttatgtacgcttgttttgtattcgtgatgttgtgacgctgcagttcgaggagctttagtactgtgatgtgtgaactatttgttgacaagttgtaaccagccatacttagtg

SEQ ID NO: 13906 - DNA, 767 bp, Sorghum bicolor
  Predicted polypeptide sequence is orthologous to G1146
aatggactcaacctgcctgcgcccatctgaccgtgagaacaacattcgtcaggttgttgagcaaaatgactacaatagaactgaacgtgcaagtgaattcggtctggaggttgactatcatcctacttcagttaatgctagagttctgccagcccccactctgaagtaccgtggcactggatctgaaagtttgtgttgtccaaaggatgggcagtggaacatgattaaaaagcaagtagtacatggtgcaagggtgggcaactgggcctgcgttaacttttgtcataatttacctagagatgttgttggtaaattctgttctgatctggttaagtggtctcgtactactggagtggacatggataacttgagaattccaatatacgctgttcgtcctgaacaagttgaaactgatcttcataagctatgtcacgatgctgggaacaggctaagagtgcaaaagatagatcttttgcttgctatactgccagagaaaaacggcaacttatatggtaatttcaaaaggatctgcgagacagagattggtatcatgtcgcagtgttgcctggataaaaatgttagaagtgcaggtcctccatactttgctaatgttgctattaagatcaatgccaagtttggaggaaggaacttagaatttgctaatcccaaagaaagcttaccggttgtttcgattgaaccaacaattatatttggtgccgatgtcactcaccctgctgctctggatgatactgccccttccattgctt

SEQ ID NO: 13907 - DNA, 665 bp, Sorghum bicolor
  Predicted polypeptide sequence is orthologous to G1146
agagtttgacttcttcctgtgcagccatgctggcatcaagggcacgagccgtcctgctcactaccatgtcttgtgggatgaaaacaacttcacagctgatgcattgcagacccttaccaataacctttgctacacttacgcgaggtgcacacgttctgtatccattgtcccaccagcatactacgctcatctagcagcattccgcgcccggttctacatggagccggacagctcagacagtggatcactggcgagtggctctcgcggaggagcgccgtccagctcttctacatcccgcagtacccgtgccgccaccagtggagccgttaggccccttcctgtgctcaaggacagtgtcaagaacgtcatgttctactgctgatgaaccggagcctgtgtctacaagcagcatgactcttaacaacatgagcaggcagcctgcctgaaatttgatttgcttggtgttgtagtttgtttggtcagtaataatctgcttgctatgagcaaaccgtgttcaaagacgttgtgtttcagtgcatttgcttagtgtttgtttgaagaagtccggccagagcggatccgctctaggccctgcttgtactggagggatcccatatgttattttgagactattagtttcggatcatatcttttcctctaggttc

SEQ ID NO: 13908 - DNA, 587 bp, Sorghum bicolor
  Predicted polypeptide sequence is orthologous to G1181, G1850
gggttttttcctcgtgctgctgctgctgctgctacctttctcaccgtctctctctcctctctcctctccgtcctgtcctcctcccgttggtgggagtataaaatttcctaatccgcaatcgaagcttccagaaggcttcctcatccgtaccttcctcccaacgcgcctcgctctttcccgcatctggaagctacggtttcgccggcttagatccagccgggctacgggcgctggccagatggccgagcagggcggcgccgcccccggggaggccgttggcagcgacaccactgcgcctgcgccagcgccagcgcttgctgcagacgcggccgggcagaggtcgctgccgacgccgttcctgaccaagacgtaccagctggtggacgacccggcggtggacgacgtgatctcgtggaacgacgacgggtccacgttcgtggtgtggcggccggcggagttcgcgcgcgacctcctccccaagtatttcaagcacaacaacttctccagcttcgtgcggcagctcaacacctacggatttaggaagatggtgcccgaccggtgggagttcgccaacgacttcttccgcc

SEQ ID NO: 13909 - DNA, 676 bp, Sorghum bicolor
  Predicted polypeptide sequence is orthologous to G1181, G1850
attccctcattttcagccccttggtcttgcaattgcgacggccctcatctatcgcatcgtcgccctcgatctccctgcgaaggccctcttattcattcgggagtactctagccagcaaagctttcgaacccctggacctgctggtgacgactgaacatcaacgcgtccagttcttgagtccgcatctagcccttacgccattcgttatcatctcagcttggcgcatcgaaaaccattcatcctcagttcaaaggaaccagaaccgttcttttttgacttattgtttgctacctaaggttcgacaacgatcaacggcgactcggcccggttaaacgcctcttccatccgtcatccgtcgaatcgactcttgaacatccgtattgttctaatcgcaggccggcggcgaaatcatctcgaagcaaaacatagagtggcaaaggcactccttatataaacacataatatgtctggtgacggaaccccaacccccggggttggtagcagcaatgccagcgagtttgttcgcaagctttatcggatgctcgaagatcccgcgcatcaggacgttgcaagatggggaaaagatggcgatacgttcgtcgttgttgagaacgaaaaattcacgcgttcaatcttgcctaagcacttcaagcacagcaacatggctagtttcgtc

SEQ ID NO: 13910 - DNA, 587 bp, Sorghum bicolor
  misc_feature (580)..(580): n is a, c, g, or t
  Predicted polypeptide sequence is orthologous to G1190
atgggccagctgatggcagctgttggtgcatcggcgccgctggtgcaggcggacgccgccgcgccgacggctcgccggctgctctcggcggaggaccatgagcgtcgtccagcctctgacgacgaccccgagtccgataaggccatggaggccatgatgctgctccggctcttgcagaagacgaagggcgcagctgcacctgcacccacgaagacgggcggcagctgcccctgcatcagccccctcgtgaatccgtggtgttgctttggtagtgctggcagcgctgccacaaactgaaatcttcatgagatagaagagaccatgtatagatggttgcggcctctaattaaatgtgtgcggtatggtgctttcgtatcatttctgccgtccaagtccaacaataaatatacgtaagatcgaaggtagttaattagccttcgatcggggtactacttgcgtatagagggatatgatgcatgcatcatgctgctacatgcatgcatgcacgtacgtagctaggtttgtttgctgttgcagccttgcaggcttgcaaccacagtgtttgtgtccaagtgtgtcncaagtac

SEQ ID NO: 13911 - DNA, 753 bp, Sorghum bicolor
  Predicted polypeptide sequence is orthologous to G1190
ggcggcctcgctcccttcgtttccgctaggttttgtttgttaaccgcgcccgcctccgtcgcagctagcggcgccatactatttctcctcgacgatcgcagtgccgcagaaatacaggcagatatcggtgtgatttcgattgcaaaaatcgcggatcccgcgctgcccacaacctcgtcctcctcctcgtctggtcgttgattaaacaaaaggaaccactccctgctggccgctgccgtcggtgccaggtcgtcctcggtcctcctcctcctccagctcactctccagtgtccactccactgccatcccatcctcctcctccaaagttgcagacttgcagtgctcgacgacggagagagtagcgtggcgtgggcggcggcgccatgaagtacagcaaggaagataagcccgagagggcgggaggcgccggcgcagggtccagggcggtgccggtgacgctcgtcgtcatcgtgctctgcgccttctccttctacctcggcggcatctacagcacggggcggagcctcctggacgccatccagccggcgccaacgactctggtcaccctcggcggcggcggcaccaccaccacaacgacgcgtcgttcctccgacaacgaccaagcacggccggcactggccgccgtggcgttccccgagtgccccgccgacctgcaggactacaccccctgcaccgaccccaagagctggcggcggtacggcaactaccgcgtgagcttcatggagcggcact

SEQ ID NO: 13912 - DNA, 834 bp, Sorghum bicolor
  Predicted polypeptide sequence is orthologous to G1198
caggcaagccaaagcagtgtgtgagaggagaggagagctgagaagagaaacaaacagacaaacaaacaaagaggaggcctcttcccccctctcctctgtgcttgttgcatgcttttgctacaaggatgagctagctagcagtggccatggtgcacggcgaggagagttcttggaggatggagagggcagcgctgcctctcaaccaggcgttcgcgtatggagcccaagcccacgccgccgccgcaccgccgacctgcttcctggacttccagcctgcggcggcagccgctgcctacttcgggttcggggagctggaggaggccctcatccatggcggcggcggcgctggcaacgcccacggcgtcgatcccggcgtgatcatcaagaacgacgtcgcgcaggcaaagtcggcggcagcggcaggatatctcgcgggcgctggcaggccccccacgctggagatcttcccttcgtggccaatgaggcatcaacagcagctacacagtgggaattcgcagtcagtagggagcaccactgactcgagctcagctcagaacacaatgtctcagatggagttggtgtccccagcctcctctgcgccgaggcaggaggtcatgatggtgaccactgatgattacagctacaagccaggcctcgccgctgcgcccgctgctgctgccgccccgccaccgagctttcagcagcaccacccgctcccgctgcagctgcacggaggagacggaggaggaggagggggagaccatgacaagaggaagcatggatccacaagaaaagatggcaagttggtagatgccaagacggaacggcggctgg

SEQ ID NO: 13913 - DNA, 672 bp, Sorghum bicolor
  Predicted polypeptide sequence is orthologous to G1206
tactggtacattgcttatggatttcaccaagagttaggcagggggtggattctgtgaccaagcttcactgcgacatgtctgatgcagtaaatatattaacacatacaacacaagtgacctatgagggttatcaacataagaagatagagaaactcaaagaaaatgaaagaacaagatcttcaggaactttatggtgttttagaatctggcactgaacgagacctattatcatcttctactgattccaggaatttaaccattgacgaaacatcaaagatctcatgtaaagatgcaggccagtgttcagattacattgacaagaataatagttatgctgggatgcataatggtgctcagtgtattacgggcaagagtggagaccatgagaaaactggtggtgctttgtgggatattttccgaagagaagattctgacaagctacaagattatcttaggaaacatgccaaagaattccggcatatcaattgcaatcctgtgaaacaggttattcacccaattcacgatcagattttctacttaactgaggagcataagagaaagctcaaggaagaatatggtgttgaaccctggacgtttgagcagaggcttggtgaagcggtttttattcctgctggatgccctcaccaagtgaggaatctgaagtcttgcatc

SEQ ID NO: 13914 - DNA, 758 bp, Sorghum bicolor
  Predicted polypeptide sequence is orthologous to G1226
gagggcaacccggccagctgagcgttagtcgcagctcttgcctgcctagcatgcagctctaaacccaagtcgtgctcgtgcagcagacgccaagttgtggcaggtagtagctaggaaggaggcaacgccaggccaggccatggcgctcgaagctgtggtgttccctaaggagcacctcgtgtgcacggtcaaggcgcgctcggcgtcgctgggatgcggcttccacatagaggagctcgaggacaagggcggcgaggttctgcaaggggaggctgccgatgcgctgctgccgccgggtgccgatgccggtgcgggcaccatgtgggagtgggacgcggtgctctgcccgtgctccactgcacctggcgccgtggaggagtgctgggacgtgcagcaccagctctccgtgtccccgccgccgccggccgtgccctccgccgtcgcagcgtcgtcgttcgggcgcggcaaggccgccgccgcgtcggcgcggagacggcggcgacggccgaaggcggtgaagaacacggaggagatggagagccagcggcgcaaccacattgccgtggagcgcaaccggcggcggcagatgaacgagtacctctccgtgctccgctccgccatgccgccctcctacgcgcagcggggtgaccaggcgtcgatcgtggctggtgccatcaacttcatcaaggagctggagcagctgctgcagtcgctggaggcgcagaagcggcgccagggcgggtgcaccgagccaccgc

SEQ ID NO: 13915 - DNA, 812 bp, Sorghum bicolor
  Predicted polypeptide sequence is orthologous to G1229
ctccgggcggccgcgccagtccactccaccaccaccgcttctctcgcttctccggcgtcccccgcacttctcagacgaaaacctcgcttcgtgtgcttgcttccggcccgcaacgccaccttccgccgcgccgccacttctcctgcccgggagctcgtccttgcacgaagaatctcagatcttcgggccgtcctccgcgtgaaactccgttccaagcgttgtgccgtttgtgcaccagcgtcgcaggaaggaatttgagggattgcttggggaactcctctagttcgagcgagttatatgaagagcggagtgcgttgtttctcaaattaaattccgtgcaattagatcttgccatggttggttgttccacaaggaaatggcacattttgtggatataagctgctgcggatgcggtatttggtctgctccagtaaccgtaaacgcgtctgcgcgctctttgcggataagagcacatgctgtctctttggattatcccagtaggactgagcagaagaatgagactaagctagcggtggtacgaccagaccgaagattgcgggatgtttttgtcgatgcaagtgcagaccatggaagtggcagagcaactgcagatttcaagaaggttgttccatccttggatgctaacccgagaaggctgttgaatgagcaactaacaccaagaaggcccttggatcataactcggacaaggcgacaaatggggcgtacttttcaaagcataaagccgagtgctatgctgacagcctccgcaggcactgcaacaatgggaagctcattcaagcttgccgcgtca

SEQ ID NO: 13916 - DNA, 754 bp, Sorghum bicolor
  Predicted polypeptide sequence is orthologous to G1229
gccttctcttctctttctttccccttcctctccgcaccctgctgctcctgccggctggctgccgccgctgatccctctccctctcttaccacaagccgcaattgccggctgctcctctttctctcacccccattgttgcctgctggaggaagtgggaaaagaaagatggcttcttgggagtgagtaaggatcacatgatgcaattacctccatctttctctcttctctttttgtgggcggcatattcttctcctccgcctgtctagatccttgtttcctcggcccggcttaacttccaatctcaccaacggtccaagttgctgaccacggagcatttcttcaaacgggtcattctctgcgccggttccatcgggttttgatgcaagagtagaggacttggcaggctgttgcgactggtggttggagagcaggaaccaatttcatggcgtgtgcccccctcccttttagccagattgaggacaatttcagccaattttgtaggaacccgttaaacccatccggagaatttttcttgcgcctcctatgattacgagctgtgtctggacagtgcctacgctctggagttttagtgcgaattgttaccggtttcagtcaattttgatcaagcccagggaaagtaccaatttgggagttccagctggtgctgctgtctgcattcttccaaggcaatcagtggggaatttttgttccttggtggcagatgggttgctccaactctaaagtggacaatgag

SEQ ID NO: 13917 - DNA, 745 bp, Sorghum bicolor
  Predicted polypeptide sequence is orthologous to G1242
tacaagaacccatggttagagttgaaaattcagtatggccaaaataaaggaaagttctataatgaggaatgtgaccgctttatgctttgcatggtgcacaaacttggatatggtaactgggatgaactgaaagctgccttccgtatgtctcccttgttccgatttgattggtttgtgaagtccagaactacccaagagttggctaggcgttgtgatacccttatccgactggttgagaaagaaaatcaagaatatgatgagcaagagaggcaggcaaggaaggagaaaaggcttgctaagaacatgactccaacaaagcgagcagcactaaggaattcagagggtgagaatactccattgagttcattcaagaggcgacggcagtcccttatggacgattatgtgggctcgggaaggcgaaagagagggtgaatgtgatgtttgctatcttgcttttggagctcgccggagatgcagtctctgcaatgctttaagcccctgccgtgcagtgtttagtttctcctgcacgcgagttaaatgcctcaagggcaggtgacttcgtagtataatttatgcaatgttgacataggttagttataaatcctaaatgaagtatgtatgagcacgctgtgttagtgtcgtagtcctgtgctttgcatttcaactgttgctatcccagctgacagaatattatgacttcagctgcaagcctgcaacacaattgaggctcttcaattcaattttt

SEQ ID NO: 13918 - DNA, 715 bp, Sorghum bicolor
  Predicted polypeptide sequence is orthologous to G1242
ccttggtatcaacttggccactgctgatgttgtggttctttatgacagtgattggaatccacaagctgatctgcaagctcaggaccgtgcacatagaataggtcaaaagaaagaagttcaagtgttccgcttttgcactgagtacactatcgaggaaaaggtgattgagagagcatataagaagctagcattggatgctttggttattcagcaaggacgattggcagagcagaaaactgtcaataaggatgaccttctgcaaatggtgcggtttggtgctgaaatggttttcagttctaaggacagcacaataactgatgaggacattgaccgtattatagctaaaggagaggagacaacagcagaacttgatgcgaaaatgaaaaagttcactgaggatgcgattaaatttaagatggatgataatgctgaactgtatgattttgatgatgagaaggatgaaaacaaggttgatttcaagaaacttgttagtgataactggatcgagccacctagaagagaaaggaagagaaactactctgagtctgagtactttaagcaagcacttcgtcaaggtgcaccagcaaagccaagggagccaaggattccaagaatgccccacttgcatgatttccagtttttcaataaccaaaggctaaatgaattgtatgaaaaggaagtgcggtaccttatgcaagcaaaccagaagaaagat

SEQ ID NO: 13919 - DNA, 791 bp, Sorghum bicolor
  Predicted polypeptide sequence is orthologous to G1255
atccttacgagttatggtctgacttcccggtaagcactacagtacctacacggttcagagatgggccgggatctacacatttcttccactcccatgcgctgtcttgggataaataactgatcggtttccttttgccatatgaatcgcgtgcaggcgggaagccggggactcctcggcggcgccgtcaccgctgtgaccggcggcgagcgtgaggcgcgggtgtcgcggtacagggagaagcggcggacgcggctgttcgccaagaagatccggtacgaggtgcgcaaggtcaacgccgagaagcggccgcggatgaagggccggttcgtgaagcgcaccacgcttccgccgctgccgaggccgccgccgcagcagcagcagaagcagctgccacgggcactgccacacgtgggcatggtgctcgcgccacctccgggagcgaacgggcgcttccagttttgagaccacgcatgcaagcatgaagaaacgtatgtgcatgatgatgcaccgatgcatctatatctagctcgtagcatgttctttctactctactacttttaattggggatgaacgtacgtacgtacgtacgtacctagcgttagttttttatcagatacccgtgcgtgcgaattagggctccccacaagatgctccctacttacgactgaaatatatctgtatatgtacatgtgcagaatttcatgtgcaaattagttaaggaagagtatacttatagctaggttggttgtttttctttttctagtttttgtaaagaaggatccactaattc

SEQ ID NO: 13920 - DNA, 761 bp, Sorghum bicolor
  Predicted polypeptide sequence is orthologous to G1255
ccggttttgttagcgctcgcttaacctaaccgccgggagcagaaactgttcgacgaaatgactacgagcgctggggcggcggcaggcgccgcgctaggcgcgcgcacggcgcggtcctgcgacggatgcatgcggcggcgggcgcgctggcactgccccgccgacgacgcgttcctgtgccagacctgcgacgtctccgtccactcggcgaacccgctggcgcgccgccaccaccgcgtccgcctcccctcggcgtcgtgctcctccccaccgtgcgaccccgacgcgcccacgtggctccacggcctcaagcgacggccgcgcacgccgcggtccaagccagggggaggcaagcatgaggcgacgacgcccaattctatggccgcggctgcgtcggcagcggtccccgacctcgaggcggaggagtctggctccggcatcgtgggcgataacgacgaccacgggttcctggtggacgacgacgaggaccttctgtaccgcgtgccggtgttcgaccctatgctcgccgagttctacaaccccgtggcagacgagggggagcagaagccgctcgccgagttctacaacctcgtggccgacgaaggggagcagaagccggcctgcctgatgccgcctctcgtggaaacatcgccggagttcgcctccggcggcttggcggaggcggacgggctctcagggttcgacgtcccggacatggagctcgctagcttcgcggcggacatggagagcctcctcatggg

SEQ ID NO: 13921 - DNA, 647 bp, Sorghum bicolor
  Predicted polypeptide sequence is orthologous to G1269
cttactatggtttcccggccaaccatccaagagggtttggtacagggctgcataacgaaggtgccagtgagagtgataccagcaaaagcccatcagttgaatctagttcagattgcgtgggcaatgctcatacaaccaccccctaccaactgcaaagttgtcaaggagtcacttgggccagttgagtcaggtccaagtgttgagctgaaacccagcgtgaattcggccttcgtaagagtgaagccgagcagcggcagcagagaccaaccgataaggggattcatgccatacaaaagatgtaaagtcgaataacccaaccagatatttgtctacagctaatttgactgaagattgattgatcttgaacagtagagactcaagtggcacacagcccctgttccagtgtgcctgccattttttgcctgcaaaagaggtaccgagattggcaagtgtatgtgtaacattatttttcatgcttgcagcgcaatgtaagattctgcaagcttgttgctgttacctagtgtagactggacagatattattgtgcagggatgccgatctctggcctgttatgttgttgtataaggaaaccagattttgttgaactctcctgttcaaagttattaattcctaatggaaactgattt

SEQ ID NO: 13922 - DNA, 541 bp, Sorghum bicolor
  Predicted polypeptide sequence is orthologous to G1272
gtttggaagccggagggggtgagaagttttctcgccttctcggatacgtcgccatccaccccccgcttccaccactctcggcgggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttg

SEQ ID NO: 13923 - DNA, 802 bp, Sorghum bicolor
  Predicted polypeptide sequence is orthologous to G1289
cttggtatgctcctcttgatagttgccttttcacaactaccattaccagtacagatgaaagatacagctggcctgttccatggcccgaaagacttgatgttagatatgcaagtgtacctgatgattctgcttctaacaaagagaagtttgaagctgatacaaagtattggaaacagctcgtttcagaagtatatttcagtgacttcccacttaattggtcaagcattcgtaatgtaatggacatgaatgctggttttggagggtttgcggcagcgctcattgatcgaccattatgggttatgaatgttgcaccaattgggcagccagataccttgccacttattttcaacagaggtttgattggggcatatcatgactggtgcgaatctttcaacacctaccctcgtacctatgatcttctccacatgagtaatctcattggaagtcttacaaataggtgtgacctcattgaagtggtggttgaaatcgacagaatactgagacctggaagatggtttgtgttgaaagacacattagagatgataaaaaagatgcgcccaatcctgaagtctctgcactatgaaactgtcatcgtgaaacagcaatttcttgttgctagaaagagtttctggcagcccggcaaaccatcttccacgtcagggtgacacagatcatactttcaggggagtcatcaacaatcaatgattctattgattctttgaattctgatcaaattaattctttctgcaacacagccaatgtagattattacttatgtaaaagcataataacaaggatgtat

SEQ ID NO: 13924 - DNA, 855 bp, Sorghum bicolor
  Predicted polypeptide sequence is orthologous to G1313
tctggtgctagtggtggcggcatctcgcttaggcgagatccccctcctcccccggtttccacccctctgctctgctccacccgagtcgactccttcccttgcaatccgctgctggtcagctcacagcagcagaggaggaggaggaggagtccattggaggagctcagctaggctccacgctgggctcgatcggcaccggctgctgcgagattccgcgagcgcgcgatgtaccgggtgaaaagcgagggcgagggcgactgcgagatgatgctgcaggaccagatggactcgccggtggccgacgacgtgagcagcggaggcgggtcgcctcatcctcacaggggcgccgggccgcccctgaagaaagggccatggacgtccgcggaggacgccatcctggtggactacgtcaagaagcacggcgaagggaactggaacgcggtgcagaagaacaccgggctgttccgctgcggcaagagctgccgcctccgctgggcgaaccacctcaggcccaacctcaagaagggggccttcaccccggaggaggagcgcctcatcatccagctccacgccaagatggggaacaagtgggcaaggatggctgctcatgtaagtgcctagccgaaatacttgattccctgtgctgcacttcttctgcacatccgtatttcgtatttcagtctgcacatgtcgaatacttgattccctgctctggggtctgatcaggtgaagtttccagggagaattgatgtgttcgttgggtctttattacgtacgtgcagtctttaattcaggatgtgtatttctgtagttatttagcgaattattctgttttgtgtcacgtactggaactgt

SEQ ID NO: 13925 - DNA, 654 bp, Sorghum bicolor
  Predicted polypeptide sequence is orthologous to G1324
tttccccttttctttcctcatattacgggcctgtttggtacagctcacaacagcttcatgaagctgttgtgagctgtttttttgccaaacacttatttccaaaacagcttcatggatgaagctgttttttccctcctctcacaaagacataagttggatgaagctgaaaaaaagtagcttattgcagcttctccctcatttctctctctcaactatacatgaagtagttagtgaagctattttgccaaacactttctccaaaacagctcagcttcatctagaaagtcactcatgaagctattttgtaaaaaaacagctttactagtgaagttgagctgtgccaaacaagacctacatattcgattttggcactagtatattaccgaaatgattttggcacgtcgaaaccgaaatgattccatcaatcgtgtgctctggactcctccacgcatggctgtggactgagatgctgtcgtgataataacgctgagagtaacgaccgagaccgacagcgatattgcggccttgtttcagttcgcaaaaaatgttgaaaaacggcactgtagcactttcgtttttatttgacaaacattgtccaattatagagtaactagactcaaaagattcatctcgcggtttacagatgaactgtgc

SEQ ID NO: 13926 - DNA, 695 bp, Sorghum bicolor
  misc_feature (682)..(682): n is a, c, g, or t
  Predicted polypeptide sequence is orthologous to G1361
aggctttcgatcgatctccctctctctctctatattccactctactcgtcaggccttaaacgaggagagactagatagagagggcgagatcgatcgtcttcgtcatcgtcgacggccatgacatggtgcaacagcttcaacgacgtgcgtgccgtggagaacaacctggccaccgccgcggccgtggccgccgccaagaaacagcagcaggcctcctcccacgtcaacctcatcaggacctgcccctcctgcggccaccgcgcgcagtatgaacaggtgcaggcggcggcgacgatccaggacctgccgggtctgccggccggcgtgaagttcgatccgacggaccaggagctgctggagcacctggaagggaaggcgaggccggacgcccggaagctgcacccgctcatcgacgagttcatccccaccatcgagggcgagaacggcatctgctacacgcatccggagaggcttcctggtgtcggcaaggacggcctcatccggcacttcttccaccgcccgtccaaggcttacacgaccgggacgcggaagcggcggaaggtccacaccgacgagcagggcggcgagacgcggtggcacaagacgggcaagacccgtcccgtgttcaccaacggcaaactcaagggctacaagaagatcctggtgctctacaccaactacnggaagcagcggaa

SEQ ID NO: 13927 - DNA, 683 bp, Sorghum bicolor
  Predicted polypeptide sequence is orthologous to G1363, G1782
agggcggcgggctgccggaaggggaacatgctccctcctcatctcacagtatgaactgaaaaacaagaataaagaatttccatgcgatgagacagaatggcacggtaatgattcaatttggtcatcaaatgcctgattacgactccccagctacccaatcaaccagtgagagccatcaagaagtgtctggaatgagcgaaggaagcctcaacgagcataatgaccattcaggtaatcttgatggttactcaaagagtgacgaaaacaagatgatgtcagctttatccctgggcaatccagaaacagcttatgcacatccaaagcctgaccgtactcagtcctttgctatatcatacccatatgctgatccatactatggtggtgcagtggcagcttatggctctcatgctattatgcaccctcagctggtgggcatggtttcatcctctcgagtgccattaccaattgagccgtacctgcacgagtctcggcatctgcacgcgatgaagagagctcggggaacaggcgggcggttcctgaacacaaagcagcagccagagtcccccggcagcggaagcggcggcggctcctcggacgcgcaacgcatgcccatgaacggtggtggcctgttcacgaagcacgagcacagcttgcctcccggcgatcgccaccactatcacgcg

SEQ ID NO: 13928 - DNA, 601 bp, Sorghum bicolor
  misc_feature (222)..(222): n is a, c, g, or t
  Predicted polypeptide sequence is orthologous to G1380
ccctcccgcggccgtggccgcgcccacgtgcagctccagctccaccgtcgagtcctccagcgggccccgcaccggagtgcccagggcgacgccagcggcggtgcatcgcaggcgtgctgctgcgaagccgcggcccctgcggcaggccgcgcccgccgacgccgactgccacagcgactgcgcgtcgtcggcctccgtcgtggacgatggcgacgacgcctnccacggtccggtcgctctcgtgcccgcgcccgacgctcgacctcaacctcccggcgccgctcgacgtcgatgatagccacgagctcgggctctgcacggagctgcggctctgagcgatcggatccacggacggagacgaagcaggggagagataggcggttttgctttggtcttcttttcttgaccgggttctgctttgacttgtcgtgctcgtgagagagcttgtaccagtgctgccctgtactaatggcaatagaattggatgatgattcctgcaacgaattcattcagaggtcagtcagatcgtcgagagtgttatttttccaatctcttgtatgggatctgatattgccattttgtttgtactagaaactctatt

SEQ ID NO: 13929 - DNA, 711 bp, Sorghum bicolor
  misc_feature (188)..(188): n is a, c, g, or t
  Predicted polypeptide sequence is orthologous to G1380
gccgcccaccaccaccttcacatgcccgccgccgccgccgcagcagcgccgtacacgacgtatcccaacgccacgggcgtctcgacgccgccggtcgctaggccggcttgcagcagcctaagctccaccgtggagtccttcggcggcgcgcggccgcggcccgtgctcccgccgcggcctcttccgcncgccgatccccgacggcgactgccgcagcgactgcggctcctcggcctcggtcgtcgacgacgactgcacggacgcggcggcctctccgtcgtgcccggtcccgctcccgttcgacctcaaccttccccctggcggcggcggctgcggagccggcgtcgggttgtacgctgatgaggaggatgagctcaggctcacggcgctgcggctgtgacgtcgagctcaattgagcgagccgctgcttagagaaagaggaaaaggagaaaaatatttggttcttcccttctctggtagccgacaccaactctcccctccactacgatgttgttgttgttgtttacttgatctgacgatgattactatttgcctgaatcttggttgacttatctgcatgcttgcctgcttgttttcgggcgattgaggattatcgccaaatcttgcagcagctgttgtactgtaatatagcaacattttacttccttcctcttgtgaggaaagagacagacaaagtaactttttcaatct

SEQ ID NO: 13930 - DNA, 736 bp, Sorghum bicolor
  Predicted polypeptide sequence is orthologous to G1382
atcccggcaccgccaatggccgattcgccaaaccctagctccggggacctccccgccggcgctgggggctcgacagagaagccggtcctggcggatcgacgtgtggctgcgctcgccggcgccggcgccaggtacaaggccatgtcccccgctcggctgccgatctcgcgggagccgtgcctcaccatccccgccggcttcagccccggcgctctcctcgagtcccccgtcctcctcaacaacttcaaggttgaaccgtctcccacaactggtactctgagcatggctgcaatcatcaacaatagcactcatccagacatactgccttcgcctagggataattcagctggtagtggccaggaagatggaggctctcgggattttgaattcaagcctcatctcaattctcaattggcggctcctgcggtcaacaatcaaaatcgtcatgacacccctatgcaaaatcatagctcaaatcatgcctcaccatctagcagtttgatgactgaaaataaacctctctgctcacgggaatcgagtcacacatcaaatgtttcaagtgctccaaaccaacctgtttcaatagtttgtccatctgacaatatgcctgctgaagttggtacatcacagatgcgccagataaatagctctgaaaatgctgccccggaggcacaaactgaaaatgtagctgaaaaatcagcagaggatggctataattggcgcaaatatggacaga

SEQ ID NO: 13931 - DNA, 116 bp, Sorghum bicolor
  Predicted polypeptide sequence is orthologous to G1420
cggagatttgttggctggcgagactgagcccaacagcaagaagagaaagaaatccattatcagcgtgcgcaacagcattcgaaagaaattaaaaacaaagtaatgtaaataatgta

SEQ ID NO: 13932 - DNA, 680 bp, Sorghum bicolor
  Predicted polypeptide sequence is orthologous to G1435, G2741
cctcatcctcgtaacccgccacacggacatggaagacgacgacgacgccggcgccggcgccggcgcgtgcggccgcgtgctcgagtgggagcacggcctgcccacggaggaggagctgacgccgctctcgcacccgctcgtccctccggcgctcgccgccgcgttccggatcgacgtcaggggcaccggccccgccttgccctcctcccccgccttcgactgccccaggcgtctatcgcgcgcaaggcccccacctctcacctgtcctgccgcggcgaggaccaggacgacgactaggactatgagggggagggggaaaggcactataatcgctccggctggaggtgtcagagagctgttgggtcctgaagtgggagccgtactccggcgggaaggccggaggaggctgctgcggctttccggggctgcgcgtgcgcttgaggtagatgcggtacttctggaggtggctggcgacgttctcgcgggtgaggccctcgacgttcatgaggcgcacgatggccttgggtacggcacccttgtcgccgaggtgcgccaccgcctcgacgaaccggtggtgcagctccggcgtccacaccatccgcgccttcttcccggccctcccgcctccgcacgagccgccgattccggaggtggcgtcctccccctcctcctccctctcc

SEQ ID NO: 13933 - DNA, 721 bp, Sorghum bicolor
  Predicted polypeptide sequence is orthologous to G1435, G2741
gcaggcctcttccttcctcctccccacgggcacaaatatctccgtccctgtcccctatctctcctcacccgccgccggcggtcgaatcgacggaggcgggtggctggattgctcgattcggatgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcgg

SEQ ID NO: 13934 - DNA, 600 bp, Sorghum bicolor
  Predicted polypeptide sequence is orthologous to G1435, G2741
atgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcgg

SEQ ID NO: 13935 - DNA, 754 bp, Sorghum bicolor
  Predicted polypeptide sequence is orthologous to G1446
ctgaatttcctcgccactttccttcttctctcccaccagaaacgcggacgcgcaaagcctcaccgcgtcacgactcacgccacgcctccgatgctcgccggcgtcgtcggctgcctccggcgatgccaacgagcccgctgaagcgcacgtccggcggcagcggcggccgcctgcgccgcctcctggcgtccctccgcccgccggcccgcgcggggccgctccctgtgcagaccggcttcccgacctccctcgccgacatcgtcgtcaagaaccacggccgcctcaggaactccagacggcgacaccgcgcacccggcgccgccgtcccgccggccgcggagctccagcaaaggagcaacctttcggtgtctcatcacgacgcggcggcaccggcaccggtaccggtgacgacacgcccaggcaaaggcgcgggcttcagcatccggccgggtctcctcgtggccggcggcgccgtggcgctggcgctgctggtgatctggagcaagcagctggtggccgcggccacgctcgcttcggtggcgctgtcctggatccgtctcgccgatccgggacgcggcggtgtcgcccaggccgagctgcggcgagtgcgcgttctacgacggaggcagcgatgcggcctggctctgctttcccgacgccgatagcggcgacgactcgtcgtcggcggtgaataaccagaagcggaaacagagcaggaggtcgctgcggaagctactttccagcaagttgcgga

SEQ ID NO: 13936 - DNA, 603 bp, Sorghum bicolor
  Predicted polypeptide sequence is orthologous to G1451
tggcgatgacccgtggcaggaatttgtgaacagcgtgtcctgtataaagatactttcaccggaggaggttcagcagatgggcaagccgggcattcagctcttgagctcggctccttcaagaaggctgagcaatggctgcgacagctatgcgagcatgcaggaatcaagaagcctgagcactgggatggcgccagtgggttcggtcgagttctgaagacagggatgccccatagcccttggctttaggattctccttctgtatgtttctgcagcactagctagttttgcgacttggaacaaagcacatagatcaaacgagctctatgctattccacgtctgatgatgtcctatggtacaggtgccagccatatctggaaaattttgttggtcacctgctgtcgagtatccaactgtggatgcttcgtgctcgtgcccccagctcgccttcttctgccgtgcctgccccctccccgacgtcactattttacgaacgttcagccgaaacgaaaccagcggtcaattcccgacagccatttctttccatttttggaaaatgtatatgttactttttatttttagacagaacaggaatcattctattc

SEQ ID NO: 13937 - DNA, 727 bp, Sorghum bicolor
  Predicted polypeptide sequence is orthologous to G1451
cagattcagcagctactacgagttacgtagcgagctcgagcggttatttggtcttgaaggccaattggaggaccctgtaagatcaggctggcagcttgtattcgtcgaccgggaaaatgatattcttctcgtcggcgacgacccgtggcaggagtttgtgaatagcgtatggtgcataaagatcctctcgccacaagatgtgcagcagatggtccgcggcggaggcgaccttctgtctgcacctggagcgaggatgctgcagagcagtgtctgcgatgactattctgcaggccacgacatgcagaacctcaccggcaccattgcacctgtggtgcctctggactactgagactgagatgaagaccggaatctgaagttctgaaccaaaaccagcaattcagcaccggaggattgccatccacaagtcgtttcagttcctatgatcttctctcatgtcctgttggtcagaaataacctagtcattaatatagctagatgagatgatcccttgtatcattatggtaatggacatgttgtacgatagctactgtagctatgtgatagccatagcctaagctctaaatggcagggaagaattgttctatgaaagtatgaacgcaggcactcactgtagaggtgatctagccctgtagttctctatattatcttatatcgaaaactgatggttccttgtggcgcctaaactattgaaacctgtcaccttgtc

SEQ ID NO: 13938 - DNA, 575 bp, Sorghum bicolor
  Predicted polypeptide sequence is orthologous to G1480
cgcggctgatgcggtaccgtgagaagcgcaagaaccgccggttcgacaagaccatccgctacgcgtcccgcaaggcgtacgccgagacgcggccgcgcatcaagggccgcttcgccaagcgctgctcctcggaggccgacgacgacgcgctggagcacgacgaaggcgcgtgcttctcgcccgcggggtcggcgcacgcggcgtcggacggcgtcgtcccgtccttctgttgaggaggaaagaagacggcgaaccccggcagacggcggccttccccgcctgcctgcccggcggcgacgacggctccttagttttgccaactctgtcgactctgaacctttttttttttggtctctcctccctctctcttttgatcgaggggttgctagctctggatctgaaactccgaatgcatgggacgcgagctccgtgtagcatgaataactgtgtagttgttcgatggacgaatcaatggcgttcgcatggaattctcctcttgtaatcctctcggtcctcaccgtcactgtaatccacccttgtatatgaccatctagagtgtttcttttccaggatgc

SEQ ID NO: 13939 - DNA, 582 bp, Sorghum bicolor
  Predicted polypeptide sequence is orthologous to G1480
ccaaagcctcaggcctacatgccatacacggcgactccccagagccacagcgtgtcgtccgtggacgtggaggtggtgccggagcggggagacttgccggcggtgaggccggtgccgctgatgggggagagccgggaggcgcggctgatgcggtaccgtgagaagaggaagaaccggcggttcgagaagaccatccggtacgcgtcccggaaggcctacgccgagacgcggccgcggatcaaggggaggtttgccaagcgcgccgaccacgacggcgacggcgacgccgacgacgccgaggccgaggccgccgtgccgtcgtcgtacgtgctcgacttcggctacggcgtcgtgccgagcttctgatgatctcgatcggcccaccccggccggcggtcccaacgcgcgcgcatgcatgcatggccgccacggaacgccgcgcgcgcgcgcgcgccttgtacttgtatcaatgtatagggaggaagtagtaatcccatgtacttatttttgagcaagcccttgcgtaaactagccatgtataatttgtatactacgtggtaacaagctgcagtagccgcatac

SEQ ID NO: 13940 - DNA, 653 bp, Sorghum bicolor
  misc_feature (653)..(653): n is a, c, g, or t
  Predicted polypeptide sequence is orthologous to G1480
ttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattgatcgatctccgcagcaattgcaacgccgacatgtacactagtttgcctcgagcttttggggctgtaatttttgctgcatgctttgcatgcaaagctctcgtgtatatgagaggacttccaagcgcgcgagcgctctcttttcctcctcttctctattctatatagtatattattactatacgaactgctatn

SEQ ID NO: 13941 - DNA, 485 bp, Sorghum bicolor
  Predicted polypeptide sequence is orthologous to G1480
gcacgaggccacgccgcgctgcctccccagtcccctcccctccctccccaccaccaccaccaccacaagaaccgcgtcggcagacaccaccgctgtcattgccgcggccaggcgcgccagccaggagaaaggcgggaggcgcctgctgtgcttagccgcttgctgacctcgctcgttcgatggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgatggcgcgccgccacgcgcgggtccccagcgcgccc

SEQ ID NO: 13942 - DNA, 547 bp, Sorghum bicolor
  Predicted polypeptide sequence is orthologous to G1481
acaagaatgcaaatggaaattgttgctcgacagaatgctgaaagtaagaacagagctcttgagcaacgtattttggaattggaagaggaaaggttggcacaaggaaggacaaatgttgaagtcctatcacagcatggttctaattcaagacaatatgcgattctgacacctgaagaacatatcgatgaggcacataatgatcctcagcctgaaaattatgataattatgtacaagatgaagaaaatgaacggtatggcgaggaggacgaggacctgcttccatgtaggcatggtgcaacccgatcagctatgaacataacaacaccaaatgttcaaattgaagagaacttgacccccattaggcctgctgtagctgtccgttcagctgtgcacatgaatactgcaccaagcgatatccacccttgccttgcaaacgattcacatgttgcggtacaagagagcttgctgccccctaggactgttgcagcccgatcaactattaacatgacttgtggacactatattaagattttgataacgtttttat

SEQ ID NO: 13943 - DNA, 679 bp, Sorghum bicolor
  Predicted polypeptide sequence is orthologous to G1493
tgttccctttccccgcccgtgcctgcggcttctgtctctgaatcagcggcggctcccgaggcgcgggctggcgagcggctaggcgccggatctacggcggtgatggaggtgtgatttggacgggagggagcgaggtgaggtctcggttttctcggtataggagatggcggcggcagaggcgcggggaggggagttccccgtggggatgaaggtgctggtcgtggacgacgacccgacgtgcctcctcgtgctcaagaggatgctccttgactgcagatacgacgtgacaacatgtcctcaggctacaagagcactaactatgctgcgagagaataggcgtggttttgatgttataataagtgatgtccacatgcctgatatggatggattcaggctacttgaacttgtaggccttgagatggaccttccagttatcatgatgtctgctgattcaagaacggatattgtaatgaatggaattaaacatggagcgtgtgactatttaataaaacctgtcagaatggaggagttgaaaaacatctggcaacatgttgttaggaaaaaatttaatgaaaacaaggatcatgagcattctggtagcctagatgataccgatcgtaacagaccaaccaataatgataatgaatatgcttcctctgcgaatgatggaggtgatggc

SEQ ID NO: 13944 - DNA, 737 bp, Sorghum bicolor
  Predicted polypeptide sequence is orthologous to G1510, G1779
acccacccatcgctaactctctcgagctaaaacccttgctctccccgcccgcccatttccctttccccttaggcgtcgctgcttctccggcggatcggattggcgatccatcatcgccggcggatcgcacccgcctacaaggctttgttgcgggatcggatcggattagcgatcgatctgtcgcgtaggcctgcttgctttgctttatttcccatcccatggaggtggagatggaggtggagatggggacggatcccaatcccagtcccaatcccaatcctaacacttccccctcggccgccgacgacgccgccaccgcctcaggcgaggccaaggcctgcgccgactgccacaccaccaagacgccgctctggcgcggaggacccgagggacccaagtcgctctgcaacgcctgcggcatccgctaccgcaagaggaggaggcaggcgctcggtctcgacgccgcggccgccgactcacagcaagatcagcagcagccgaagaagaaggccaccgccgatccgcagcagcaggatcagcatcacctgagaaagaaggccgccgatccacagcagcaggatcagcatcacctgagaaagaaggcagctgccgctgccaccaccgatccacagcagcaggatagaaagaaggccgctgccgccagcagcaccaacaagaaagacaaagataaggaggacaacaagaagaagaaggatcagcaagtcaccgtggagctc

SEQ ID NO: 13945 - DNA, 836 bp, Sorghum bicolor
  Predicted polypeptide sequence is orthologous to G1510, G1779
cttgccttttgatccctcgctccaattgcccattattccgacatacacacagcaccagccgccaccgccgccgcggctgctgttctcctcctactctctccatattatctctcatctgatcttcactcatcacctagctatatatactagatcctgctagctaggtcctccatagctctatccaaatctcgatatcgcaagcaaattcctgatctcatcagtccctatagctcccatgtctgccatctacatgagccagctctccactgctctccctctcatggagggagatcaccaccaccaccaccaccaccaccaccaaggccacttccaagccttcacgctgccaaaggatcccccaatccttttcccctttgtgatcagcaatagtagcgccagcgaaagcagtctgagctatggatcggcagatcatcacttgttgaggcagcatcgtcaaactatgctcgagccccaacatatgattggtggatcgtcatcagctgcgagtagtgtctttgcgacgccgttcccgactgtggagagcatccgtgacgacatgatcgagcctgcctcgtacgatccatacgatatggggaagctgcaccaggtggtcggtggcgggtcgtcgatggatgcttgcagctggacgccgccggcggccaagatgaggatcacgaggaaggccactgccgccgatcccagtggtgccgggaagaagccgaggagaagggcgcatcaggcagcagggtacgacgccgacatcaacatgagcggccaaccaaatttgggtgttattagggtgtgctccgactgcaacaccaccaagacgcccttgt

SEQ ID NO: 13946 - DNA, 815 bp, Sorghum bicolor
  Predicted polypeptide sequence is orthologous to G1510
acacggctgacgttctctcgaccagcctctgtctactacttcgttcaccccttcggcttcgtctcttctactcttcctccctcgtctccggtggttccttgatctatggatggttggcgcctgatgggcggttgttggatccgatggaaagctagtttctccggatcggatcagatcacatctcccggtaaccgttccgatcaacctcttccggtattttttcagaggaaaggttggccaacgggcttccggtggttggatttggtggcggacttcggttaggttcacatatcgcttgcagttcggttcgcttcaatggaaagctgatgtctctaggttagaagaataactatgagtaagaaaggaaggatggctgctagattgggtagctagctgttggctgcttggttctacagtagcttggagcttggcttctaggtgttctagtgatggtggtggtggtgtttggttcaggggatggattaaattagtgtctgaaatagctgtttggtttaggtgatcttaagtagacgacctgattataattcagggtagtttatcgttgcaataatctaaggtttggtgtgcgtttggtctgtgtgagttttgtgttaggtgagtcatgaactaaagttatgtgatgtttagtaggtcaggtgaaggttcttctcttatgtaagatgtcaagtttgtatctattatcagcttagctgtgatatactactatatatatatatgagtggtaaatttaggtatggaaaatctgtgttggtgcctctgatcaggaatggttaacatctcttatctttatggtc

SEQ ID NO: 13947 - DNA, 796 bp, Sorghum bicolor
  Predicted polypeptide sequence is orthologous to G1512
ccgcctcctctgctatctctccctcctgccatattatcgccggctgccgtgccgcagcgtcctgctcctccctccccgtcgcccgaagcaccgccgcggcctcgcgccaccgcccagaaaccatcttccccttgccgcgccgccgagcctatccccggggcctcgttccaccgaagcgcgttgtgtcaaatttctgcgacctagccgctgccgccgccgtcgtcatcatcctcgctggtggtgctgagcgcagatccattccagctcggattgatttcttcctttgctgtgctgtcataactgaactagaacagtttctgagagcaagcatcacgattgttatggaagctgggagagtggatcagccttgcatggctgctaccaatagccaacctttcgtggctgatattgagccagtgaagaaggccagtggggacatgcctgtgacaacaggaagcggatgctttgactgcaacatctgccttgattttgcagcagaaccagtggttactctctgtggccatctatactgctggccttgtatctatgagtggctgcgccctggggtggagtcgactgccagcgacaacagcagttcggcaaggcggcaatgtcctgtatgcaaggcaacactctcaacggacacccttgtgccactatatggccgtggaggggactcaaagaagtcacctaatagcattgccatcccgcgccgccccatggtacaccgggagactgttgagcaacagaatgcagagagcaacgccaatgatcagcactaccaccagagcatgga

SEQ ID NO: 13948 - DNA, 525 bp, Sorghum bicolor
  Predicted polypeptide sequence is orthologous to G1526
gtggtgttggaatcaaccttactgctgcttctaatgcatttgtcatggacccttggtggaatcctgccgtggaagagcaagctgtcatgcgcatccatcgaattggtcaaacgaagactgtttgtatcagaagattcattgtgaaggccactgtcgaagaacgcatggaggccgtccaggctcgaaagcagcgaatgatttctggagctttgactgaccaagaagtccgcactgcacgtatagaagaaccgaagatgcttttctcttgagacgaaaaaaagggctgttgagcatctgatggtcggcatgcttgcacattgcatccatggataaaacaagatggccggtgtcctttttttttcaaaaccagaagttggaaggtaaggcgagggtaggaaatttgccccgcctcaaatatcttccatcttcgggcgtttagctgttgttgtacgcgtggttcgtatatcatgaacaaaatgggagtcagcaatcggcagaaagaaaagtttcttttgtaaactgtgc

SEQ ID NO: 13949 - DNA, 538 bp, Sorghum bicolor
  misc_feature (484)..(484): n is a, c, g, or t
  misc_feature (494)..(494): n is a, c, g, or t
  Predicted polypeptide sequence is orthologous to G1537
gcacgagggttcctatggatctgccataacttgcccactgatggttaagggccatcctggaggaagaaagactcataacctgctttctgctgctgaccacattcagtcaggagacagcagtgttctatcaagatcaaaaggttgcatagctgtgccagagaatattaaggatgaatatttcttgtcaggctcggatgaaactggtgtccaccgccatgcgcatcctggtctacaagtggcaccaagtagggctctcagaaggttgaacacaagcacatcagatggaatgtcatcatcctcgtatatcactggaagggacgacattctgcgtggcagctgtgagtttggatcttcagactgggagcatgtgctgaaggaagaaatcggctcaacctaagggctcaagggatctggctggaagtatatactagtagtgtacatgtacgggcaaccacgaacctaggaattcgaggcctcttgattntgcttgacanggctgatgaatgggcactgcttgatatggtgccgctctagccta

SEQ ID NO: 13950 - DNA, 728 bp, Sorghum bicolor
  Predicted polypeptide sequence is orthologous to G1638
tggaagccactgcccaatcgccggctgacactcacaagatacctgcctccctctggatcgctatctcttttctagtgctcagggaaagctagctcagagctgttgagagaaggaagcaaggagacggagagggagggagggaggaaaaaaaaacacacacacacacacacacacacacacagaggtgttgagcaagaaccgaggcggatcgccttttgttcctcctgccgaggactagcctgcctgtcggcgccgcgagagatcaagaggaggcgcggttcagtgattcctacaggggagggagaagaggaggaacaccgggggcggagagagatgatgcgggagatgtatatggacgtgctgccgccggtggaccacataaccgcacggagcaactggttcccggccgcggcgcgtctctggacggcggaggagaacaagcggttcgagtctgcgctcgccgggctcgacctctgccacccggactgggagaaggtggcgcaggccatccccggccggacggtccgcgaggtcgtcagccacttcaagaacctccagctcgacgtccagcagatcgagagcggccaggtgcccttgccggtctacggcagcggggccagctcgttcactctgcagtgggacggcaatggcggctacgggcccggggacttcaggcacgggtaccgcttcggcggaggctgcgggaagcggcaccatggccgcacgcc

SEQ ID NO: 13951 - DNA, 793 bp, Sorghum bicolor
  Predicted polypeptide sequence is orthologous to G1641
ttgctcgccttttctttaggcctccaacggtggagccgtaataaactccggccacttcggcatccgccggggaatttgattcttctctccactatatactcacgctaccttccacctccccctaattctctccctcgtctttcttcgccgccagccagacagctccagctcaggtgggcagacacgcagcggccaagatgatggcggaggcagcgtggacgccggtgctgtttccgccgacggtgccctgtttctggcagcctgacacgcacccggttttttggcggagaggagacgcgtggacggcggaggagaacaagaagttcgagaaggcgctggcgctgatcgaccggaacgcgcccgaccggtgggagaaggtggcggagctgctgcccaggaagacggccgacgacgtgaggaaccactaccacgacctcgagaacgacgtcggctacatcgaggccgggctcgtgccgttcccgcactacagcagctcggtcccgtcgtccgggttcaccctcgaggactgggacgcgtacggcggcggcggcggcgggttcaggcgcggcggctactgcctcaagcgctcgcgcgggtcggaccaggagcggaagaagggtgtcccctggacggaggaggagcacaagcttttcttgatgggactgaagaagtacgggagaggggactggcggaacatctcgcgcaagtacgtgacgacccggacgccgacgcaggtggccagccacgcgcagaagtacttcatccggctcaactctggcggcaaggacaagcg

SEQ ID NO: 13952 - DNA, 716 bp, Sorghum bicolor
  Predicted polypeptide sequence is orthologous to G1649
agattgacaaagcctccatgctggatgaagcaattgagtacctcaaaaccctccagcttcaagtccagatgatgtccatgggaagtggactgtgcattcctcccatgctgctgccaccaacaatgcagcacttgcaaattcctccgattgcccatttccctcatctcggcatggggttgggttatgggatgggcgtcctcgatatgaacagcacagcagcggttccatttccacccatgcctggtgctcacttcccttgttcaatgatcccaggcacgccaccacaaggtcttggaatgcctggcagaaacacgatgccaatgtttggagtccctgggcaagcaatccatccctcagcatctagcatacagccattcccatctttggcgggtcttcctgttaggccaaacctggcacctcaagcttcagccgtcatggctaacatggtgcaggagcaacagcaaggggctactcagcagcagcatagcctgaataacgaagctcaacagggagcaaatacaggagatcctcaattgcagactaccgtgcaggctgagaaccagcattttagtgtgccctattcagcacaaaccgaaagcaatcagtttttggatggtggtggcaacaggacagatactacagggagaaatgaagctgaaacataaaaatagtcagcaagtgcgagtctcgactaacaagctgcagatgtgaatatc

SEQ ID NO: 13953 - DNA, 850 bp, Sorghum bicolor
  Predicted polypeptide sequence is orthologous to G1652, G2776
acgaaagggaccagaggacaggcccctctccctctctctccccaatctccacaggacttgttgagcttttaagcagctagtagcctagagcactagcagtccttttggattttggtttggaaacaaggcgtcccagtcccaaatctcaagcaagcaagcaagcaatctgcagatggcaacacagtggttctccaacatggtgatggacgagccgagcttcttccaccagtggcagtcggacgcgctgctagagcagtacacggagcagcagatcgcggtggcgttcgggcagggggaggtggaccacgccgtggcggcggcgctgtcgacgatgccgcagcagcagcagcagcagcaacccgcggtggcggccgagcaccgcccgcgcaaggcggccaaggtcaacaccagctgggactcgtgcatcacggagcagggctcccccgcggactcctcctcgccgaccatcctctccttcggcggccacgccgcggccgcgttcgccaagccggagccgcacccgcaccaggcgcccagcgccgccgcgtactacggcgccgcggcggcggccgccaaggcgccgaagcaggaggtgctggacgccgccgcgctgccgttcccggctaagcgttcctacgacgacatggccgaggccgccaataaggcgccggccgccaccacacgcccggcgtcgcagaaccaggaccacatcttggccgagcggaagcgccgcgagaagctcagccagcgcttcatcgccctctccaagatcgtccctggcctcaagaagatggacaaggcatcagtgctcggcgacgcgatcaagtacgtgaagcagctgcaggaccag

SEQ ID NO: 13954 - DNA, 576 bp, Sorghum bicolor
  Predicted polypeptide sequence is orthologous to G1666
gcacgaggctactacctagtacctactacggtcaagcagagcgcgtccattcagtcaatcatctgcatcccgctcatgggtggcgtgcttgagctgggtacaactgatacggtgttggaggacccggacttggtcagccgagcaactgcagctttctgggagccgcaatgtcccacatacttggaagagcaagagccgagcccgagctccaacaccccatcggcaaacgaaaccagcgaggccgcagcagacgcagacgacatagttgtgttcgaggacctcgatcacaatgccatggaaatggagacgattactgccgtggtcgagggacatggacaggagctacgagaagccgagagcctgtcaaacgcaagcctggagcacatcacgaaggagatcgacgagttctacagcctctgcgaggaaatggacgtgcagccactagaggatggctggatcatggacgggtctaattttgaagtcccctcgtccccgcaaccaacgcccccggggaacctagctgatggctctcgcgcgaccagtttcatggcgtggacgaggtcctcgcagtcgtgc

SEQ ID NO: 13955 - DNA, 634 bp, Sorghum bicolor
  Predicted polypeptide sequence is orthologous to G1672, G2802
gaaatgcagcacgcatcggttgttctcgatcatgatcagttccatgtgccagcaatccttctccatcaccatgacaaatttcagcctcagcaccaacagcatcagccacaacaaaagcttgaccgcaggtctgccggcttggaagaactgataatgggatgcacgtcgtccacaagcacgaaaggggaaacttcaattgctcacccccaagagacagaatggccttacccgtactggccacctgacaaccaagatcatcatggatagtagcaaggactggtaaaatagtggcgactggcgatgaatgctaaaaggaacactaaccacaaccactttcactggaatggtttttgtctgcttgaacatgcagcgatgcttttcttggagaatgtacacctactatagtggggggaagaacagagaaaaattgatctctgtagatctccctcaataaaaaaaaggaactatgtgagctctccaagacagaaaagacaaaatggccaacgaaaagagaagatgaaagatcgatgggaggaaaggtattgtttgtgctgacactgaagggatcatgtgcgggccgctagatgtattagagaccacttaatcaagtacaactataatcagttcaccgttt

SEQ ID NO: 13956 - DNA, 582 bp, Sorghum bicolor
  Predicted polypeptide sequence is orthologous to G1700
taaggactgggacagtatcaccattacatacgcagtgtgtttattgaatctcttgaatcctgattgacctgaaaatatacacttctgacttccagcagaagtagctgaaatcgctactcctggatataaactagtttcaacatacgtgctgaggcgatctttatatttcatatagtgcagttgtgcatttgatggtttttgccacggtccagtggttgtataaaagatgtcttcattatagctaagcattctttcacggccaatttcatttcactgtggtgtttgcatggcaataatgtcaacacaaaggcactatgtttctttctacttgttgctcttccaacgactttatctaatgatctacctcttgttgcagatagtgtatttttcgttccagtacatttcatacacagcattatactgtacaaagaacatagattggatggcttcgggcttaagaactggaggatgactttctaggatttttcagttgtgatcatcttgcaagtgtttgtgcaatcacacaagaacatgtgatgtactttgagtggtatatgtcaagagattgtcctgtaaataatt

SEQ ID NO: 13957 - DNA, 811 bp, Sorghum bicolor
  Predicted polypeptide sequence is orthologous to G1706
tcttggcctttccctcatcgcctaatgccttggcctcttgcacctcctgcaagttgccggcaaccgagaagctaccactagtagctgctcaggcaggctccgctcagctcaaaaaggcgctcgggtttagtgcacgaaatgagcagcgcgctgcccgcggcagattgggcgtcgtcgacagggaggacgaggacgaggagcgagagggagagatgttgctgctactaggattagccacgggcctcgccgtcgccggggaagccgagaagcagcagcaggacggcggcggcggggcggcgtcctccgggggcggcggtggccatggttccaagattagccccgcggtgctgttcgtcgtggtgatagctgccgtggtgctgttcgtctcctgcctgctgcatctcgtggtcaggctattgcttaggcgcggccgtgcgcgggcccgagccgaggccgacggtggggtggacgcggcgggcggcggcggcggcggcggggaggagtcggcgttgcagaggcagctgcagcagctgttccacctgcacgacgccaggctggaccaggacgtcatcgacgcgctcccggtgttcctgtacagggaggtggcggtcggcgcgggcgccaaggagccgttcgactgcgcggtgtgcctgtgcgagttcgccggcgaggaccggctgcggctgctgccgctgtgcgggcacgcgttccacatcgactgcatcgacacctggctgctgtccaactccacgtgcccgctgtgccagtgcgcgctcggcgccgatgtcgccgccgcgctgttcgacgggtt

SEQ ID NO: 13958 - DNA, 658 bp, Sorghum bicolor
  Predicted polypeptide sequence is orthologous to G1784
aaaaaaacgacgagatagttgtggcgatcctggtgtggctgcctgtcaagtctctcttgcggtgcagagccgtgtgcaaggcttggcgagccatcgtgaatgaccccttgttcgtgagtgctcacctacggtggtcagccatgagatgggagcaagagccgtccttcctcgtcaccccggtaacccgggaccatgtcatcccacaggaggatgtgaaggagcgcggctggccgaccaccttctccaagcaaattagcttctatcgctaccaatggcagtggcagcaaagtgcctccgactccgactccgacaataatggccatggccagcagcagacagctaggttgatgcatgtcaaggagttgggctccaagtccaaccgggtgggcttctttgcccactgtgacggcctggttctcgctcccaccgaaaaggagctctacctcttgaacccggccaccggggacgcaatcacgctgccgaaaagccaccgcaacaacctgcgacacgccccaagaacctgccattgtgttggtcttggcttggatccacgcactggcaagtacaaggtcttccaggccttctaccgacctgttgacccctatccaaggttcaatgactataagaaagttccaatggggatggaattcctcacttt

SEQ ID NO: 13959 - DNA, 697 bp, Sorghum bicolor
  Predicted polypeptide sequence is orthologous to G1789, G1911
ctagcttagcttccttcctctcgagcaagctccagaaaagctacggaatggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctgacatgcaggctgaaacatctgaagatctccggagatgatgaacataataggacgaacgatcgatgatccagaagatacaaacatgtgtgtatataggattaatgggacagcatgcatgcaatggtccaagctgcaactgcaagtagtgatgtgaaagcaaaaatcagattggatgcatgcatatgcatgtgttaattaataataataaattttagtatggggtgagtactagacagtcacgcgagatcgaccgacccatctatctcccatgcatgcatgcatgcaagcttgtgttctctctccctacttgtcaacttgtgtgtgtatattatgtactattattgtaattatatatatgctactataatcgcatctgtgtagcat

SEQ ID NO: 13960 - DNA, 639 bp, Sorghum bicolor
  Predicted polypeptide sequence is orthologous to G1793
ttgaggttatgaagaccatgtctcaagatgaatttgtggcctacataaggaggtcagtggtacagtcgaaaaaattatattgtagtagttatgtgataattatttattgtcattatggtttattattacaggcaaagcagttgtttctcaagaggtacttcatcataccgtggtgtaaccagacgcaaggatggtaaatggcaagcaagaattggtaggattggtgagagtagagacaccaaagacatttatcttgggacctttgaaactgaagaagaggcggcagaagcttatgacctagcagcaatcgagctccgtggtgttcatgctgttaccaattttgacattagtaactactgtgaagttggtttgagaaaactagaaggtccgtcagaggtggtgaatctggaaggtccatcggaggttatgaagcacgctgggcaatagatctagaatagcaacatgtaaattagtttttatttcatttctttcgtcatcatatttttctctccttttggtattcctggtaccttttcttccccctttggtgagttatctccttgccgtcttgtcaagccagtatttatccggctcgaaaggacaatgtgatgttgtaaaggcctcacagaaaggtcttat

SEQ ID NO: 13961 - DNA, 716 bp, Sorghum bicolor
  Predicted polypeptide sequence is orthologous to G1821
agaggaaaacttcgacccttcaactcaacccgacgacgaccgagacgaagattctattcacgtgttagccacatcgccgacactctctgcgaacatattacgaaacgctcgtctctgtgaagagctgctttgcttgttacttgatccgccatttccttttggccccagacgacgactgacgaaccaccgtgttccgtccctcaactccagattccctgatcgcgcccactttggctgccccaacagaccagacgacgataacataaataaataaataaaaaggcgaagagaacatcgtttctcatatctcaaaagaaaaatcaaagccgacgatacagaggccctttgctgcactctgcttatacatcctacaaaggcgacgaagcgtcacatatttgtcgacgcaatatttactcttgcttgaccggaagtcgaggacagcgaaaactcgcacgcgctgacggtgttctgtctcccccccttctggcttctagcatcttgctcgcccctcattttctgacgccctgtacctacctgtctcttttctggtacagctatcaacaaccaaagtcggtggcccactgcggcaaccacgacgacgactgttttctccccatatccaacgtgatctgattgcttcttttttgcaattcaatatcgaacggcgacacaatttgctattgctgatcaacttgctcttctgcgctttcgatctc

SEQ ID NO: 13962 - DNA, 568 bp, Sorghum bicolor
  Predicted polypeptide sequence is orthologous to G1855
gagatggataggatattaaggcccgagggcacagctatcatccgtgacacagttgacgtgctcacgaaagtccaggcaataaccaagcggatgcggtgggaaagccgcatcatggaccacgaggatggccccttcaatccagagaaggtcctcatggcggttaagacgtactggactgccaaaacggaggaggagcattagcacacaggcgacacggctcactgaaaacctgaaccaggcttgttctaccagttgggaggatggcatcagggttttgccgtctcagtgtagtatgggaccgcctggtcacatgttcctttcacctttctgtaattctttgtagctgcaatcagatgagaagctgagggaggagtttgaggggtgattggacctctagttgatacaggaaaaacggttttgtagcaggggaagaattcgctggtcttgcataggttcctggccctgttccacgaggggttgagctaggttttagtctgtaatatgatggcaccgagcaggcagtgttaccgtatattggagtgacactaatagtaataggtatttattc

SEQ ID NO: 13963 - DNA, 711 bp, Sorghum bicolor
  Predicted polypeptide sequence is orthologous to G1868
agggtccaacaggaatttgctggataaacagaatataggcgaccagttctctgtatccacttccatggactcctttgacttctcagcgtcacattcttccccaaaccatgacaaagtagcattttcaccggtggagatgcagcatgaacatgatcagctgtatcttgtgcatggagcaggcagttcagcagaacacgttaacaagtctcaggatggtcagctactggtctccagggaaacaattgatgatggacctctaggtgaggttttcaaaggcaagagttgccagtcagcatctgcggacattttaactgaccaatggacttcaacttgtgagttgcattctccaaccggaatcctacaaatgtctagtagcaacagagtgacagtagagaaccacacaagtaacaatagctatctcatggcgaggatggtgaattctcatactgtcccaacactccactagtcaggctggtcttgttgggaccacaaacaactgaaaccatgtgtaatgtcatgagtttgctgatactaggttttcagtcaagagtcttgtaactcctgttttagttgttatatgttcacgttatgttgcctttaattttcggttctggtgggtgtactaataatttatttccttgttccttgtaaaggatttgaattccaatctgagattgggtattcatgtgggtttcctaacatggaggtatt

SEQ ID NO: 13964 - DNA, 522 bp, Sorghum bicolor
  misc_feature (20)..(21): n is a, c, g, or t
  misc_feature (74)..(74): n is a, c, g, or t
  misc_feature (82)..(82): n is a, c, g, or t
  misc_feature (93)..(93): n is a, c, g, or t
  misc_feature (105)..(105): n is a, c, g, or t
  misc_feature (502)..(502): n is a, c, g, or t
  Predicted polypeptide sequence is orthologous to G1917
tccttcttcgccggcgcggnncggccgccgccgcgagcggggggctacttctctctacaagggactacaagctncgccagcngactccatggnccctcaaggtgnaaaggtgtccaagattctatagacactcgctacaaggcccttgaaaagagactcgctgctttagaaggtcagcaaagcactggggctgcaccggatgtggatacaccatctgattagtctgttcactacgaggcttggacacctatgatttacggctgttttcgtcatcctcacttgtcttctcctttgaaatcaagaggcctgactgacaacaaaataagctagaatacttcttttgtactgcaaatgtctgaggctgagattttcccgtacattctgcctgtgtttcatgccataaaagcacatgatcagaactctgattgctcaggcatacttagcgtggacccaacccaatttgagacaacgttgcaatgatttttgccgcaccaaaaaaaanaaaaaaaaaaaaaaaaaaaa

SEQ ID NO: 13965 - DNA, 788 bp, Sorghum bicolor
  Predicted polypeptide sequence is orthologous to G1935
gaccatggcaataccggttggttcatttgcggactggcgcccagactgtgaggtcgaagttaaagatgtcactgtggatgccagcgacccacatcactctgacctgctgtctaagctgaccagcagcaataccttgcaggaacttgcataccccaccataagcatggatgacgatgttgtctacttgctttctaggactacacctaggaacatgaggaaactagagttggtggttgctattgatttgaggaagaagatcgtgcaaggagtagccgagcttgatgtccagaaagacttcatttttatgccgtcctattgtaccagtgagatttgcagacttttgaggaagagtacatgcgcaaaagaagaacttaaacaaactgagaacaaagctattaaagcaactgaaaaagaagagggtgaaccaactgagatgcacgtgaaaggaccatccagcaggaagaagtatgtgaagcgtcctgtcaacctgtttgatgcgtgatgcttcagcaggaagaagtaaagtgtgtatggtgtcctgtcaacctgttagatgcggaccggtgatgcttcatgcagatactaggattggggagcttggtgaatcgatttatgagaattatgccaaaaataattatctgtattgtactgcaggcctggctactcgatttctgtactagaacttgcgtaggctcatgtcactagagctgaagcattctatctatcgtttggaaccttgtcagatggtgataatctgggcaggaatctgcatttggttttattgcttg

SEQ ID NO: 13966 - DNA, 676 bp, Sorghum bicolor
  Predicted polypeptide sequence is orthologous to G1938
accgccgagtgcgtagctatccttatcctctcccaacaactcctccctcccttcaccgccgccggtcccctgtcctcctcggcgtcctcgccggcggcaggacaggagggccggccccctgcatctcctgctcccctcttcctcttccttgtaagatcctctagccaaataaagctttggagaaagatggagaagaagaactcatccgaggtgtcacagcagatccaggcggcgctgctcctctgtatcggcgtatctgccatctccagcggctccgggcagcatcagcagcagcaacacggaggcacggagcagcagctgcaggtggtggcgcagcccggggagctgaggaagcagacgctcgcgcccaagcggagctccaacaaggaccgccacaccaaggacgacggcaggggtcgccggatcctgatgcccgcgctgtgtgctgcgcggatcttccatctcgcgcgggggctcggccagtccgacggcgagaccgtgcagtggctgctgcagaaggccgagccggccatcgacgccgccaccgacactgacaccatcccgttcacgccttcgccgtccactacatcctctccgccccccacatcgccgcctccgtcgtcgaccccggctccagcgacctccactgcatccctgtccgtgtcgttgtccttct

SEQ ID NO: 13967 - DNA, 692 bp, Sorghum bicolor
  misc_feature (681)..(681): n is a, c, g, or t
  Predicted polypeptide sequence is orthologous to G1946
atccagtgcccagttgtgctggacaacaagttgtctaaccaagtgcccaacatgagtgctgtgcctcctgtttcaaaccctataacagcaggctcaagtgacatcagcattccggaattctcagatctggcggacttggtaaacgaagactctgtcaatattcctggaggggcctttgagatgcctggtcctgagtttcccctgccagaaggtgatgacagtgtccccatcgagactgatgagaccatgtacaacaatgacgagactcagagccttccaggcatcatcgactccttctgggagcagttcctggtaggcagccctctatccgccgataatgatgaagttgattcaggcggactagatgcaaggggttcaccacaggagaatgggtggagcaaagtggggaacatctccaatcttacagaacagatgggccttctatcatcaacaaatcaccgggactcagggaatgggctgtaatatcttaatatggtagactgggattctggtaataagtgtcgcctgccattttgttattttccttttcgccaaaatgatatgcccggtatatcaacaacccaacctatatgtggggggattcaatcttccagccatgaatgatcttggtacacacgccacagccaggaattcacctgcttgtttctagtgttggcaggnttgagaacacg

SEQ ID NO: 13968 - DNA, 510 bp, Sorghum bicolor
  Predicted polypeptide sequence is orthologous to G1946
gcacgagggacagatgggaatttgcaaatgagggttttcttagaggacaaaaacatctgctgaagactatcaacagaaggaaaccatccttgcaggggaacagccaaccacagcaacctcagttgcagaatgctcctgtgccttcctgtgtagaggtgggcaagtttgggttggaggaagagatagaacggctgaaaagggataagaatgttcttatgcaagagcttgtcaggctgagacagcaacagcaaacaactgaccatcagcttcagactttgggcaagcgtcttcaagggatggagtcacggcagcaacagatgatgtctttcctggctaaggcaatgcaaagtcctggtttcctagcacagtttgtacagcaaaacgagaatagtagaagaagaatagtagctgcgaacaagaaaaggcggctacccaagcaagatggtggcctagactctgaaagtgctgctgcttcgttagacggtcaaattatcaagtatcaacctttga

SEQ ID NO: 13969 - DNA, 690 bp, Sorghum bicolor
  Predicted polypeptide sequence is orthologous to G1968
cctactgggaaagaaaaggtttgctgcaactgtgaccaccagaggcgtacgtgtggcgctatagcttggaaggcaccgtcatgaacagcaaatctgtcgcccgatgcatgcggtgctatagctccgaagacgacatcgtcgagaccatcgaatctgtcgtgcggcaatgtgcgaatctctatcatccctgatgccaccatctccatcaccaccacaaccgtctaggccgccgggacagtcaccggagtacaagcacttctgtcgagtatgcaacaaggggttcacgtgcggcagtgcgctcggtgggcatatgagagcccacggcgctagtgacgtcgacggcttcggcgccgacgatgacttgctcggcgatgaggcgtccacacgatgcctagctgcagatcagtgggacacggtgggaacgtcggcgactcatgcgtacgcgcttcgggcgaatccgaacaggctgatcaggagctgccagctgtgcaaaaactgtgggaaggagttcacgtcatgggagctttttcttcaacatggtaaatgcaattcagaggatgaggaagaagaagaggagtggggatggggttgggctcgctacgttcaccgtcgcctccctcggacgccgtcagtgaggaggatccaacggtggcagccgcatggtcaaaaggaaagcgatcgcgccgcgtc

SEQ ID NO: 13970 - DNA, 567 bp, Sorghum bicolor
  Predicted polypeptide sequence is orthologous to G2035
cggtggtcgttgtgcagatcaccttggttgcctgggaaactggtgcccagaagcaaattatcaagatcgtaaataagctcatgtggacggcatgccttagcacaggtgcggcttttatctcgctggcctatgttgtagttggcccgcagcatgcgtggatggccttcacagtatcagccataggaggaccgatcatgattggaaccctcctgttcctagcctatctgctgttgcgcccacggttcaagtttggcgaagacagacagcgccgcatcaagagggcaagtggcagcaagtccttctcctggtcactccatgatggtttttcagatctagaagccttctctgatcatgagaagaagatctatgccctgtaggaaggtgtaacagtagctactcttgcattgagaagagacaattgggagagtcagagtacaaatggttcatgtatatattcggtctagctgttttgggcttttagatctggcgaggaactgcaattagacctttctcctcgtgtatattatctaagaatgaagagctgcacctactggaatgcgcaagtgt

SEQ ID NO: 13971 - DNA, 757 bp, Sorghum bicolor
  Predicted polypeptide sequence is orthologous to G2060
cctactggaaaacaggaaagcgactcatctctgccatgagggtccactcgtcagggacctgatgttctcctgctgcggtacagtttgctttctttccatcctcaactccggcggcggttcctcttcctgttaccccgcatccctagccgcgacgactcctcgatcgccggcgaatatcgtcgtccctgactctcaactctggtagcccccagcctccccacgagtccgaccatcccgcggttatcaatctggcttgaactgcacttcgaagtctcgttgcttcattttttttgagtgtttattatgcgttgtgccttcaattcaaagaaccatgcttgggataaggactcaaatgcgatggatggttcaagagtggattttctattgttgtctccagaaggaaacccaatgggattcagacccgaagccccaaaggtatcaagagttcttgctgaaacccacaccatttttttttgaaagatctggataatgcgggcatgtgttactctcaagtagaagagcaggttgcggtgcccagacgcacagataagacctgagtcagtaagaatctgatcaggtggagcatccagcgatgattcccagcaatttggcatacccacgccatttgaagttcttgctgatagcctgatacccatgccatttgaagttcttgctggttgtggcaaactgacagtgacaaactgacaattttccttctcgtcaactcaagagttgcttgcactccaagtagcaatac

SEQ ID NO: 13972 - DNA, 829 bp, Sorghum bicolor
  Predicted polypeptide sequence is orthologous to G2110, G2574
gaggtacggccaggaaagccattgcgtgccttgccgaaagctgagcggagctagctagctgctgctcgatcgagaagggaggggtaggccggccgttgcggctagctagctagcttggttggttggttaagttgccatggaggtcgccgtcgaaaggccgccgccggcgccgcaggtgaaggcggaggagaagagacccgacgccaagccagagatcgccgcccggccaccgatggtaggaagcgctcttccgatagtcttcgaaagctttccatcgacgcaaagagacgcggccggcggcatcaacgtcaagcaggaggaacgcaggctggaggcggccagggcggagatgggcgaggtgagggaggagaacgagcgcctcaagtcgatgctgtcccgcatcgtcagccagtaccagtccctgcagatgcactttttttacctcgtcaaggtgcaggagcaagcatcgtctgcagccaaggtggccgagaagaagctccccgtcgcgccggcgccggcgccgaatcccggcaccgacgacgacggccccgacgacctcgtctccctgagcctcggcaccagggcaaatagcggtggcgcaccccgccgcaaggggcacgagaggtcgtcgtcctcgtccggcaccgctgagacaaccaccgccgccgacgctgatgaccaaggccaccaccagctctccctcggtcttggtttcgcgcgcggaaacgggctgccgtcgtccaccacgacggccacggacgacgacaggcgagccacgcgtccacggcgcccgtcctgaaactgacctccgacagcagcggcagtgccg

SEQ ID NO: 13973 - DNA, 657 bp, Sorghum bicolor
  Predicted polypeptide sequence is orthologous to G2114
cccagactaaactttccgattgaacaatatggaaaggaattggaggacataagggatttgtctcgagaggaatgtgtaacatacttgagaaggaggagcagctgcttttcaagaggagcttctatttacagaggagtgacaagaaggcagaaagatgggagatggcaagcacgcataggactggttgctggaactagagacatttacctgggaacattcaaaacggaggaagaagctgcagaggcttatgatattgctgcaattgagatacgtggcaaaaatgctgtgactaattttgaccgaagcaactatgtcgacaagggtatgcactgtatagaaggagaaggcttgaggctgctcgcatccaagccagaagaatgacttcaagttcaatgcagtgattgttgatggagcagatttggccagacatataatggagcttagttggtacatacagatagaagaactggtttcagtttgtcaatattcctgctttacaaggcttaagattacagtaaatcgacccactagcaacaattgtgccaggaagattttgagcttgtgtatcataaggctttgtagcatagatctttctgaaaatgttagcaagtccatgtttactgtttgatagcatcgagttatcaaattgcactttcc

SEQ ID NO: 13974 - DNA, 544 bp, Sorghum bicolor
  Predicted polypeptide sequence is orthologous to G2115
aacgaggcaagatgatgttaaaagcactgccaggagttctgcagctagggagtcttcagaaacctctgcggctgtaggttcagatacccctggccttacgagcaatgatgctggtaacaacgggagggaagcaactaggactccaacaaatgatttcgatttggatcgtttcatcaaaaagaggctggccctcgacccggcggagctggatgccgtgctcgagggctctgacccgaggggtgttgtttctcagaggaggaaacagcggctgcccaggaagccactccctgtcccgtaatccagatcggtctgtctcatttccaccggtaaaatccactaacagtagcaggtatacgtggatatgtgtgaggagaggacgacccctgccgctgccatagcaatcacctgttaattgtcattccaggcacgtgtatgtaattctgccaccatttgtagtataagtctagctctgtacataaattagactctctttatctacataattcccccgagtaattagtcgagaaatattctgataaatgcc

SEQ ID NO: 13975 - DNA, 619 bp, Sorghum bicolor
  Predicted polypeptide sequence is orthologous to G2141
gcacgagggctggtgaagacaattccagctccaaaattcctgacacggaaggccagaaaagataacgcacaaaacagggaaggcaacctgatgacctctggcagaaatgttcactttggtccatctgtgccatctgaatccatacatgcagctacgagagggaccggtagtgatcaggctgtctcaagacatcagccagaactgaagcgaactactacaaccataactggaaagggccatcaaactacaggatctctgggagaagagctgctgataccactagacaacagcaatgtgaacattcatcatctaattctagtccaacaccccatacaaatcgatctgtgtttgacacacttgaatcgtcatcaaggggctcccagaaaacagtgaatcaagaaacaagctctgacaataacaagatgagaccagaaaggaatagcacccaggaagaaggtatatctcattcagcagcagcagcagcagaaccaccaaggaataacaacttcctattgcataataagacagagataccagaacatagtcctgggtctgcttctcctatgcactgccatgatgatatggacatcagttcagacttgcatactatggagaagtc

SEQ ID NO: 13976 - DNA, 881 bp, Sorghum bicolor
  Predicted polypeptide sequence is orthologous to G2141
aagagagaagattagccagaggatgaagtttctacaggacctagtgccaggatgcaacaaggtggttggcaaggcactcatgctcgatgagatcataaactacgtgcaatcgctgcagcagcaagttgagttcctgtccatgaagcttgccactgtgaacccgcaacttaatttcagcaacctgtcgactctcctacacaaagatatgtaccaaccatgtggcccatcagctaattcggtctttccattggaaggtgccggtgcagcttttccattttgtgaccaaggggatcttttccagaactttggttcgggtgctatggaggatcagtgctctctaagtctgttagacacggctctaccccacacggccaacccacagtttgcttttcaaaagcagcaaagggacttctgggaggatggcctacagaatgctttgcctaccggtagtgagcaaagacaggaggatgggcttttagtaccgaactttgatggtcagttacaagctgatcaggcaatgattgagttctagtccctggtgatctccaaggttgatatttttgtatataggcggtacgaagaagacctgtggcgagcaaagctctcctaagctgaccatcattagagtttaggcctccaaactgattcattctgtgatatgctggatgtttggcaactcgattcttcccatagagaccttgtgatcgatctcgcaaaattgaagtagattgtgtactagatatggtgcaaatattacatgcaccatcttctaaagttctactaatatgtaagagcgctggctggtattgggacgatgccgtgttactgtttgttgcatttttatcttatgatgacgaaagtacaagtatgagattttctcc

SEQ ID NO: 13977 - DNA, 667 bp, Sorghum bicolor
  Predicted polypeptide sequence is orthologous to G2192
gcagtttctctatctctggacgaagatggcacagataactctagcttgttcaaggagaagcttacacaagctcttcggtacttcaaggagtccacagatcaacatctgttggtccaagtctgggcaccagtaaagaatggagaccgctatgtgcttactacttcaggacaaccttttgtgcttgaccaccagagcattggcctacttcagtacagagctgtatccatgatgtacatgttttcagttgatggggaaaatgttggagagctgggcctacctgggcgtgtctacaagcaaaaggtgcccgagtggacaccaaatgtgcagtactatagcagtggtgagtaccaacgacttaaccatgcgatcagttacaatgtccatggtacagttgccctgcctgtttttgatcctgccgctcagtcgtgtattgctgttgtcgaacttataatgacatcaaagaagataaactatgcctgtgaggtcgataaagtctgcaaagcacttgaggccgtaaatcttaaaagcactgaaatattggaccatccaaatgtccagatatgtaatgaaggccgtcaagctgctctggtcgaaatactggagatcttgactgtagtctgtgaagagcacaagcttcctttggcacagacctgggttccttgcaagt

SEQ ID NO: 13978 - DNA, 653 bp, Sorghum bicolor
  Predicted polypeptide sequence is orthologous to G2192
tgtaacaataaaggctagttttaaggaagatattgtaaggttccgtttcccatgctcaggtggtgttattgtattgaaagaggaggtagcgaaaaggctaaggatggatgttggtacgttcgatatcaagtatctcgatgatgaccatgagtgggtaaagttggcgtgcaacgcagacttggaagaatgcatggagatctcgcggctttctggtagccatgtcatcaggctactggttagcgatattgcagcacactttggcagttcttgtggaagctctggttgatatgcgtgtcagccttttgctctgatcaatgggtactcgaaagtggttgtaccatgagttcagttccacttgtagttttgttgctagttagcactagctgcttcattgtattttataaatgtatcattgtatttgccccccaaaaaaatacatgtaattgtgcagaatgcacttgtagtcaactttgtatatatattatgtgctggaaattctgtttcaagttataaactggatttgttgttgttgtctagaatttgcacagacagtattgggttaggatgattatattgtttggaaatgtagcagattttcgtaggtcataagtccatgctgtaaacacatttgttgattctatttatatctttgg

SEQ ID NO: 13979 - DNA, 654 bp, Sorghum bicolor
  misc_feature (575)..(575): n is a, c, g, or t
  Predicted polypeptide sequence is orthologous to G2192
gaacaagaaagttttggatttgacagagggacaattgttgactgatgactactctcaagacaatggtacttctgctggcaggccaaatggtagcggtgcttctgattcttcattgcttcacaaaaccaacaaaccccctgaaaggagacgtgggaaagctgaaaagactatcagtttagaggttcttcagcaatatttttctgggagcttgaaaaacgcagctaaaagccttggtgtttgtcctacaaccatgaagcgcatctgccggcagcatggaatttctcgttggccatctcgaaaaattaataaggtcaaccggtctctctcaaaattaaagcaggtaattgagtctgttcaaggctccgatgcggcatttaatctcacgtctatcacaggtcctcttcctatacctgttggcccttcatcagagtctctcaatgtagagagattaactcaaagtaaagtggcagaactttcgaatcttgctgttgatggtgacagagattctttgcaaaaatcacttgaaaatgatgaccattttggtatagtcatggcccaccaaggatttatagacnataacaatgactctcagcttgaagctgacaaagcttctcactcgagaagttcatctggagaaggcagcataaattcacg

SEQ ID NO: 13980 - DNA, 781 bp, Sorghum bicolor
  Predicted polypeptide sequence is orthologous to G2226
cgctggcggggctggtgcgcaaggcgctggtgttcctggacctccaggacgacgacgccggggaccgcctcgtggcgtcagcgcccggcctgggcctggcggaccggttcctgagggcgttccggccggcgctgtacggggtgctggtgtcgacgtcgacgacgtgcagcgcggcggaggcggacggcgacgactgcagcgtgtgcctgtccggtttcgtggccaaggccgtggtgaaccgcctcccctgcggccacctcttccaccgcgcctgcctcgagacctggctccggtacgagcgcgccacgtgcccgctctgccgcgccaacgtgcccctcccgcccgaagagacgcccgtgctccgctacccggagctcgagtgatccggtccccctcctccggcgagcggtgacccccccccgggcggggctcggggtcgggctcggccgtcgcgcgcctcggctgtgtgctgcaagctccgtgtggccttccgtgtgtgtgcgcgtagcaaaaaacaaagtataggagcagtagtagtagagttgctgttgctttccccccctttccctttcccttctcgttttgtgttttttttttccttgtttttcttcttttccccatttctcttcttgttgtttccgtgctgtcgctgtagcgtgtaaatactgcagttcgcacttcgcagcagagagtagagtgctcccgtggctgtgctcatggtgtagcactttttacgagctcagctcgtgtacattgcaatgcatgcttcaattcaactccc

SEQ ID NO: 13981 - DNA, 746 bp, Sorghum bicolor
  misc_feature (627)..(627): n is a, c, g, or t
  Predicted polypeptide sequence is orthologous to G2227
ccgtcccctcccgtcgtcgtctcccccctcacccgaaaccccgattcgaagccggcggagttcgatttggggatttcggcgcctcgctccccgaaatctcctggatctgagtttgtccgccgtcttcgatctgcggctggagtgagcctgcgagtttttcctgcttgatttggtcggggcctcgggcggtcggggtcttcgatttcggggatggagtcgtcgccggtgtcctactggtgctacagctgcagccgcttcgtgagggtgtctccgtcgactgtcgtctgcccggagtgcgacggcggcttcctggagcagtttacgcagccgccgccgcggggcggcggcgggagcggccggcgcgggacgatgaacccggtcatcgtgctccgcggcggatcgctttccgggttcgagctctactacgacgacggcgcaggcgaagggctgcggccgctgcccggtgacgtccagcacctcctcatggggtccggtttccaccgcctgctcgaccagttctcgcggctggaggcggcggctccgcgtccgccggcgtcgaaggctgcggtggagtccatgccgtcggtgacggtcgccggaggtggtgctcactgtgccgtgtgccangaggcctttgagcccggcgccgccggccgggagatgccgtgcaagcacgtctaccaccaggactgcatccttccctggctctcgctccgcaactcctgccccgtctgtcgccaagagct

SEQ ID NO: 13982 - DNA, 761 bp, Sorghum bicolor
  misc_feature (549)..(549): n is a, c, g, or t
  misc_feature (678)..(678): n is a, c, g, or t
  Predicted polypeptide sequence is orthologous to G2311
gctattgggtcggctagtttggaaggaggagagcagaggacacaggggcgaggcgaggaggagaacaagctatgggcgcgccgaagcagaagtggacgtcggaagaggaggatgcgctccgcgccggcgtgcgcaagcacggcgcaggcaaatggcggaccatccagaaggaccccgagttcagcccggtcctgtcctcccgctccaacatcgacctcaaggacaaatggaggaatttaagtttcagtgcaagtggactgggatcaagtaaagtacgggttccaaggataactggacccacatcttccccatcgcctagtgcacaagctctgcttctcccagcgccaaataaagtaactgaagctacactgcctgcagatgctgagaaaaagccacaggatgggaaaactccgccaaagtatggtgtcatgatcatggaagctctttcggaattgaatgagccgaatggttcagatatggctgcaatcctccgcttcatagaggaaaggcatgtggtgcaaccgacctttagaagatttctaacctcanagttacggcgacttgcagactcaaacaaaattgtaaagatcgataagtcttataggctcccagattcctttgcaacaaggactccagctccaataaaagcttcagctcccaaacagaaggatccatcanagccatcgaaggtgtcaaagaccataggattatttactgcctccagccctgcactagaggcagcgatggcagctgctgtcaag

SEQ ID NO: 13983 - DNA, 581 bp, Sorghum bicolor
  Predicted polypeptide sequence is orthologous to G2348
ctgcgacgccaggaccaattccattcgctccagaactccaccccgcgaccgcgagtcccctccctctcccttcccttcccgccgcctccgcggaatcgtgagggggttgcctcccaaatcgccggagttggttgatcctgccgtgcacgcgcgcggtggttagggctaggcgatctccggaaatggacgtccccgattccggcggtggcgcgccggatgccggcgagcccatctgggactggggcaatctcctcgacttcgtcgtccaggatgacgactccctggtcctcccgtgggacgacgccgccgccggtatagcagcagcagccgaccccaccgaggctgccacggcaccactgctccccgcctcgcccccgctaccgcagccggtggaggtagagccggagccggagccggagccggaaccggaaccggggccagtgcttccgccgccgcctcttcgggttcaggggatcgggcgccgcgtcaggaagcgggacccgcggctggtgtgcccgaactacctcgcggggagggtcccgtgcgcgtgccccgaggtggacgagatggtcgccgctgcc

SEQ ID NO: 13984 - DNA, 800 bp, Sorghum bicolor
  Predicted polypeptide sequence is orthologous to G2348
gcctatggatgatacctttgaccgcgttgagaatggtgatcttattcctgattctcaacacgaaattttccgaattaacattactcaatcaagaccagatattcatggacctgcatttgtggaagtcgaaaacatatttgggttatcaaattttgttcctatcctttttggtagcaaacagttgtgttctgaactagagaggatacaggatgctctttgtggttcttatagtaaaaacaatgtacttggtgagttactcagtgcttcttctgatcctcatgagcgtcggaaacttcatagttctgtgatgtctggattcctgatagacattggatggcttatcagaaagactactcctgacgaatttaagaatgtgctgagttcaacaaatatccagagatggatacacattttgaagttcttgatacagaatgatttcatcaatgttctggaaataattgtgaagtcaatggacaccatcataggttcagagattctttcaaacttggaaagggggagattggaagatcatgtaacaacatttcttggatatgtaagccatgctcggaacattgttgaacggagagctaaccatgatgagaaaacacagattgaaacaggaggcattattgttaattctccaaatcagccaagcttaggtgcttcattgccacatgctagtgaaaacactgatattggtggtgataacaaactgaactcagctgatgaggaagaaactatgccacttgtgactagagatgtctcacaccggcactgctgccagcctgatatgactgcta

SEQ ID NO: 13985 - DNA, 674 bp, Sorghum bicolor
  Predicted polypeptide sequence is orthologous to G2455
caaatgtgggcattgtacaatggtgctctctatggatctcagtcctttccaccagcaggcacgcactgttccagacaaccaggttgtccagaacagagggtttcaatataacaattttgggagctacgagcaagcctcgtcaagaaatctacgaacgccttccatgtattcagtgtcaaacaatcagccacaagtgccaccaataagacccccagagaagaggcaacgtgtcccatcagcatacaacagatttatcaaggaagaaatacaaaggataaagacgagcaacccagagattagccacagggaagcattcagtgctgcagcgaagaattgggctcatcttcctcggctccatttcggcctcagcgtcgccgacggtggcggcggcagcaactagatgatcgatcgtgtacgtgatcgagacggcgacgatcgtgcgtgcatctggattcgatcatgcacacacagatagatcgatcgagctctttgccttacatatatgctgtgctacgtgcctgtgtttaatttgcattgtaagcttgttaagttttgcatttgataacctgtgttttcagacttgtgcgtactttgcatgtatcctgtgttcagtgtagcatgctagcttcacaaggggattatatgatatgcatggtgtataatatttctaaata

SEQ ID NO: 13986 - DNA, 719 bp, Sorghum bicolor
  misc_feature (19)..(19): n is a, c, g, or t
  Predicted polypeptide sequence is orthologous to G2456
agtaataattaatccccangccaccgccaccgccaccgcctagggcctacacagaggctcgatcggggcctcttgcccgcggccgcggtgccgccgggtcgacccagcgagcgccttttgtggtcgctgtcgacccacgccagccattgccacgctagtggaatggtgactggccttgtgtggcgcagagcggagcacgggcgaaacgcgcacgaaggaagaaaccgtgggtgcctcgacggtttcgcacgctttgggcgcaccacaaggcagaattcggcataggttgtgccgttttgccctttcgccgtgtcctctcgtcaatcgggagcaaggagagcgtttttttggttgttgtggcggctggagcgagtgagcgacgccgccgccgggcatttctgtttttggtgttggcggttccagtacgtaatgcatgtgaagatggtcgtctgaatgcctgatctagtagaggggaataaaaaaagaactgtgaattagatcaatcgcgcgctccgtgtacagtgttgttactttgaacttaatggttgtctgtttgctcggttcaagatacaacgcagttctgttgcaggtctctttagaacgtagtactaggatctagttcttgttccccgtaatcacactgcagggttcgaagttcgaactggatttttttccggttaaaattcctgcagtattaattctcgcgggatttatgcttt

SEQ ID NO: 13987 - DNA, 688 bp, Sorghum bicolor
  Predicted polypeptide sequence is orthologous to G2457, G2459
cccaaatcgcgccggcagatcatgtgtgctatgtgcactgcaacttctgcaacacagttctcgcggtgagtgtcccggggaatagcatgctcaacatcgtgacagttcggtgtggacactgcacaaatctactgtcagtaaacctgagagcactgatgcactcactcccagaacaagatcagctccaggagaatatcaaggtccatggcgtcaatggcaccttgcatgatcagtgcggccatttggagctcggttcttcttcgtcctcaaagttccgacttccaatgatgtactcgccgcaaaacgagcacctgctgcaggaacaaacactgaataatgctcgtcctccagagaagaggcaacgggttccatcggcgtataacaggttcatcaaggaagagatacgcaggatcaaggcgaacaaccccgacattagccacagggaagccttcagcacagcagccaagaattgggcacattatccaaatatccatttcggtttaaactccggacgagagggtggcaagaagctcgtggatgaggctgttgcagcagcaccggctccgaaaaagatccaaggtttctactgatagatgtccgagctcatcaatcatcaactgggtggaagaattaataccacaaattataatttctgtaagtaaagaattaagggggaaagggaaagtta

SEQ ID NO: 13988 - DNA, 821 bp, Sorghum bicolor
  Predicted polypeptide sequence is orthologous to G2522
gccggccgccgggcaccggcaagaagcaccagccctcgccctcccaaggcaatgcgttcgccggttcggctggaacgagcttcactccgcacatcatcacggtgcctccttcagaggacgtggcggcgaagatcgtcgcgttcgccacccagtcgtcaagggcggtgtgcgtcctctcggcgatgggctccgtctccagggccgtcctccgccacccggccgacggctctcccatggggagggttcacgctgcgtcgccgcagccgtacaagaacaaccctgccatctacgaggggttctatgagatcctgagcctaacaggctcgtacaacctggccgagggctcacaagcacagggacagggccagcagagcggcgggctcagcgtcacgctctgcagccctgaaaggaatgtgatcggaggtgttttgggcggcccactggtagctgcaagcaccgtgcaggtggtgctggggacttttcaccagggagggtcgagatccaagtccaggaaagccgggaagctgcagcagcagcagcaggcggccacggcgacagcggcggccttcagctccgactcgctcaccggcggccaggaggcgtcgcccagctccgggcacaaccaaaatctaacgccgccgccctccgtgacgggagggtggcccacctccgggatatttgacacgagaagttccagcattgatatcaactcatctagaggctagctcatttgtcgataattccagctctcgagaaattttctattttcgcacaagaatacccgaaaccatacttcgaaatagcttattcggttctttttt

SEQ ID NO: 13989 - DNA, 818 bp, Sorghum bicolor
  Predicted polypeptide sequence is orthologous to G2522
gaggacgttgctgccagaataatggccttctcacaacaaggcccaagggcagtgtgcatcatttcagcaactggagctgtttcaacagcaacccttcaccaggattcagactctgggggtgtggttacatacgagggtcgatttgagatcttgtgcctttctgggtcgtacttggtgctagatgatggtggcacacggacccgaagtggagggctttgcatagctttgtgtggtcctgaccacagggttattggtgggagtgtaggtggagtcctgacagcagctggaacagttcaggtgatagtggggagcttcatgtacggaggttcgaagaagaacaaggcgaaagctgaggcggacatcgagcccgaggaggcgaacgccggtgacgaagaggtggcccctgcgatggcactcgcggaccacagcagcatggcccctcctcctgagatgagcggcgggtgggcatcgggcatgatgaggcagatagactcgagaactcccaacatcgatatcaactcgatccgcgagtagtagggaagtggtggttgcatctggttggtcgggttgggtggataaggctccttgacatggaacgaagtggaatcctcctccttggacacacagcatgcatgtactaacaactctgttgtaggcgttgctgtggtttaggaaactctgaactccgagtatatcgtatatggtattattgtgatgtgatgttgtacttgggatgttgttgtatgagataatgggagatgctttgccacctaacgatggtgttatgttaaatatatagtatgtggtatatgctacta

SEQ ID NO: 13990 - DNA, 539 bp, Sorghum bicolor
  Predicted polypeptide sequence is orthologous to G2536
gcacgaggctactcatacgacccatggaatcttgaaagtagtggcagcacgcataggggactgctgttatttttccgcccactaccggaggcaaggggcgtcgttccggtcaaaacaccctcaggttactggaaagtcacaggtctgcctgggtacatctactcggatgaaagacttgcagttgggatgaaaagaacgatggagttctaccatgaccacttgacatcaggtaccaaaaccaagtggaagataaaagagtttacagcatttcagcatgccacagctggtgaaatctgcacgcccatgatgccaagaagcgagatgagcctgtgtcaactgtacacggaattggcagcgaatcccgattgcagtccagcaggtgtccagtatgatgaaaaattgtccgtcaaacaaaataaaattccagcagaggaaccatcagtagaaagtgacattgttcaaacccgcaaacatgctgataagaggaaacgtagggtggacgagaccacaaaaactgtggtaactattgccagccctga

SEQ ID NO: 13991 - DNA, 729 bp, Sorghum bicolor
  Predicted polypeptide sequence is orthologous to G2557
aacaaccaccgcaccgccaccggcgccgttcccgcggcctgccggcggtggcgcgaagcggcgtgccgcggcgacgagcatcagcttcggcggcggcgcccatgtcgcgcgcgatcccagcgcggggtacgagccggacatggaggcgatggcgcaggtgaaggagatgatctaccgcgcggcggcgatgcggcccgtgaacctgggacccgaggtgatcgccgcggcggccgcggagaagccccggcggaagaacgtgcgcatctcgagcgacccgcagacggtggcggcgcggctgcggcgggagcgcgtgagcgagcgcctgcgcgtgctgcagaagcttgtccccgggggcagcaagatggacacagcgtccatgctggacgaggcggcgagctacctcaagttcctcaagtctcaggtccaggcgctggaaaccctaggcacgaccaacgacacgagcaccagcaacagcacagcaacagcaagcaggtcgcagcaatacaactattacagcagcggcagcaataatcctggtgggttcctcggatttgcagcaggaaggagcagtaacatgatttctccagctgggtatgtaaatccaacaatcggatcgtcgaatactagcagcaaactactgttgtagtaactgttcctgtagtatgactgtcgtcgtcgtccagatcactccagagtggacgatatacacatgcatgcatgttgcttttc

SEQ ID NO: 13992 - DNA, 834 bp, Sorghum bicolor
  Predicted polypeptide sequence is orthologous to G2559
cgccacgcacagctagctcgcacccctacacactcaacagcaacagctaagcttctccaaccagacagcaacatggctgaggaggcggccaagaaggtggaggtggaggtcaccaaggacaaggagcccgaggcggcgcccgcggaggccgtgccggaggcggcggccaaggaggacgtcgccgaggagaaggccgtcatccccgcgaccgagccgccggccgccgaggagaagccgccggccgacgattccaaggccctcgccatcgtcgagaaagttgcagatgaacctgctccagagaagcctgctgctgagaagcaagggggttccaatgacagagatcttgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaagaagaaggccgaatatgctgagaagatgaagaacaaggttgcaatgatccacaaggaagccgaggagaagcgagcgatggtggaggcaaagcgcggtgaggaggtcctgaaggccgaggagatggctgccaaataccgggccaccgggcacgctcctaagaagctcatcgggtgcttcggagcctaagaaacattccaagtcacacccgagcaggaagtgaaaaacgtcaaccagtgattgcttggtcctctcgctctatcaagtgtgtagtgtgtcttcgaaagtgtgtaaagcctactgctgctctgt

SEQ ID NO: 13993 - DNA, 821 bp, Sorghum bicolor
  Predicted polypeptide sequence is orthologous to G2559
ccggcctccccctcctctcgctcgtgccagagccagactgctcagccaccacaccattctttccccattagctctctaagctaatctagcgtcgtcgtgtcttagtagcttgcaggctcacctgctgctgattgagaggagacgactgaattcagcaccagctagccagctagctagcagaagatagatggcggcggaggaggccaagaaggtggaggttgaggccaccaaggacatcgccgaggagaaggccgtcgtgccgctgccgccgccgcccgccaagctggccgacgacgacgactccaaggccatcgtcgctgttgtcaaggacgctgctgagaaacctgcaactattggaggttcaactgaaagagatgcttatctcgcgaagattgtatcggagaagagactgactctgatcaccgcctgggaggagagagccgagaacagggccgccaagaagctcgccttcatcacgtcatgggagaacgcgaagaaagcggagatggaggccgagctgaaaaagatcgaggagcaactggagaagaagaaggcggcgtacgaggagaagctgaagaacaagctggcgatgctgcacaagacggcggaggagaggcgggcgcagacggaggcgaagcgcggggaggagatcatcctggcggaggagatggccgccaagtaccgcgccaagggcgaggcacccaccaagctcttcggcctcttgaaagcctgatgaagaaatgaccatgtgattgatacgaatgctgggatgggaacaactgttggttcgtggtggtgtgtgcatgcatgtgtatgtatct

SEQ ID NO: 13994 - DNA, 782 bp, Sorghum bicolor
  misc_feature (71)..(71): n is a, c, g, or t
  Predicted polypeptide sequence is orthologous to G2571
actttccgggcgtcatggacgcgccggacacggactgccccgaccaccttcgccagctccgcgccgccgtngacgccaagatccaggccatccgcgcccgcatggcgcggaagcgcgcccgcgcgcgcaagcagcgcgaggagaaggagagcgcccgctccggttccggtgccaacagcagcaagccagccgccgcgcgcccggtcgcctctgagggcgccgcaacgacgacgacgactaccaccacctccgagacgtcaaccacgccgtacgggtcgccggacggggttctgtccgtgagcgcggtctcggccgagggcgactgcccgctggagcggatgccgtcgttcgacccggagctcatctgggagatgcttaacttctagccggctaactgcacggcgcgtgtcgatcgatcaacgggaccgccatggacaccgggaccaaacgacgtcaaggtccttgcttggacatggctgccccgcgtagagctcgcatctaggtgctgttcctttttcaaattatgagcgtatatacatgtataacaaactattagtagaaggatgatgataccatgagcaataaaatgcccaagaaaacctgggcctgctagccatgattagtactagtatctgaatactcgaatcgtcgtgtgttttcagattgatcgacgagttgtaaagactgatcgctgattcactgtctatctctacatgcataagcattccattacagctagcatcttctactgttatgagtcatcatgcataagcattccagct

SEQ ID NO: 13995 - DNA, 413 bp, Sorghum bicolor
  Predicted polypeptide sequence is orthologous to G2579
ctttttttttttttttttttgcatggccgcatggggttcaacttcgtctgtcaacaaaagacatcccaattatgtgctgttatactgcaagtttgtgtcaaacagacaacgggactccattcaacaacagagttggatacccccaacgcagaattgtatagacagccaatagggcgctttattaattcatcctttgtagggggaacttgaaacttcaaaggatagacagccaatagggggctttattaattcattctttgtagcagaattgtatagacagccacggaattctccctgttgctgctcctgccattgattcagtggcgaggatgctactaccaaagagtgagcccatggcctgggggcctccgtgaccttgaaggataaaaaatcagatcccgtaggatggcaac

SEQ ID NO: 13996 - DNA, 610 bp, Sorghum bicolor
  Predicted polypeptide sequence is orthologous to G2592, G2713
gcacgagggcggtgtcgtgcctggccaatcgaaagagctcctcccaggctattcgatgagtccttcagcagcacagcaacttctttctccaagtactctgtcgtggacagctccatggacctgagcagctgccgattctccgagctcagtggaggggctctgcaagaaggcagcgacgactcagagaaggagaggcctctggttctgcgcaacaaggcgccaaggtggcacgagcagctgcagtgctggtgcctcaacttccgcgggcgtgtcactgtggcctcggtcaagaacttccagctgatatcttccgtgccacagccagctcccgtgggggtttcttctgctccaccgctggcggtaacacctcctacacagacacagccacaagcctccggtccgtcttcagcgtcgtccagccatgtccatgacccagtgatcctgcagttcggcaaggtcgggagggacatgttcaccatggactaccggtacccgctgtcggccttccaggcctttgccatatgtctgacgagcttcgacaccaagctggcctgtgaatgaatagatgggacgagtagtgtatcgtagcagggcagcagcgctgagagtc

SEQ ID NO: 13997 - DNA, 654 bp, Sorghum bicolor
  Predicted polypeptide sequence is orthologous to G2592, G2713
tgaacaactgcagtgttggtgcctgaatttccgtggacgggtcactgttgcttctgttaaaaactttcagttggtagcttctgatgacaatggaccagggaaccaagataataacaaggtcattctccaatttggaaagattggaaaagacttgttcaccatggactaccgttatccaatatcagcatttcaagcttttgcaatttgtctgagcagttttgatacaaaaattgcctgcgaatgaggcaagaagctgggcaacaatggcagatagcaggacagcatacattatatagcctgatgctggagcaggagggctggaaactaccataccaccagaagaagtgatacaaaatgattatgagctccggtgtgaatagctgcactacaaagttggtccctgcttgttccgccgcctagtttatttttcctctgaatttcaatatatgcgcattctttgccggtgttggcaagtcaaagtctatagtgtggagaatggcttgtgctttgtgtggccactggccatcggtgagctgatgagtttgtgagaatagaggtttccagtgatagtgtgataacagacgtgattacgctgtacgagtttttgagttttaatgtttagtcagtgcttgggtttcatggtgaaaagaccca

SEQ ID NO: 13998 - DNA, 620 bp, Sorghum bicolor
  Predicted polypeptide sequence is orthologous to G2592, G2713
gcacgagggatcaaacttcttgggaacaaaatttactgtctatgatgcccatccaccttgtaccggggctgtggtttcaaagggtccgtctgcacacatgatcggttcagcccaagtttctcctggggtgcctgctgggaattatccaatttcgcacatttcttatgaagcgacttttggttctaggtatccaagaaagatgaactgtgtcatggattccatccctttatcagcaattaaagaaggagggactgctcccacgcagactgaatttccatcaattaactccaactcttttgcttcagttccattcttcaggaaatcaggtcgtctggatagttcaggtgttcagctagccactcagaatgaagctaagatggtgctgaagaacaagtcccccaactggcatgaaccactgcagtgttggtgcctgaatttccatgggcgggtcacggttgcatctgttaagaacttccagttggtggcttcaggagagagtgatctgaataaccagggtgatgacgacgtgatactccagtttggcaaggtcgggaaggacttgttcaccatggactaccgttatccaatatctgcattccaggcatttgccatctgcctga

SEQ ID NO: 13999 - DNA, 656 bp, Sorghum bicolor
  Predicted polypeptide sequence is orthologous to G2592, G2713
tctctacgagctgaatgtcctgggaactcgaggtccaaggcggatgaactgcgtaatgcactccatcccagcttcatgcctcgaggctggtggcagtgtcccttgccagccggacagcattgttgcccactctgttggcgaaatgttcagcagcatccccttgtcaaagtcatctactatggaccactctatgcacttcagcagttcccggttctctgacgccataacagcggatgccattgttagcggaggccaggcattgagcaacgctgatgacgaagagagcacggacacacctttggtcctccgcaacaaggctccgagatggcatgagcagctgcagtgctggtgcctcaacttccggggtcgggtgaccgtcgcctcggtcaagaacttccagctagtcgctgctgtgatgacgcagcctgccgtcggagccccgaccccgtcgcaggcagccccgctgccactgccagctccagctccaggtccgcctctgccagaccaggagaaggtcttactgcagttcgggaaggtcggcaaggacattttcaccatggactactgctacccgctgtccgccttccaggccttcgccatctgcctcagcagcttcgacaccaagctggcttgcgaataaattcgatgactctagc

SEQ ID NO: 14000 - DNA, 787 bp, Sorghum bicolor
  Predicted polypeptide sequence is orthologous to G2592, G2713
ttgtcgagcatggagggagatgtgccgggagattgtgctgagcccggagttttgtgggaagcttacattcccagtttctctaaagcagcccgggcattagaggagtccttccgcagcaccacctccttctccaagtcatccatcatggaccggtccatggatttcagcagctcccgtgacttcagcagtgcccgcttttctgacattgccggaggcgccgccatagctggcgatgaagagggacagaacaaggagaggccgcttgtgctccgcaacaaggccccaagatggcacgagcagctgcagtgctggtgcctcaacttccgtggccgtgtaaccattgcctcggtgaagaatttccagctgatcgctgcgccaagcccggcccctgcccctgctgccagggctccaaccccatcgtcacaacctgttccgcaggaccaagataagatcattctccagtttggtaaggtggccaaggatatgttcactatggactaccgctacccactctcagccttccaggctttcgccatctgtttgagtagcttcgacactaaactggcctgtgagtaaatatagaccccgtggaagcaatggaacaacccggagctggcaatgcacaaggggagagatgcatttagccctaggattttagtttgatgcttttgcaatttgttgttttctctctgatggttgtattaagcttcctgttaacctggaaccggacctctaggctctaagaaggtatgttttcacctgctggcaccatggtaggtgccatttc

SEQ ID NO: 14001 - DNA, 831 bp, Sorghum bicolor
  Predicted polypeptide sequence is orthologous to G2592, G2713
ccatttgtgttgtgatctgtccaatctccccctcctcttcttccccgcaccagatcgaagctacccccgttcctctgcgatttgggatcgtcctgtatccttcctgttgctcaaaagctcgctcctttgatttccaaggctgaaaggcgacaaatccgacgggaattggagcactgagctttcaatccaggagcaaaacttttgctcatctctcagcatcttctctgcgtgtgaaaagtcggatctttttcacagattcggtttaaaattaccaagcaggtcgacgaccgcggtgtccataagacttgctttgaagatcttgatcaccacaagagaattcgtggatttctggttattgtaccttttctactggacatgtcctttcgcagcatagtccgtgatgttagcgaaagctttggtagcttatcaagacggagctttgaggtcaggatttccggtttgcctggtctgtctggtcatcatagagggaaatctgttggatctctgagcgacagacctgtagtagttgatcaaagcaggtgggttggtcttcctcctgaattgcttcgagatgtaatgaaaaggcttgaggaaggggagagcaattggccatcccgaaaaaatgttgttgcctgtgcagcagtctgcggaacatggagagagatatgcaaggatatagtgctgagtccggagttttgtgggaagctcacttttccagtatcacttaaacagccgggaccaagaagtggaatgatccagtgttttataaaaagggacaaatcaacgtcaacttattatctttacctatgtcttagccctgctgtcctcagc

SEQ ID NO: 14002 - DNA, 756 bp, Sorghum bicolor
  Predicted polypeptide sequence is orthologous to G2592, G2713
cagtccttccgtagcaccacctcattgtccaagtccatcatggactcatccatggatttcaatagcgctcgcttctctgatattggtggcagcagcgctcgcttcacgggcattcctggcagcagtgctcgcttcacgggcattcctggcagcagtgctcgcttctcgggcattgctgaaggcagattggacaacgatgaggagagtgaaaccaaggagaggccattggtgcttcgcaataagccgcctaggtggcatgaacagctgcagtgctggtgcctcaacttccggggccgtgtgacaattgcctcggtgaagaacttccagctgattgccgcgacaaccccgccacctgcaggtgctccaaccccctcccagcctgctccatcagatccagacaaggtgattctgcagttttgaaaagtggcaagggatatgttcacaatggactatcgctaccctctctcggctttccaggcatttgccatttgtctgagcagcttcgatacaaaactggcctgtgaataaatggagagcaaaggtaaaagacaacaggttgccggcattaggcctttagtgtacctctttccatttgactctcgtgttatcttggttgtaattgtgcttgctgtagccatgaagtggtcatatatggtggacgcatgtgttgttggcccctctcgtaaagtgattacaagttgcatttggaccacatgttaccagatctgtaatatacttgcagtggcattgccgcgg

SEQ ID NO: 14003 - DNA, 768 bp, Sorghum bicolor
  Predicted polypeptide sequence is orthologous to G2592, G2713
tccttcgcctcctcttcctcctcccgtcgggtcgcctccctcctcttcctccccctttcctctctcccccccaccccacctcgcctcctccccggatccgcatggcgcatccgcagtccgtcccgtagcagcggctcgccccaccgcccgctcgctgccccgtcccaggcaggctcatctttccacagtcattggaggacctttgatgtttcagcacttgtgacgtttagtagatgtctttccgcagcattgtgcgtgatgtaagggatggctttgggagcttgtctcgaagagggtttgaggtgaagattctgggccaccgcaaagggagatctcatggtgctgtccatgagctgcatgatccagccccagtgatccagagcagctgttgggctaatttgcccccggaattgcttcaggatgtgattgagaggttggaagccagtgaaggcacttggcctaacaggaagaatgtagtttcttgtgcagctgtttgtcgaacctggagagagatctgcaaagggattgttaagaatccagagttttctggaaaaatcacttttcctgtgtccttaaagcaacctgggcctcgagatgtaaccatccagtgcttcatcaaaagggataaatctactcaaacttactacttgtatctgtgccttagcaccgctgtgcttgttgaaagtggcaagttccacctatgtgcgaaacgaacctcccgtccaacttgtacagaatatacaatatttatgaattctgaaaatttat

SEQ ID NO: 14004 - DNA, 541 bp, Sorghum bicolor
  Predicted polypeptide sequence is orthologous to G2604
catcaacgaggttcaggttggagtttactttcctttggattgggacaggataagggccgctcgggatcatgagactcagtacaagatacttgaggaagaaggccaggaagcaaggcgcaagaaaggtgagctcaagaagaaaatccaggaacagctagctcagaatacaaaccaacccattgtgacggtgggctgagtacgtctggaacagccacaggctgattcgatgatccgtacaaggctgaagacgatcagagcgggctgcctgggagcaacagccaggtgggtccaaatccaatatggtacctacgtgggtgcgtaccgtaccagtgcatgtgccgccattccctgatatatatcatatatgtgctatgcgcatgcatgttgttcatttctgttttccaaaggattggtggtgtacgtgtctgtgcctgcgcatgttgtaaacaagtactgtatttgaatacagcctcttctacctatttcttcttggtttctgtattataaattgaagatgcttttacgagacaagaactccact

SEQ ID NO: 14005 - DNA, 564 bp, Sorghum bicolor
  Predicted polypeptide sequence is orthologous to G2604
gtgccgtttgcagcaccgtcactgccgtgccggctccaggaactgagatggcacagttagtttgtggaggatgccacactctcctgatgtacttacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggcctcacctggtgcagagcagaagcccagcagctgatgatagtgtccctgaaaatactgagatcacctatgaaggcagcttctgaaaggatgctttgagtgcacatgcatagagttcttccctgaagcaattctttttttttctctcctcatctccattctcccccatccacttctgcgttccttcgatgaatctggcgaacccgcagaataaatgagagttttggaaataactagggctcaacctcgtcgacttgtccataaaatcaaatgagacatatataaacctatggtattttctc

SEQ ID NO: 14006 - DNA, 668 bp, Sorghum bicolor
  Predicted polypeptide sequence is orthologous to G2649
tttttttttttttttttttaaccagtggctagaaaccagcaggcaatatcttatgcataatactaggaaagatttaatcttgggctatcttctttccaattcctaacaattattctcctctctacccaaactactagtagtagtagcgaaaaaaaaagaactagcaatagtacttgctttgctagagttgtagcacacctaaaaaaaacaattcatcgatgttattgtacaccaacgaatgactaaataacaccacgatggaatgaagaagttgaacaggataacaccatgcattgacagacattgatgcccaccagaaggttgagaaaactgaactccgctactagcaatgaagaggaacaaagaatggaaattgacgatgtaaccttactcttccggtgtagaaggaacatacgtactcgatcagttcatggtgttaccatagcttgacgagccgccaagaatgtgcggatgatgtcctccgccaccgtacagctctgtgggcgccatcgaggtgccgccttccctcacgccgccggcgccggagccagacgccgctccgagatggagctccgagatgttgggcactcccgccgtggaatcgtcgttgctggtggccgcgtgacggccgtcgtcggggccctggtcgtacagaaaccctttgaaca

SEQ ID NO: 14007 - DNA, 542 bp, Sorghum bicolor
  Predicted polypeptide sequence is orthologous to G2679
ccgatcgagagtgtggtgagggtgaagaaggtggagaggatcgaggcgaacaacctcgccaccaagccgtcacaaatggcgacagccaaggtgaccaggagcctgaccgtcagcattgtccgtgtcggggacgtggatgaaatgcctgacagctttgtctcggtgcctattgcgcacacctaatcagtgaccgctactgtcatacatttaatgttcagttctgtcaggaaaagcctgtaatactaacacgtatggctgtgtcgtcaggaaaatagtggctcaacaaggctcaccagccatacatacgtgttactggtgtgcgtgttaagtttctataagcagtccatggtgagcttctcgttgtataaataaacttgtgcaactcgatctcttttgctagctcacttgtcgagttcgatcactgcaattgttttctctctgaattcagtgagtaataacactagacagataacggattatatattattcaccagggccttgctctgttcttctatagcatgtgcagccacaagtaagctaag

SEQ ID NO: 14008 - DNA, 684 bp, Sorghum bicolor
  misc_feature (65)..(65): n is a, c, g, or t
  misc_feature (80)..(80): n is a, c, g, or t
  Predicted polypeptide sequence is orthologous to G2682
gcaataaacttggtggtctgaagtagggcattccttgtcgacggcttgagaagcgcattttccangaaacacagccgagnagagtagccagagtagaattcgcagtcagagttgcttgagcaagggtctccaggcaagttcttagagctcttttggcagacattgttctcacaagtgtagtcgtaagtccaagcagggttggcgttgacgtctccacattcagatgaagaattgcaagcagatccaacgcccttgacagaagcgcatttgccattgtcagtgcaataagcattgctgtagcaagagtatccagtgagggctccagtgtaaggagttccacaactgcagttagagagttgtgctaaacaagagtcgtgataggcgctagagtcacaagtggcgtctttagcggcggcgtagcagttaacgaaagtagtggcgcaagcgcagagggcggtttgattttcagcatttacttggcagtcaattaaagcagaaacacagtctgggcatccagcagaacacgatcctccaacgttaacgcattgatagtttgcatcttggcatgtaatagcgtcagctctctttgaggtcttggaaactccagcgctcaattgttcatagagagaagatgcaaaacaagatgagaagagaagtgctacaatgattaacgacttcatgttt

SEQ ID NO: 14009 - DNA, 604 bp, Sorghum bicolor
  Predicted polypeptide sequence is orthologous to G2713
atgacagcttgccatttccccacctgtccctatgctaccaccacctaataaaaaaaaatcccaggcacctactcccccattaggccattacaatctgcgaaaggcgactcctttctgatcctttttatcggaattctttcttgcttcctcctctcttctccacagaccaagaatctcttcaccggttattcgcgggtcatttcatttcagtcggtgccttttttaggccaattggagggaacagaagggtggcagtattttatcgagcaggattctggtatccggtgattcttgcttgttgcaggcgccaaggcgaggaattgggcctagctccaggtcaaatccgtgccttgttgcgttaaatagaaggattcctggatgggtaacgcgctcaaggcaccatagctaaagagattcttggtgtgtcagactgtcatccctggaaccggagtctgctgctgatttggtgaggacagtgcaggagaaacatgtctttcaggagcctgattcaggacatgagggacgagttcgggagcatctcgcggcacagcctgcggtcccggtctcaccggtccgccgggaacgcgtcgcgggcggcggccgc

SEQ ID NO: 14010 - DNA, 638 bp, Sorghum bicolor
  Predicted polypeptide sequence is orthologous to G2717
aagtggttgctgaactggagaagatgaaaggcatgaccaaggaagaggcagctgcctttgctgccaaggcagttgcggaggcagaagtagcaatagcagaagctgaggaagcagcaagagttgcagaggctgcagaaaatgatgctgaagctgcaaaggcttttctcgatgctgtcactttatcaatgagaagcaggaatgctgcttccatgatgcttcgagcttgctgatcctttacccatgccgtcatatggttttggccagcagcacactggtgttctgctgcaaagattttctggatagatgagtttcttgtatagccttatagatcgtgacgcatcaacgggaggggttttcaacatcttgctgctggtcctgtgctgtgcagccaatctgcaatggacaatatgataacaagaatgatcgggaaagtagtcttcaattttttttgttttctccccattgtgttgctttgtaattaaactctagccttttcccttaattagttgatgaagtgaattgatgtcgtctaatagaacaactgtagtgaaaagaaaatgtcagaaagctgccatagttaatgcaaattgctgtgatactatgtttctagatatgtttatctgatgacagcgttcgag

SEQ ID NO: 14011 - DNA, 483 bp, Sorghum bicolor
  Predicted polypeptide sequence is orthologous to G2717
agatcccaaattgatgctgaattggttcgtatggcaactatgaccgccgaggcagctgcggctgctgctgctcatgcagttgcagaggcagaggctatcatggcagaagctgaagcagctgctagggaagcagaggctgcagaagcagaggcccgagctgcacaggccttcgctgaagcagcagttttgacactgaagaacagaaatgctgcgaaattgatggcccaagcttgatggtacccagaactgtcgcggtccagcattgctgcagggcaggccacctatgcatgtaggcatgtagctcatgtcaaactgttgttcaggtaaacacagctgtccctgtagccgtgtaaagttgtgttattggatccatctgggttccaacacaccaacagcgatgccaggcagcttggctctgtattcccccattgggacaccattttcagaactcggtgccgtgggtaaactcaacatcaacatgcc

SEQ ID NO: 14012 - DNA, 836 bp, Sorghum bicolor
  Predicted polypeptide sequence is orthologous to G2717
cactcaaggctagataatattataatggaggctataaagaatttaaatgagcctacggggtcacacagaactactattgctaattacatagaggagcaatattggccacctagtgattttgatcacttactatctgcaaaactgaaggacttgtccaccagtggcaaattgataaaggtgaatcggaagtacaggatagcacctagttcacccaattcagagggccgaagccccaaaatgctgctgttggaagatgtgcaaagagcgcctgtcaagatatggagcgatgatagtaaaacccttaccagatctcaagttgatgctgaattggcacgtatgtcaacaatgactgctgaggaagcttcagtggctgcagctcatgcagttgctgaagcagaggccatcatggcagaagctgaagctgcagcgaaagaagcagaggctgcagaagcagaagcccaagctgcgcaagcatttgctgaagcagcatttttgacattgaagaacagaaatgctgcaaaactgatggcctaaggttgatgctactcggactctcgggtgttcggggtgccagctagatttgtataactgtacacgtctactgttgttacagttgctcggcttaaagcagctagtagatttgtataactgtacaaagtgggagccatgtgaagctccggcctccagcctccagcgcaccagtagcagcattagctgtttgctacaacgccattcagagaacttagtggcataccctgggccctccactgtcgtgaacatgctaaactctgtcaatgtctaatgtttcgctgacggtttgcaggattgcattgtgc

SEQ ID NO: 14013 - DNA, 785 bp, Sorghum bicolor
  Predicted polypeptide sequence is orthologous to G2717
acctcttctctacaaaaacaagccaatggcttcctctccatctcgtgcctctacgctgccctagaaccctcgccgccgcccctcttaacgattcccctctgtccccgatcgccccctgacacgcccgccgcccccggatcctgcaccggaattccgcctggaattccggtccggatcgaaatcgaaccgcctccctgcgtacaccccccgatcaacgaactcctcgcgcgcgcgcgcgcgcccgaggcggttggatcctccggtgagggttccttggtctcgatttgcagcggatgggggcgccgaagcagcgctggacgccggaggaagaggccgcgctcaaggccggcgtcgccaagcacgggcccggcaagtggcgcaccatcctccgggactcggacttcagcgagctcctgcgcctccgctccaatgttgacctcaaggacaagtggcgcaacttgagcgtcaccgcaggaggttatgggtctagagagaaggcaaggatggcgttgaagaaaggcaagcgcgtggtgcctaagcttactgctgagccaatggacatagatggcaaggatatggacaacgctcatgacgcagccattgaagcggaaccattagcgatggctttggagcctttggcaattgaggaaagtccagataagtcagttgctaggctcgatgatctcatatttgaagctataaggaagcttaacgagccttctgggtccaataaggcagccattgctgcatatatggtgaacaatactggccacctgctgattttc

SEQ ID NO: 14014 - DNA, 570 bp, Sorghum bicolor
  Predicted polypeptide sequence is orthologous to G2741
ccttttttttttttttttttttttattttgaaaagcagactcactatgaacaaagtactttgcaacgagacctctgaacaccacaggatcaaatacagaattctctcttccagacgtgttcttccaagatgctaagaacctatccctatcctcttgagagatataatgacaataaaatccaatatgcctattcaaatgcgttgttccttgccctggcacagaagataactgaaacttgcaatacttgcagacagccttctcaactccatcaatgaattctgtgtcaagataaccccaaactttagctctctttttccctgacctgcctgactgatctgttgacatagcatcctcatcctctgctgctgttgctgatgaagctctttccataataccacttcttttcccgaagacgtaagaccaaaattctcgagtctagaaaaagatccttctttttccttttgcttagaccacaattcacctgcagtagcaacaaaattatatcagcttcgttgtatttatgcacagataaacacatgtatataagttgtgagtgacactgtaaaactt

SEQ ID NO: 14015 - DNA, 679 bp, Sorghum bicolor
  Predicted polypeptide sequence is orthologous to G2743
gcctactctcgattccccattcctaaccctttcctttcccctcccgggccggctcccgcgcctctcgtcttccacggcctgcccagccagcaatcagtccacggagcatggagatggacccgccgccgccgccgcccctgcacgccgacaaccgccgccgccgccgctgccgcgagtacctgctcgcgctggaggaggaggagcgcaagatccgggtgttccagcgcgagctgccgctctgcctcgacctcgtcacgcagactatcgaggagatgaggagccacatggacagcgtggtggtcggcagcgaggaggagacggtcagcgaccacggcggcgggcccgtgctcgaggagttcatgccgctcaagcccaccctctcgtcctcctcttccgaggacgacgacgacgatgagcacgacagctcccgccaccaccaacaccgcgctgccggcgttggtgatgacgacaagaagaacgacgaggcatcgggagatccggagacggcggcagccttagccagcagcaggcggccgttgttgccacagccggagaccaagaaggcgatgccggactggctacagtccgtgcagctctggagtaaccaacaacagccgccgccgcagcagcagcaccaggacgagctgctgctgccgtgccggacggtggcgctcaacgc

SEQ ID NO: 14016 - DNA, 816 bp, Sorghum bicolor
  Predicted polypeptide sequence is orthologous to G2743
ggcagattttgtcccaccatgccaccatctggctcttctggggtcaccttgcactctcaggctcagcagcaggctagcaggaaggcgaggcggtgctggtcgcggaagcttcaccggcagttcgtcgccgctttgcatcaactcggcggccctcaagttgctactccgaaacaaatcagggaggtgatgcaagtggacggtcttacaaatgatgaagtgaaaagccatctccagaagtaccggctgcacaacagaagatcccccggtgttgttccggtgacccagccgatcatgttggtgggtggcctctaggctccacaggagcaaagcagctccggttcaccccagggtccgcttcagttctcgggatcaggtgtggccatttctacggcccccgtcggcggtgacagcagcggcagcagcagcgacgaagacgacaagtccgaaggctacagccggaaatgcgtgtaaggttgcgcgcgtttaatttgcggaggatcgtcggatgagagtgtagagatagcgtcgcggcttttgcttgcgcatcggtgtcggtggcaataatagattcatcagtctgaactgaagagaggttgtagtgcagccaggcccatgcatacagggagattgggcggtgtgcgtgtcaaggtttttggtgcgtgtgcgtgcgcccaagagatgaactgatcatgagttgggttgctgtgtcatgtacgtacatggtggagaggttttcttgaggcttcctaacttttaatttccgggcagatgccaaaattttcgccctgagaatcacatattatttattatacatac

SEQ ID NO: 14017 - DNA, 685 bp, Sorghum bicolor
  Predicted polypeptide sequence is orthologous to G2783
ctgttggcctacgaactctcaagcggccgcagccccaacccgccctccgccttcgtccccgccgcgcctccgacccccaaccagcctctcgccgctcgatggcggcgccgtatcaccagccgacaagcctggaggaggtccgcacgctgtggatcggcgacctccagtactggaccgacgagaactacctctacagctgcttcgcccacaccggggaggtaggcgacgtccttagacctgtgcccccaagaccgtgcgttccgcgccgattaggaagatgtttctcctagggttcgtttggtttccgtcctaattcggtgattgtaagctgggtgttagtctcgatgtctgattgagcggttgtgttgctgcggattgggtgaattcagacgagttaatacttcaaagtaactctcggatgcatcaagggtcgacttgcccacttgcgtgggctagtggctgctgttctttcggctttagagtagatacatagattgacaacggtgcccttatgcgttttttttttcctgagcaatacaagggtttcatggtcctagggttgtgtcttgtggagccagcctcttggttctgaaattgacccgaacaattgtgaattgaatctgtcacatgcttcgtgttgcatcaatggatgggcctctggtgaaagtagcaacgcgtttgttca

SEQ ID NO: 14018 - DNA, 687 bp, Sorghum bicolor
  Predicted polypeptide sequence is orthologous to G2783
aaaaaaaatcacaccacctctctccccgtccacacctccatcgtcccacctaggtttcgctccccgtcctcctcctccgccgccgccgccgccatgatgccgcagcagcagcccggcgtggccccgcctccaccccaggccgctcccggcgcgccgccgcactgggcccagcgaggtcaggacgctctggatcggggatctgcagtactggatggatgagaattacgtctacgggtgcttcgcatccacgggggaggtgcaaaatgtgaagctaattcgtgacaagcatactggacaacttcagggctatggttttattgaattcataagccgtgctgctgctgaaagagttcttcagacttacaatgggacaatgatgccaaatgttgagttgccattccggttaaattgggccagtgctggtgaaaaacgtgatgacacccctgactatacaatatttgttggtgacttggctgctgatgttacagactacgtattacaagagacatttagggcacattacccttctgtgaaaggtgcaaaagttgtaacagacaagctgacaatgcgctcaaagggttatggctttgtgaaatttggtgatcctaatgagcaagctcgtgcaatgactgagatgaatgggatgctatgttcttctaggcctatgcgtattggacccgctgctaa

SEQ ID NO: 14019 - DNA, 658 bp, Sorghum bicolor
  Predicted polypeptide sequence is orthologous to G2791
gacaggatgaagaatttgcaggagctcgttccaaactccaacaggactgacaaggcatccatgcttgaggagatcatcgaatacgtcaaatttctccagttgcaagtcaaggttcttagcatgagcaggctgggcgcgacggaagccgtcgtcccgctcctgacggagtctcagaccgagagctccggcggtcttctcctgtccccgaggtcaggctcatcaggcaggcagcgggcaggcggaggcagcctgccgtcgtctgaggcccgggacggcgcggcgttcgagcaggaggtggcgcagctgatggagaacaacatgacgacggcgatgcagtacctgcagagcaagggcctgtgcctcatgcccatcgcgctggcgtcggcgatctcggatcagaaggggtcctcctccgccgcggtccagccggaaaatggcggcgccaaggaaatgctgcgcgccgtgaagcccctgggaagcccgatccaagggagatgaaatggagcccttggggggcggctcatcggtgcagtgcagtccccggcatcaaagccatctcgagtttagattccccaagtcctaagttcctaacagcttgcgccttgtttttgcatgatcctttggcaacttgtagccatgaaatgaaacctggacctag

SEQ ID NO: 14020 - DNA, 794 bp, Sorghum bicolor
  Predicted polypeptide sequence is orthologous to G2802
taagcaatcaagcaaagcagctgcaacagattatcatcactcatcacttgctcaatttcactacaacgagaaaggaaacgcatgcaggcttgctctgctatgctctgttgttcccatttggggcggcggcggcattggaggtccagccgcttggttgcttgtcactagtcactactgggtctcttgtgtcagtccacccctgcttgcatcgcagcatccactgtagcaaagctcctgaaggaaggatcctggcaggtttgctgttggggaccgtcacaactcaaaacaggaatgtggtttatccttgctttctttgtgagctgtttcttgcaacagaacaagaacaaagcagcaggtccagtcttctcctagttgcaagaaacaaagaggagtgaatacctacagctgcatcagctctcccatcctgtccgatgattgtgttgtgtctgtcagtctcggagggaagggaagacaggctgaggctggccctggctgtaagttgtccacatgtatgttcctcctctcccttgcttgccctgctttgctgcgtctgcttgctgtgattttacttagcaattaagttggtttccttttgagctcttatctggattggattagtgcttgagaataatataagtactgttggtagtctaagtacttatttattagtcatcatcagttgttggtagtagctcagttcaggccctgtcctgtatgtatgtatgaatgtacaccatgtatgtaaccacgtacggatattgtttgaaaatgtgtttgttgatcaattaatggac

SEQ ID NO: 14021 - DNA, 796 bp, Sorghum bicolor
  Predicted polypeptide sequence is orthologous to G2834
atccactcgctggcgtggcggctggtgatggactccacaaggagcacccttgtcgccggcacgcgcagcagcaccatcgcgtcgagggctttttgaacggccccgcctttgctgaccatgccgggcggcgaactcgccgacgccaacctcaggatgcacatgcctgcccacggcgaccgcttcaagaccctcgacgcgctctcccgccctggccacggccacggccagccgcccaagctgcccgcgggcagcaacgtgcgcttctcctgccccttcgccggctgcaacaggaaccgcgcgcaccgccgcttccgcccgctcaagtcggcggtgtgcgcgcggaaccacttccgccgcagccactgccccaagctctacgcctgcgagttttttggcggcaagaagcgcttcgctgtcctggccgatctccgcagccacctttgttactgcggggaggaggcacagtggcgctgctcctgcggcaccaccttctcccgcaaggacaagctcttcggtcatctcgcgctctttgaaggccacacgccggcaatcactaagccaaacaaggatgtggtgacaggacctacagagtccaccattgatgctatggaggaagggggatttgaagaaggcaatcctgaccgggaggaggatgaggagggtggttatgatccagagttcttcaaggagtggatggaggagctcagaggtggtgctagtggctccaactggcctggaccagcggcagccggacaatagcaatgttgtgagggctaattggatggtttgacaagag

SEQ ID NO: 14022 - DNA, 834 bp, Sorghum bicolor
  Predicted polypeptide sequence is orthologous to G2834
ccgggagccgcaattccatcctgctgttcgggttacatactcgtccaatagaacaattctacatccgatgatcgtacttcctgaggtagaagcataccgaagcaagagtcgagcggtgttgaattgaaatggaaggcaggatgacaagtttggaagccgccatgaaagcttcttcgtcaatggcaagcagcatggcaaggaatgctgaccctgaccatcagactcttcgctccaattcagtggagcagttttattttccaagacctggccaatctttgccaggcattcctccattctttgggcctccctcctccagtttgtatcctcctaatgacaatgaagctaaatttggcagccagtttgaatcaaatccttcacagaatacagattgggacccgcaggctatagtgagcaacctaaccttccttgagcagaagatcaaacaggtaaaagatattgtgcagtccatgaataatcgagagaaccaagtagctggtggttccagtgagctagcggcaaagcagcagctcataaccgctgatctcactagcattataatccagctcatatctactgctggttccctgctcccttcaatgaagaacccacttcttagcagcaatccggcagtcaggcagctcggcaacactcttggttctcctatgggctttggcatgaatgctaatcagcgaccaagtgtagacagcaagactgatattcctgacacaggaaaaacttctgattatgatgaactgatgaatagccttaatactgctcaagatgaaagagatgggctgatcaaatgcccaaatctctgtggtggtgaagggtctg

SEQ ID NO: 14023 - DNA, 738 bp, Sorghum bicolor
  Predicted polypeptide sequence is orthologous to G2850
gctcttcccttccctgatccccagatgtccccgggccggcccccctcttcacccgtccgttcttaaaccctgcgtaagcctcgtctcgtcctcgttccccaacacaggcccctcctccttcggcaggtcgctgcctcccggcagccttttcgttctcctctttccgtgtggtggcgcggctccggccgggggaaaaggaaggcgcgggtgcacgtacgccgggaagggagaagaagcgcacgccccgctcgctctgccgctggttctcggtcgtttccccgccggtgacacgtacagacggctcgtgccgtcttctccaccgcaatcgattcccgctgtgctcgatcgctctccttccgcacgcagtggactgtcgccgttgatcctgcaggaaaaaccgggtgggcaaggaagctagtgagcccagggtgaagaagatgatgatggctgaggtggccaaccacagcaaaaggaaccacaccgacagctacttcagtggcaaagccgccgccgtcgccgtcgcggccaccggcccagaggagttcgcaagcatgtcctcgaagaagccgaggaataccagcccgagaatcgcgcccgtatcaccaaaggagaagaaggacaagatcggcgagagagtcgcggcgctccagcagctagtgtcaccatttggaaagaccgatacggcttctgttctgcaggaagcatcgggctacatcaagttcctgcaccagcaactcg

SEQ ID NO: 14024 - DNA, 755 bp, Sorghum bicolor
  Predicted polypeptide sequence is orthologous to G2851
ctcctctccctctttttttcttctgtttggtattgttgttgttcccttctttctctctccccccctctctataggaggaagagaagatatatgccctgcccagcccatctccctcaaggaaattgcgacgagcgacactgctggcccctttaagattgacctgagactacttccacaccaagagtgcaagaggagctagagagcctctggcaaggaagagatagcagcagctagcatttgttgaagtaagagagctcatctctagctctcctctctctccagcgcgcggccggtgatgaacagaggagaattccagacctcccttgtccagcagatgatctggagcggtaccggcagtggcggcggcaatactgccacagccagcagcaataatatcatgagcagcttcaagtcgtgccatgaggatcaagaggcctcccccatcctgccctccttgtcgtctccatccatgctcttcccacagcagtttctgcacaccggtacctcttcaggccagctaggtcatatcaacggcggcgcggctggttctcttccaagtctgcaagacggcggcagcggtcaggagaaccacatgccagaatcatggagccagatgcttctaggggggttagttgcaggagaccatgagcgatacagcgccaccgcagctctcccgtcaaagggcatagagaattggggggatcacgctgaaactgcagcaagtgcatgcatggtgggtggtggtggtatgaaag

SEQ ID NO: 14025 - DNA, 665 bp, Sorghum bicolor
  Predicted polypeptide sequence is orthologous to G2854
gagattcccaatttcaggctattgctgaagcagctggttaccatggaggtcatccagtggacaactttgtgggagttcgccaagcacgaatacgagaacgagaagaatcttctcggaggagctttggaggccttggtaattctgcaaggcaccttggttggagggcagaatgtgaggctttcatggggtcgcagcccttcaaacaaacaagttcagcctcaacaggactccaaccagtgggctggagctaatgctggatattatggatatggtcaaggctacgaggcctatgggtatccccagtctcaggaccctaatatgtatagttatggagctggagcttatgctggctatccaaattaccaacagcaaccagtagcgcagcaaccacagcagcaacagtgagatccaatgaggctactgtcatttgagtgcggcgattgatgtgggcatatttatgagttgtaagatgggcttcggatgcaagcctggattaggtatacagacatgatttgtagtactcagattctgagcaccttgtatcactgagcttatggttctatattggttactgaatgttttattcgcctttgcttatgttgtaccgtgtcttccgttactccaaaatcttgacacttactatgttgggatttttttgagtatta

SEQ ID NO: 14026 - DNA, 623 bp, Sorghum bicolor
  Predicted polypeptide sequence is orthologous to G2854
agtccatacggagagcttctctatgtcaaaatacctgtaggaaagcgttgtggatttgtccaatattctaacagggcttcagctgaggaggccataaggatgctaaatggaagccagctgggaggtcagagcataaggctctcatggggtcgtagccctgcaaacaagcagcctcagcaagagcagaaccaatggagtggtggtggctattatgggtatccccaaggatatgatccatatggttatgctcgcccccctcaagatcctgccatgtacgcctacacaccatatccagggtatggaaattaccagcagcagccaccacagcagcccccaccacaacagtaagaatgatgatggcccgagaggatcatttacaaactggtcgcaaagtagttggggaaactttggtgcattggcatgagaaattttgcgacggttgcttgtgttatattggcccaacgcccttgtacacgtagcctgtgttgtaacttaattttggcaaggcctagagtgactagtgtttcagctgtagtaactggattggacatttttccactgttcgagaagttttgtcgcaaggattttcttcaagctcttattgctggaatctggagaaagtt

SEQ ID NO: 14027 - DNA, 633 bp, Sorghum bicolor
  Predicted polypeptide sequence is orthologous to G2854
aaggcaaatttttactccgcacggagaaatttcctatgtgaagattcctgtaggcaagcattgtggatttgttcaatttaccagcaggtcatgtgctgaggaagccatccaaatgctgaatgggagtcagattggtgggcagaaagttcggctttcatggggccgtactcaaaacagacaggcttctcagcaagatgccaacagccagtataatgggaacagctattatggataccgacagcagggttatgaaggttatggctatgctgcacccaatacacaagacccaagcatgcaaaactactatggataccctggttatggtaactatgagcagcagcagcagcagcagtcaacacaggaacagcagcagcctccaccagcacaggagcagcagcaacagcagcctccacagcagtgatgatcatgcacttctggagatctatcagatcagagggatggtagagtcacaggccactgcctaatgagacagatatggaggtcatgtagttgcatgggtgcggttggacttgttcttggggaccagtgttaattgatgatggcactccacactccagatgtttcttttgtttgtcgttgagatcttgaccgttaaagtatgctctgttgaga

SEQ ID NO: 14028 - DNA, 807 bp, Sorghum bicolor
  Predicted polypeptide sequence is orthologous to G2854
ttctttcttattggctctctctttggcagtttggccgcttgaatcctatgttatctggattttgggcctgtctagttgactaatgttcttaccaataccatgattcttcataattgtatgtgttagatgggctaactttgtataattgctctgatgcattctttctcctaggaacatataacacgatatgcatgctcaattttccttttgtaaatgttcttattgttgaatatgtgttaacctaataactttagtgacctgtaggcttttccgtggtagcattcatttattagatattactattcatcaatcttacaatgtatgttgccttcacttttttgcttttatttacagtaccaaattctcaaggagctcagtctgagaatgatcctaacaataccaccatatttgttggtggtcttgaccccaatgtcactgaagataccctaaaacaagttttttctccttatggcgaagtcgtccatgttaagatacctgttgggaagagatgtggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctgggtatcccaattaccaacagc

SEQ ID NO: 14029 - DNA, 800 bp, Sorghum bicolor
  Predicted polypeptide sequence is orthologous to G2854
agacgaaagaaaaaaagagtcgcggcggcggcggagtcggagctccactcatcatcaatgcctagggtttgatcctccctccctcactccgcgctccgctcgtgctagccagccagcccccccacccacaacccgccacggcgatggcttcgccgcacccgctcagctgggccgacgcgccgcccttttactaccacgggacgacaccccagccggcacccgactcctcctccgacggggccgggccgcgctcgctctggatcggcggcctgctgcactggatggacgaggactacctctacgcctgcttcaccacctcgcccgagcttctttccgttgtcatcagacggagcaagcagactgggcaatcagagggttttggctttctcaattttgctgaccataccaccgctgctcagattctcaagtcttacaatggtcacaagatgcctaactctgttcaagatttcaagctcaactgggccactcaacaacctgctcccgacaaacttcctgatccacatttcaagctcgacccggccatgcagcaggatgtgcctcagaggcacgacgacgataattcctcatctgagcatttcatatttgttggggacttggcctatgatgtcacagaatacatgctacaccatctgttcaagacccgctacgcatcagtgaagagggcgaaaattatcgttgacaggttcactggtcgctcgaaaggctatggctttgttcagtttggagatgtcaatgagcagacacaagcactgacagaaatgaatggagcctactgttct

SEQ ID NO: 14030 - DNA, 569 bp, Sorghum bicolor
  Predicted polypeptide sequence is orthologous to G2887
tgcccatactcaaggacgccggcgcgctgtggctttgatgtgaagaccaagccgttgttgttgcctctccattgtcagcacttctttcttttttggtttccctgtccttgcttggaattaaacgatgatgtgttgttaacttatttttatttactcctagatcgactagatagacaggcatgcacataggactttaattcttttagttgaaaaaaaaaggttattactaggagaaatggagtgcgcatgtaagcgatttcctataatatagtatatatatttgtattttccgcatcatgtgaatatgaaagagtgttaaaatagctgagcttctattttgacgtgtcatatatgcacagtaagtcagtacagttcatgaacggtacaggtcgtcggcagccggctgttggatattgatgagattttcctccatacaaacatttttttttttaaaaaagaaaaaaatataacataggtgttcgacaaggacgtgcgtgtgaatgtgtgatcatcatatttgcagtgcacagtacacggcagctcaacatgagtacagatgaatttcgtgg

SEQ ID NO: 14031 - DNA, 606 bp, Sorghum bicolor
  Predicted polypeptide sequence is orthologous to G2907
gcacgagggcactgggtttcactggcatattaacatcagaggtgaacggagatagatataatgatgatagcatcaaacatccactcttgaagcagtcatcattagatctattgacgattgagactcctggtttgaagaaacatgacagcttttcaagatggatgagtaaagaacttgaagaggtggttgatttgggtattaaatccacttctgatgctttctggagtagcattgagacagtgaaggtgcctgatggttctaatgtgctgagtaatgaacagctgggtgcttatgtagtgagcccttcactttctcaagatcaactattcagcattctcgatgtttcaccaagttgtgcatatattggtacaaatacaaaggtttcggttactggtacattcttggtgaataaggaacatgtggaaaatcagaagtggtcatgtatgtttggggatgttgaagtaccagctgaggttttgactgatggcaccctacgctgctatgcaccagcacatcaatcaggaagagtcccattttatgtgacctgttcaaacagggtggcttgtagtgaagtgcgagaatttgagtatcgtgattctgatgctc

SEQ ID NO: 14032 - DNA, 659 bp, Sorghum bicolor
  Predicted polypeptide sequence is orthologous to G2907
tccccatcacacaaacctggcagggttcctttttatgtcacatgtaccaacaggttggcctgcagtgaaatccgagagtttgagtttcgaccaagtgttactcaatacatggatgccccaagtccacatggtgctacaaacaaaacatatctccagatgcgtcttgatgacctgttgtctttgggacacaatgagtaccaggcaacagtatctaaccccactaaagagatggttgatttgagcaagaagataagctcactgatgacaagcaacgattcctggtccaagttgctaaaattggctagtgacaatgagcctgccactgatcataatcaggatcagttctttgaaaaacgcttaaaggaaaaattgcatatctggcttgtccacaaagcacgcgatggtggcaaaggccccaatgtgttggatgatgaagggcagggtgttcttcatctggcagctgccctaggatacgattgggtgataaggccaacagtttctgctggtgtgaatataaatttcagagatgctcatggatggactgcactccattgggcggcattttgtggcagagagcgaacagttgtcgcacttattgcacttggtgcagctcctggagctttgacagacccaacgccagatttccctacaggaagcac

SEQ ID NO: 14033 - DNA, 521 bp, Sorghum bicolor
  Predicted polypeptide sequence is orthologous to G2907
ccttttttttttttttttttttttttttttttagcagaaaacaactctatactccatgtagtccatagcataaatacatcataattgctaatggaataaataagcatatttattaggccagtgttcagaagccacgggacctaaatagagcacaaaaacataataaaggaaagtagaaaaggaaagagaaaaaaagtaaccatactcctgggcatgttgggcggctcggccgcgatggaaaaaagcttgtagttggacaatatctcgcagatttcggggggccgcagccaccgcttctgagcctcctgcagtatctgcgagatgtctgcagattcacgacgatgtgtttagttagtcaccgggtagtcaacgccaacaactgctcccaccagggcaccaccactcgcatccggtcctcgcgctcgcgctgtttggtactgaaaaccccttttgtctgctctgaatattttttttagacgtttgtctgctctgaattattggccggaaaagtcagcaaaacg

SEQ ID NO: 14034 - DNA, 464 bp, Sorghum bicolor
  Predicted polypeptide sequence is orthologous to G2969
gcgaggccacgccagaagcacgtgtcattggtggagaagatctggatctgctgagccagattactggccgccccttcaacagcagcaaccgcaaacgcagcttgggtagcgcaggcgtgctgaccggcggcgaagacgatgacattgacgaagtggaagacgatgttggcttttgatactttttccgggctgtttttgtttgttcatcagcatcatggcgcggcgctcggaactttcttccttcttttctcttctcttcttttgttctttgggaaaaggtagcaaaggaaagcgggcgtttctcttggtgtcggtatacattgcattctttggaaaggcacatccccaatgattatcacgatgatgggcgtttttttttgtagctcgatttgggtactcttttttttctctttaacttttctaccaagcatcggctactcacgataatataaatgacaactacg

SEQ ID NO: 14035 - DNA, 507 bp, Sorghum bicolor
  Predicted polypeptide sequence is orthologous to G2979
tggcagctctacattacaataagggtgataaagatgtatcgcccaatggaagaacaaggatgggaacacagactgtacattctcagctgtgaaggatcatcccgctgtgaatgatcaatccctatttatggttgcacatgcaaagtcaagtaaggtgctctctgcaaaatgtaaggatcgacaccaaatgtatccatcaacaagtgacctatctgcttccttctctcgactttattcctcattggacatctccgacgacgacgaacattgctgggaacttgactgtagctgcaacttctgatcatccttgcatccatgtggaagccgaacagagaccgcacacacattgcttcctaaccttgtatataatatttctactcaacgctctgttatgcttttggatactacatctgacagagcatacaatggacatcatactaatcttgtataatatcaacacgcaccactctaatgttttttatatgcgcagctcaaatctgccatccg

SEQ ID NO: 14036 - DNA, 742 bp, Sorghum bicolor
  Predicted polypeptide sequence is orthologous to G2981, G2982
aacctccctactcgcacgtacttcttctcatcgtgtcgctagggtttcttccctcttcaattcctccgctccaaattccggtccggcgccgaaccccactccatgcccaccaccggcggtggtgggggtagctccgcctccgataagggcggctccgcatcttcgtcctcggcgtcgctccccacgccaccaccctgcgagagcaccgtcgcctggcctctccctctcaacggacttgacatcccgggagacgacacgccatcgtcgcaaccagctgccactgcgagcaagaagaaaaggagaggggcacgagcagttggccctgacaaaaatggtggtggattgcgccaatttagcatgagagttcgtgagaaagtcgaaagcaaagggagaacaacctataatgaggtggcagatgaactcgttgctgagtttttagaccccaaaactaatattgacactctagatcatgataatccctccgcgcaacaatatgatgagaaaaatattcgaagaagagtttatgatgcactaaatgtcctaaaggctatggacattatatctaaggataaaaaggaaatacagtggaaaggcttgcccaagacaagtatgaatgatattgaagaattgaagaaagaggtcacaggactaaaagatcggattaagaagaaaaatgaatatctgcaggaattagaagaacaatatgtatgtctccaaaacttgggtcgacgaaataagcagc

SEQ ID NO: 14037 - DNA, 801 bp, Sorghum bicolor
  Predicted polypeptide sequence is orthologous to G2990
tagtcctcctaacactacctgcactccagtttctcactagagcctgcagcctgctagctaagccaccgagcatattgagtccagttgctacacactactgcaccctctgctagctgcgtcggcgatgtgtctgccgttctcctgcggcggcggcgacaaaggcgacgattggtcacatgactctagcagcgtccaccaccattttcggcagccgccacaaccacaacctcctccgccaccaagggaagacgaaaagcaaacttattataagcctccccctgagaaagaagcatatggccaccatgggaccaacatgcctgccggcggcggcgatggcatgaataatggaggagctcgtgcggcggaagtgaacaagaacggaggagggcacacgacggacttcggctactcagatggcaacgtccatgcttctgtcggcgttttccgaggtcgagagagtcagagcgctgccgggaagaagatcgtggcgtccaccgctccagcggtgcaagccttcaataacaagcatagggatatggccgcagctcaacaagctcctcagggtatgtatgtcgtctctgctagtcctcgccaccccaccatggccatgggtcgtcggcagcatcgatatcgcatcccagcgaggccgctgatagcatgaaggcaccacttcaagtactaccgatgggtcgtcgtggtcctgaagactactagctatatataccctactgctgctgcagtcaccacacagacgccgtgttccccaacaatttcgttcgttctacggtaatcgtgagtgtt

SEQ ID NO: 14038 - DNA, 598 bp, Sorghum bicolor
  Predicted polypeptide sequence is orthologous to G2998
ggttttaacgtggaaatctcagggcatgggaggcaatttgaattgagtgcaacagttggtggctttgttagtctgtgatggagatgcacttgcctgggtgtaatgatgagatctgccatagtatatggaatggacattttacaatgtaactagtcttgacaacagcatccagcagactaatctctcttagtgtctgaagaacgatagtcaaacgatgacgggttttgatttgtgatgtgaatattgggatttgggtggagttgaggggagctggagcagctaaagccttggtttgaagaggtaaaatgtagaattgtatgtaggaaaaaaaatgtacagttgctaacacaatgtgctgtagtcccttggcacaagctggggaggactaatggagcttctggtacaattttacgcaatttcatggaaggcttacagatgggttagttaggcatgtagtgtgatacaattatcgtttctgttcacccgagccattttttttgaagagaaatcaatgtgacgagcagctaagtggtgatgttacccttatatatctgtgtatgtgcggtgtgtaactgggtgatggtgatggtgtgtggtc

SEQ ID NO: 14039 - DNA, 543 bp, Sorghum bicolor
  Predicted polypeptide sequence is orthologous to G2998, G2999
gatggccgtggggttgaccttcgtgccctcggctctgtgcaagaagcggtccttaattgaccaagctcacggcggagaggagaggatgctggagttcgctcgacactttaggtggcgcatccacaaggccagtgcggaagctattgacgccttttgcgcccatattggtgtccccggaactggatgagcaaaaacatgcacctcgcctccacgctgatcgtgcccgtgcgtgggaggttccaacgcctaaagctcactgcggaccaagcctaaagttcagagtacaaaaatttgggaacaggaggttccaacgcctcaacaagctatttgattgttgtactgtccaatcattttttaatatctaacattatctttattagttgttttttgaatctctaatggtgtgtgatctactgcgttcaaataatttgccctcaaatccaattgatagcctaatccaaccgctctgcgggatggtatggagatatggtgaaacttattcatggatttactgacgcatgaaaaaataaatattggagattt

SEQ ID NO: 14040 - DNA, 526 bp, Sorghum bicolor
  Predicted polypeptide sequence is orthologous to G3054
gcacgaggagcacacagcagatactcctagctacttccagttccagctcggtcttggcctcttggaagagagcagctagttactcttacttgcgacgatagtgtctgtgaattgcgagaaacgagtgagcaatcatatatatggcggcgtctctgctcggactgtacagcggcgggaggggccacgccaggagcggcggccgccggtcggctgcggcggtgaagcggctgctgtcgagcttgaggcgctcttggaggagacgtgcggcgcggccgaggcgaagcgcggtgaggttcgggtatgacctgcatagctactaccagaacttcgacgacggcattgcctcctactcaggccaccaccgcttgtagctgtactgtacctagctagtgtacagtaattccctcttgccacttctgtacttaattagctcgtgcagtcattgactcattattttttatggaagtcattgactcattatatgtaagagtaacactaaatctgcgatcgattagcagaataataa

SEQ ID NO: 14041 - DNA, 627 bp, Sorghum bicolor
  Predicted polypeptide sequence is orthologous to G3054
ctcgtggctatgcatagtcccaacgcgccgctccgtctgcggctcgacgcctcgccgggcaggtttgtctccgggccagtcaagaaggagatgaccgccgagtcgcgccggagcgcatccgccgccgccgtcggcggccgacctgaccgggcttcaggcgcggcacaatcgaacttcacaagtatggagggggccttatggacatagacggcagggatatcgcagcgctccgccattgacagccagaggtctggacagctgcaaatgcccattcataagtggaagggctctgacaagatcggcgggatctatggtgattggatagacgacaatgagtaggaaggggctatggtaggctgaagggagactgttagtatctgtacgactatgcttcagctggtgaaagttcagcaggcttagaagatctagttagcattgcaaaaccttgtctcgacaaaatgcagggtgtttgtcctatgttatgttcctgcatgtcctgctgttgtaaatgtgactcaatttgggcttccttggtagctgaacaagaaactcagtttgggtttcaacaaagatgtaaatgtgacttctatatgagatatatttagatgttttgcaaaaaaaaaaaaa

SEQ ID NO: 14042 - DNA, 563 bp, Sorghum bicolor
  Predicted polypeptide sequence is orthologous to G3055
tcgcgcgccatcgggaagatgttcttcaagaccaagctctgctgcaagttccgcgccgggacctgcccctacgtcaccaactgcaactttgcgcacggcatggaggagctccgcaagccaccgcccaactggcaggagatcgtggccgcccatgaggaggccacggagcagcgggaggagcaccagatccccatcatgacctcgggaagtgtcgtcgctggagacggcggcggcggcggcagctcgcaagggggcagggcgtacaagggtcgacactgcaagaagttctacactgaagagggctgcccctatggtgacgcgtgcaccttcctgcacgatgagcagtccaaggcgcgggagagcgtggccatcagtctctcgcccacggttggcgctgggggatacaatgctgctgcctctgccaatggagtgatggtgcagaagccatccaactggaagaccaggatctgtaacaagtgggagatgactggatactgtccatttgggagcaaatgccactttgctcatggttctgctgctataactgcagaacttcacaagta

SEQ ID NO: 14043 - DNA, 825 bp, Sorghum bicolor
  Predicted polypeptide sequence is orthologous to G3060
accaatgcctcacctagacatggttcctccttccaccttcggtgcttcagccacagccaagatcagtgtcgatgcatcccttgctggcgccatcatcgggaagggtggtgccaacacaaagcatatatcccgagtgactggggccaagttagccatccgggacaatgaggctgatcccaaccataaaaacattgagcttgagggaacatttgaccagatcaagcacgctagcgcaatggtcacagagttgattgtccgcatcagtggtaaggcgcctggcccacaagccaagaataacccaggaggcagggggcctggttctcatgctgggggtcctggaagcaacttcaagaccaagttgtgtgagaacttcaacaaaggctcctgcacctttggggacaggtgccactttgcccatggcgaaagtgagctgcgcaaacctgctgctgcttgataggtatgcttattgtgccctgtggtgattactctgcctgtatggctgaataacaccagaaccaaggacagtcacccatggtgaaatgtattgagcctcatgcttcctgagatagatccgttccgtggcttgtatttgatcatcttactgctgtaactctttgatagagagaagcaatggcctgtcttctagtttttgtaggtttgccgtattggtctccctttatcttccccctgcttctgaatcctatttctgtatcgtttcttaggcacttttggctggcggatcattgtgattctgttaacttgaacagttgctattgatgttatccgtttgtgaattcttaatagctcttttgaaatccagatgtc

SEQ ID NO: 14044 - DNA, 865 bp, Sorghum bicolor
  misc_feature (854)..(854): n is a, c, g, or t
  Predicted polypeptide sequence is orthologous to G3074
aagaaaagcacacacaaaaaaaaaggagtactcctccgtagactacgacatcgtccgtcgaggcggcgaggaggcggaggcggaggcggaggcgaagatgaggaagaagctcggcacccggttccccgcggctcgaatcaaaaagattatgcaagcagatgaggatgtcggaaagattgcactagcggtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcaacaaggtaccaggtcttggtggcgctgattcctgtggagatgaaagaggattacctagaagaagaaagtcaaatggcagtgacccagagaatgatgaatcaagatctagtaaaatggtcataagaaatgcaaacatcagccccagaggacgtgggaggggtcgaggcagagggcgaggtcggccaccaaccaagagaaaggaagttggttatgtgcaatttgaagatgagagcagcatgtttgctgaacaaggtgaacccttaccaggagaggaaacagttcaagagatcaacaatggcaacgagatcatgcctcaaagcacgcaacctccagtagaggctccgccaacagcccctgcacaagctacaagttctaaggtggaagaagcgaacaccaatcatcagtcagattggcctatgccagatgccattggaagcatcggtgtcggtccgtctggttttgggcatctgacagtgcaggtcgatgaagacgaggactacgacnatgaggactag

SEQ ID NO: 14045 - DNA, 645 bp, Sorghum bicolor
  Predicted polypeptide sequence is orthologous to G3091
gctactggaaaaccttcgccttttcctctcgtcttccctccctccccctccaatccccccctacccctactctttctctagctttctctccacattctccctgctctgtgcaccttgtagtttcggttgtggatcgccggaaatggcaatcgacgatgaatcgccgctcagagtcaacaccagaggcggcgccatgggaggaggcgggtgcgacggggcggagaaccagcggtggccgccgtggctcaagccgctgctggggacgagcttcttcggtcaatgcaaggtgcacgcggacgcgcacaagagcgagtgcaacatgtactgcctcgactgcatgaacggcgcgctctgctcccagtgcctcgcctaccaccgcgaccaccacgccatccagatacggaggtcctcctaccatgacgtgatccgggtgtctgagattcagaaggtgctggacatcaccggcgtgcagacgtacatcatcaacagcgcgcgcgtggtgttcctgaacgagcgcccgcagccgaggcccggcaagggcgtcaccaacacctgcgaggtatgcgagcgcagcctcctcgacaccttccgcttctgctccctcggctgcaagatcgtcgggacctccggcgacttccgcatccg

SEQ ID NO: 14046 - DNA, 802 bp, Sorghum bicolor
  Predicted polypeptide sequence is orthologous to G3091
ttggcccgatgcctgtgttccaaacctttcttcgtcttttcccccgtctacaaagacttgacactcgcagccgcagccgccggcagactccttccccgcgaaggcttctcctctcctctcccctctcccttccactcgcacgcattctcctcggttccgcggcgacgagatggcaatagatcacgcgacgcctctcggactcaagagcagaggcgccatgggaggcggtgagtgcgactacgacgacgccgagaaccagcggtggccgccgtggctgaagccgctgctgtccacgagcttcttcgtccaatgcaggatccacgcggacgcgcacaagagcgagtgcaacatgtactgcctcgactgcatgaacggcgcgctctgctccctctgcctagcgcaccatcgcgaccaccactccatccagatacggaggtcctcctaccacgacgtgatccgggtgtcggagatacagaaggtgctggacatcgccggcgtgcagacgtacatcatcaacagcgcgcgcgtggtgttcctcaacgagcggccgcagccacgcccgggcaagggcgtcaccaacacctgcgaggtctgcgagcgcagcctcctcgactgcttccgcttctgctccctcggctgcaagatagtgggcacagcccgtggctaccgtcccaagaagaagcacggcatcggcggcggcggtcacaagaagaagagggcggcgcttaaggtcaaggacgtgcgctctgactcggaggattcgtgcaccagcaccagcggcgccagcagcgacaagagcagc

SEQ ID NO: 14047 - DNA, 784 bp, Sorghum bicolor
  Predicted polypeptide sequence is orthologous to G3095
gccgggcatccggtggtccgacgacgagggtagcaggtccaacatcacgccgccgatgaaccggtgccggccgtccaggaggaagggcatcccccaccgcgccccgttctacggttagcgttcatgcaatgcaacacacaagtcatcaatcaacctttaaaataaactcccatcttcagtcagcacgatataatgctgtgtgccactgatcaggtgtgagcagtgaatcaagcgatccaaaatcttctgctagtggtatatagtaggtcaccatacatagcagctagtatatatatagctagctaggtacacatatgtttagctatagcttgttacatatatagctgtatacgtacatgatgcatgcatacatacaaaataatgtaggcgaaagatatatctgtacatgccaccagtatattgacaaaggttttcagtatgtgtagacatgatctgaaaggagatagaaacatataggtagggttttggattttattaggttggctagtagtagtacgtatatatagtagtcgagattgatatgtgaaaaggaaccagctagcatcatgtatttatctcggtttgtagtatttggctgcttgcctgcaccacccaatgcgtttattagcgttgtggtgcgaagataaaagtttttgttaatctcctccctgcttataggagcttattaatctgtacatgtacatagagtgtttgtatgcacacacgtgtatgatgatgtatgtatatgtttgtgtaccatcagaaatcaaagaaagataagcgg

SEQ ID NO: 14048 - DNA, 779 bp, Sorghum bicolor
  Predicted polypeptide sequence is orthologous to G3095
cttggatttccgaagccccgaatcggcgaatcatccatccatccatcccctcctctctccccgtccagccgtcgtcctcctctcctcccttatcatcgatccgcccggccggtcgtcggcagctgaacccgtcttcctctccgccgtgtcgccgtccttgcccggcctgtgaagcaggaccggggttgagcctttgcacgagcagacgagctagagtctaataagggtatagagagacgtgcatcagttgtcgctctggaggaacctataccaatggtgatggtgagcgttgcgagcccaagcccgagcccgagcccgatggtgcggtcggaggaggacctgggtccgccgtggctgcggccgctgctgggcacgagcttcttcgtgccgtgccggctgcacccggagctgagcaagaacgagtgcaacctcttctgcctcggctgcaccggcgacgccctctgcgcctactgcctgccggcgcaccgcgaccaccacgtcgtgcagatccggcggtcgtcgtaccacaacgtgatccgggtgtcggaggtggggaagctgatcgacatctcccacgtgcagacgtacgtgatcaacagcgccaagatcgtgttcctcaacggccggccgcatgccaggccaggcaagggcgtcaccaacacctgtgagatctgctgccggagcctcccggactcgttccgcttctgctccctcggatgcaagcttggagggatgcagtgggacccgagcctgacgttcgccatacagccgaagcgcgg

SEQ ID NO: 14049 - DNA, 724 bp, Sorghum bicolor
  misc_feature (479)..(479): n is a, c, g, or t
  misc_feature (625)..(625): n is a, c, g, or t
  Predicted polypeptide sequence is orthologous to G3111
cctactggaaaaaaaaaaaaaaagcacgacaacttctcggcgtcttctccgatcctcgccctcccccgtcgccacggcgtatatatatgcggccgagctctccactcccgagtcccgagaactcgttccacctccacacggcacaccaacggcttgccggctgcgccaacaactggagctttcagcgcttcgcgttccatcagatatacgtatgacgcaaggctctgaccaagcaggcgccggcgctggcacgcccccggcgcccagggcatcagcaggggcggcgggcgccatggcgctcgggagcatcctcaccgtggcgggcatcctcctgctcttcgtcttcttcgccttgggcatcatcgccctccagtgctgcatcaacacctgggacagggaaacagcccagcagcagggcgaacaagcaggcaggcggcggcgccgtggtccgcgggcgcccgggccggccggggagcaantgggtgggtgggacggtgcggaccaccaccagcaggggcgtcgacccggagctgctgcgcgcgctgcctgtcacggtgtaccaccaccaccaccacggcacgtcggaccaccaccagcaggacgcgggggtgggtggagtgcgccntgtgcctcgccgagctccaggacggcgaggaggcccggttcctgccccgctgcggccacggcttccacgccgagtgcgtcgacatgtggctcgcctccc

SEQ ID NO: 14050 - DNA, 780 bp, Sorghum bicolor
  Predicted polypeptide sequence is orthologous to G3967
tatattaagtgtctgtgatgaggaggtagctcgttatgagacagcaaatttaacagcagcagctgttcctgcacttctgctacctccaccaacaacacccttggacgagcatttggtggctggcctgccccctcttgaaccatatgctcgcttgttccatagatactatgcaattgctacaccaagtgctacacaaaggttgctttttggtcttctcgaagcaccaccatcatgggctccggacgcacttgatgcagcagtacagctagttgagctacttagagcagccgaagattatgcttctggcatgcggcttccaaagaactggatgcatctgcatttcttgcgtgcgattggaactgcaatgtcaatgagagctggtattgctgctgatacagcagctgctttgcttttccgaatactttcccaaccaacgctgctttttccaccactgagacatgccgaaggagttgaagtacaccatgaaccactgggtggctatgtatcatcatataagaagcagttggaagctcctgcatctgaggccactatcgatgccactgcacaaggcattgcttctttgttgtgtgctcatggccctgatgttgagtggagaatatgtaccatctgggaagctgcctatggtttgctaccgctaagttcatcagcagttgatttacctgaaattgttgtagctgctccgcttcagccacctacactgtcatggagcctgtacttaccattattaaaagtattcgagtatctacctcgtggaagctt

SEQ ID NO: 14051 - DNA, 720 bp, Saccharum officinarum
  Predicted polypeptide sequence is orthologous to G2
gcatccttgcacccctgcacgtaccgcggacttaacgggccgcgagcgcacccactgccgtccgcttggataagcgcaggcgtagctgaaagaaccccggggggacactacgcgtgtgtggatggtggcaagctcagatgggtcactttcttggaaagaagtacatctaccttgttctgtatgacagtgtaatcgaactaccaagagcgtatgacaggccatccattcgtttcaatggaccggatgctgatactaacttcgactctagttcctatgatggagatgtcccacttccacctgcaattgagaaagatgtggttgatggggacatccttgatctgaatttgaggatttcacaacctaatgtgcatgatctcaaaagtgatggtaccctgactggttttggattaggttgtaattctcctaaagcttcaagctccattgtttctcagccaataagccctcagtggcctgtgcatcctcacagcacactgatgcaaccccagcatcaacatctgtatgcatctccttgtccaggcttctttgtgaacctcagggaggcgcctatggaggagaaacgggcagagccggcgggtccccatccccaaccggcgttcccggcttggacatggcaaatgcagggctcccctgccccgtttctccctgctactggagcatcattaggattttttaccgccaccgtcacccgtgtggaccccg

SEQ ID NO: 14052 - DNA, 985 bp, Saccharum officinarum
  misc_feature (710)..(710): n is a, c, g, or t
  misc_feature (857)..(857): n is a, c, g, or t
  misc_feature (947)..(947): n is a, c, g, or t
  Predicted polypeptide sequence is orthologous to G4
cggaggcgccatcctcgcggagctgatcccgccgacgcggcgcgtggcgtctaagccggtgaccgagggccacctctggccggcgagctccaagaaagccggcatcggcagcggcagcaacaagaggcaccaccacgaatacgccgacgacgacgactttgaggccgccttcgaggagttcgacgacgactttgacgcgcacgaagacgacgaggaccaccccgaccacttcgtgttctcctccaaatccgccttctccccagcccacgacgggcgcggtgcgcgggcggcggcgacccagaggacgaagcgcggccaccgccagctccgcggcatccggcagcggccctggggcaagtgggcggcggagatccgcgacccgcacaagggcacccgcgtctggctcggcaccttcaacaccgccgaggacgccgcccgggcctacgacgccgaggcccgccgcctccgcggcagcaaggccaaggtcaacttccccgcagccgtcgcgcgcgcccgccgcggcaagggcaacccaagaaccgcgccgaaaccgcagcaacaccatgctgctgcagcacagccactgcccgctctgcttcttcgaagaaagaaggggcaggaaggagttgccgtgaaacctgaaactatggacacgttcgacgtgggcagcttcttcgacatgaccttccccacctttccagccgtgctgncgccggccctggagagctccttcgccggcagcaagggccacgtggagacctggagcccccgcgaagaagccgagataccaaagagggtgacttgttccgagggccacgggcggtgccttcccgcttggaacttgcttaacaaactgnccgttcaatccgttattgctggttgcaaatgcccttatttggggggggaccatttccttgaaggccctttttccccaaagggcgcggctncaggacgggacacacgacttgaaaggggtttagcccct

SEQ ID NO: 14053 - DNA, 1009 bp, Saccharum officinarum
  Predicted polypeptide sequence is orthologous to G4
cgcggccccaccacagcccagcgagcgcctgccagcagcagccagccatgtgcggcggcgccatcctgtcggacatcatcccgccgccgcggcgggtcacggcgggccacctctggccggagagcaagaagccgaggagggccgccggagccggcaggaggagggcccccgtggaggaggaggaggacttcgaggccgacttcgaggtgttcgaggtggagtccggcgagtcggagctcgagtccgaggatgaggccaagcccttcgctgcgcccaggagcggggtcgctagagatggattaaacactagtccagctggtgttgatggccccgctgcaaattcagttaaaaggaagaggaagaaccagtttaggggtatccgccggcgcccatggggtaaatgggctgctgagatcagagatcctcgcaaaggcgttcgtgtctggcttggtactttcaactctcctgaagaagctgctagagcttatgatgctgaggcacgcaggatccgtggcaagaaggctaaagtcaacttcccagatgagttttcaacgaattctcagaagcaccgtgctgggcctacctttctgaaagtgcctgagatggacgttgaagagaagccgattatcaagatggccaacctcaatgcatatcactaccctgttgtcgggcacaacattgctggagccattatgcatacctaaaacatgttaatttgctcctttgggggaattctgccgccccccgtcaggaaccttttggaacccttttttcgaccaaggttgcaactccttcaatggtcaaacctcaacttgagaaagacaccagaccccctgtcaatacatcggtagttgtgggggaatttgtattccccaaaacccaaaaatgtttggttgccccttggatgggttagcctcggtgatcccaagaatgtggcccctattaatttcctgtgacagcgcttaaaggatcctttaaccctttcttgtgaaggtctccatcgctgtta

SEQ ID NO: 14054 - DNA, 1270 bp, Saccharum officinarum
  misc_feature (1172)..(1172): n is a, c, g, or t
  misc_feature (1181)..(1182): n is a, c, g, or t
  misc_feature (1203)..(1203): n is a, c, g, or t
  misc_feature (1225)..(1225): n is a, c, g, or t
  misc_feature (1241)..(1241): n is a, c, g, or t
  Predicted polypeptide sequence is orthologous to G4
ttactgctcgctccggcgcgctgcggcggagctaccgacgacgactgagccatgtgcggcggtgcgatcctcgacgacctccgcgagccggagctgcgccgggtcacggaccgggacatctggcagaagaagaagcccaataggggcggcggcggcgggaggcgctcgttcgcggcggacgatgaggacttcgaggccgactttgagcacttcgaggctgactccggcgattcggattttgagctcggggaaggggctgacgacgacgtcgtcgagatcaagcccttcgccgccaaggggactttctccagaggtggcttaagcaccatgactactgctgattatgatgcccctgtagcaaggtcagccaaaaggaagagaaagaatcaatacaggggtatccgccagcgcccttggggcaagtgggctgctgagatcagagatcctcagaagggtgttcgtgtttggcttggtactttcaatagtcctgaggaagctgcaagagcttatgatgctgaagcacgcaggattcgtggcaagaaggccaaggttaactttcctgatgcaccagcagttggtcagaaacgccggtctggctcagcttctgctaaggcacccaagtcagtgttgaacagaagcctgccgtaaagcagctatgaccggcgacacaaatgcttccttctacccatctggtaactaccccttcaacaattccattgtcagcatgccattatgccttcattcccacaatgaacttttacggcttcgggtgaggatccataatgaatctggcctttgaacaaggaagtaactcctttgggttggtagaacatgccctggaagaatgggtccaaaaaaccaaacttacatcccttgggtccatttcaattattggtgaaggggagagtctgctttggcaacagcaattcaacaggctaatggtgccttctggtctggaaaacaggctgtgattaactggggggctgacaatagatccctaataggggtcttcggaggggggcagggatcaagcaaacctttgaacttggggaacaaggagtgggaaacatgacattgggatttaggaatgccctcccggaatttttttgaattagaccgccctaaagaacctgggccggggaaagccttgtatgggcgccgcggttccctgngatatatcnntgtaagaacaaagtgtttcgnggtgttgtcctgattgttgttnttgggacgtataggangcattttctttagtggattgtgtcgtagt

SEQ ID NO: 14055 - DNA, 912 bp, Saccharum officinarum
  misc_feature (686)..(686): n is a, c, g, or t
  misc_feature (746)..(746): n is a, c, g, or t
  Predicted polypeptide sequence is orthologous to G5, G974
atacaaccaacatataatagtagcactaacaatagcagttcatcaaattacaagtccttgacacagctaggctgattttacaacatacggagtactactacttaattaatatcacatcacaccgtgctgttcttacaacctgtagagcagcaccatcttctagcaagaaacagctaccagaacaatggacacctgaacggccggggtcactgaccagtgaccgaccgaccgaccgaccaccggagacgccggacacaaaaacgccggcttcccatcggttcggttgtggttctctcctccgggaaccaaaccctaaataacataagagatctacaactgactgaccggtgacagcaacaaaaacgaattaaacatctacacaaaaccaacgaacgggattagcactaataatccactagtgcccgcgcaggatgtctaaaatcccatctgcgcgacggccgttaaccttaaccatctgctgcagcctgcagtagtcgtcggaaggagccaagaagaacaacaatgtcggtcggtggttaattggcggcgaggagggagtcccagtcgatctcgtacgacgggtacttggtgagcgcgaagccggcggcctctgtccacggcgccctcgctgaagtccagctgctggatttccggcacccgcgacgacttcggggaagcggacggcnactgggactgtcgcgaagacatctttgcggactctaggcaggaccaggacccccttcttngaggaacgctaaggaagacaatttcttgttggggcgggcgaaccatttgtaatttgtggggggggcggagggggctttttggcccccttttgggaacccgtaagtttctggcaaaacctttgtgaattggcgtttcacggaagcctgggaaccccccccggtaagg

SEQ ID NO: 14056 - DNA, 705 bp, Saccharum officinarum
  Predicted polypeptide sequence is orthologous to G8
gtgcagggtgacgcctctgtacttggagctgcccctcgagaagccggtgctctgccgccgcaggacgtgcacgaactcctccttggataggctcttcatctgcttcatgtcgtcctcgtagtcgctgagattgaaatttatgtcggcgtcgacgccgcggaacttgatcgccgctcgatcgtacgcccttgcagcagcatgagcagtgtcgaatccacctaagtacacctgctttccgcaatcccagatgtgggactcccagcggccggtgcggcggtaaaaggtgacgccgcggtactgcgagctgcgggagcgctggccgcggcgagtcttcttgaccgggtgcagcttcacagggggcgggggcgccggcggcgtgccttgcgtgtggccgaagtcgtcgcggaagaagccgagctcgcccccatgcagcggaactggtgagagagggtagggaggggtcccgaaaaaggttctgaccccggtggataagaatgtagagagaggtggttggagtcgcgtgagggttgtctcccctctctccacccccccccccacgcggtggggtgagggtcggggggagggaggaaaaacaaaagagagccatgggtccccccccgcccccccctcgtatgtttcggatgtagaattcctgtaggggaggaggaagaaatagaaaaagtatttatgataagtgggagtgtt

SEQ ID NO: 14057 - DNA, 786 bp, Saccharum officinarum
  misc_feature (526)..(526): n is a, c, g, or t
  misc_feature (740)..(740): n is a, c, g, or t
  Predicted polypeptide sequence is orthologous to G20
ggggctgcaggccgtggctgtggcgcggggaggggagggcggctcgtcctcgtcgctcagcgccgttgcgcgggctgcggctgtgtcgtcgtccggggagctggtgcccaggagggcgttggcggtgcggaaggagcgcgtgtgcacggccaaggagcgcatcagccgcatgcctccctgtgccgcggggaagcggagctccatctaccgcggggtcactcggtacgcgccgcaccgtccctgcctcccctccgtgctactttgttgccgcctgctccagagcttaggccctcgccaatcttgtgcgcgcgcttccatcggatggctccttgtctgaatctcctttgctaagagcttcgcgcttccatcggatggctgcttggctgaacctcctttgccaagagcttgtcatgttgtttcggccattcgggatctacaatgtgcgcgcaattccaatgcactgtagctgtaggtcgaatggttgcggcacagagtttcttcctcccatgcaccgaagaggtttatntccccgtattcagttggctgttggtggaattggaaatgaggcgatctcccaggagcttccgttagttaagctctcttgagtctaacagcgttgacttcccatcttaccggcataggtggacaggtcgatattaggctccactttgggaacaaacccgtgggatccgaatccgaacaaaaggggaaacagtatatttagttcctatgataacaanaaggctgacaaaggcctattaactttgtggattaaataatggggaa

SEQ ID NO: 14058 - DNA, 777 bp, Saccharum officinarum
  Predicted polypeptide sequence is orthologous to G38
atatggagcagagggcagtactgtggtgcatggttccgtcagaacaatagcaggaagaagcgacctcgcaggtcacgcgatgggcctacgtcagtggcagctgtcatccagcggtgggctgagcacaacaagcagttggagcatgatcctgagggggcaaagcaaccaagaaaagcacctgcaatgggttcgaagaagggctgtatgaagggaaaaggagggcctgacaatacacaatgtgggtaccgtggagtgaggcagcgtacttgggggaagtgggttgctgaaataagagagccaaatcgtgtcaacagactctggctgggtaccttcccaacttcagaggatgcagctagggcctatgatgaggcagccagagcgatgtatggagacttggcgcgtactaacttccccagacagcatgcagtaacctatgcccaggctgctctagcatcgacctctgtccaggctgctccaacagctgttgaagctcttggtcctggcacatcatgtgagtcgacaacaacatcaaaccactcagatatcgcatccacctcacacaagcctgaagcctccgacagtttgagctccctaaaggcagaatggccagaagctttggaagctggatcaagcggtattcaagccggcacacccagtgtagctgacaaggtctttgtgacgctggaacctatcacaaatctttcggatggtggtgatgggtgtgtcacaaatcttccagattgtggtgacgatggttttgatgttgaagagatgctg

SEQ ID NO: 14059 - DNA, 679 bp, Saccharum officinarum
  Predicted polypeptide sequence is orthologous to G131, G135, G155
cggacgcgtgggcggacgcgtgggcggacgcgtgggcgaagatcgagacaatacagaaatgtcaaaagcacctcatgggagaggatcttgaaactttgaatctcaaagagcttcagcaactagagcagcagctggagagttcactgaaacatatcagaaccaggaagagccagcttatgctcgagtcaatttcacagctccaacggaaggagaagtcactgcaggaggagaacaaggttctgcagaaggagctcgcggagaagcagaaagccctgcggcagcaagtgcatcgggaccaaactcaacagcagaccaggtcgtcttccttcgtcttcatgataaaggaagctgccccaacaacaaatatcagcatctttcctgtggcagcaggtgggagagtggtggaagcggcagcagcgcagccgcaggctcgcgttggactgccaccatggatgcttagccacctgagcagctgaaggtttcttttcaccatcgcggtgtggtagcccaaaattcggcaactcgcttctccgcctggtgcaatatcgtcgtgatcgcgagaagcaacaatagtggtctaccggaatttttaaccacatatataagtcccaaatctggaaggaatgtaatatatgggcagcatccgatatttcattttcatgaccataacacgggccgt

SEQ ID NO: 14060 - DNA, 1031 bp, Saccharum officinarum
  misc_feature (752)..(752): n is a, c, g, or t
  Predicted polypeptide sequence is orthologous to G175, G877
cgcgtcgagcaacaagcaggcgagcagcggtggcgggaacagcaacaccaagctggaggacggctacaactggcgcaagtacgggcagaagcaggtgaaggggagcgagaacccgcgcagctactacaagtgcacgtaccacagctgctccatgaagaagaaggtggagcggtccctggccgacggccgcatcacgcagatcgtgtacaagggcgcacaaccaccccaagccgctgtccacgcgccgcaactcctccggcggcgtagccgcggcggaggagcagcaggccgccaacaacagcctctccgccgcggcggcgggctgcgggccggagcactccggcgccaccgccgagaactcgtccgtcaccttcggcgacgacgaggcggagaacgggtcgcaccggagcgatggcgacgagcccgacgccaagcgctggaagcaggaggatggtgagaacgagggcagctctggcggcgccggcggcaagccggtgcgcgagccccggctggtggtgcagacgctgagcgacatcgacatcctggacgacgggttccggtggcgcaagtacgggcagaagtggtgaaggggaacccgaacccgcggagctactacaagtgcaccacggtggggtgccccgtgcggaaagccgtggagcgcgcgtcccacgacacgcgcgccgtgatcaccacgtacgagggcaagcacaaacccgaactgcccgtgggcccggtgcctcaagccccccgcngcgggggccgtggggcccacgggcttcggttaaacttattggcccccgcggcgggcaattggcaattacagaaaaagccttacaccttgaaagcttaacggcgggaaaatcggtgggggttcccgggcaaggacaaacccggggacaaactttttttcaattgcttcttttgttgtaggggaatcgaattttgggttcacaatattgtcctggggggtatgtaccttttgtactgtacggggggttactttatcgggcttaaattacccttttgctttt

SEQ ID NO: 14061 - DNA, 551 bp, Saccharum officinarum
  Predicted polypeptide sequence is orthologous to G180
aagtgaaaaaataagtgtagctttatttgatataatgctacatgatgaccgcatacacctacggcggatggatcgtttgcacggtggcggatgatcacatcggattacatacatgagtagctagtacgctgcatgacgcgggttcgatcacgttctgtgtcatccatccggcaaaactgaagaagatcgagatccatcaacatatattgccctcggcctcgctgcttcaattcagaacttaactgcgtcgtcaatgtatgcggtcgtgggatagatagattcagaaggagctgaagcaatcggtgtggtcggcggaggaagcgtcgtcgttgcagagcccttccaccatgtgctattactctagttgcaacctagtttaatagccaccgaggtgcagacctcctcagcgccaatagcacttggcatgaaaccggacgtcgggttcccaccgcatgctgttgcggcggcggcgccggaacaattgctgtgagtgcaccggaaatagctccttggatggaggccgttcttgacaaccttctgcccgtactttc

SEQ ID NO: 14062 - DNA, 835 bp, Saccharum officinarum
  Predicted polypeptide sequence is orthologous to G214, G680
ccgcttcagagaaagacagagattgcccagttgaaaatgcacagaaggaatgccaagaagctctaaaacagggacagtttgaaggtttaagagttgccgcttcttcagtgtctgatgggagtggaaaaggcgaggtgtctctccacacagagttaaagatatctcctgtccagaatgctgatgccacacctaccacaggagctgatacaagtgatgcattcaggaataagaaaaagcaggatcgctcttcatgcggttctaacacaccttcaagtagtgatgtagatgcggacaatgttcctgagaaggaagacaatgctaatgagaaggtgaagcaagcctcctgcagcaacaactcttcagctggtgacactaaccaccgcagatttagaagcagtggaagcacaagtgattcatggaaggaagtttccgaagagggtcgtctggctttcgatgcgctgttcagtagagaaaagcttccgcaaagcttgtctcccccacaagcagaagactcaaaggaggttgccaaggaggaggaagatgaagtgaccacagtggcagttgacctcaacaagaacgccacaagcattgatcatgacctcgacacaatggatgagccaaggggcttccttccccaatgagctgtccgcactgaagcttgaatcgcgccgaacagggcttcagccatacaagagatgttctgtggaaccgaaggagataaggtgccggctaaccacgaggttggttacaaaaggattcgtcttgaaagcgaggcatccacataatccatctctacatggtcaccggtcgggctgcctctaccaatgaagttatg

SEQ ID NO: 14063 - DNA, 1112 bp, Saccharum officinarum
  Predicted polypeptide sequence is orthologous to G217
aacaaatgaacaccttattctttattgcgggaaattactcactgaaaacaacagatacctgacgctaatttacttcctataggacacaggtgcacatgcaatcgggaacgccagcagactggggctgaggcgccacataagatgaacacccaagcctaagtagactccatgggaacaatatggacaaacatggcgatggctgcgcacgagatgaccatcggctgcatgctgacagcacaagccctgcttaatgaccaaatgccatgtgcctgcacatatcttgggcctacaacctgcaatccggaaaccgacttgggcggcctgactcatgggccgtggaatagatgcaaaaccagatcgcagggcctgattgagcacaactagcctacgaagctgaagcttagtgctgtcctgcatctccacctcctcatttatgcgcagctcagcacgaaaaggagttcctctcggtgataaaccaaagcgtgggccacttcctagatggcgacataccaatccttggaggaataccaacaccagggcttgccaaaggagtcgccattggattcggagacgtgatctacttcttaacgcggggaaccaccagagaaaatactgaggggtgaagcttttgggttggacacttccaaacagaggcgttggggaatcttctaaagacgggcaagatgtttcggcctccaatataaatgcaataacccttcccaactgggaactcgtggcgaattccaaatggtttaattaccaaacccttggagtctggaaagagctgcgaaaccacaggtttgggggaagaatcttccttcacaagcctacgactaatacggaccacgcattgcccaacttgttggaacctgtgtcaccccggaattcgaaccggacatacggggaacgatttcctattgggtagataaactcgctaaactggatacttcaaccggtgaatatatcggcaccttaccaaataccgacgagattaggatgacggggctctaggcatctctctattattccaccagccctcataaaaaacacccaccctataacaatacaccaaagaacttaatttggctaactactataccaccagtaatatg

SEQ ID NO: 14064 - DNA, 679 bp, Saccharum officinarum
  misc_feature (516)..(516): n is a, c, g, or t
  Predicted polypeptide sequence is orthologous to G217
ggaaatgcaggacagcactaaacttgagcttcgtaggcaagctgaactgaaaaaaggcctgcgatctggttttgcttctattccacagccaaggaatgagtaccagatagtcatgccacctattacagaggatgagacagaagaagctgaagagaaaattgaagaggacatgtcagacagactggcacgagaaagggctgaggaacaggctaggcaggaggcattgctcagaaagagatccaaagtgttgcagaggagtctgcctaggccacctgctgcttcagtagaaattatccggcaatctcttattagaagtggagaaagcagaagcagaagcacctttgtgcctcctacatcacttgaacaagctgatgaactaataaatgaggagctccttaggcttcttgagcatgataatgcaaaatatcctcttgatgaaaaaactcaaaaagagaaaaagaaagggagcaagcgtcagcaaaatgggggagctcttgtccctgaaattgatgattntgatgaagatgaactaaaagaggctagttctatgattgaagaggagattcaatatcttcgagtggccatgggtcatgaaaatgaatcttttgaggactttgtgaaagccatgatgcatgccaagaggaccctatgttttttcctaccaacattacctatggtt

SEQ ID NO: 14065 - DNA, 747 bp, Saccharum officinarum
  misc_feature (581)..(581): n is a, c, g, or t
  Predicted polypeptide sequence is orthologous to G264
tttcggtgttctatctcttttttatgacagagaaggatcgctttacatatatacaagctatctggtctttccctacaatctcatagtggtagcttggcaggccattgcgttgtaccagcgctgtgattagttagaacagatacactgatagcctgcaggcaacataaccttgttgtttgcacaaacagtgtccacggtaacagggtcgggcagtcggccagaagaaaacaaactatggtatctctggataccataggaacatcttaatccaaatacttccatccgcatgctgaacagactgtattaacaaccgcagccgatatagtgtctcattgatcgaagggtcaagtacaaaacagtgatatacgagcatataatggtaaagatactcggagccattgtgataaagctagagccgctgatgtctgggtccatgttctttcagtcgaggcaggctaccttctgagattacatcttcatatcatcgtgaccaactgcattacctgcatctgcaccgagttccccctcatgcagaaggtcctcccagaaatcatcatttaactctgcacttggcctgccanttagacgctcagagccaccagaagaaacaccttgtggggactcgaaaccctttgcctcaacagatgaactttcgagatcagatggcacaccattggcaagttgatctatcggctccagcggtaaaaacactggctgtgacccttgctccaggcttaaaccagtgcc

SEQ ID NO: 14066 - DNA, 784 bp, Saccharum officinarum
  Predicted polypeptide sequence is orthologous to G274
ttacgtaagcctggatgctctagagcggacgccctttctttttatttgtgtgggctaagttgaatctgaaatttacagttggattcaggtaaaaggcctgagcacgtgtcgtgacattacgcaggtacggtctcggacctaaataattcgactgcacgaaaaaagctatcactgaattttacaacaatagcaggccgattgcgcccatcacccatgtatggttgctgcaaagtctcacttcttgggatcaatggatgcaggcacctaaataagccagcagagaattgaagtaccaatgattattcttttctcagcgctgtccaagcccttctgggaaagtgcagaggttgtggccatacagaatacctaaacctgctctagctggtctgatgggacaagtggctcatgctcgtcaccagcatttgacattctatccatgccacacaatccctggggactttataggcacaagagaggccttgtccagggcagtcaaaaccttgtttccttcaccgtttgctccctaaacaaaatggtatcacgcttcgtccatggcctaaaaaccgcaactgggaacattggttgactctctcaaaaagttccctaaccctccaaaggacaccaactgttaactaccatagtggacactattataataatgggttgcataacctcagatacgatacccaacatgtcgggtctatcgataacctccccgggctatgagttcaacattactctgtccctgggataccatccctcccgcgcaacgataaactccgct

SEQ ID NO: 14067 - DNA, 2616 bp, Saccharum officinarum
  Predicted polypeptide sequence is orthologous to G274
caggctagaagatcataaaatgaacaactttcaatctgtcaagtgaaagccacagtagcgaccatcgactgctactatcatgcctgaacaaccagaatctagttgcatgacaaatgaaccttcaatttcaattttcaagcacttcagtgttcagaggaaaactaaataaatacctattgctattagtgttactccaatatacggtaacactgtctgctcggtgccatcatattacaaactaaaacctagctcaacccctcgtggaacagggccaggaatctacgcaagaccagtgaatcttaccctgctacaaaaccgtttcctgcatcaactagaggtccaatcacccctcagaaccctccctcaacttctcatctgattgtagctacaaagaattagagaaaggtgaaaggaacatgtgaccaagcagtctcatactacgctgagatggcaaaaccctgatgccatcctcgccgactggtagaataagcctggttcaggctttcagtgagctgtgtcgcctgtgtgctaattctcctcctctgctttggcagtccagtacgtcttaactgccatgaggaccttctctgggttgaaggggccatcctcgtggtccatgatgcggctttcccaccgcatccgcttggttattgcctggactttcgtgagcacgtcaactgtgtcacggatgatagctgtgccctcgggccttaatatcctatccatctccaagaggatgtcggttatatcacacctgtcttggtagatgctaaacaaattgtcagcatgcaagaggtcataggttcttggatacgttgagaaagcttcacaccaatcctggtatgtgccaatgaaccctcgctcgtatattgccccaagggtgtcccggtcagagttaacagggacgacattcatcacccacacagggtactttactaaagaagcagcgaacccacccatgtttgcgttcatgtccatcacatttctgtatctattctctgctatgggtatggtgcgcttgtagtatgccaccctcttctcccacaacttcttgtcctcatcaaacttctttgcatccaatcctggaatcatgcccctttttatcctggggggaactaagaatgccctctctggccatttctccactgctcctcccgccacttctccctggttgcttacttcaggcaatggagtaacacaggcttccatctgtctgtaccaagcagcatcaggattgtcactcttgcagatatggggtgtcttatatgtcttcttaatgttggaacactcaaggtggttcttaggcttctgccagatggagagatccctcttctcaaccaccttgttccagcaaaggctcctcgcgacatcctcaatcttgtcttgctcttgcttgaggtcctcctttgtcctctcccaccccgcgtggtgcgtcttccagttgattggaggacccgagagaatccaatatcctcctggccttagaatcctatcgacttcagcaaggtatagtccatcatgtgcatgccaaggaatcagacagcgagagcaatgtgccatatcaaatgccctagatgggtaaggcaaccggtgcttccccatcacaccgatgatggcagggacacctctttccagtgcgaattgcacctgagcttcatgcgtgtctcttggcgcaaatgacatggcaatgatgttcctcttcagcaagtaagctcccaaactagcaaccccacaacctgtgtcaacagccgtcctgatctttccatccgataatgagattagcttatcgatatcatctatgtaagcatcagcaccacgcgggaacatagtgccaccaccagggaacttgaacttatcgccctcaacctggatccagttctgcactgctttctcaatgctgagctccttgtgggggatgttgttgaaataggcatagtccctgctatgaggccacttgaagggggtcctgtacccaggcggtgctgggatgaggcatcggacctgctcgtccttgccaggacaatggcgctcccggtacactagcatggcgcggtcgaaccggcgcccgcgcgtacggtcctcacacggcgtgtactcactgaagttgagagggcatgccgggaactgctgcagttccccatcgccgtccgtgttgttgatggtgagctggtggtgtgcgtcgaagtcaagcatctcgccggagcctggcccaaacgatggcacagagccagaggactgtgccgtggcgacagtgggatcgcagccaacccgggtgatcgccgagttgcctatgggctttggaagcgtggtgttctgccatgcaccgaggacgtagaaggcgatgcagagcgcgcttacaacgaggatgtatgtcaggcgctgcttcttggattcctgcagctgctgggctttgggagaagctgggtagtcctttgccatggctcctgcgaacaagaagccagctcaggaaggcagagcactggaggacgccaagacgacgaagaggaggcagagtacccccaagctccagagggggaaaaggccggaaggggcacaggagaggagcaccacgggtcctgcctatttatgcgagctctgcacttcagcaatggtgag

SEQ ID NO: 14068 - DNA, 2841 bp, Saccharum officinarum
  Predicted polypeptide sequence is orthologous to G275, G837
caaggacgcgcatcgccgtccccttcctcgctcctcttcgagatccgcgcggaggaccaccgcgaccgctccggtcggttccggcgaggtgccgcgcggctgtagcagcctagagcagacaaagctctgatttttgggggttcttagtccagccgtagttgttggagacaaaccgcgtgaaggtcggtgctccggtacatgttcgccaggcactgatggcatttggccgaggtgggaagatggacggccgccggccgtcgtcgtcgtcgtcgttctgcacgaccaccacggtcgtcgtctttgtggcgctctgcctggtcggcgcgtggatgatgacctcgtccactgtcttcccgctggagatctcatcgaataagaagccggtgatgaagcaacagcctgcgcctgtcaattttggggcgtcacaggagacaccatctggcaatgctggtgaaggttctgagaaatttgaggacaccgacaacaacgatgccacggtcccagaggagccgaataacaaggatgcccctgaggaagagaagttcactgagaaaccagaggagaagcctgaagagaaggagccggaagtgccgacagagaaagcagagaccaaggatatgtttgatgatgcaaatgggaaatcagaagggcggtcagatgacttgaagaatgatgatgatggggagaagagtggggagaagaaagatgatgaaatcacaaatgagagtggtgatgaaaaacctgatggtgagagcaaggacgatcaagaagagaagcctgaaggtgatgtcactcaggaggagcaacctcaaatagaagagaaggtggaagaaaatggagagaaggatcagagctctaactccaacgaggtgtttcctgatggggcccaatcagagcttctgaaggagtcaaatacccagaatggttcattccccacacaggctgcagaatcaaagaatgaaaagaaagtccaagcgtcatccaagtcttcaggtgatgcgaccagctatacctggaaattatgtaatagcagtgcctcgacagattacataccttgccttgacaacgagaaggctatcaagaagcttcgaactaccaaacattatgaacatcgtgagaggcattgccctgaggagcctcctacctgccttgttccactcccagaaggatataaacgcccaattgagtggccaaagagcagggacaaggtatggtacagcaatgttcctcacactaggctcgcagagtacaaggggcatcaaaattgggttaaagtctcaggtgactacctcctgttccctgggggtgggactcagttcaagaatggtgccctccactatattgatactattcagcaggcactgcctgatattgcatggggcaaacgaagccgtgtcattctagatgtcggttgtggagttgccagctttggagggtacatgtttgatagagatgtgcttaccatgtcttttgctccgaaagatgagcatgaagctcaagtacagtttgcattagaaaggggaattccagcaatatcagctgtgatgggcaccaagagacttccataccccagcagagtctttgatgtcattcattgtgctcgctgcagggtcccttggcacattgaaggtggcatgcttttgctggaattgaaccgattgctacgacctggtggttactttgtctggtctgccactcctgtttaccaaaagctcccagaggatgttgagatttggaatgcgatgtccactttgacaaaatccatgtgctggaagatggtcaacaagactaaggataagttaaatcaagttggtatggtcatatttcagaagccaatggacaacgtttgctacgagaaaagatccaaaaacaacccaccattgtgcaaggaatctgatgatgcagacgctgcttggaatgtacctttggaagcatgcatgcacaaactgcctgttggctcgaaagttcgaggatcaaaatggccagagttttggccgcaaaggcttgagaagacccctttctggattgatgcttccaaggttggtgtctatggaaagcctgcaaatgaagattttgaggcagataatgctcactggaaacgggttgtaagtaaatcgtatgtgaatggcatgggaattgactggtccaaagtgagaaatgtcatggacatgagagctgtgtatggcggttttgctgcagctctgagggaccaaaaggtctgggtcatgaatattgtgccgattgattcaccagacacactgcccatcatttacgagcgtggcttgtttggtatgtaccatgactggtgcgagtctttcagcacttacccaagaacgtatgaccttctgcacgcggaccatctattctcaaagctcaaaaagagatgcaaattgacggcagtttttgccgaggttgatcgtgtattgaggccacaaggcaaactgattgtgagggacactgcagacacaataaatgaactggaaagcatggccaagtccctgcagtgggaggtgcgaatgacctacaccaagggcaacgagggcttgctctgcgtcgagaagtcgatgtggcggcccaaggaacttgatgcaagcacgtgaaatatatgtgttgaagaaaactggtaccaagtagggtaaaattagaggaattttgtcgctagatatgcatatgattcttgttgatgctgaaaggacaaactctttggcgtaactgtagaataatacagatctgtttttccccatttgttgtttcattcacaacgcagctgtaagatagtgtgctggaaatcacaggtacattcagttcaatcgggcccctttttcagtttgtcggatagcc

SEQ ID NO: 14069 - DNA, 410 bp, Saccharum officinarum
  Predicted polypeptide sequence is orthologous to G280
cacgaggctgcccccgcacgcacggcagcggcgacccatcgtcgatgtggccgtggaacatctgacgcggttcacggagaccgtcgtgatcaccgcgttcgcgcatgacgtttgcattttcttcaaggttgtcgagatgatacagaagtaagatggcatgcaaggacggaagcgcgcgcgcgcgcgtgcgccgggcagcgggcactgtagtttcagatattacattcagccgtgcccgagaaatgaagttgactatagctaggtcgattactaggttatattatattatatgttttcacaaattaaattgcatgatggccgcagctcagagtttcagttgattcatttcatccctttgtgtgtgtaatattgtacataattttgattaaataaacattgtacagaattta

SEQ ID NO: 14070 - DNA, 829 bp, Saccharum officinarum
  Predicted polypeptide sequence is orthologous to G326, G1337
aggtatgcatgtacgggcccggaattcactgggtcgatccacgcgtccgtgccatttatattcgtcggcgtaggctggtccggccccagcgattcgatttcgtgcgcctcgtggtccacgtgcgcgcgggctttgtgctccctctctctcgccccctctctgtgagttcgtcgggtaggttggtggcggcgtgtgacatcatcaactggctcgtatgaggcttctgcagccacaagcgggtgcacaactcctgggaggaggtggtcgcggcactccactggcgcgcggacgccgcgcggctctgcgtcacgtgcgaccgccacgtgggcggcagccacgtgctgtcgccgaagcacgtgcatgcgccgctctgcgctgggtgtgcctaactccctgtcatagaccgcgcagcaaatgggagcgtctccccaattgcgggcgccgaaccggggttccttctaaccgaataatgatagggtcgcgaatccccggaaggagtccaaaattaagggattgatccgaatgcctactgagagagcgaagcacgcctatctaaatgtgcgggaagtgggcatcaaaacgcccctgggagattagaaaccccaggggcaggggacgatgaacatagaaagaaagaaagagttgggacaagaaaaaaggtggtttcgtgttcccaggatccaaccagaaagacccctattatgtcctgggggggggtacatggcaacggaggagggagcggagaaaattgagatgggggggtggcgggaaaagtaaagtgcgaggggtgggaaagatccgcgctcgatgggggggggggcggattttg

SEQ ID NO: 14071 - DNA, 723 bp, Saccharum officinarum
  Predicted polypeptide sequence is orthologous to G326, G1337
tcagtagtagcaacaaaaatacgaccggatagccacataaacaaaacacttggctgtaaactcactctccggcgcttttccggtctcgtatgaccacatgcatgggggataatctatactggatgtaagctacactatttctcgttctgatgatggcaacagcaaaagggagaggggggtaagttgtttcatgctttcctatactttctcaggactaaggtgacagttctccaccatctttttatctgataacctataaacactaacaattgcttagcccttatcataaaatctattccataccaacttcattgttgctggacgtaacgcaagcacacatctgacttggtcttcacagctcacaggccatattgtttatccgccataaccggcgttccagcgcttaggtcaacttgactaaccgcccttttactctcttccttgtgaacaaactcagcttcctctactcttaccggatgtgcttcttatacctgcggttctctttctttttcttaccagattactgttcctatctctaaaccggttgagcgggggcatatccatgctcttggatcgctgtataaatgggtgagttgaaatttttaaatttcaataagcggatccctctaaatggttctgatcggtttgtttggaactggtttaatagaatttgaaagctcctataatattggaattaaatgcattctatacaatttaaacgct

SEQ ID NO: 14072 - DNA, 724 bp, Saccharum officinarum
  Predicted polypeptide sequence is orthologous to G347
gaagtgacgccgcgtccctccccgccttccttcctcccgcgtcgagctcttcccggggccaccggaggcgcaggcgttggttgggacagcctcgcccgtcccacgccggtatgcagagccagatcgtgtgccatgcttgccggaccgttctgcactacccgcgaggcgcgtccagcgtctgctgcgcggtttgccaggccatcaccaccgtgccgccaccaggactggagatggctcagcttatatgtggtggttgtcgaactttgctgatgtatactcgcagtgcagacactgtaaggtgttcatgttgcaatacagtcaatcttgttagaccagtgaataatatagctcatgtgaactgcggccagtgccggacaactttgatgtatccatatggcgcaccttcagtaaaatgtgccatatgctattatgtcacgactactggagtaaatactgtggcacccactccatctgcgaggccaacatcaaatgagtcttcatatagtggctcatctacttctgctcctaaatctcaaccacagaatgtaactgttgttgttgagaaccctatgacagttgatgataagggaaaacttgtcagcagcgttgtagttggagtcacagctgggaaagtgtgaccgacatccacgaagtatttttaggaactttgtaatgaaaccatggctgggaatgattctttttgggggataaaatggggcctttt

SEQ ID NO: 14073 - DNA, 856 bp, Saccharum officinarum
  misc_feature (506)..(506): n is a, c, g, or t
  misc_feature (518)..(518): n is a, c, g, or t
  misc_feature (648)..(648): n is a, c, g, or t
  Predicted polypeptide sequence is orthologous to G347
cctgccgcacccgcgagacccgtcctcgaggggcacgtcctagatcggtggcgcctgcctctcgccgccgctaccggtgcctctcgcggtctcgctccccccgctcgcagcgtccttttgtttttttttatagttcctcccgttggttcttggaggggtttgttgccgtctcctccccccgcggttcttgaggcatgcagagccagatcgtgtgccacgggtgcaggactgttctgctctacccaagaggtgctccgagcgtgtgttgcgcagtatgccatgcggtcaccaatgtgccacctccagcaatggagatggctcgacttatatgtggtggctgccaaacattattgatgtatactcgcagtgcaacaactgtaagatgctcatgttgtgacacagtcaatcttgtcagaccagtgagtagcatagctcatgtgaactgtggccagtgccaaacagtgttgatgtatccatatggagcaccgtctgtcaaatgtgctatntgcaacttcatntacaatgttggtggggtgactcccgtgagaactttgccacctgcacttaccgcattcagtggaaattcatatagcattcccgtcacttctgtgccaacgaaccaatcgcagaatgttactgttgttgttngaaaccaatgacagtagatgacaagggaaaattggtgagcaacgttgtaataaggggttacagtgggtggtaaaaagttacatatcacaaactgtgttaacttggttattatgttttaaatattcttgaaaaggttaagaaatacctggtttgatactgcttgttgggcgatcggctgctcgaacaaaggattcctttcttgaagaac

SEQ ID NO: 14074 - DNA, 543 bp, Saccharum officinarum
  Predicted polypeptide sequence is orthologous to G351, G545
aactagtcgggctcgtttgtcgttttgtttatttcggagtgtttctgcggtttttttttttttcctattatttattgttttaaaataaaaaatataatatgtgccgacaaaattcaaatacaagtttattattttcaccaagcaaccaaaatccatttaaaagaacgaaggtgcgaaaaactctacaagcctcatcaaaaggaactctaaattgataaaaaaaaggaactctaaatcgttaaactaaggtccaaggacggaccggcaatccgtctcttcttgaccggaaaggggctctgaacctcttcctcctctccccaccttgtcgcatctttggcggccatcgccggcggcaccggcaccaatttcagatcaaaccccttgacggtcgacccggaccccgatggccccgactacgcggtgagcgacaccgaaagcccgtcccagtaatggcacctcttgtgcccgccgagcgcttgccccgtcgcaaagctccgatggcacaccgtgcatctgtgcctcccctgcccactgatgcctacg

SEQ ID NO: 14075 - DNA, 762 bp, Saccharum officinarum
  misc_feature (500)..(500): n is a, c, g, or t
  misc_feature (696)..(696): n is a, c, g, or t
  misc_feature (702)..(702): n is a, c, g, or t
  Predicted polypeptide sequence is orthologous to G386, G707
agagcatcaaatttctaattcctacatatatattgcagaataaattttaattgatgtaggtaaataagcatttccatgtaaaccactacaccggccactttatcgatcagacattattggctgataaatgcctagctacacttatgcatgctaccatgacctatggacgacaccactacaacacaacatttctgaactctcaagtttacatgacatatagcttacctcacaacagagaatggacagtactatattataataactaaacaacgagccggccaaaaactcaacgtttgattccctgatgaaacgacgggactgaaacataagattagccatctactaaccattattgtccactatgcaaaggtcctgtatcaaacagctaggttgccagggagaacaagcagacgatagagaccgagtcaatacccgaaccaccaccattgctctgtgctaaggacctgtccgagctggatccttatcacctagcaaaggtntctttgcagcacgaggttcgttcttgactcaggctcgtcgtcggcgaacatcccctgcggcgacgtcaacattcaggcgtcgcactgcagcgctgtcttgatcttcttgatggtgcaggatatgaggttgttcacggtttcaactgattccacggtgagctgggcggtcggctggctgttgacgagtttcttgaanggcacngtgagtagcgagcccgctgtcttatgctcggcgccgaaactgtttgggccgtccggcaag

SEQ ID NO: 14076 - DNA, 1019 bp, Saccharum officinarum
  misc_feature (701)..(701): n is a, c, g, or t
  Predicted polypeptide sequence is orthologous to G390, G391, G438
ccccttgctcacacggtggagaatgaggagatcttagaagttgttcggcttgaaggacagactcttacacatgacgagggccttttatccagagatatccatctgcttcagctttgcactggaatagacgagaaatcaatgggatcctgcttccagcttgtctttgcaccaatcaatgagcttttccctgatgatgctccattgatttcttcaggcttccgtgttatcccgttggacataaaaacagatggactatcctctggaagaacgttagatttggcctctagccttgaagttggtgcaaccacacaacaagcatcagcggatggatctcaggatgtttgcaacctgcgatctgtgctgacaatcgcctttcaatttccctatgaaatacatctccaagataccgttgcagctatggcccgtcaatatgttcgaagcattgtctctgctgttcaaagagtctcaatggctatttctccctcccagtctggcttgaatactgggcagaagataatttctggcttccctgaagctgcaacacttgttcgctggatttgccaaagctaccggtatcacttgggggtggatttggtcagccactcggatcaagctggggaatcactattgagaatgttctgggatcaccaggatgcagtcttgggctgctttttaaggaaaagcctgtggttacttttggncaccagatgggaattgacttgtaaaaaccactcttattgctctaacagaacttcccctgaacaaaatcttttgacaacctggtagaaaagcctttcaccgcggtgtttcccaaacttgttgaacagggctatgcgtacttttcgggttgggtggtgcttgtctgggaggggcccccatgtcttctaccaacaagctgttgcctggaaagttctcggtgaggaccggaaccgtcacttgcttgccttttggttcgacactggcccttgtttggagcaacctaggccccctgggcaaactttccgaacgcattctttttt

SEQ ID NO: 14077 - DNA, 942 bp, Saccharum officinarum
  misc_feature (4)..(6): n is a, c, g, or t
  misc_feature (31)..(65): n is a, c, g, or t
  misc_feature (650)..(650): n is a, c, g, or t
  Predicted polypeptide sequence is orthologous to G390, G391, G438
tccnnntttttaaactcctccccggaggccnnnnnnnnnnnnnnnnnnnnnnnnnnnnnnnnnnncgcctttcaattcccttacgagatgcaccttcaggacagtgttgcaactatggctcgtcaatatgttcgtagtgttgtttctgctgtgcaaagagtgtcgatggctatatctccctcccaatctggtctaaatgctcagaggacactttctggcttccctgaagctgccacacttgctagatgggtttgccagagttatcactaccatctaggcgtggaattacttaatcaatcagatgaagctggcgaagcattgttgaaaatgctctggcatcatccagacgctgttctgtgctgctcttttaaggagaaacctatgtttacgtttgcaaacaaggcagggcttgacatgttagaaacatctcttattgccctgcaagacctgacactagacaagattttcgacgagtcaggaaggaaagcaatattctcagatatctcaaaactaatggaacagggctacgcatacctgccgtcaggtgtgtgcatgtcaggaatgggtcgccatgtttctttcgaccaagctgtggcgtggaaggtgctcggtgaggacagcaacgtgcactgcctggctttctgcttcgncaactggtccttcgtgtaacgcccacccatccgatggggtggcgagcctgtcggtctgtgtgatgagccagcccaattttgtatgatgatcctgataaggaaatcattgacccgggcaaaatgcttatggtgcatgcactattttgaggccctgaaatcccgggttttattaaaaaaactggagaattttcccaggttttttcccacttttcgttggcccccccacccacagggtgtttgtacaatttctttggcgaggggcaccccactcctgcagtttttttttccatac

SEQ ID NO: 14078 - DNA, 1043 bp, Saccharum officinarum
  Predicted polypeptide sequence is orthologous to G390, G391, G438
cggacgcgtgggtttttttttttcatcatcaaaacatcacatgatccatccgtgtacaatactgctattcaggtccttctaccatttcacatttttcttcaaaaccgaaaccattttacatcccagtaattaaacggcgattcgaacctaaaacatgtcaccgatcaaccgatttcccatgagcgcgacgaccaggcagatgcattattacacaaacgaccagttgacgaacatgaagcagatgcactgcgcgccgctgtcgtcgtcgagcaccttccacgccagcgccttctcgtacgacaccggccggcccagacccgacacgcacagtccgccggggatgcacgtgaacccctgctccatgatgctggggagctccacgcacaggttcttcctcccttggtcatcgaacactttctccagggtgatatcctggagcgccaccagggtcgtctccagcatgtccaggccggactggttcgcgaacgtgaacactggcaaggccttcaaagagcagcagagtatagcactagcatgatgccaaagggcttttagccctgcttcacagccgctaccgtctgcggatttgataagctcagccccaaaatgaaatctgtaactctggcagatccatctggcaagcgtggttgcctccggactagtaggagtgggactgatgctgctggcctgaggaacgaggcccgaggaggagaacccccaccgcggatctctgaactgatgcgatgaatcttcgcatggactgccttgccatggttggaacatggcctggagagggttcttaagggaaacgaaaaccgaatcgtttaccacctttgaaccagacaagcagcatttcacggaaccgtccgttattctggtttgggagtccaattaaggtggagggaggccaacggcctttgggctaaaattacaaggagcgaatgggtgatcggaacccatgaagccgggggatttttatgactttatgggcaaaaactgaaaagggacctgttgctccttggaattcaaaaaaatacgggggg

SEQ ID NO: 14079 - DNA, 1141 bp, Saccharum officinarum
  misc_feature (712)..(712): n is a, c, g, or t
  misc_feature (993)..(993): n is a, c, g, or t
  Predicted polypeptide sequence is orthologous to G390, G391, G438
aatgccctatggagggggccgccagccagcggtgttgttaacattcagccagaggcttagcaggggtttcaatgatgctgtcaatgggtttccagatgacggctggtcactgatgagcagtgacgtgctgaggatgttactattgctatcaactcctctccaaacaaacttattggttctcatgtcaactcctcccagctgtttactgcgattggaggtggcatcctgtgtgctaaggcatcaatgctgcttcagaatgtgccacctgccctactagtacgatttctgagggagcatcgctccgaatgggctgatcctggtgttgatgcttattctgctgctgctctgagggctagtccatatgcagttcctggcttgcgcgctagtgggtttatgggcagccaggttattctaccgcttgcgcataccttagagcgtgaagagttcttggaggttattatggcttgagggacacagactctgccatgatgaagttgttctgtcacgagatatgtatcttctgcagttgtgcagtggcgtggatgaaaatgcaactggtgcatgtgcacagcttgtctttgcacccatcgatgaatcttttgttgatgatgcaccactgctacccttaggctttcgtggtcattccactggacgcaaaagacggatccaccattcatgcacacgcacacttgacctaacatctactcttganggtggatctgtgggactaactctgcttaaggggatgctcccagaccttgaacacagaataagggtgaccattggtttccagtctaatatgaaaatacctacggaaaacttcaaacatggccagccattttccaggatgggtggctcgagccaagggtggctaggaattactccttccttttggggcaacttgaatgaaacaactcggtattctgggcacacactttgagggggtcgtagagcttcgtgttaaattgagggactctttacaaacccaagcanttgttttttaaacaggggaccttaaccaacttgctgtcctgagggtgctggttccttccacaaccggcccagggggaaatttttttccaattcctgaaaacttgaagggaaggcgctccttcccaattaagggctcccccccggggtg

SEQ ID NO: 14080 - DNA, 711 bp, Saccharum officinarum
  misc_feature (487)..(487): n is a, c, g, or t
  misc_feature (507)..(507): n is a, c, g, or t
  Predicted polypeptide sequence is orthologous to G409
cgcgcccagggtggcgaacagcagagaggaggaggacgacgaagcgccgtctgacggcggagcaggtgcagctgctggagcggagcttcgaggaagagaacaagctggagcccgagcgcaagaccgagctggctcgccgcctcgggatggcgccccgccaggtggccgtctggttccagaaccgccgcgcgcgctggaagaccaagcagctcgagaccgactatgaccacctcaaggctgcctacgacgcgctcgccgccgaccaccagggcctcctggccgacaacgatagcctccgggcacaggtggtctccctaacagagaagctgcaaggcaaggagacatccccgtcggccaccactgctgcccaagaggtcgaccagccagacgaacacaccgcggcgtcaggcactgagaaactgctggcgcagcagctcaaggacgacctccacagcagcggcgactgcactggccatggtgccctctnctcagaggaagaagatggtngtgtggtcaatgacaagggcagctttgatctcccgatgccatgtttgctgccggggtcacccaccatggcgccgacgccgaggaggcacagctggccaactggacatcctggttctggaactgatcgatggatggatgtgcaaagagcaaatcctctcctggtttccaccctgttctgcaccatataattactgtggtgaatat

SEQ ID NO: 14081 - DNA, 716 bp, Saccharum officinarum
  misc_feature (661)..(661): n is a, c, g, or t
  misc_feature (679)..(679): n is a, c, g, or t
  misc_feature (689)..(689): n is a, c, g, or t
  Predicted polypeptide sequence is orthologous to G419
aaaattctgaggtgagcagcccctttggattacctattctgttggtgagtagtacttgctcgctcagacattgaagttggtatgatttcctgttctttttttcctgcgattggagttggtatggtttcctattcttttggtgagtactactcgctagctcagagatatttactattttctcataactcttgcatactgaaatcgatttattttttgcagattgatctgttctatgaaggagcttgtgtcctggaatataattgtcgtttcttgcttcttcgcaacgaattgctgctgcagaattttatgcatagtgattggggactactgaacgagttgaaattccctctagtgaattttacgcgtagtgattggggactgcttgcgtccagaatttatgaattgcagctcacaatcgatgcttgcttcctttccgtagtatcacattagtctatacataattctataactgctgcctttgtaggcgctcgatgatattgcctgctagtgttcgatgaactgatctgctcacattgtcttcctttttctgcactcatgttggagaacagttttgaatgataagcaagcaaattttctatgcagttttaatttaaactttttatgcttttctctcatacgatgtgtaatgaatttgtaaaanaaattcttcttctgattnttggctgcangagatgcggcatcacagtctttggtgt

SEQ ID NO: 14082 - DNA, 582 bp, Saccharum officinarum
  misc_feature (580)..(580): n is a, c, g, or t
  Predicted polypeptide sequence is orthologous to G428, G1594
gaagagcagaagtaattttatctttataagcccttcagcctatctaaaaattaaattgggtagcgagtattacaaatccatgagccaatacgtgaaactactaattaaatgcttttgcaggtctcctcaattcgcccatacatacagtttgttttgatacgatggcaccatatacacatgtgatcttgtaaaataatggggcaactgactaatgtgatcaacctcagctcgacagatttattgtcaattttgaccgggcagatcgtcacttcacatgccaggtcttactactgattgagttggccaattgtcatcccaagtggtgtgtgattcagggtccaattgtgcctgtatcgaagtagagtgtcgtcccagaagatccaccggcaacaccctccatgagcgcgaaccgcatgtcctccgatggcttccaatgcctcttcctctgattgatgaaccaattgttgatctgctttgggtcgagaccggtcatcgctgcaagcctcaccttatcttcctccgtaggataaggccagcggtagtgcgtgttccaccactctagtaatacttgccgtgcatnct

SEQ ID NO: 14083 - DNA, 1078 bp, Saccharum officinarum
  Predicted polypeptide sequence is orthologous to G447
ccaacagcagatggttagtcctgatgctcaaaatattcagtccgtgctcagcccaagtgctattcagcagcgggtccaccaactccagcagatgcagcacgctcataatgaccagaagcagaagattcaaccagatcaaccgtatcaagttcctagcagtgcagttctcccgagtccaacgtcattaccaagccatttgcgtgaaaaatttggcttttctgatcctaatgtgaactcttccagcttcatcagctctagcagcaacgaaaacatgctggaatcaaacttccttcagggaagttcaaaatctgtggatttgtctagattcaaccaaccagcagttagcgagcagcagcaacaacaacaggcatggaagcagaagtttatgggcacacaatcgatgtcttttgggggctcagttttcgcttaactcacccaataacgaagatggttctgctgacaacaaaattggttaggatgggccagaaacagtcccttttttaaaccctaaaggagggactacttcctgccctgactggggacaaagataggggtccgctttatgcttgaacgctaaagaaatacgccttgcgggggaataagctaaatgtttaattggtgaccgggatatccgccatacgggggtgtatcctaaaccagttaatgtgtgaaatcgttgattgcccaatggggttatagggtattaggtgtatatgcgatgaaacattacctcctgggggttcaaggtggttcctgatgtgtctatggtagtaaagattagtctcatggtctactgaaaaacttatggcatataggaacttgaggggtaactggaaggatttcggtagtcgaactaaacggtatctctcgcgtaatggtaatcatcggccaaggatattgaaggagttgggaactgtaatgcgatatgattagcatatggtacagctaatggtaacagtacattagtaatgtgtagaggaaacagtgtttaccttataaggctaattgctaaaggtcataagggtttatgggattttagacatagccgctatggtaagtaatacttgtctattgtaga

SEQ ID NO: 14084 - DNA, 830 bp, Saccharum officinarum
  misc_feature (488)..(488): n is a, c, g, or t
  misc_feature (526)..(527): n is a, c, g, or t
  misc_feature (555)..(555): n is a, c, g, or t
  Predicted polypeptide sequence is orthologous to G447
ggctttcctatggaaacagaaggcttgttggtaagtgcacttaatcctgtgaagtgtcagcctaatctgtcaactgatattgagaacaattaccgaatacaaaaggatccccaacaagagatctcaacctccatggtttcacagtcattcggtcagtctgatatagcttttaactcaattgattctgtaatcaacgatggtgccatgttgaacagaaattcttggccacctccacctccaccacagagaatgcggacattcacaaaggtctacaagcgtggagctgtaggccggtccattgacataagtaggttctctggatatgaagaattgaagcatgctttggcccgcatgtttggtatagagggccaacttgaggaccgacagagaataggctggaaattagtctacaaggaccatgaggatgacatcctacttctcggtgatgacccatgggaggaagttgtgaattgtgtgaagtgcattangatcctatccccacaagaagtgcaacagatgagcttannatggtgattggggaacaatgtcctcttncaaccagcttgcagcagctcagatggtgggaatgccttgaagcctcgctgtgaccagaacccttgtaacccttcaatcggcttctacgaccaatttgaatgacctgatcacagaatgggagatgagaactatggttcaaaaaaacagtgtccagccatctacagaaatatcggccagcacatcgagaagcttgaaacgtctagcttttataagctgggagaacacttcctaaattaggggttgttttaaaaatatgggaaatttcttggttgaac

SEQ ID NO: 14085 - DNA, 719 bp, Saccharum officinarum
  Predicted polypeptide sequence is orthologous to G447
cagaaacataccaagtgaaacaaactagcaacgtcctcccaacaatggctaccaagatatttgccctccttgcgctccttgctctttcagtgagcgctacaactgcggtcattattccacagtgctcacttgctcctaatgctattaatccacaattcctcccaccaattactcctatggggttcgaacaatcagctgtgcaggcctataggctacagcaggcgcttgcagcgagcatcttacaacaaccaattgcccaattgcaacagcaatccttagcccatctaaccatacagaccatcacagcgcagcagcagcaacagttcctgccagcactcgatcaactagccgtggcgaaccttgccgcctactggcaacaacagctgcttgcatccaacccactggctccggcgaacaccgctgcataccagcaacaacaacaacaactgcaacaggtcctgtcagtggtcagtcaactagccgtggcaaaccctgccgcctacctgcaacaacaacaactgcttgcatccaacccactggctgcggccaatgccgctgcatacctggaacaacagcagctgcaacaaatcctaccaacgctcagtcaaccagccctggtgaaccctgccgcctacttgcaacagcaacaacttattccattcaccaactggctacggcgaacaccgctgcatacctgcaacaacatcagcagctttcat

SEQ ID NO: 14086 - DNA, 842 bp, Saccharum officinarum
  misc_feature (104)..(142): n is a, c, g, or t
  Predicted polypeptide sequence is orthologous to G450, G456
tacattactgctcattcccacccctttacgcctccactctgtgaggaggtgcacactctcgaacatcatattcatactcgaagtttgtatgccgatcctttgcnnnnnnnnnnnnnnnnnnnnnnnnnnnnnnnnnnnnnnncgacctcaagctgaagctggagccggcgacccccgcggccgtcgtgaaggctgagggggaagagcaggacgacggtgctgcccttgccgccgccaaggaaggcgtggccgccgccgcggtttggccggcgggaagatgaagcggtccccgagccagagcagcgtcgtcaccgccgccgccgttcaggctgaccccgccgagaagccgcgcgcccccaaagctcaggtggtgggatggccaccggtccggtcgttccggaagaacatcatgtcggtgcagtccgacaagggcgccggcggcagcaaagacgccgacaagtcctcgccggcggcggcggcggcagcagcagttggcggtgccgcgttcgggaagggtgagcttgggacggcggcgccataaccttgcgcaagggtggaccctcaagaatgttaccaagagcttacctggaagctgttcccaaggcggctcgaagaaagaatgtttcagcctccctttcacccatttgggaaagctgggggggttctccacggggatggaaacgggtcatggaaacgcaagagccaaagcctgggtggggaattctggcttcaaacggggcttcccgaagttaccgttgccccgaaccttaccgaaggaaccaagggacccgggtcgaactggggaattgcctccagtccgggccgaacagatgccccgggtg

SEQ ID NO: 14087 - DNA, 767 bp, Saccharum officinarum
  misc_feature (573)..(573): n is a, c, g, or t
  misc_feature (576)..(576): n is a, c, g, or t
  Predicted polypeptide sequence is orthologous to G451
agcagtgattgatggatagatataacttaagtaagacaagaaagaagagtgatctttggctttgtacaaacacacatggagattcaactcgactctccactccttttgtgttactaataacacctacaagtagcacaaaagaaaaagaagaaaaaaacaaacaaagtgaccacacatcattccacgcatgcagatgcatgcatgcacttcgatgcacaaagctttcctctctccttcaccccaagcagcttcatctcctcctctccatgtcgtctttggtttgctgctccattgttgccagacaaggagagatggtagtacaacacatgcccatacatacccatgcacgccttggacaagaaaccccaaaagaacaaaagaatctgctcacgcatgcacaagccgtgcatgcatctcagcgataatcctcagttgttcttgactgagccgagccctctggcttcagatcccttcatgatcctcagcctcttgcaggtgctgatgaacatgtcgaagggcacgtcgccgacgagcatgaggtcgccgtccttgtcctcgtaggtgatggcgaantcngaggggttgacggcgggcgcgtcggcgccaccggagaaacagaggaacatggcctccagcgcctcccggagctcgcggtaacccttgtacatcttgagggtcaccttcctgaggttaggcgccccggtcatgctcacctttcacaacagcccggaccccggggcggcaggggcctccttcgccggcgccgg

SEQ ID NO: 14088 - DNA, 1000 bp, Saccharum officinarum
  Predicted polypeptide sequence is orthologous to G451
caaagcttctctcctcgatcctcatcttctactcatcctcatcctcctcctctgcctccctttctcaagagccaagaacacagcagctagctagcaagctttcctttctcttcgggtccatggagatcgtcgacgccgacaacctgagcgccaccgagctccgcctcggcctgccagggaccagcagcagcgacgactggcagaagaagccgtcgccctccgtcggggccaagcgcgcgctcgacgacaccaggagcgaggcctcggggaccagcccggccgccgccggaggcgacgaccacgacaccgccgcacctgccaaggcgcaagtggttgggtggccgccggtgagggcgtacaggaagaacaccttccaggcggcggcggcggccaagaaggccgaccagcagcagcagcagcagcagggaggaggcctgtatgtgaaggtgagcatggacggggcgccgtacctcaggaaggtggacctccggatgtacaaggggtacagggagctcagggacgcgctggacgccctcttcaccaagtccttctctgccgccgcggcggagggcggggaccaccagcacgccatcgcctacgaggacaaggacggcgacctcatgctcgtcggagacgtgccctgggatatgttcatccttttatgcaagaggctcaggataaatgaagggctctgaggcccagggatcggtgatgcataagcagagggctccggagcacccacacaccttcaccctgtgggaacggtttccaaaggggagagccacagatcgtggctccggaaacggtggggggttgggcctctcccaggggtggccaaaagggaaggttggtttctgaactccaagaggggggaaagaacctttgaagcggggtaaaaatcctaagctggcggtgtttttttttaaggacggttttgtttgtaccaaaagtctttaataatgtggaaaaggaaagtgggaaaattggctcaaggtggggg

SEQ ID NO: 14089 - DNA, 640 bp, Saccharum officinarum
  misc_feature (608)..(608): n is a, c, g, or t
  Predicted polypeptide sequence is orthologous to G464
aataaaaaccgacactttgggcgaccatgcctcacaggtaaaaacagtgtggacagaagagatgggggctatgctcatagtcatagcccatgagaaaaagctcaacgagtgcaccaaagggaagaagataaaaatacttctactatttgcactagacacaagtaatctcacaactatgccaaagatatgggctgctgttacgtggtatcagacacagttcaagcttcaccagcggtatagctctctagcaccaacaaacaccatcggtggttttcaagtcctgcctcttgtgcaagttgctgtaggtctgtgagccccttggaatcgcggaccgagaccgttggcatctgaggtcctcatgatcttgagcctcttcactgaacctacaaacatctcccagggaacatctccaactagcatccagtccccatccctgtcctcataggtgagctgatactccgatgagttgtccaatagctttagagactttgaactactagaagtgcaaagaccgatggacggcttcatgaacatgagctcaagtgctgaagcaaggatcttataagaccgatgggcgttgagatccaccttccttccaatgacatctncttccatgttcaccttcacccaaccgacgacc

SEQ ID NO: 14090 - DNA, 1027 bp, Saccharum officinarum
  Predicted polypeptide sequence is orthologous to G470
ttttggtgggtgttgttcctctataactcttataatacattcagtgagaagatcagacatacatataccagtgttggccatttatctcacgctacagagctacgcttacaggggattaaaatgccgcgaatagctgctggttaataccaaaggtactgctactgcttgctattacttactactggctgaggctgggtacataaatatttacatcagaaggcagaagagcaaatcagcaataacaatagtagtaataaataatcttggcccttaaacttgctgccaagaccaaactgcggggaagcaaatggagacagttctacgttcactactaaaacccaaacggacgggatgggtcactacggacaagcaaaagatttcaggagttacttggctgggacccaggcacccggcacaatgagttcatcatgcatcgtcggcttccttcacacaacctagttatctaaaattgcttgctgcagggcaggcagacatcctactcattggtggcggcgcaaccttcaccagctgctagaggttcctcctttcttggcgcagatgattttgagttcatcttctggacctcctcctttgtatagatgtagatcttccggcactatgctacagaaatcctcccagcgggttcatctccaacaggcatcatgtcaccctcattggtcagtattaaccaaccggccagttccggtgggcggatacttattcggccttgaattccaaccttttgtttaagtcccgctttgatttcctcaatatccgggaatttgaaagggccccaaatttgccaagcccaagcctgctttatacacctggtgccctccctgtcgaaacccccgggaattgttgaatttttttggacttggcggggttcgtaaattttctccgacctggggcccccggaatcggagggggcccggggcggccactttcccataggggcgttataacgggggaacaggcgaaactggcgggggaaatgttcgggccgaaccccacacaggggcggggt

SEQ ID NO: 14091 - DNA, 696 bp, Saccharum officinarum
  misc_feature (6)..(6): n is a, c, g, or t
  misc_feature (644)..(644): n is a, c, g, or t
  Predicted polypeptide sequence is orthologous to G470
cccagncggcgggaggagggggtggaggaggaggaggaggcggcgagggggatgccgctgctgcggcggcgcgaggtggcggcggcggaacggaggacggcatgtacacggagctctggaacctctgcgctggcccgctggtcacggtgcccagggtcggggacaaggtctactacttcccgcagggccatatcgagcaggtggaggcatcgaccaaccaggtggctgagcagcacatgcaactttacaatctcccatggaagatcctgtgtgaggttatgaatgttgaattgaaggctgagccggacaatgatgaggtttatgcccagctcactctgctacctgaatcgaagccagaggagaatggctctagtgaggagatgcctgccgcacctcctgctgcacttgcaaggccacgtgtgcactccttctgcaagacattgacagcctctgacaccagcacacatggtggtttctcggtgctgcgacgccatgcagatgaatgccttccaccgctggatatgagccgtcaacctccaacacaagagcttgtggccaaggatctgcatggtgtggaatggcgctttcgccacatattcagaggtcaaccacgaaggcgtcttttgcaaagtggctggagtgtntttgtaagtgccaagcgtctggttgctggggatgccttcatctttctgagag

SEQ ID NO: 14092 - DNA, 731 bp, Saccharum officinarum
  Predicted polypeptide sequence is orthologous to G470
cggacgcgtgggctgatcaatgctccacaggctggtttggacatattgagtcaagttcccgcacaggccatgcatcgtcaagtttgatcaggtcccagcctttggttattggaaatgatgttcagaaaaccaaaggcacttcattcaaactatttgggattcctcttggcagcccagaaaaatgtgaaccactggtttccccaccaagtgtcgcatatgacgggaaacttcaaacctctccatcagaaaaagggaatcagctagacatagttgaagtggatatttgctctgatccttccaagactgtgaagccacttgatggtcctcagtcagattctattacagagaataatgagccttgtccagaagctaccctgaatattcagaacaaagtgcagagtagttccaccagaagctgcaagaaggtccataagcaaggcagtgccctcggcagatcgattgatctaacaaagttcacttgctatgatgagctgattgctgaactggatcagatgtttgactttgatggtgagctgaagagtccttgcaaaaattggttggtcgtctacactgacaatgaaggcgatataatgctggttggggatgacccctggaatgagttctgcgacatggtccacaagatcttcatctacacaagggaggaagtcgaaaggatgaacccaggtgccctaaactcaaggtccgaggatagtctgtctgacttcgcagga

SEQ ID NO: 14093 - DNA, 939 bp, Saccharum officinarum
  Predicted polypeptide sequence is orthologous to G502, G519
ctccagtctcctccagccagctgaggccgattgaagaaacgaccccagcaatcggctgagctctcctcgtctccagtccggcggcggttgctagtaggtgaccgatcgagatcgaatggactgcggtggcgcgctgcacctctacaagttcgacccatggcagctcccagagaaggcgtacggtggggagaaggagtggtacttcttctcgccgcgggaccgcaagtacccgaacgggtcgaggccgaaccgggcggccgggacggggtactggaaggcctccggcgccgacaagccggtggggtcgccgcgccccgtggccatcaagaaggcgctcgtcttctactccgggaagccgcccaagggcgtcaagaccaactggatcatgcacgagtaccgcctcgccgatgtcgaccgatccgccgccgcacgcaagaagaccaacaactcgctcaggatatgccaagaacacagtagaatgaaggtatggaagtgtgctcctgggatatgtgtcggggcctcgatctcttgcagcttatgtactggctaggtaggatcagttgtgatctgtatggcatctcagaattcctttgcagcaatgcaaccgaagattacatgtgccggtgtcttcttcgctccatggcagaccttacactgtgtgttttccaccattcccttctttgccagattaagtttgcactgtattcctccctgtgatagcaaccacgccaaagacttgaccccaggccgagcttttgttctttcaaaggaaccttgccccaggcattctggccctggatcaattcttttggccgctttgtgtaaccacgaggtttccaagccttccttccttaaaaaaaaaaaaaaaagggcgggccccttttaaggatcaaactttcttacccttgctgcgcaagataagatttttttagggccccc

SEQ ID NO: 14094 - DNA, 925 bp, Saccharum officinarum
  misc_feature (569)..(569): n is a, c, g, or t
  misc_feature (572)..(572): n is a, c, g, or t
  Predicted polypeptide sequence is orthologous to G502, G519
cagcgggccggagaaaggaagcaggcagccaaacccaccaccacttttaccgaccgaccgatcggtgtggccgccgcctgtcgggttcattcatcgccacgccagcaaccagaccaagccatgggactgccggtgaggagggagagggacgcggaggcggagctgaacctgccgccggggttccggttccaccccaccgacgacgagctggtggagcactacctgtgccggaaggcggcggggcagcgcctcccggtccccatcatcgccgaggtggacctctacaagttcgacccctggaacctgccggagcgcgcgctcttcggggtcagggagtggtacttcttcacgcccagggaccgcaagtaccccaacgggtcccgccccaaccgcgccgccggcaacggctactggaaggccaccggcgccgacaagcccgtcgcgccgcgggggcgcacgctcgggatcaagaaggcgcttgtcttctacgccggaaaggcgccgcgcggggtcaagacggactggatcatgcacgagtacaggctcgcggacgccggccgcgccgccgncgncaagaagggatcgctcaggctggatgactgggtgctgtgccggctgtacaacaagaagaacgagtgggagaagatgcagctgggggaaggagtccgccgccggcgttcgcacccccaaggaggaggcgatggacatgaccacatcccattcgcactcccacttgcagtcgcacttgcacttcgggggcgagacccgcacgccggattcggaaaatcgtgaccacaacccctttcccgaagctggacttcgttcccagcgttcaaggacaccgtcggcggcaatttgtatgggtccccaaaaaaaaacagtggcataacggaagctccttcccccacccccggcaaaaacaaca

SEQ ID NO: 14095 - DNA, 1274 bp, Saccharum officinarum
  Predicted polypeptide sequence is orthologous to G536
tcgacccacgcgtgcgccgcagttcccccgaccacaccgttccgccgcgcacagaagccagccccgcgccaggagtaagtttgttctttttaacaatatgtcgagggaggagaatgtttacatggccaagctggctgagcaggccgaaaggtatgaggagatggttgagtatatggagaaggtggctaagactgtagatgttgaagagctcactgtggaggagcgtaacctcctgtctgtcgcatacaagaatgtgattggggctcgccgtgcttcatggcgcattgtctcttccattgaacagaaggaggagtcccgtaagaacgaagagcatgtgaaccttatcaaggaataccgcgggaagattgaggctgaactgagcaacatctgtgatggcatcctgaaactgcttgactcccacctagtgccttcctctactgctgccgaatcaaaggtcttctacctcaagatgaagggtgactatcacaggtatcttgcggaatttaagactggtgctgagaggaaggaatctgctgagagcacaatggtagcctacaaggctgctcaggacattgctctggctgagctggcacctacacatccgataaggcttgggcttgctcttaacttctcagtgttctattatgagattctgaactccccagacaaagcttgcaaccttgcaaagcaggcgtttgatgaagctatctctgagttagacacccttggggaggagtcatacaaagatagcactctgatcatgcagctcctgagggacaacttgaccctttggacctctgacctcacggaggatggtgctgatgagggcaaagaagcctcaaaaggcgatgctggcgagggacagtaatcttcggagagggcatgttgttccagcctggttttagatgctctatgctgtcgaagctgtgccgtgccattattgtagcagatttcctctccccctcacttcttttgcctcatattagtaggctggtagtggtcgaattagttcccattgctttgtgttgcagctagttggcactaggtccgtgtggactggtattgttcccctggatttgacaagcatgtctggtcgctctagcgttttattgagctttgaagttatcacatttatttctgtcgcaatcagttattgtctggatatgcggacggctgtttgaatctgcggtttaacgagctgagcctcttggcagccagagttcctcaccggagctgtgtaccaatgtggaaaataaaatggtaatgctttgttt

SEQ ID NO: 14096 - DNA, 912 bp, Saccharum officinarum
  Predicted polypeptide sequence is orthologous to G536
cacccctcatctccgccccagcgccactcgcatcgagatcactcccggaagtaactctgttccttgatcaacatgtcgcgggaggagaatgtctacatggccaagctggctgagcaagcagaacggtacgaggaaatggttggagtacatggagaaggtggctaagaccgttgatgtggaagagctcaccgttgaggagcgtaacctcctatctgttgcctacaagaatgtgattggggcccgccgtgcctcatggcgcattgtctcctccatcgagcagaaggaggagtcccgcaagaatgaggaacatgttgctcagattaaggagtaccgtggcaagattgaggctgaattgagcaacatttgtgatggtatcctgaagctgcttgactcgcaccttgttccttcctccactgctgcagagtccaaggtgttttacctcaagatgaagggtgattatcacaggtaccttgctgagtttaagactggtactgagaggaaggaatctgcagagagcacaatggtagcttataaggcaagccaggatattgccttggctgaactggcacctactcatcctataaggcttggacttgcacttaacttctcagtgttctattatgagattctgaacttctcggacaaaacttgcaaccttgctaagcaggcatttgatgaggctttttctgaggtggaaacacttgggcaaggaatcctaacaagatagcaccttgaatattcagcttctgagggacaacttggccctggggaccctttgatatcacgggggggccattaaggagggcaaaaaaacccacccaaggggtgattccaaggccagggtacaaaaaaccctggtaaaaacctctatggggaggggtcgagaatggttttttttagacccattcgggg

SEQ ID NO: 14097 - DNA, 1210 bp, Saccharum officinarum
  misc_feature (664)..(664): n is a, c, g, or t
  Predicted polypeptide sequence is orthologous to G536
cggacgcgtggggcgctgccgagtccaaggtcttctacctcaagatgaagggcgactaccacaggtaccttgctgagttcaagtcaggtgcagagaggaaggatgctgcggagagcaccatgaatgcttacaaagctgctcaggatattgctcttgctgatctggctccaacccatcccatcaggcttgggctggcactcaacttctcagtgttctactatgagatcctgaactcccctgatcgtgcttgcaaccttgcaaaacaggcttttgatgaggcaatctctgagctagacagcctgggagaggagtcctacaaggacagcactctgatcatgcagctcctgcgtgacaacttgaccctatggactttcgacaccaacgaagatggcggggacgagatcaagggaaactgctgctcctaaagaatccacagaaggggtaagtaaggatgggccccaatcttccgaaccctggttttatcaaactggattgtccggggagaaaacctagggaccccgctcgttgttaaatagcaaaatcgtgaatgggccatcgttatttcttaaaaaccaattaattttccaggttgggtggtggggatttttatgatgttccgggggtgtggtgttgcacagagtggaatgtatgtggagtatgggtngtgtaaatgaggcgctgatgtatgtggttacggaagagattcgatgtgtgatccccgagagttcactgagggggaatcataaagcgcatttattttgtgattacgcgagcataaagttctgatactagggcggattaaatggttacactgagaggacaaatatgttcgttatccgggcaagtggttgtaggaaagagatcgtttttgttattgggagattgaggccttgatggtcaatacgtaatttgttggattggtgaccaaattagaagatataatacagtatgattggaagtagtttcgaatacctatatggggtatggggaaggggtggtgtaagtttgtaggcggacgataataagggctaagtacgttaacgacaaggctgtagtgatatggggcgagatattaagtggtaggtggacattggatgagtgagtcgggataaaggtaaaggtgcaacggggggagtgtatgcttatgaggtaatagatgaagatcgcgaggggaacggcgataggtgagagggcatagggacaactgttc

SEQ ID NO: 14098 - DNA, 1241 bp, Saccharum officinarum
  misc_feature (1148)..(1148): n is a, c, g, or t
  misc_feature (1167)..(1167): n is a, c, g, or t
  misc_feature (1179)..(1179): n is a, c, g, or t
  Predicted polypeptide sequence is orthologous to G536
cggacgcgtgggcggacgcgtgggggccgctccttccccccatctccatctccctctcccgttcccatctcactccccatcccgctcgagccacacacacacccacccacccatggccgccgccgccgccggcacccgggaggagatggtctacatggccaagctagcggagcaggcggagcggtacgaggagatggtcgacttcatggagaaggtcgtggccgccgctgcatcctccgagctcaccgtcgaggagcgcaacctgttctccgttaactacaagaactgttatcggcgcgcgcagggcgtccttgcgcatcttctccttcatcgagcacaaggaaggatattcggggcgtccgttgtccactcctgcgcctttctctagggataccgtcctccccttagagttactatttcaccgggatcatgtctcagcatgtttgtgacttgtcaataagctatcttattcctggcccaaacagcctattatgtttacgcgtcctatacttataacgcaatggatccttatacttattaacctattcgatctatatttcctgcttcatgatttttcgattttctgtggtacgctcttatatgcgatccattttctagtctctctatcatcttttatcatatgtcttgtcttaccacctctttaaacagtctccgcctatcttatttaaatatttacatttcgataatgactctcatattcaatttatcgttctctataatcattgataataaatatgtgttcgtataattgttagacctacctctgttctctctacgtataacgatcttatcgctagaattctacaaaattttgtcacactcttcaccggaataaacgtatgatctttctaatactttatctccattatattatacgtttccatcgcttctacactgtcttcttgttttcaactatcgactcatcgctagtgatctatatgtacagatctcaggactgtgtggaccatatgttattctttctcactgcgcgctcttctatgtgacatgatatcggttcccacactctcatatggtactctagagacgaaatctttcgtgccccttcacctcctgttatacatcatctcgcctctgtgctcattcttactatgcttcatataatacanattgagtattccacgtgcnctcataaatcangtatgaacaggtattctggtagtgtaatacgcatcgtgtgatatgatatgtcataccggtcc

SEQ ID NO: 14099 - DNA, 1196 bp, Saccharum officinarum
  Predicted polypeptide sequence is orthologous to G536
acgccggagctcgacgaggtcgacgcacgcagagatccggcgtactgcaagttttgaaaactgaattgtaagatggcatcagcagagctttcccgtgaggaaaatgtgtacatggccaagcttgcggagcaggcagagaggtacgaggagatggttgagttcatggagaaggtagccaagactgttgactctgaggagctcactgtggaggagcgcaacctcctgtctgttgcatacaagaacgtcattggagcccgccgtgcctcatggcgcatcatctcctccattgagcagaaggaggagggccgaggcaatgaggaccgtgtaacactcatcaaggactaccgtggcaagattgagactgagctcaccaagatctgcgatggcattctcaagctgctcgagtcccaccttgtgccctcttcaactgctcccgagtccaaggtcttctacctcaagatgaagggtgactactacagataccttgctgagttcaagactggagctgagagaaaggacgctgctgagaacaccatggtggcatacaaggcttgccaggatatagctttggctgagcttgctcccactcaccctattaggcttggactggcacttaacttctcagtgttctactatgagattctcaactcacctgatcctgcctggagtcttgcaaacaaggctttgatgaaggcatctcggaactggaacaccttgaccaagagtcctacaaggacagaactttgaccttgccactcctccgtgataacttaaccctaggaattcttaaatctccgaggaccttcttaagagatacaggaggcgcccaacggcgattccaacaaggggcagtaaaccggttttacttgcctaaaacataaacctatggttggcggcgtctataacactatcaagtgaccggaaccggttctggggttgaaccggtatatatggcggaaattgggtccccataaattgcggaggccgttccccttttagaggctgaaccttggggtggtggaacctaaggtgctcttaatttcccctattggggcccccccaccaaaaactaaataaaaaggggccaaaaacattgcctgagaatcttttcaatatcggggttaaggggaacgttcctactggaccctccgggaaagccaccccccccaaagaccccccaacgggggtcccccccc

SEQ ID NO: 14100 - DNA, 979 bp, Saccharum officinarum
  misc_feature (440)..(440): n is a, c, g, or t
  misc_feature (498)..(498): n is a, c, g, or t
  misc_feature (510)..(510): n is a, c, g, or t
  misc_feature (520)..(520): n is a, c, g, or t
  misc_feature (556)..(556): n is a, c, g, or t
  misc_feature (561)..(561): n is a, c, g, or t
  misc_feature (613)..(613): n is a, c, g, or t
  Predicted polypeptide sequence is orthologous to G558, G578, G629, G1198, G1806
ccaataacccatgatggtctacaatatgaactgagcgttcacttgaacacatacatgtcatcccttcataagatcttagattcaaatatctcactaacacatgagcaatgtgaagaaactaatggacatactagagacagtacaaaaaattatcctatttatgaattaattgaatttattcccttggacgggcaagccaaagagaactcaaagcacgcagccgagagaagtagtcgcttattgcaagtagagctcgtgctgattgtcgggtggttaagatgcgttgcatttgctgaagtgtttgcagccgtaaattatcagcctgtcgtagaaagttctcaagggtgccaagttttcccatagccatcgccatttgtcccatgtaatttgcaacattgccagaaggtccagcagggcccagggatccagatgctagagtntctgcaagcgactgttgtagtgcttccatcccttgagaaagagcatcttcagcttgtngggaggactgtngcaggtgggnatatacaacaagctgctgatcagtaagaggctctangtganctgccagcaacttaagaagctcagatgatcggaagccacctaaccacatganacatctctcagcaggggtcttccacatcccagacagcacatgaaaaacatctgctttagctggcacacccttgagcctgaaaattcgtcgtagtgtgccatatgctatcaacaataccacgaggatcattatcgccggcatgtgcattgactgcagccctcaaccatttacatgttggtgtgctcctccaaacagcgtgatattcatggtcaattgccaaacttcatttccactgggtgatggagcttgacttctgatgtccaaataaaattaacttgttgacagacccgctgaactctggctccacctgagtaatttcaaccggcaacccccaggtttggagggtgcccccaaccttaaaaggta

SEQ ID NO: 14101 - DNA, 742 bp, Saccharum officinarum
  misc_feature (545)..(545): n is a, c, g, or t
  misc_feature (599)..(599): n is a, c, g, or t
  misc_feature (615)..(615): n is a, c, g, or t
  Predicted polypeptide sequence is orthologous to G558, G578, G629, G1198, G1806
gcacgagagtgaatgctcatgcaagtgacagtgatctacgacttattgtagatggcataatggcacattatgatgaaatattcaaggtcaaaggtgttgctgcaaaggctgatgtatttcatatactttcaggcatgtggaagacacctgctgaaaggtgcttcctgtggcttgggggttttcgtccatctgagcttttaaagctcctagcgaatcacctcgagcccctaactgagcagcaaatgctgggtttgaacaacctccagcaatcttcccagcaagcagaggatgcgttgtcacagggcatggaagcactgcagcaatctttggcagagactttagctggatctcttggtccatcaggttcttcaggaaatgtggcgaactacatgggtcagatggccatggccatgggcaaacttgggacactcgagaattttcttcgccaagccgacaacctgcgacagcagacattgcatcaaatgcaacgcattctaacgatccgacaggcttctcgtgctcttcttgccatccatgactacttnttcgcggtgcgtgctttaagttctctgtggcttgctaggccgcgcgaataactntggatcatcgctgttntgagttccctgtgcctgcctgttggaattctatggcacgctggatgcctggatcgcagcgacaccatgaagatcattcatggtcctgtgttttgtgtacaattacttttggctgctgcttggcgaaa

SEQ ID NO: 14102 - DNA, 676 bp, Saccharum officinarum
  Predicted polypeptide sequence is orthologous to G558, G578, G629, G1198, G1806
acaaaataagcagataaatgagctgaggactgcagtaaatgctcatgcaagtgatagtgacctccgtcttatcgtcgatgggataatggcacattatgatgagatattcaggcagaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcaacaattgatggggctatccaatctccagcaatcctcccaacaggctgaggatgcattgtcacaaggaatggaagcattgcagcaatcattggcagaaacgctggctgggtcccttggtccatcaggatcttctggaaacgtggcaaactatatgggtcaaatggctatggccatgggaaaacttggcacactcgagaatttccttcgtcaggctgacaatctacgacaacagaccttgcatcagatgcaacgtatcctgacaatccgacaagccgttcgtgcgcttcttgcaatccatgactacttttcacgtttgcgcgccctgagttctctttggcttgctaggccacgagagtaacatcacccacgttggggtcactccatgaactgatgatctgtgaatgtgggactg

SEQ ID NO: 14103 - DNA, 677 bp, Saccharum officinarum
  Predicted polypeptide sequence is orthologous to G597
cgcggaggatccacctggtgctaaccaagaacttgcatcgtgctgcataggggcacagacaggttcagtacacggcatccattccagacgacaataagcaagtaagcaaccacctaacaatctacagcaagagctacagagtcttgacaccacctacaactacaagctactgctgcttctccctccctcagtgagcttcgggcttcagtgctgaaacactcttctttctgccagttctaccacggtcagacggagacggtatccgggatctggtcatttccaggacaggccggagaagccccctggctgctgctgcccatggccgccgctggcccctgcgtgcggcgggcttggtgcgccgccggatgactcgctcaggctcaatgtgcctctggacggcgggctgctcggccctgccgccacgcccgtcgttggcggcgcgagctttagtggcgctggtgatgggtctgacggtgacggagcaagcttctgctgcttcggctccttcttgccatcggcgtcgaagctccccactacgatctgtaccggtgatgcagctgtcagaagtccgggcacactaaccaccaaggacacggccatcagggccctgctacgaaacgctgaacccaaccagttcgactgcgatgcccatcattctctgacagaagaaacgatcc

SEQ ID NO: 14104 - DNA, 1067 bp, Saccharum officinarum
  Predicted polypeptide sequence is orthologous to G597
cccacgcgtccgaaagatttcagatttgagttttagtccaagaaacgggtggtggtccgccatggaggtgaggtccgagcaagggctgatggcagggagggatctattcggcatgccgaagagcccgccggcgccggtgcccgggccgccggcgtccgcggccatgcagagcgtgcgcatggcgtacaccgcggacggcaccgctgtgtacgctccgatgagctcctcggctgcgacgccgtcttaccagccgcagggcgcagcccacggcgctagcatgtccgcggcgacggtcgttggtggcaatggcgcgtcagctgcgccgggcatgtgggagccggtggccaaaaagaagcgcgggcgaccaagaaagtacgggcccgacgggtccatggcgctggcattggtgcctgcgtcggcggctacggggtcgccggctacagggtcgccggcgacagggcagggttcttctgggccgttctcaccggctgggttaaatccggcgagctctctgctggtggtgtcgccagatggatataagaagcggggccggcctaagggttctatcaacaagccacgcgtgaatgctgttgggtcatcaggagctggatttacacctcatgttattacagttcaagctggggaggacgtgtcataaaagattatgtcattttctcagcatgggacacgtgcagtttgtgttcttttcagcaaaggcgccatatcaaatgtgacgctttgtcaagatgttacatcatgtggaaactgaaacaaacaggggtcgattgaaaaactatcactggcagggttattcctctgggggagaatgggggtcactgtatccaacgtgaagcttcatggtgtactggttgcccctaagggcatttttggtggggggaattatgaaacttttattactcttctcacagttataatgaattggcaaccttattcttggagtgaataaaagaccaaaaatgtttatttataaaccctattataggacctaagggctctttaaaagcgggggataccctacctttctctaatgaattatttgaatgtta

SEQ ID NO: 14105 - DNA, 1117 bp, Saccharum officinarum
  Predicted polypeptide sequence is orthologous to G602
aacacacacactcaacagcaacatctaatcttctcctaccggacagcaacatggctgatgaggaggccaagaaggtggaggtggaggtcaccaacgacaaggagcccgaggcggcgcccgcgcccgcggaggccgagccggaggcggtcaaggaggacgtctccgaggagaaggccgtcatccccgcgaccgaaccgtcggccgccgaggagaagccgccggcgccggccgacgactccaaggccctggcaatcgtcgagaaagttgcagatgaacctgctccagagaagcctgctgctgagaagcaagggggctccaatgacagatatctcgctcttgcaagggtggaaaccgagaagaggaactctttgatcaaagcatgggaagacaatgagaacaacaaagctgagaacaaagcttgctaagaaagtattcggctattctttcatggggaaacaccagacaaagcacacattcaaagctcatctgaagaatattgatagacaacttggaaaaagaagaaaggcggaattctgcttaagaactatggactaaccatcggttggatattgattccacgaacggacacccaccaatcaaaaatacgagactcaagtgttggaatcgcacaatatcgccggggtaaggatcggtccattttacagtgcccaacctaagaaatgggcttgtcccaaaattactccggggcacacctgggccaattcctccgtataataacagcaccattaccgtctgggatcctgatacctcaaagaaaaccacttctcccatttatccaccctgacacggtactttgtacaaaccttccataccacatcgggttgttgcgagttcgctctctcacaaacataattcttgctaaagaatccacttcaaatattgttagacactcctagctgctgattttcacccgaaatatcatccacaaaaagcggtctggtcgttatccattatcaataagcgcgcggacaacactactctctgtattaaccgggctcccctcacaccgcaataacccctatcatgtagccgtcagaaactataactctaccattctatcatctggaacatgagctccccctccacaccaacaatt

SEQ ID NO: 14106 - DNA, 882 bp, Saccharum officinarum
  misc_feature (540)..(540): n is a, c, g, or t
  misc_feature (747)..(747): n is a, c, g, or t
  Predicted polypeptide sequence is orthologous to G611
ggagcaacatttcgactagttgcttcagaaacgctctgaccgtaccccccatatgaatcaggctctaaaggggcactcgctacctatcagcagctcatgttacatcagatcagtcgcccgccagctaattctacggatggcaggaccagctgccatggagaattcaagtacatgaaacattcgagttacaatgacaggttcaaataaattgggggggcctatgaatgacaggttcctatcttggttgaatggctgccaaatttgtggcccaacaatgaaagaatcagaatcagattcagcctctggtgttttgggcgagcttctttgcacgcccattggacggttgcccatcatcctttcctcccgaagcctcaggcttccgggcccaagcaggggctctgtcaggctcatagcggtaatcatagaataactcttcgccagcgaggattctttctttggcgaatatgcccactctatgatcgccagctaccatgataaccttggcatagcaattcgggtcaggggcatggttggcaaatntcagcttgtcacccattctgtatgcatcaagaacatactcattgttcaggttgaaaagaaacgatgagttctcacgatcgtatatctttccacgcttatctgcttctttgtgtgagattagtccccagtgtactcaccaagatattcatgtgtgctaacactattcttgaggaatgctcccagccagagacatctgatcttccaagntagaacctttgttgttgttttagaagcaagttcatgttcctgcattcataattatcttctctcgggtttgggacccccatgtaccatcaccacacccaacccagaagttttggaaacatccggatcgcattccct

SEQ ID NO: 14107 - DNA, 791 bp, Saccharum officinarum
  Predicted polypeptide sequence is orthologous to G618
ggcatgtaacaataaacatactaaattcccccagaaattattttacacaattccttgaaaccaaaaatgtacatctattttccagcattatgcgaaccgaaaataaattaaaacgctttttggagttcaaaggggaaaacctccggtactacgttattgagttcggagtcaaaggtgacatgttcatgagcatcacacagccaggtcaaacttctaccccacttgatcgatgctccaccatcacctatgccatcttagcccatgcccttcagtagccatgaaatgaactcctggaattatcgccccctccttaagcaattcatcgaggggtcatcttccactaaagttcaccagcgaccaatccatgcatatgcttctaatggcttcggatgcaaacattgggaattctagccacggagcctggcggatttatttaccccccgaaagtcagctacaatttcctctagaagatcatcttgcaacatactcccgatatcgcacccgaccaaattggtgccatcttcagaggcaacccactctacactccaaaataggggttcctgattaaactctatttcttggtgtacctgcaccaacctttgtcgcacaagctcaggaaaatcttcctcattccatcccaggggagaacctccccatcaatctcttttgagcaactgtttcgtcacagaggttattataaccccccacaaaaacaattttgtgatatctaaaaaaaaacttccttctcatggtggtgggcattaaatgaggggggggggacttctttttaa

SEQ ID NO: 14108 - DNA, 923 bp, Saccharum officinarum
  Predicted polypeptide sequence is orthologous to G622
tctgcagtgacctttagtcgcatagatcctggagggaaacttgttatgggctttcggaaggccacaaatactgtcagtctgccagactcgcagatttcagctattgcaaatggttcccttctcagtgagacactcttttctactgcaaatgagaacataggagtagtaagtggttatcctggatttcttcactcaataaagggagctgcagatctccatccaagctctctatatgatcatcatatgaactcagctgacggggatgtcagttggaataagacagataaattcagcagcaggccagatgaggggtctttgcaatttttacaaaaacgaagtcgcaatattggttccaaaagcaggaggttcttaatcgatgctgaagatgccatggaactaaagcttacctgggaagaggctcaagagttgttgcgccctgctcccactgcaaaaccaactgttgtgatgattgaggactatgagtttgaagaatatgatgaaccccctgtctttgcaaagagatcaattttcaccatccgtgcaacaggggaacaagatcagtggattcaatgtgatgagtgctcaaaatggcgccgggtgcctcttaatgttattggtgcatccaaatggacatgccaccacaacttatggaacccaaatgcctgttcttgttcgcgcctgaaaatttacccccaaaaaagtgccaagtggtattccgcattttgaaaaaattgaggaaccaaagggccactttgggcttaaacttaatgtccttaaaaggatggcttcagcccttgaccccttgcccggtccttaatattttgtgaaatcgggaaccaaggcccgttttattccaaaaaccaccaagacccccgggttttgcccgggtggcaatgctttggggcattcccccccccacggga

SEQ ID NO: 14109 - DNA, 764 bp, Saccharum officinarum
  misc_feature (589)..(589): n is a, c, g, or t
  misc_feature (624)..(624): n is a, c, g, or t
  misc_feature (642)..(642): n is a, c, g, or t
  misc_feature (700)..(700): n is a, c, g, or t
  misc_feature (734)..(734): n is a, c, g, or t
  Predicted polypeptide sequence is orthologous to G635
cacgctcttaaactatcaaaagaggatgtccttctttattcagctaaggttattcctggaaatgagacacgggtaatgaagatgatgaatcgcctcactgatcttggcccaaaaattatcatgggtaaagattctggcctgcatacctctgggcatgcctaccgagaggagctggaggaagttcttcggattgttaaaccacaacatttcttgcctgttcatggagaactcctatttctcaaagaacatgaattacttggaagatcaactggcatcaggcacacaactgtaataaaaaacggagagatgcttggtgtgtcacatctaagaaacagaagagttttgtccaatggatttgtttcattagggaaggaggatcttcagctcatgtatagtgatggggataaggcttttggtacatccactgatctctgcattgatgagagactaagaattgcatctgatggcattatttttgtcagcatggagatcttccgacctcagaaggaacatggtttagcgcagtcaggtttgaaaggaaaatttaagattactacaagatgtctatggcttgataatggaagaatgntggacgcactctacaaagcagctcatgctgcattngtcagctgtcctgtgaantgccacttagtcacatggagaggatggtagctgaaatcttgaggaaaatggtacgaangtatagtgggaagaggcctgacgtcattgcggtngctacagagaacgccacggaggtttcccag

SEQ ID NO: 14110 - DNA, 784 bp, Saccharum officinarum
  misc_feature (441)..(441): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (468)..(468): n is a, c, g, or t
  misc_feature (471)..(471): n is a, c, g, or t
  misc_feature (486)..(486): n is a, c, g, or t
  misc_feature (489)..(489): n is a, c, g, or t
  misc_feature (492)..(492): n is a, c, g, or t
  Predicted polypeptide sequence is orthologous to G652, G1335
gagcacaatggccaacgactcgataacattcatatattatagatagttcatgactgatagatcgggcagagccacccatgatcatggctgccctacaactcattccaacacaaagacactgatactgctccgagacagatctaaactagtacatctccatacggcttgcttttcttgctacgaccacctacgatagggatcgacgagaacgaaacacgacactggtaccacaactactgatagatagctggctccgacgacttcatccagagtaagccgagcgataccttgagcgggtagggaagcgggcgggagacgacatgggactccgccggatccggcgcgacgggggcgccgcgcctagcgcctagcgcctcttctcggggcagtcgcgggagatgtggccctcctggtggcagttgtagcactcgcgggcaccgncaccgncgncgncgtagccaccaccgncanctccgtagccgccgncgncgnctctgtagccgccggcgccctgggagcagtcccttgccatgtggccctcctcgccgcacttgtagaaaccgggaacggcggccacgccaacaaccggagcggctccgccggcgtaaccaaggttcgccgcccacagacgtaacacccgtcggaatgcgtcaacgttatccggggggaaaaacccccgacttgtccgttgactcgcagacaaaggaaacactagccgagcctgggtgtgcgtagataaattgcggtttacaccaagtgactccacaaagcccaaaaaagcgag

SEQ ID NO: 14111 - DNA, 837 bp, Saccharum officinarum
  misc_feature (553)..(553): n is a, c, g, or t
  misc_feature (567)..(567): n is a, c, g, or t
  misc_feature (618)..(618): n is a, c, g, or t
  misc_feature (716)..(716): n is a, c, g, or t
  misc_feature (749)..(749): n is a, c, g, or t
  misc_feature (774)..(774): n is a, c, g, or t
  misc_feature (815)..(815): n is a, c, g, or t
  Predicted polypeptide sequence is orthologous to G653
atccgattcccacatcccctcgtcgtcgcttgtttgttgctgccttttcctttccgccgcggcaaaagcgaggcgcgggcgagctgggggagggagacgaacccgtcataattccatcgcttaatcgcgcctcgtgctcctgcgcatataagcgcggcaatcgggacgccgggggagggtgctcactcttcatcccacccacgccacgcgcgcgcaggccaaggccggatcgggctctcagtcagatctcgccggccacgacccgtgagacagggagagagggaggggttggccggtgctcgggagaagatgtttagcgggacgcagcagaagtgcaaggtgtgcaccaagacggtgtacccgatggaccagctctccaccgacggcgtcgtcttccaccgctcctgcttcaagtgccagcactgcaagtcgaccctctccctgagcaactattcctcgttcgaaggagtgccgtactgcaaggcccatttcgagcagctgttcaaggagaccgggagttacaacaagagcttccaatcacaatcacccgcanagattactccgganaagttggcccctgagctgaccagatcaccaagcaaagctgcaaggatgttntcaggaacacaagacaagtgtgcgacttgcggtaaaaccgcatatcctcttgagaagggtacagttgaggaaaaggcctaccataagtcatgcttcanatgctcccacggggggctgtgcgatacaccttncaactatgcagccttggagggcatnctctactggaaacaccatttctctcacttttcagggagaangggaagctacaccacttgatca

SEQ ID NO: 14112 - DNA, 692 bp, Saccharum officinarum
  misc_feature (653)..(653): n is a, c, g, or t
  Predicted polypeptide sequence is orthologous to G670
gcccatggctgtctatatttatttaatttccaccaaaaagtgaacaaaaactcaaatatgcaaaagttgagtcgtcgtgtacagaaggaaacatcatttttcaagagaaagaaaaagaagactctagaacgtacttttctatgcattctgctgccacttctaatgccagggctgtcctttccttgatattgccaggtcttcaactgaggaacagctgtggaggatgattactgtatcaacttaatgtatctatgtaagcaattcagcatagctctgccccatgaatctctgaaaattacaagtttctgcttctgctgatctgctctgttccatgtggtggaacataatgcctaaatattctcaaaagacagttgcattctttgcaagtccttgtcatacatgtcgggtgcggcctgcaactgttgctgtggctgctgattctggaaccaaaaagcacatatcccttctatgctgaattggctctctgccttgatcacgtcatcataaagcgtttggctctggttctgcatggctgtggtcgtctcggcaaaggttccatggagcaagtcaggccacttaagttcctctactaggtgagcccttgtatctttttcttgtccgatgtctgtccatgggaaaggactgttctccanaaattagctcgtgctctgtggttcaaatcccaatatgtt

SEQ ID NO: 14113 - DNA, 1010 bp, Saccharum officinarum
  misc_feature (678)..(680): n is a, c, g, or t
  misc_feature (688)..(689): n is a, c, g, or t
  misc_feature (691)..(691): n is a, c, g, or t
  misc_feature (694)..(694): n is a, c, g, or t
  misc_feature (715)..(716): n is a, c, g, or t
  Predicted polypeptide sequence is orthologous to G718
aaaggtccttgatcaaggcgttgaaacttctgcggccgtctccaacccaaacggagctccggatcttcagcatgctctctctcttctgtcaaacagttcggctggtgctggtaccaaccagcagccgattgctcagctgcaccaccaccacgctggcctgagcaccctcgtcgccagctccagctccgtgatgcaagcctcatcaccagggctgtggcaagacggcggtggcgcggccctgggccaccatgcccacgcccacgcccacacgcggtttcaggctctcgatgccacgggcagtggcgccaccattgcgacaacggctcaggagctgctccagctcccgaggccgccgtcctcgtacgacagctcctcgtcccactacgacctgatgcgctgatgcttctcccttcaggcttcaggtagagcgtgcggtttgcgtgggatcggactcgcttctggcgtctctggaactcgggattttgaactgctgtatgtttgatctgaattaacgaacaaaataaaggcctgcacaaacctagccttgttgccatggaaactcgtgggatcgccaggagctgcgtgggcttgaataatccacagttttgtgacgctagctttctatttatttgtgtaatgtaactctattgcttgaattatcccaaatgtctctctcannnaaaaacannanaanaaaacaaacaaaaccaacaanncaacacagaaccgccacaatgacaacctacctccacagagggcggccgctctaaaagatccaaactatactttcccgttgattcaaaatccaaaactttttcattaggtcgcgccaaaataaaaaccactggggcggggtttttatacactccttaaacggggaaaacccagagtttcccacacaattacagagcttggacaaaacccccactcggtcaaaggtggacatataaaaaaagagtcgccacccaatcccccttaacaaaaaagctcccaccctaatatgatatagt

SEQ ID NO: 14114 - DNA, 932 bp, Saccharum officinarum
  misc_feature (253)..(253): n is a, c, g, or t
  Predicted polypeptide sequence is orthologous to G728
gcttacaaacgatgaagtgaaaagccatctccaggtgagcaatgatccgctttgtccaggattttttttagtagtacaaatgcctatttctggcgatatagtatcttgtttggaaacttattcgatcgtgtcatgttcgtattcagaagtaccggctgcacaacagaagatcccccggtgcggctccggtgagccagccgatcatgctggtgggtggcctcgaggaggagcgcaagaagatccaaggtgttcnggcgcgaggctccgctctgcgcgcgcctcctcgccgacgtgatcgacgagttgaaggaggaggccgccaagagaggcagagacgcggaggcgaaggcggacgacggcgacaagcggaaatggatgagcaccgctcagttgtgggtggacagcgacgccaaatcggacgagtctgacaaagagcaacggagtgaaatcacctcgccgtcgcccaagttgctcggtggcgcacccatgccgataagggccgttgcggctgtgccacccctgccggcgccggtcttcaggaaggaagacagctctgccggcactggtctgtcgctggtggtcccggcaactaaagccgcgatttcttcccgggctgccaacgattacgccagcgggagaatctgtgctaccttggccacatcttggttctgggtcaacttgactctaagctcaccaccagccccccagaaggccaagcgggctgtcaccggaccttcaccggcgtttgttgccgtttgcttaacttggggcccctagttgttcttcgaaacaaataaagggggggattccagtggcaggcttttaaaaccatgaattgaaagcccttttccgggggacaaaaacaattttcgggttttccccaggggtccgtttcaatttttccggaaaagggggggcctttttaaaggccc

SEQ ID NO: 14115 - DNA, 1013 bp, Saccharum officinarum
  misc_feature (620)..(620): n is a, c, g, or t
  misc_feature (748)..(748): n is a, c, g, or t
  misc_feature (751)..(751): n is a, c, g, or t
  misc_feature (754)..(754): n is a, c, g, or t
  misc_feature (869)..(869): n is a, c, g, or t
  misc_feature (930)..(930): n is a, c, g, or t
  Predicted polypeptide sequence is orthologous to G744
gagtaaaaaaagaacatgaaactcaatcactgatgagtaaacctttgttcacaatagggacaagtgcaggactttaatttacatgcaacgtatctttctttctatatgacgatggtagcaactttgcaaaggcatgaccgtatgataaccccgaatccaacatgatctacctacacatcctgcctacatactgggcatgaaccatggtcaatgaaccatctgtccacacaaggctgatggaaggtgtgagagcactttggcaacttcctcactgtctctccgctaacaacatcctgcaggcaaatagcgcaagacacattttcaccaattgattcctgcttctgatcagtcaccacatgatgtggcaacttctttagagtatcttgtgagagcccttcggataaaacatcttcaagaacatcgaacagatcatcattgtccgcaatgccaacctgccaacgatatgccatatatgccgatggctcatactggtcttgcacaaatcgagcatgaaggagctgttctatgaaatcccccatggaggacgtgctctgcgggctcgatcggtcccgcctccaataggcgcgcgaagcctcgagaacctcgatggagagcaccgnccccgcaaaggcccccagcccggctccccggaggacgccgctgtccgaagcgcggccggccaatgcgccggtgaacgcccccgtcaggctccaactaccccagcaaaacaatccgcgtcagagaatancanggncggagagcacgcaaaccaaacacagaagcgacacaatttaaggtgcgcgttaacgctatgttgggcgcacgcaagtgcacgcttacaacgccaaaattccggtgagggccccganagacgcggaaacaaccggggaggagggccgtcgttaccttggactcctttccgcgccgcgntggaaagccggattcctgatccacctccggacggggggccactcaggctccgaaataaagccaaccatcaaccgtccgaactg

SEQ ID NO: 14116 - DNA, 705 bp, Saccharum officinarum
  Predicted polypeptide sequence is orthologous to G791
cgtagtgaccgggtcgacccacgcgtccgccgccctcgaccccgaatcccccaatccctgacgtgaccgctgaaccctagcctactccggccatctgccgctggccccggcgatcccccgccatggcctcccccgagggaaccacgtgggtcttcgactgtccccttatggacgacctcgcggtggccgctgacttcgcggcagcccccgcgggggggtttttctgggcggcgccgccgtcgctgcagccgcaggtggtgcaggcgccggtgcagtctgtcgttgccgcgtcggctcctaaccccccatgtgtggaaattagtagctctgtggattgtggtcagggaaaagaacaaccaacaaataaacgtcctaggtcagaaagtactgcagaaccaagcacaaaagcatccagggagaaaattagaagggacaagctgaacaagagattcctggaatggggtgccattttggagccaggggaaactcctaaaatggacaaatcagctatattgaatgatgctattcgtgcagtaggtgaattgcgtagcgaagcaaaaaagctgaaggactcaaatgagagtttgcaggagaagattaaagagctgaaggctgagaagaatgagtcgcgagacgagaagcaaaggctgaaagccgagaacgagagcctggagcagcagatcaagttcctgaatgcccgcccaa

SEQ ID NO: 14117 - DNA, 827 bp, Saccharum officinarum
  misc_feature (522)..(522): n is a, c, g, or t
  Predicted polypeptide sequence is orthologous to G798, G1897
accgtgtagcatcccgggtcgaccacgcgtccgatcgtattccctcctcttactagtctcttctcatcccaggtcacccagagagagctagcgaggtggtgagtgagaccagagcagcgctagcagccagctgattgcgccgcgcactagctagctctcggccggatcgctgctgggcgtctattaagccgccgacgccgtcgtccgccctcggcatgcgcggttctgctcgcccgggagatggcacctgcagcttcgatccactcggccaccgccgccgctgctggtgcttccaagcgccaggccgattccgacgctgagctcccgctcgactcctccgcgctccaccagcagggcgacgaggccgcgcgcaagggccagctccagcagccgaggcaacagcagcagctggagtgcccgcgctgtcgctccaccaacaccaagttctgctactacaacaactacagcacggcgcagccgcggcacttctgccgcgcgtggcgccgctactggacgcacggnggcacgctgcgcgacgttcccgtgggcggcgcctcgcgtcgctccggcgggggcgggaagcggcgacaggtcctcgcccaacccctcctccgcggggtccgcgtccgcggcccggcgcaatgccgggaggttcattccgggcgccttcctgccggaacctcgttcgccttcccgttcttaacgaagggagttcttcccccctgtgaattcggaggggtgttgccttgcacccgggggcctttcccccttcctggaatcgggggtccccgattttccaaaagggctcccccgggggaaacggaagg

SEQ ID NO: 14118 - DNA, 706 bp, Saccharum officinarum
  misc_feature (477)..(477): n is a, c, g, or t
  Predicted polypeptide sequence is orthologous to G831, G1202
tcaaagcatcctgtttgggtcatgaatgtggttcctgcaaatacaacagagaatactcttggtgtcatctatgagcgtggtttgattggaacatacaccgactggtgtgaagccttctctacttatccacgaacatatgatctgatacatggtaatggaatcttcagctcccatattcacaagtgtggaattatcgacatccttgttgagatggatcgcattctccggccagggggtgccgttatagttcgggacatagctgacgttgttctcaaagtcaagaaggatgccgaccgtctacaatggcatagccgaattgttgacactgaaaatgggcctctggatcctgagaagcttctcattgtggacaattccctcccactcccagggagctaaagtgagtactagcaagtagcaagaagcaagatcagcaggctcttcatgttcatgacaacaggttctagatctcctcatgtntcgagcaagagccagtggtctgcgaccttactacctgtacagtatgtcttctggcagactgggatgttcggatgaagcgtatcaggcgactgggatgtcttcacctgtatacggggggttcgataaacaaaatgttatttacctaatacctatacagattaagggttcaaggctattggctatcctacagggagaaattcagaattgcagatcttcatttatgaccagc

SEQ ID NO: 14119 - DNA, 822 bp, Saccharum officinarum
  misc_feature (484)..(484): n is a, c, g, or t
  misc_feature (532)..(532): n is a, c, g, or t
  misc_feature (681)..(681): n is a, c, g, or t
  misc_feature (775)..(775): n is a, c, g, or t
  Predicted polypeptide sequence is orthologous to G839, G1196
gctatgtttctttccatatatagttctatccttatatatgtataataagcactatacatacacaggtgtagaagtccctatatgctgtccgggtccaggtctccaaaaccgtgattacaaactagtatacggcaaaaactagtcccttgatcacctattcacctcttggtggatttctggggtggcgagcacgacgacgatgaagacaggcccgagaacatgctgctgtccgccttgtccttgctaaaggccttcagcacgtcctccttcagctcacagaagcgcatcctcttcaccttctgctcgtcggcggtgcccctctggaggtagaactggtccagcccgtccggcaggtcgtcctccaggaatttgtccagcacctgcgagcagttcgggaagtaccgacggcccagctccactgttttcatcagtgcatctacccttgaatggagtcttttgttttgtgtgactggcgtctcataanggtcgacctccctcagtttaccacaagtacttgctgcaactataccgncgaattcttctgtggtgtctgcttgtgcaatttgcatggcgaccttggcttcagcaggaaagacaatctagcaaatgcaactctgtttccaggtagagaagcctcatgtgaagatcatctgccaataaaggcgaggtgacagcatcttncaccgccatagggattcgcattatctccctctctagatatctatacacagcctatctttattgattcttgacctgctccatctttggattgagnctttaaatcttgtaacttccacaaatacaaatgcgctcctgccataa

SEQ ID NO: 14120 - DNA, 807 bp, Saccharum officinarum
  misc_feature (560)..(560): n is a, c, g, or t
  Predicted polypeptide sequence is orthologous to G846
tagagttatgattatgtcactgaaagctggtaatcttggtctcaacatggttgctgcttgccatgtaattctccttgatctgtggtggaacccttatgctgaggaccaggcagttgatagggcacacaggattgggcagactaggcctgttactgtatctcgcttgaccgttaaagatactgtggaagatcgtattttagctctgcaggaggaaaagagaactatggtgaactctgctttcggtgaagacaaatccggtggccatgcggcccggctcaccgtggaagacctacggtacctatttaggatatgattgtgagggaaccctcaatgcctcagtcaacttgtcagggcatgatgcgttgtactacattgtatattcttataatccggcaaaagctgtgtaccattgcgaagcgaagcccatgggtccatctcctcgcacgcctttgttgagccccaagtttgtggtgctcaagttgctagatgtgtaatctaaggctagattacatgtgtaatatacccctccaccccgcctccccgggcattgaagagagttncctggtgcctctgctatattctttttttcctgtgaggagataggctaatctatttcaatattaacatgtgatgctgcaacttgaatgaatttttttttccgaaaaaaaatatatttatatttaatacttatttaaatttgttgttatgttttttatgataaaatattatttaaaacgctgtgtgtctttgctataataaaaactaaataaaaatctgggggtagtttttaaaaaacatttttatacc

SEQ ID NO: 14121 - DNA, 839 bp, Saccharum officinarum
  Predicted polypeptide sequence is orthologous to G852, G2633
acaaaatatcttctagttaagtaatgcataatttttatacacaaagtagagtcgccatgtcatgactcttctatcctaaaatacagattcatcacgcaacaagatgctactagcaccgggtaatcagccaaactcaattattctgacaagcatacatctacgattaaggttcagttaacagcccagcggtcacatctttgtacagtctgcaccggaagctcctaaaatacaacaatactaatgcaactccatacgtgagctctaattctctattgccatgcggaggagacaatgagagtcttctccccccaaccgaagtgaaacccgccatgctcctcgtggaacttgtacctatcacgatatgaattcggtatccactttttcccgtggatgacttggtgttaaatggggctggtgtgaaacccggcattgtcattcttgctcctcatttcccagcaattcgtacctctccacacgaatcggaacttcacaagcaagatgtaacaatttctcgtgcagacatggccctcccattcattctattggggctctccttggaagtgttgctctagagaatcgaaaagcgcggatggtaatcgtagacttcacggaacctgtgcagaaacggtggagtattggtattgggcatcctgctcaaccagggtgcctagcttaggatggggtcccttccccatacgaaggagctgggccctttcattcattatttgaaccctctcttcaggaagatggggcaactggaatgaagaaatggacaacaggtgcttcaccgggaagaacatgcgggcttcgcggggttaaatccccatggttgccgccct

SEQ ID NO: 14122 - DNA, 807 bp, Saccharum officinarum
  Predicted polypeptide sequence is orthologous to G861, G1140
tgacaagtacaacacacattctaaaaacctggggaaagcagaagagccttcgctcgacttgaacttagaacatagcaaatacgcaaatttgaatgagcaacttgtggaagcaagccttcgactcaggcagatgagaggtgaagaacttgagggattgagtgttgaagaactccagcaattggagaagaacctggaaactggtctgcacagggtgcttcaaacaaaggatcaacaattcttggaacagatcagcgacctggaacggaagagtacacagctggcagaggagaacatgcaactgaggaatcaagtatcccagatacccccatctggcaagcaagcagttgctgatactgaaaatgttattgctgaagatgggcaatcctctgaatcagtgatgactgcgttgcactctggaagttcacaggataatgatgatggttcggatgtatctctcaagttagggttgccttgtgttgcatggaagtaaactgcaaaagaggctccgtgtggatctgggtggagctgcacggcctcagcggataggcacttgtgttctggtcttatggacgacccccgactactgcaataaacttgcattggaagcgagatcagttaacctgatttgtcatccttgtggcttcatgatgcgatgttccgcttgtaccgtttgctaagatgtttacttttgttcttatatcactattgtactggtcgtgaaatctatctactatgcaaagttacctatggcttgcaacttctctaatgttttactgaaaacagcggcaatgtgaatggcgcgccggt

SEQ ID NO: 14123 - DNA, 1011 bp, Saccharum officinarum
  misc_feature (1)..(1): n is a, c, g, or t
  misc_feature (3)..(3): n is a, c, g, or t
  Predicted polypeptide sequence is orthologous to G861, G1140
ncntacactaactggtctccgcagtacggtccggaatcccgggctcctaccagcctctcgactgcttccgaagcgcgccgcagatctactccaacacctctgctgcggcgccgccgcgggtggaggagcaagagagaggcacgatggccgggaagagggagcggatagcgatacggaggatcgacaacctggcggcgagacaggtgaccttctccaagaggcggcgggggctgttcaagaaggccgaggagctctccatcctctgcgacgccgaggtcggcctcgtcgtcttctccgccaccggcaaactcttccacttcgccagcaccagcatgaagcaggtaatcgatcggtacgactcccattccaagaatctccagaagtctgaagcgctgtctcagctgcagtcacatattgatgacggcacttgttcaaggctaaaggaggagcttgctgaaaccagccttaagctcaggcagatgagaggagaggagctccaaaggctgagcgtccaacagctgcatgagcttgagaagacccttgaatccggcctcggctctgtactcaaaaccaagagccagaaaatccttgacgagatcagcggtctggaaagaaagaaaatggaactgatcgaggagaatccaaagctgaaggagcaactgcaagtgacccggatggccaagatggagacgccacttggcgtcgattcaaaattgtgtttgaggaagggcagtcctctgaattcggtgaaaaaacattctattcgggcccattaacagaaactgacgaatggtcccatacatcgctcaagctccgggctaccattcttcagctcgaaatggtgggaatcaggaaatttggactggccccatggggtaacggagtggtgccaataacctgccccctcccctctaaattggggaaacaggattgtgggattaataaaccaacgggtttccatcaaatttaaggattccaagtggcgattgaaaatgggtattctcgaaaggg

SEQ ID NO: 14124 - DNA, 611 bp, Saccharum officinarum
  misc_feature (411)..(411): n is a, c, g, or t
  Predicted polypeptide sequence is orthologous to G861, G1140
aagacgaaagtgctatagtgtttattttactttaactcctcaaacctaacaccccctacagttatttagggctacaacagaaacacctccttcgggttttcccagctcctatattaccagtataaatacaatccggtactactacagtcctacagctactatatcttgatgaacaagctgtacaggaggggagtatctgcatgctagctagtgaccatcagcgcctgctatctaactgtattttgcttcgttttctgcctgttaaacgcaggaatcagtgtccaaatgcggattaatcaaaggttgccccggttgcagtagcagcaaccatgtgaaattgtgagtgaaacttcagagcgatgggcatgaagttgaagggacatctgagaaacaagctctggcctgcatganagcggcttcacatctcagggaaggcttctgctatagcgcctgacttgccatcttttcttggcagatccttgacagtgcttctacatggaaattttgtagctcttcaaggactttaacatctaggcccctgaagtcctcacccttcaatctggaaacgacgcttttcaattctttgcagcgcattctttcataattgtatg

SEQ ID NO: 14125 - DNA, 773 bp, Saccharum officinarum
  Predicted polypeptide sequence is orthologous to G878, G884
cagagaggatgatcttttggatgatggttatagatggcgcaagtatgggcagaaggtagtcaaagggaatcctcatccaaggagttactacaaatgcacatttgctggatgcaatgtcaggaagcacattgagagggcttcgtcagaccctaaggctgtcataacaacctatgaaggaaaacataaccatgaaccaccggttggtcggggtagcaaccagaatgcaggaatatcacaacagaaagggcagaacaacatatctagtaatcaagcttcacttccaagaccagacttcagcaatgctaaccagatgccgcttgggattttacaattcaagagcgagcaatagtaacagaaccttgctgctcactgttgtttggatgacgttcttttggcaaatatcggatgcctgcaattcgtagtcatatggcatcaaagtttcttaaagcctgataattgaaatggtatcggtttgcagttttttcccatagatacacaggatagccgatacggcaccatcatttctagtttgtacatgttattaagttcaaccatgcagaatgttataccagctaggtggaagttatttatatatgcttatgatgttttatagatggatcagtgatatacatgtttatcttctgattttattcccaacatccaacaagatcttgtatgtattgtaataagaatgaaaataaagtgaatgtacagatgtttttcagttaaaaaaaaaaattaaaatttataaaaagggcggcgctcttaagatc

SEQ ID NO: 14126 - DNA, 818 bp, Saccharum officinarum
  misc_feature (805)..(805): n is a, c, g, or t
  Predicted polypeptide sequence is orthologous to G881
gagaaaaaattataatgatttcatttgatcaatcagatgaacagttcgcctacaactacaaagtacaggggattgtacaatttcatgttgttttcctgtggcagtatttcgcatgtcgatcaccccggcgtgatgatctctggtccacgccatgtcaagccgcgcggactctgtttgttcctcttcctcgtgccgagctgcagatcctcatgtcgtctggttctgttatcgctgtttcgctctaacagtgaacagaggtggcggccagcgaattgccgcgtgcgtgcaagacaatctcagcaagaatctcgtgtgatgccaatcgacccgatgcgtctgtcaatccttggtgggcgacagctcgaggatgcggccggacagcgcggtgacgagcgccgccttgaagctggggtcccgcgtcagcgtcatcgccatctgctccgccaggttccgccggatcatctccgacgccgccgcgcccacgggctgctcgccgttcatcgcgacagcgtcctgctgctgctggtggtggtggagctgcatctgctggcggtgcggtcccggggcgaccgcagcgggccggctttgtggggacggcggatttcggacctgtgtttttttgtttgggggccgtggcctcctgatccgtctttgtgcattcttgcgcctgttggttatgattcctggtggggcttggccgattataattctacacattttatatggctaactatggttgagagtttctaaagtcatcgtttgatacttatttatgatttggggggtcatggactaatagataacnatgatgtatctca

SEQ ID NO: 14127 - DNA, 1003 bp, Saccharum officinarum
  misc_feature (608)..(608): n is a, c, g, or t
  misc_feature (611)..(611): n is a, c, g, or t
  misc_feature (640)..(640): n is a, c, g, or t
  misc_feature (922)..(922): n is a, c, g, or t
  Predicted polypeptide sequence is orthologous to G892
cagaaatctgccgccgctcccccgtgaaggcaacgccaggctcgggcgggccctccgctgctccacatctccgaccacaccggcggcaacgacccctacatcaccgccccgcctcttatcagatccagatcggtagctaccgcctcttcccggccacatccgcgccaccggagacgacatccgtggtgccggagacgaaccagtctgcagtctgcacaccttctctctgcaggagatgatccttcccggtcgcatctgctatctgcctgagatgatcccgtcccagccatggcaatccatccagcgatagggggctttgtgtggaggcaaagggatcgatatatattcagatgcgaaagttgggcatttttcggccggattgactactagtgctccagtaacgggcttttccacaacgtcgcgtcctccggccgccggcggactcattgattcgccaaaagtaaatcagctggacacctgatctgcgcacaaaggagcacctctagaatagctggtcagtggtcactgtggcatgccttgtctctgtgatataataagcaaattggaactaaacctttcataaacgagatgatgcccacttactgttnctnccaacagcaaactggcttcactatgcatnctctgtccagtaaaaaaaaagctgactcgtccggtcgccggtgagaccgtgagaaaagcttctgaccaaatactaaggcaatgtctgcttgactaactatatctgaggactgtgcataaggggtctacaataacatcaatttgacaccagtcatttggcatgccggggggctatgccccggcaaataagcatccagctatcgggatttgggaagaatactccctagaagttgcctgtaatgcaaccttgatggtttatactggaccaggccaacctaattgnggtttttggccaaccaccctttttccctggggaataaacgttaactgtggatatctaaggcttttgttaaaaaaaaaaggc

SEQ ID NO: 14128 - DNA, 990 bp, Saccharum officinarum
  misc_feature (622)..(622): n is a, c, g, or t
  misc_feature (634)..(634): n is a, c, g, or t
  misc_feature (642)..(642): n is a, c, g, or t
  misc_feature (650)..(650): n is a, c, g, or t
  misc_feature (757)..(757): n is a, c, g, or t
  misc_feature (825)..(825): n is a, c, g, or t
  misc_feature (828)..(828): n is a, c, g, or t
  misc_feature (831)..(831): n is a, c, g, or t
  misc_feature (842)..(842): n is a, c, g, or t
  Predicted polypeptide sequence is orthologous to G928, G931
gagagccatcaagaagtgtctggaatgagcgaaggaagcctcaacgagcataatgatcattcaggtaatcttgatggttactcaaagagtgatgaaaacaagatgatgtcagctttatccctgggtaatccagaaacgggttatgcacatccaaagcctgaccgtactcagtcctttgctatatcatacccatatgctgatccatactatggtggtgcagtggcagcttatggctcacctgctattatgcaccctcagctggtgggcatggtttcgtcctctcgagtgccattaccaattgagccagccgctgaagagcccatttatgtcaacgcgaagcaataccacgcgattctccgaaggagacagctccgtgcaaagctagaggctgaaaacaagcttgtcaaaagtcgcaagccgtacctccacgagtctcggcatctgcatgcgatgaagagagcccggggaacaggcgggcggttcctgaacacgaagcagcagccggagtcccctggcagcggtgtcggcggctcctcagacgcgcagcgcgtgcccacgaacggtggcctgttcacgaagcacgagtacagcttgccgccttgcgatcgccaccactatcacncgagaaggggcngcgcgtanggaaccancccccaactggcacttatcctttgcttatcagcgatttcgatcggctctttgctaaactgaactgaaactcgggtgtctttgcaactgtaaactgtgactaaactangtgttgtccgaattggcggtcgctcagttctaataacttgggacgctccgttggggtctggactaaanggntgnagtggatgccnggtgcgggaatgcttggttctttttggtgacgtaagcttggacttacgttgtgtgtgtgactaggggcgaaacttgcaaacttggcccctgtttcatggtaacttgctccaagaacaatacttgtataataaggaccgtgtttaccac

SEQ ID NO: 14129 - DNA, 1004 bp, Saccharum officinarum
  Predicted polypeptide sequence is orthologous to G938
tacacctgtaagtacaacgatccaatccctcagagcactgagaacaagccgccgccgccaccaccacagtcacaggccttccagccggccttcaaccaacccaatcaggcactgaacaatctggatttcagcctgcccatggacgggcagaggtccatcgcagagctgatgaacatgtacgacaacaacttcatgacgaacaagaacatgagcagtgacagcgtctccatcatggagaggcctaatgccatgccccagaggatccagatggatgagggtttctttggacagggcaacggagtcttcgacgatgtcaatagcatgatgcagcaacaacagcaggcaccagtgcagcagcagcagcagcagttcttcatccgtgatgacacgccattcgtgagccagatgggcgacatcaccagcacatcggaattcaggttcggttctggtttcaacatgtctagcaccgtccattatccaggcgcggcacagaagaacgacgggaccaattggttctactgaagaataaactcgtagggctgggaaaccttggtataaagccttggatttctccatggtgctccatggttctcctaagttgtcaagtctataaggtcttgtcatataggttttgcagtaactggaaaacggctggaacttggaactgggttatacttgtatgttcgtccagccattaaacctcttattgaaaacttaatgtattccttattttaaaattgttaaatcccaatgatggtcaaattatatgagctgtaaccatgtcgtgcctggtcccagtagacacaaaaataaaagaggggggccgctctcaaaggatctcaaactattgtacacggtgtatttgaaatgtcaacaccatctctatcagggtacccccaaatccaatcctccagggcctgctcctaaacacctctgtaaaggtgaaaccccctggcattccacaatttcttgggctggctcaccactccccttagaacagttgt

SEQ ID NO: 14130 - DNA, 623 bp, Saccharum officinarum
  Predicted polypeptide sequence is orthologous to G957, G961, G2535
agcagcagccgccttgccgccgccgtgcccgtgctcgttgttactgccgtgcttgctggccccgcctccgcccgatgactccttgtggtggtgcttcttcttgaacaccctgcacaccacccagccgtcctcctgcccgccgtccgacgacgcagccgcagcagcagcagcagcggcgaccgtggcggcagcggcggcggcagcatcgccggagccagcagcagcagggtcgtcaaggcggtactcatgcataatccagtcggacttctggccgtgcggcgcgcggcccttgtagaagacgagcgtcttgcgcatgccgatgcgcttgacggcgttgtagatggccttgtcgcggccggtggccttccagaacccggcggcggtggcgcggttcgtgcgcgtccccgttgggtacttcttgtccttgtggctgaagaagtaccagtcgttctgggggcccgaaccgatcttgcatttctcttggatgtcccatggctcgagcttgttgaggtcgacgtcgcggatgacatcgaggtcgatctcctgggagggcaccttcttgcggaggtagtagttgagcagctcctcctccgtcgggtggaacggaaccccggcggcacgca

SEQ ID NO: 14131 - DNA, 770 bp, Saccharum officinarum
  Predicted polypeptide sequence is orthologous to G958
catggattaatattgttttatgataaattataagattatttatgataatataatttatgagaaggtattggttaccttgatgagatataagaaatatgaacttgaggataataactatgcaacttaatttggtaaaatcagactaatcttgacatggggcgagtgaggggtatttcacatggtgtggattacccttttggcaggttcgcctggtaagggtttctgttgggagatactcgcctcggtcacataaggaccggttcatttgccatctcgcctagccagaatttcgtacagccacatgtctatatgggtagacttgatctcacaccccgttagatagaagtataatttttactaggaggccggagtggcaacagactaacagaagaggacacgactgctgtgtgatctaccgtggtctgatcgggatggttgttttgtgctcttccatgtaaaatttattgttgtgccgtgtgcgagcaccctttttattattaaatctggatgctttgagatcattcaccggatgctgtgtgatatccaaccactccgtatttaaggaagttgagtaacatcctgagcttgtgggttatggtccctaaatgtttcgagtgggattatatgtaaatctaagggtccacattcgggtgcgaggtgatgttcgtctagacaattcaattgctttgtggtggcattgtcttcaggagggaaattattcacctttcagagttacagattgattgcataacccgattttgaattgaaac

SEQ ID NO: 14132 - DNA, 893 bp, Saccharum officinarum
  Predicted polypeptide sequence is orthologous to G1017, G2567
ctcaatttggtttacccctaacagaccaccagcttagcaagctgcacctcggtcttttccaaggcggtggttttaaccggcttgatgctatcactccgccatcccatatatccaagggttttgtgatcagcagtgcaccagtcaatgagagtgtctcttgcttgttgacaattggcacaccacaggccacagagaaatctgatgacacaaagaaaccccatataatgctgtttggaaagccgatccttactgaacagcagatgaattctagaggatcaagggaaacattctcccctgagattactggaaacagttcttctgatggcaatgttcagaagacaggaaatgtatctgatggttctggttcatcgatttgcatcggtttctcatcccaaggttgcgaggcttctgagcttgggttagaagcccggcactgcaaggtatttatggaatcagaggatgttggtcgcaccattgacttatctatctttggttcatacgaagaactataccgtcagttagctgacatgtttggaattgagaaggcagaaattatgagccaactttgttaccgtgaagctgctggtgctgtcaacatactggcgaagacccttcagtgacttcatgaaagtagcacggaagctccccataattaaaaacaccgaggggagatgggaaaaacctctcctcaattacttaatggaacggggtttattggcttaatgggtcaattaagcaatctgaacttttggaaaacccaacttgaacgaataactggcgggttgcatttgtgttttctgccggaaacaaaattgcatgtttgtctgttctcttggaaaccttgggtccggatttcttctgtcggacttggtccttaaaaccctgtgaaaaca

SEQ ID NO: 14133 - DNA, 1373 bp, Saccharum officinarum
  misc_feature (6)..(6): n is a, c, g, or t
  misc_feature (9)..(9): n is a, c, g, or t
  Predicted polypeptide sequence is orthologous to G1033
ttggcnctnccaccctcgcagccccggccgccaggcaattcgcccctttttcgcccggccgcgggcgggattcgctccgccccgcgcggggctgaccgctgcgctccgtgtcgccgctccaatccgccatgaagggggccaaatccaagggcgccgccaaggccgatgccaagctggcggtgaagagtaagggagcggagaagcccggccgccaagggcaggaaagggaaggccggcaaggaccccaacaagcccaagagggctcccagcgctttcttcgtattcatggaggaattccgcaaggagttcaaggagaagaaccctaagaacaagactgttgctgcggtgggaaaagctgccggcgacaggtggaaaaccctcaccgaatcggacaaggctccctatgtagccaaggctaataagctcaagctagagtataacaaggccattgctgcctacaacaagggcgagagcaccgctgctgctaagaaggctcctgccaaggaggaagaggaggaagacgaagaggagtccgacaagtccaagtcggaggtcaatgaagaggatgacgacgaaggtagcgaggaggacgaagaccatgacgaatgatggagctcgctcgagacgatggaccaagctttgaccaacaatggagctgcaacaaaaggccccggtggcgaaaaactataaggagccctaatccaagaactaggaataagcaggctccattcacatcgtgacgatataacttcgatgggccgcaacgaaagcgcccattgtgggcgcaccggcgctgggcagctgatcgactgaaagatggccgtagaccgaagaccggaacaaggagaacaggtaacataggaaacccgctggggaaggcgatcaatacgaaaagaaaaagagggtcaagagaagatcaactaagaacagacatcgcaaatacgatcactagagcacgaaagtaaaacaggcacagatacacagcatccggcacaaggagagccgactaagcctgcaagagacacatagccgcggccatacaaaagactgaagaagactatacacggggccaccgagactaggcacccctgaacacacaaacgagacgaaggaggaccaaaatgacagaacgcaagcaaacgctctcacagagtaccagtaagaacggagcggtatcaccaatcacacaggtctctaagatcaataacgtagcgatacacaacagaaaagagggtggccacaggcgacagtcaagacatagctctgaggtcaacctgcaaggacacagcgactggatacatcaacaatctattctaagaagaacgtgcacgcgatagatcggtacgaagcctatataaagcaccacgcgtgcg

SEQ ID NO: 14134 - DNA, 634 bp, Saccharum officinarum
  misc_feature (384)..(384): n is a, c, g, or t
  misc_feature (478)..(478): n is a, c, g, or t
  Predicted polypeptide sequence is orthologous to G1033
aatctaacattacccaaactgatattatcacaatgttagccgatgacgacaatggaaacagtaatctaggtacaagcgggcaatctgccagtgcggagcagcagacccacccgccggtggcgcccaacaaggagcgctatccgttatagcacaacaaaagtaaaaacatcacgatgtgaagtgaaactgaataattctgtacatggatataggctccttatagtttttcgccacggggccttctgttgcaagctccattgttggacaaagcatggtccatcgtctcgagcgagctccatcactcgtcattggcttcgtcttcttggtaccctcggcggtattctaatcattgacctccgatttggactttgcggactccttttnggtcttcctcctcttcctccttggcaggagccttcttagcagcagcggtgctctcgcccttgttgtaggcagcaatggccttgttatactctancttgagcttattacccttggctacatagggagcctttgcattcggggggggatttccaccttgggcggggagtttttccaacccaacaacaaactttgtcttaggggctttttctccttgaacctcctggggaaattcccctcttaaatccaaaaa

SEQ ID NO: 14135 - DNA, 1227 bp, Saccharum officinarum
  misc_feature (42)..(42): n is a, c, g, or t
  misc_feature (481)..(481): n is a, c, g, or t
  misc_feature (927)..(927): n is a, c, g, or t
  misc_feature (973)..(973): n is a, c, g, or t
  Predicted polypeptide sequence is orthologous to G1033
taaactgataccctgcaggtacggtccggaatcccgggtcgnaccacgcgtccggcaacgcagacctacacacggttccgtgcacacacccaaaccggcaaccctcgtcgcgatccggccccaaggcctctagatgaaggcgagggcgaggtccatcggcggcgactccaggctctcggtgaggaagaccaaggctgataaggacccaaacaagcccaagaggcctccgagcgcgttcttcgttttcatggaggagttcaggaaggactacaaggagaagcaccccaatgtgaagcaagtctccgtgattggcaaggctggtggcgacaagtggaagtccctgtctgatgccgagaaggctccctacgtctctaaggccgagaagctccaggctgagtacaccaagaagatggacgcctacaacaacaagcagtctggaggccccacagcgtctggtgattctgacaagtccaagtccgangtgaacgacgacgacgaagagggtgacgagtgattgatgacggatggaggagctctcgccctgcccaagtgcttgcagtcagtaaggaaattctcatcgtcgtgggccttaacggggctttgctgctcctttttaaccctctggaaaagctgtctggtctttccttagattgccattagaacttagttaattagttgggccgcctcccgcttctcctgtaaattttgggtaagtttggcacaaatttgtttggttcccctttgaaaaatttgaattgccacttttttaaaaccttgggtttaatgtgttgtttccggccttttctttccgggcaacctttggggaacccggttgggttggccaaattgggggattggtttaaaaccccttgcaaattctttaattttacccccccaaagccattcttatgtattggcctgggtttntaaaattcttccagattcttcactaagatatgcctgtgttttaacnacaaaacaaacactccccttcatcactttggaacccctgtacgtgtgtggccttattacaccacattttcaatacttcaaaaggggcgggccgccctctaaagaatccaaactttacttccccttgtttgtggaagtcaatacccctcttaataggtccactcaattacaatccacgggccgcgctttacaactctcttacggggaaaacctgggtttcccatttaacgccttggagaaatccccctttcacag

SEQ ID NO: 14136 - DNA, 845 bp, Saccharum officinarum
  misc_feature (67)..(67): n is a, c, g, or t
  misc_feature (436)..(436): n is a, c, g, or t
  Predicted polypeptide sequence is orthologous to G1033
atttcccaggggaaccagaccagagcattcccctccgctccacagtccctgcgtcactgcaccctangcctcagcaaaccctaaccgctcgtcgccatgaaggacacctcgttcaaggccagcggcgccaagcgcaagaaggccggcggcgccaagcgcgggctcactcccttcttcgtgtttctggctgagttcaagccgcagtacctggaaaagtaccctgagctcaaaggcgtaaaagaagtgagcaaggcggctggggagaagtggcgctctatgtcggatgaggagaaggcgaagtatggttctagcaagaagcaggatgacaaagcaagcaagaaggaaagcactatctccaagaaggccaaaactgatggtcgggagggagagaaagcaacaaagtccgaggttgaggatgatgatgagcacgatggtnatgacgatgaaaagttaatagtacgatggggaacagcagctttgcaattgggtgtttgcttcttcttaacttagcctccaatgtgttggtccttttgaaggtatatgccggaaggaaaatcttgtcatgaaggaacccttgggcctattgcatgcttgaatgcccgttttaacttgaaagaaccggaatctccttgccagcctcttcaacattgtgtaaaactggtgatattttttggtatatacgacatattaggtgaccatacccataattgggtttgcgacacttcgcattaaaaaaaaaaaaaaaaaaaaaaaaagggcgcgccgttttaagaaacaaacttaatataccgtgctgcgaaataaaaatttttaataggtacctaaattaattacctggcgcgtgt

SEQ ID NO: 14137 - DNA, 666 bp, Saccharum officinarum
  misc_feature (485)..(485): n is a, c, g, or t
  misc_feature (554)..(554): n is a, c, g, or t
  misc_feature (560)..(560): n is a, c, g, or t
  Predicted polypeptide sequence is orthologous to G1037
caagctccttgagcttgtagggcttgagatggacctacctgtcatcatgttatcagtgaacggggagacaaaatctgtgatgaagggtataactcatggcgcctgtgactacctcctaaaacctgttcgtatcgaagagcttaggaacatatggcagcatgttgtcaggaggaagttcagtaagcgcgaacgcagcaatcttgacatctacaaagatttcaacaagttaccaagcacagatccatgccacggccacaatcagatgattgctggggcttctgaccagagtgggaggatcagcaagaagaggaaggaaatgcatagcgacgaggaagatgacggcgaggagaatgatttccaagaaggtgatgaaccctcggctgctaagaagccaagagttgtctggtcagttgaactgcatcggacatttgttgcggctgtcaaccagctcggaattgatagtaagaactgtccaccctcccttntgctttatgttattgtccttacatattgcagcaactcatctatgttttgtcctttattctgctgttgtngccaangctgtcccgaacagaattcttgagctcatgcatgtcgacaaaccccaccccggaaatgtcgcgagccatctacaggtttggccttgggatgcacttcctcctctgt

SEQ ID NO: 14138 - DNA, 858 bp, Saccharum officinarum
  misc_feature (812)..(812): n is a, c, g, or t
  Predicted polypeptide sequence is orthologous to G1048
gcaccaggtcgaggggatcagcgtggatcagttcttcgacgcgctgtacgacggcggggaggggaaagatgagggggaggcgggggcaagcacggatgcggactctggcagggacgaggtggtggaagtcgtgacgccggagccggaggcggagatggagacggtggaggtggatggcgatgatcccgtcagcaagaagaagaggaggcaaatgaggaacagagattccgcaatgaaatccagggagaggaagaagtcgtacataaaggacttggagacgaagagcaagtatttggaggcagagtgccgccgcctcagctacgcacttcagtgctatgctgctgagaacatggcactgcgccagagcttgatgaaggataggcctgttggtgctcccacagccatgcaggagtctgccgtactcacggaaaccctgccgctggtttccctgctttggctggtgagcatcgtctgcctgttcctgatgcccgttctgcccaaccgaggtccagctgctccaagcagcggcggaagagatctcgtgatggcagccggaaagacaagcagtgaaaccttagagatactggaactcatccttctatggaaggcggtggcagagcacgagagccaagattaactacatactttacatttattgcgaactgttgctagtggtaggttttaggctcttgaagcttaccggagaagggacttgcgatggaaacttttcttaccggcttatgtctttttcatctaatcagcaagaacccttctcttacctaatcttccgaatcctacaaccttataaaatntttatccctcttatcccggaaaaaccactggcctttttttaaaggg

SEQ ID NO: 14139 - DNA, 880 bp, Saccharum officinarum
  misc_feature (803)..(803): n is a, c, g, or t
  Predicted polypeptide sequence is orthologous to G1108, G2394
agccccgaccccgatcgcctcacctctgcacgccgcggcgcgcgcgcagtgtccactggcacggccgccttccgtctgtgggggcgcatctggtgctagctcgccgggctagggttggctttaccctcgtctaccttttccgtctcgtctgtgggggcgcatctggtgcacgcggtcgtcgtctctcgctccggctgtgactgcgcgccagccccgcttgcttcgtcctgccacgggagggccactgctgccgtcgcgtccaccggctaattctcctacagagcaactatcttggagtttgagatctatacctgaagattcatttgaaatctggaagcttcttttgttgggtacagagaaatatttcccgctttttgaggaagactgcagagcttctaaatgtgaaacttgcttcttttcttgtctactcctgaatgctgatgaactcagcctgtcacgttacttagctcaaggtcatactggtacgaacgctgatgatggagcaagcaacaggtgtaagtggtcctgagcacataattgatattccaagggcaattggtccttctgcttcggtttctcaaagtgttggtagagagaaccatgaagaattgaatcctgtggacaggccttcaacaagagctctagtacctgccttgcaggcaccatcagcaataggtgccgtaactaatgcagggcagacttcaggcactcggagaaatgacaactatgttcgtcggcacagaagccctttgaattctggactgtggatttcaattgaagttatcgtcaatgtgagccagatngtagctgccattgttgtccttggtctggtcaagaattggaacaccacaagctccattacttgagtgggtccatagtt

SEQ ID NO: 14140 - DNA, 682 bp, Saccharum officinarum
  misc_feature (621)..(621): n is a, c, g, or t
  Predicted polypeptide sequence is orthologous to G1146
aaatgatcgccaatggacagacaggagtggaaatattctacctggcactgtagttgataagaatatctgccacccaacagaatttgatttcttcctgtgcagccatgctggtatcaagggaacaagccgtcctacgcattaccatgtgctgcgagatgacaataagttcactgcagatgctctgcagtctctcacatataacttatgctacttgtattcaagctgcactcgctctgtgtcaatcgctcctcctgcatactacgcccacaagctagcattccgtgcccgcttctacatcaaccaaggctatgatacggcgacaagtgtgggctcttttggttcatctgctcctgctgctgctggtccgaagccacttccggagatcaagggtgaactgaaaaggctcatgttctactgctagtccgtgaccactgaaaacctcctgaacaaggctttgctactgaagtctcaagtcccttgactgctctgaaggagacttggataataacgtctgcacttggatgcattattctgttcgctgttccttaaatggataataacgtctgcacttggatgcgtttttctgttcgctgttccttaaagtactgctataattgcagngactgcttggttgtagtttgtggtttgaattttattttataaacaaatgaactttttgctt

SEQ ID NO: 14141 - DNA, 542 bp, Saccharum officinarum
  Predicted polypeptide sequence is orthologous to G1146
gttctaaactctcaccaagttgcagacatctccctaagttgatagagttagatgatacaactagacaataactacataggaaaaatataaaaatacaatggatattactttgccacatgaaaataactccaaacaaaataccattgattcaaagattgcttggaagtaggcaatttacatagcataatgtcaagtacataaagagcctcttgaggagcgtctagttgcctcccagctagaaacatagccaaatggttactgtgagcatgcagagaagggtgtttctagatcttgttaacaccatatacacttgtcaccatttgtacttcaaagtttttctgaaccatatcacataattttaaatacaccactactaaatggagtttaaaaaattgactattatctctaaaggcagcaacacaccatagaaccagtggaattctagacatgttaatcttgttgaggggattggataattttcaagatgttctccccctccaaaaattaaatttatcagaaattaaaataaggttattacaacc

SEQ ID NO: 14142 - DNA, 847 bp, Saccharum officinarum
  misc_feature (3)..(3): n is a, c, g, or t
  misc_feature (9)..(9): n is a, c, g, or t
  Predicted polypeptide sequence is orthologous to G1146
acnaccggncttgaattaccggcccgagccacgcgtccgtgaagcaggagtggaacaacttctatcggaatgtgcaagatcgtgccgctaggggtcttggtcatgagctggcagtcatgtgccaaatatcacgaatggattttgctcttgagtctgtgctgcctccagtgactgcaaggcctgaacatgttgaaagagcgttaaaggcacgttatcaagatgcaatgaacatactgaggccacagggcagggaactcgatctgctgattgtaatactgccagacaataatggttctctttatggggatctcaaaaggatctgtgagactgatcttggattggtctcccagtgttgtctgactaaacatgtttttaagatgagcaagcagtatcttgcaaatgttgcactcaaaataaatgttaaggttgggggaaggaatactgtacttgtagatgctttgacaaggagaatcccccttgtcagtgacagaccgaccataatatttggtgctgatgttacccatccacatcctggagaagattccagtccttccattgcagctgatgatgcttcgcaagactgggctgaggtcaccaaatatgctggactagtgagtgcccaagcccatcgccaggaacttatacaagatcttttcaaagtatggcaggacccgcataaaaagacagtaactggtggcatgaaaaaggaacttttcatttctttaataaggcaacttgacagaagccccaaggatcttattctacaagattggtgtaaataagggacagttttaacactttttgtgaaagaaattgaggcgcctccaaagggctgtgtccaccttga

SEQ ID NO: 14143 - DNA, 972 bp, Saccharum officinarum
  Predicted polypeptide sequence is orthologous to G1146
ggaaaattaacttcggcggtgcattacggtgtgccagcatcaccaaaacagtgcaggtacttggaaaaatattcaggtcttaggtaaagcatgagcgcagcgtcaatcttagcagtagaacatgacgcgcttcacattttccttgagggcaggtaatggcctcacagcaacattcccaacaccagccctggtgttgcgtgcctctggtggagggccacggcttggcgtagcaccgctcgccatagacccactgtcagtggtatccggctccatgtagaagcgagctcggaaggctgccaggtgagcatagtacgcaggaggtacgattgatactgagcgagtgcacctagcatacgtgtaacacaggttgttggtgagagtttgcaacccatcagccgtaaatttgttttcatcccacagaacatgataatgggcagggcggcttgttccctgaatgccagcatggctacagaggtagaaatcaaattcagttggatggcagatctttgagtccactacagtaccaggcagtatgtttccacttttatcaacagcacgtgggtcattgtgattattagcaaacaacctagtgtgatgacgcttctggaccacaacaaaagtaactggaggctggtaatcccgacttcaatgatgcacaagcccttctaaatggcattaagttcatacaacaaaacttgggaaaactgtccctcactgacaccatccctggagaatatgaccccttttggttctgtccaagtggccgccaaaaagaaaggaaaagtccctgaccatgccaccaaaaacagaccctttggggaacttgattaccttgaaagaacctggttaattttggggatgggcttggacctccataaaccggcatactgggaaccctaaggccaccctggaaagcaacaaccgctgcaagggaaggactttaaactttcccaggaggggggaggggtccat

SEQ ID NO: 14144 - DNA, 621 bp, Saccharum officinarum
  Predicted polypeptide sequence is orthologous to G1146
agagccatcagtctccactgtgactccgtgagctgcctgccctgcacactccccgcaccgccgcaccagctcagcaatcatggctcgcctactcctcctcgccgccgccgcagcggcgttcctggccgcgtcggctgcatcgccggtggccagcgacttcatccgcaagtcgtgccgcgcgacgcagtacccatcagtgtgcgagcagagcctggcgtcgtacgggggctccccgccgccgcggagcccgcgggagctggcgcgcgcggcgctgtacaccagcgcggacctcactacatccattgctgcctgctgttgcttctcaagactgaccagacgttacgaaggatgcttgatagatttggactcaggcacaccggcaagagctgattcaagacctttacaacacataccatgatcctcagagaagcgctgtaacaagcggcatgagcatggaactctgaattgccttaaggagtgcttctgggcagaagccggtgagaataatgttctccgacgacagtaggacttgagaccagttggaccgaattgctccctttgcaaggagcaaacgcatgcccaacatcatgtacgttcgcgtggaaccgagttagccagccg

SEQ ID NO: 14145 - DNA, 621 bp, Saccharum officinarum
  Predicted polypeptide sequence is orthologous to G1150
atgtacagtggtttttattactagtacccggcgatcattaccatgggcatatgcatcgatgaatggttccataaacaacaaaatatctgtgtattccaactatcgaataacatatctaatacgtctggcctccttagtcatagactcacaattacataaacccttgggcaaaagattcttattgagtacggcaaaactatcccggctcctccgatctgatcgggttggagtttcccaactaaccgattcttcgggaagaaagaatagaaggtatcatgcatatcttggtcggggctcctatccgacgatggcggaataagcgcctggatctacgactacgtctctttctcagtcttactcgtcaactctctgggttcccgatcgaccgaatctagtgttgagacattcttatcctcatgagatcctgacggaggccacggacgaagaaaaaggctgaaactcggggaggtggcgcacgagggcccaactcttggtcttcacatcgaacaaccacagggcggtgccgccaccaccgccctcgccatcaagggccccggtccccgcgaacctttttgttcctccaccggagggcaaagaacggggggggcgatccgaccctta

SEQ ID NO: 14146 - DNA, 686 bp, Saccharum officinarum
  Predicted polypeptide sequence is orthologous to G1190
tggacatgaacaccgtgtacggaggcttcgcaggcagcctcatcaaggaccccgtctgggtcatgaacgtcgtctcctcctacgggccaaactccctcggcgtcgtctacgacagagggctcatcggcgtcaaccacgactggtgtgaggcgttctcgacatatccacgcacctatgatctattgcatcttgatggcctgttcacggcggagtctcacaggtgcgagatgaagttcgtgctccttgagatggaccgtatccttcgtcccacgggttacgccataatccgggagagcacctacttccttgattctgtggcacccattgccaaaggaatgagatggagctgcgagaagcatagcaccgagaacaaggctgacaaggacaagatcctcatctgccagaaaaagctttgggcaggaaagcagtgacgacaagagaatcatccaggttataacaagtagtaagtagccttaacctggatggatgatgcgtaaaatctgctgcccaaaggcatcagtcagagctcgaatggatgggcctgtgatctcggccacaaaaagggcagaggcgctttcactgtgcagtacacatgggaagattgaccgacgactcttgataaaacttcaagaacggtccaaaattattcaaattaaattaacctgggttaaacctccatactagaa

SEQ ID NO: 14147 - DNA, 655 bp, Saccharum officinarum
  misc_feature (505)..(505): n is a, c, g, or t
  misc_feature (640)..(640): n is a, c, g, or t
  Predicted polypeptide sequence is orthologous to G1206
gttcctcgtgcgatgagtatgacaaaagcagcagcaagaacatgtcactgctgtgggataaagaaggcagcgcgtgttgccaattgcaagaactgtgataagaatttctgtaacagctgcattaataaatggtattctaagttgtccaggaaggatataaaggctcgttgtccagcttgccgtggtctctgcaattgtaaacaatgcagccttggtcataccaggggtgctacgcaaaaggaaccgccaagtggtgaaaggaagatactcagcataaaaatttccaaccatcaattttacaagcttttacctgtaaaacttaaccaggagcagcttgatgagttggaattagaagctaaaatacaaggaacaaaaatatctaatgtccgcgtccaggttgctgaaaatggtcagaatgagtcactctactgtaataactgtaagctctctgcgagccaattcttgagatgctgcccaacatgccctttcaagctgtgcctaagtngctgtcagaagatacgtgaaggaaacatgtcggacagcacacccgaagataaattcaagaacaggctgcttcaacaagagtctgtccatgaggatggcagcataacttgcccttccattgagctgggttgctgcngtgaccccatgctga

SEQ ID NO: 14148 - DNA, 799 bp, Saccharum officinarum
  misc_feature (450)..(450): n is a, c, g, or t
  Predicted polypeptide sequence is orthologous to G1242
atgctaaagttttcaaggagagatacaaagaactgagtgattatgatagaattataaaaaatattgaaaggggggaagcaaggatatcccgcaaggatgagattatgaaggccattgggaagaagctagaccgctacaagaacccatggttagagttgaaaattcagtatggccaaaataaagggaagttctataatgaggaatgtgaccgctttatgctttgcatggtgcacaaacttggatatggaaactgggatgaactgaaagctgccttccgtatgtctcccttgttccgatttgattggtttgtgaagtccagaactacccaagagttggctaggcggtgtgatacccttatccgactggttgagaaagaaaatcaagaatatgatgagcaagagaggcaggcaaggaaggagaaaaggcttgctaagaacatgactccaacanagcgagcagcactaaggaattcagagggtgagaatactccattgagttcattcaagaggcgacggcagtcccttatggacgaatatgtgggctcgggaaggcgaaagagagggtgaatgtgatgcttttggagcttgccggggatgcagtcactgcaatgctttaagcccctttgcctgcagtgcttaatttcttctgcgcgtgaataaaatgccttaattgcaggtgactttgtaatggtaattatgcaattataacattgggttagttataaatcccaaattgaaaaatgttttaaccttcctgtggtaaggggccaaaaacccggacttttgcaattcctactggt

SEQ ID NO: 14149 - DNA, 1024 bp, Saccharum officinarum
  misc_feature (601)..(601): n is a, c, g, or t
  Predicted polypeptide sequence is orthologous to G1246
ggggggggtttttaataacaacactagctctgccaatcctgttcactcatctaacacaatacactaaaaacatctccataagggaggtaaataactcgtggcaaatattcactaaatgggactccacaacaaattgaaccatctacaaccaccgtacaacacactaacatcaccgagaactctaactcactacgcactaaggcccgcaccacacataatctaactaacccaccctctggtcttatacccacctcgttgctgcttagcaactctagaactccgaaccaccttctctataacaatagcaaccgccctcgacaacaccgtcaacctcaccagattcttcaccttaagaagaaagttccgtcaacttcctctttaaccttgcctcaccctcggccggcaggctcctcttcctcccaacattctgaacacctgggacaacacccctgttctcttgctccccgccaatagacacattcctcgtgccccctttcctcttctttctcattgcctgcttcaggagcccttccagaggaaaatgaaaaggttctcaccatcaggctccttcttgttcaaggcgctctgagcttcctcaganaacaaatacacataatcaccccaacccaaataaccttaaaaaaacataaaactatcacaacactccctttaacaccaaatcatcaccaaacaaatacaaacccacccaccacataacttttgtcttcctgaccccatcaaacttcacataaaaaaaaatcctaacataaaaactaacaacactaagcaccagacacaccatctgtttccaaaaacaccactagtcacactatccacgcccaacacaagccacacacaaccaaacaacccggaatccttagatcccctcacaccataacccaccaccaccccttaagtaataaactttacacaaacaaacaccaaggggtgatccgtgtccctccacacctagaacaccccatcactttcaaacgctataattccccacaacaacaccagccca

SEQ ID NO: 14150 - DNA, 762 bp, Saccharum officinarum
  misc_feature (500)..(500): n is a, c, g, or t
  misc_feature (518)..(518): n is a, c, g, or t
  misc_feature (607)..(607): n is a, c, g, or t
  misc_feature (616)..(616): n is a, c, g, or t
  misc_feature (622)..(622): n is a, c, g, or t
  misc_feature (629)..(629): n is a, c, g, or t
  Predicted polypeptide sequence is orthologous to G1255
tctcggcgttaaccttgcgcacctcgtaccggatcttcttggcgaacagccgcgtccgccgcttctccctgtaccgcgacacccgtgcctcacgctcgccgccggtcaccgcggtcacggcgccgccgaagagtcccctgcttccggccgggaagtcagaccataactcgtaaggatcgaggtgaggacgctcgccgtggaaccacggggatccgccgtcacggacccacgaggcgatgacgccctcgtagttgagcttgagtatcatctccggccgcttccttttcttgtcctctcgttcaagcgccggcgccgccatggccaccaagtccgcgtccgcgttcacctgaggcttctcttcgtccaagaaacccagatcatcaaacccgtcgttgactcccatgaggaggctctccatgtccgccgcgaagctagcgagctccatgtccgggacgtcgaacccggccgagagcccgtccgcctccgccgagccgccgtangcgaactccagcgatgtntccacgagaggcggcatcaggcaagccggcttctgctccccatcgtcggccacggggttgtaaaactctgcgagcggcttctgctcccnctcgtcggncacggngttgtanaactcggcgagcattagggtcgaacacggcacgccgtacagaaagtcctcgtcgtcgtcctggaacccgtgtccgtcgtcgttatcgcccacgatgccggaccacactcctccgcctccaagtcggggacgct

SEQ ID NO: 14151 - DNA, 963 bp, Saccharum officinarum
  misc_feature (467)..(467): n is a, c, g, or t
  Predicted polypeptide sequence is orthologous to G1272
cagcgagaggatttgcaaagaacaaacgtttccgctgaggcagagaaatggtagcaacggagatggtgataccattgaaatagctgtctatgactactatgcgaagaaaggaattgatctaaagtattctggtgatttgccctgtataaatacagggagggcaaagcgtccaacatattttccaatcgagctatgctcccttgttccgcttcaaagatacaccaaagctttgtcaacgctacaaaggtcatcccttgttgagaagtctagacagaagcctcaagaaaggatgacagttctaaatgatgcactgcaacgcagtaactatgattctgaccccatgttgagggcatgtggcgtttcagttgctccaaaatttacccaagttgaaggaaggatccttcaagccccaaagctgaaagccagcaatggtgatgatatcttctcacgaaatggacggtggaatntcaccaataggaagtgttatcaaacctgctctgtaaataagtgggcggttgtgaatttctctgcacgttgtgatgtccggaatcttatccgtgacctgatgaggaatgcatctgcaaagggaaattcaaatggaggaaccttttgatggtgtgtggaagagaagtcctcctatgaaggcgtgcacccctggtccaaaaagagttggatgattttgttggggggcaaattaaaatctccaaacttcccgggaagctccctaaagttcccctccatggttgtcctcctcccctggaaaagggaaacaatttgccaaaagtcctaatggttcctctgggaaaaagaaaagtggccttggccccaagttgtggttatttgtccacccacagtgttctaacctccgcaacaaaaagtgccagggatccgggaccccgggtttaaattggcggggatgagaaaattaatggcaaaccctgtggggggcctgaaaaccccggg

SEQ ID NO: 14152 - DNA, 676 bp, Saccharum officinarum
  Predicted polypeptide sequence is orthologous to G1341
gctgtattttcatttttggattgaataaccagagctgagctttttcgaacctgcatccgagaagagattatctctaccaaaaaggaaaagacggcctcgagatcaattacttggtgtaaatgaatcttgatgggatttatgcgcctactactactatagtgccattaaaaaatgataacagccacacaaaggttgcaaggtatttttgttactagaaatctaggactgtatacattttatacagtgaggcaacattgcttcaggtcagcagcctcttcacgtcgagggtccggtctgagcttcgcttgaagttgtacaccgactcaaatgcctccatgcagacgctggcaaagcccgtcatcgcctggaaaacgttagggaagccagtctgcaggttattcaaggtcattgctcttgtgaccccaatgctcttctcatacttgctcttctcctcatcggtgcggctcctcagagtctcaacctttgcccgcttgtcagctactggtgattttcgtgacatttctctgtaaccttcagcaccaatatatgacccatattttgactctagggatctcagctcctctgccttcttctcaaattctttgaatgcagactctgacctcttcttctgcttctgttcctcagcttgttgaatgacaacaggatggatcactgt

SEQ ID NO: 14153 - DNA, 673 bp, Saccharum officinarum
  Predicted polypeptide sequence is orthologous to G1363, G1782
acaagaaacatgagattatttctgtatccacattatatcaacaagtagcccttccttgagttcagtcattcagtcacaataaatatcaccgagttaatctgagacaagctccatatatgaaactgaaagcgaaagcaaattattatatataagatacatcataagccaaggatgaattgccacgggcacaccggagcgcgccagtgatggtaccagcacctccacagtcgaggctattcacctcacgacaggggtgtggtgacggacgccattgacggccatcttttcacctccattctccgcgtggaagttcatgctggggaggaagttagcagatgcgaagctgatgtgctcttgatgagccagcatgccactcccgtttgaaacacttgagatcccagagctcgtcgaaggcgagtgagatgtgctgctttcagtgcataggttcctgccgaaggccattttgctgctgaccccgcctgttggagtctgaagtgaaagcagagccttctgctgctgtcctggagctcctttttggtgaagaaaagggcctctggttcacggactcgcttcattgcatgacgatggcgagattcatggagatatggtttccgaacttttcacagtttattttggaggctcccaattttgcacgtatttgcctcctccggga

SEQ ID NO: 14154 - DNA, 552 bp, Saccharum officinarum
  misc_feature (1)..(1): n is a, c, g, or t
  Predicted polypeptide sequence is orthologous to G1380
nttaagtaccgggtccacccacgcgtccgtccggagctccacggcagcaaacaagttggataagagaaggcaaggcaagaagcctgcgagcggcgacttcgtgcgcgacactccggattactggtccatccatggcgcccaagagatcgacgtcgccgaccggaagcagcagcggcggcgtgcgcgcggcggcgaccgagcaaccgaggctccgcggcgtgcggaagcggccgtggggccggtacgcggcggagatccgggacccggtgctgaaggcgcgcgtgtggctgggcaccttcgacacgcccgagcaggcggcgcggtcgtacgacgccgacgagcgcaggctccgcgggcccggcgccaccaccaactaccccgccgcctcggagccgatggctccagcggtgagcggcatcgcaagcgggagcgccgaggagtacgagtcgccgtcgtagacgtcctcgtgctccctgctgccggagtctgtgacggcggcggtcgaggcgccgcccccgacgctggacctcaacctggcgctgccggcttttg

SEQ ID NO: 14155 - DNA, 869 bp, Saccharum officinarum
  misc_feature (667)..(667): n is a, c, g, or t
  misc_feature (759)..(759): n is a, c, g, or t
  Predicted polypeptide sequence is orthologous to G1451
agatatgaagtcgcatgcatgcatgcgtacgttaggatgcattctcatagggcgcccttgggttttttttttgagcaaaccaggcatgtgattgccgtgctaagcaacaagagggctattgcctgatccatcattagagagcctggctacattcacaggattagtatttctccatacaagaacaacgtttcagcatgtataccaacggcggcgacccgccgtcggtagttttctacttaggagttgatgatatcatacgacgaacagaattattaggtggtacataacttggagagctaaggcttggtccgcactgaacttccattccagctccatccatcccaaggtcactagaccattggaagtgcaaaacaagctcgcgggtcgggtcgcagaccagccctcagccctaacctgagggcatgtaacttgctgctgctgcgggcgccctatcctctgctcatcataactcaaccgacccgacggacgcaatcccggtgcttaggcttctcgactcttgagtcctgctaacgtagtcgtcacagctgctacctagtctccgcgcgggggccgagctcaggagctccaagccctgcttgcccatctgctgcacctcctgcggcgagagtatctttatgcaggacaacgtactcacgaattctgccangggtcgtcgcccacgaaaaaggacgtcctcctcacggtcgacgaatacaagctgccagcctgatctcaaaaggtctttccactgggccctcnagggcaaataagcgcccttagtcccctacggagctcatgattacttactaaacctagtgatatcgagcgaacttccgtaaggtgccaaatttgtaaaacctcaccaaagg

SEQ ID NO: 14156 - DNA, 882 bp, Saccharum officinarum
  Predicted polypeptide sequence is orthologous to G1451
agtggccaattgatggcatcagagggatggccttcaaagaggttggctgtggaatgggtgggtagtcatgagctccaacctgtgcagctcaagcttgagaaagtgaatcaccagagtaatgcatctcatgtttctggcaccttgccgccactgtcaacaagagacggttctagtgcccaggcttgcggtacaaatgttcagagtcacctgctttcatcatcatttgcaatccatgatggcttgtcaaccgtcaggagtggtggtgttggcaatggaactgatgcgacaaccatagcttcgttgagatatggtgatatgaatttgctacctgaaaactccatagcaacttccagttgtttgggtgaatcaggaaccttcaattctcttgacgatgtttgtcgtgtaaacccatcacaaggtggaaccttcttgaagggttacaaatcaggggccctcgggagatcgctcgatatcaccagattcagcacctactggcgagttacattccgagctcgagcggttatttggccctgaaggccaacctgacggaccctgtaaaatcagtctggcggcttgatttcgcgtccccgtgaaaagatattttcctttcgctgggacaccccggggaagaagtttccgccctacggatgggttgcataatgatgtggccaaaaaaaggggggggggaggggcccccccccaccatccccctcttgatagatgatggtatgtgagattttttaaaaaaaatgattttatctaatttgttgatgaccaaattattgttcgtgtcgtcattggttggttcttcgacccgtaggagaagtgtcgggttatatagagggtgaggattggatgtgcgggcgctccccccccccccct

SEQ ID NO: 14157 - DNA, 1004 bp, Saccharum officinarum
  misc_feature (634)..(634): n is a, c, g, or t
  misc_feature (638)..(639): n is a, c, g, or t
  misc_feature (792)..(792): n is a, c, g, or t
  Predicted polypeptide sequence is orthologous to G1451
tgaatgggtaccgttccccccctcgagtttttttttttttttttttagcggtattggtactcgatagaagaactaggtgctgcctgctggcatgtatacaacatgtagtagttactgctaagagtctatatcataggaaatcatcagacgtggaataacacagggcttcatttgatctatgtgctttgttgcaagtcacaaaactaggaggtgctgcagaaacatacagaaggagaatcctaaagccgaaggctatgggctggctccctgtcttcagaactcgaccgaacccactggcgccatcccagtgctcaggcttctcgattcctgcatgctcacatagctgtcgcagccattgctcagccttcttgaagaagccgagctcaagagctgaatgcctggcttgcccatccgttgaacctcctccggtgaaagtatctttatacaggacacactgtttacaaattcctgccatgggtcatcgccaactagaaggacatcgtcctctctgtcaacaaatacaagctgccagcctgatctcaaagggtcttccaactggccctcaaggccaaatagacgccccacctcactacgaagttcatcataactgctgaatctagtgatatccagcaancttnnaacggttccagatttgtaaaccttcacaaaggttgcaaactgttgatttgcttgttcagaattctctgcacatggaacataacctgactcatctaagcaacccgcactatgtagtggttgattcaaggggaaatcattctgagaagggctcangacattggaggttgagtatggaatcgtgtctgaactgttatcattctgaaggcttggaatgccaccttgcttcaaaagggctgggagtctattgttacaccaaataaaagtgatttgaagaacagacttccattttgatccataagccatctcctcaggtatggtgctatgcggagctttgggggatgttcatgaagcctatccacggtcct

SEQ ID NO: 14158 - DNA, 1274 bp, Saccharum officinarum
  Predicted polypeptide sequence is orthologous to G1510
cgtctctgtaaaagagctatcattcagtgtactactccatgtagaacatgattatacagtgactgtgccacaagtacaagtctaacacacaaatataaaatgtggccatccaaagaaacacttcaccacaacacgtggccactaagaagcacacaacaacattacagaaacttccggcatttgcgcctgaacatccaaattttgaatgagagaacttggcgccactaccctagtacaaaatgccttcacatgctcctgacgaaccaacaccagccatccacacgctccaaatctgccaacctccatagctccatagcatgctctccatagctccatagcatgcaggaaagtttcatcttcaaccatggccatagatctaaatacagcacacgctaaagaaaatgaagagccctctatacctgcaggaaaattccatcctcaaccatgacaatagatctaaatacagtactaagtgaatgatatgaagaagcccttgccagacctaactcaagaagttcatgatgatgatggtggacatgaaatccataaccgccaggaagatcaactgcatctcattcaagaagcacaaattgcatccactcacaggtcagtcccaatatccccagaaaaaacgaaatggtggtgggcatggcataaatctcaataatcccgcgttgtgacgggccacgaaaaagaaactccatgaagggaatgtctcccctcaagtcccactactacaagcaagttacttggtatgggtacaaacaaactttaaacctccacaaaattcctatgaaccacacacatagcaagtcttgaaggttgacaacacccatcaacaagacaaaaaactttaatttcgacgcctcccactaaaccaaatgattttgagccccaattaaaaactggtggtcacccacatgcacccaccatagatcaagcaccccacaggaactcgagtctttcctttacgggtgcacgaagacattcacccacatcgtggacctaatgttcgcggtcacacgtaataataggaagcattgtattcacttggtactcagaaaacacactgtgccacaaatagtcccaaaggaactctactgagataaagaaacacaaagacgtttcatgcagaacaccacaagactggtcacggatatacacacaatctctaaagatccgtccactttcgacaacactcacatagtgtcggacacacattacagtccacgaactcacatgcgctctctactgctcgacacacaatatctctt

SEQ ID NO: 14159 - DNA, 604 bp, Saccharum officinarum
  Predicted polypeptide sequence is orthologous to G1660
acagcgagcaatttttctaccacgcccaaagatcacgggtcatgctatgttacaaggcgggtgactagagctggtcattcatcagagaacgagaatcacaggcaccagcaccagcaggagaaagaggaagtcgtatgcccggtttctcggatctgggccgcctgctcctccgttctcgcggcttcctggttccgcctcacctccgcggcctccctcttcgcctccgctcggtggcttacggctgccagctcgctggcgagactgtcctgctcgcgcgcccgttttcgctctatcttggcctctatccttttcatttcagcttcaattttcgctttctggagattttcccaagcttggatctttgcttcctccctctgaaaccttgcaagatactttgccttctctgcctcctgccaatctgccgctcgattctccctgttgatatcgacagccttataggctgtagtactcgtggaatgtacagcggctttctcttccttgcttgcccaagcagctatagtagtcttgcctaacctttcgccaagatccataaattcctggtcttgtacttatttgtggctcctcttcagacatctccatcttg

SEQ ID NO: 14160 - DNA, 756 bp, Saccharum officinarum
  misc_feature (588)..(588): n is a, c, g, or t
  Predicted polypeptide sequence is orthologous to G1672, G2802
ctgaattatattatttattaattttatttaaatatattggaagctatctgcaatacaaaagtataaacatatgtgtcaggacttgttctatatcatgactgctcaaacccttgtgcctatacctagctaattgatcatctctaggcgtgacaagagatggacacagcaatcatttcttccacaggacatccaaagcctatccaacaagcacaaggattaggagaaagatcctgtcagagcgcggccagcgcagcagtgaagatgttggggaggcacattggcagcagaccggcaagacacgtcctgtgatcgtctgcaaagatgtttcaggaggtaattttgctagttgtgttgcgttcattcaggatcagaagtttattaagcctctatcattatattgaacaaaactagtaatatattagttagcttgagatgcttttgaatgtgtttgtattcgacacacttgcactctaattatgcaagctactagtcatactcgcaaataatcatgaaataaccctttccatgcaccacccagcctgtgtgttcacctttccttttttattaaaaatgaaacaccaatatgtntaagtagttctattattacatgtagagcaatcaataggtttggtgtatctccaactttgttaaaggcgagtacggacatgctgaagcacagtgggaacacacaactcataattttacttgaaaagggaggcaaacttatggataaaattgcatccacccaccacaaaa

SEQ ID NO: 14161 - DNA, 790 bp, Saccharum officinarum
  Predicted polypeptide sequence is orthologous to G1743
atataataataataatctgcaaaaggattcacaactccacaggtttggaagacggaatcggcctacacatcaaccaaattggctattttcctgatgccttatctgtttcgcctcgcttttaaaactgttgggagccgctgtaaaaaccagggcggtctcctctgccgttggtttcgcctttcaccaacggatacacgaccgaagacttgagtgacggccgagcacgggaatttgggcggcggtcacccgtctgaccgaccgggcggggtgggccgcacatgaggacaggacgcggtttgccttgccacggatccgattcgcgtggcctgcccaaccgccagccacgcacacgcaggcgcagtagctcactggaagccgccgaggccggtgagcagcagctcgtgaggccgcaacagcgtccgggtgggcaacgccagcagcggcgtggacggcagggaacacgggtaggacatgtcgtattcgcccgcgtcgggccacggggccacgcccggtgcccaagggtccgctgccccggggatgaacggcacgcggcaaaccgggcacgtgcgctcgtcttgcgccatccaacggtcgaaggaagcgcgtggaaagcgttgcgcgattgctgaaccgtcccacctcttcggcgccccgaatccgctgaggcaaactatcaattctcgaccctccccgggtcccggcacctcgttaaaccgacccagggaagccctccttaacgatcacccccggcacgaccgtaacctcgtccgcggttttcagccttccagcc

SEQ ID NO: 14162 - DNA, 776 bp, Saccharum officinarum
  misc_feature (541)..(541): n is a, c, g, or t
  Predicted polypeptide sequence is orthologous to G1743
tcaaggcccgcctccccgccgtccggtacgccgacctcctcaggtcccgccgcgcatccgcgccgtcggccccggccgtgtgcgccgtgtgcctgggcgcgctcgaggcgcggcatcgcgtccgcgagctcggcaactgcgcgcacgccttccacaaggcctgcatcgacaagtgggtcgacaagggccaggccacctgcccgctctgccgcgccctcctcctccccgacccttgcagcgacggggacgacgacggcgtcggcgagctcgcctcctcgtcccccttctccttctgaacccacccacgcgtagtagtacgcgccgcccgctccaaaaggccggcggccgattgggaggcagagcaaggtcagtaactagctacctacctacagtacctgctagctgatgagatgagccccgtcgtacggcttggcgcgtccagtggtccatccatccaccatggatccagtttaaatttgtttcttggaagcaatgaaatggaggagagagaggagagaggagagagaataggaggtgtcantgaagcggaaggggtgcaatgttattggttggggaggcactaattatgaggaggacagggatggctacctgcattggaactggggaataaacgaacgcattaaatccttccattcattcttttccatatttttttctgggaaatccaatttaattctctttaaaaaacgtcttgggaattaaaaaaatagattgcctattatttttttccaagggtcctttatttataataaaat

SEQ ID NO: 14163 - DNA, 865 bp, Saccharum officinarum
  misc_feature (1)..(1): n is a, c, g, or t
  Predicted polypeptide sequence is orthologous to G1772
nagcggcgccctgggtgttttatttgcaccccaaaaataggttcattgaatgagatcagattccgattacatacagggcaaccaatggaaacaactatggccgactactacacgctcaaatcagcaaaactgcagcttgctaacaagacatttcccagctgcataagagccctatgcgttaacaggaacaacaggctacctaacctaactctatagcatttacagggtaaacgggaccactatacaaaggatgggctaccaggtctaaatgtcagttaccacctatctacaaacattgaaccaagcctctcaccctgcactttgcgcagctatcaaagaaccatgaatcctgccttctttccttcccttgagcacaagaagcattgccctttgtcagctctggaaccaagaaaccaaattatttacttgcagggcagcaagattgattgaagttgtccaagaagcaattcctatacccattatctagttcccgagaaaccacaactggatcctgcgttacttgggtgacaagaaccctggccagcagagccactacaacaaacacatgggatctcattctgaattaaacagcctctatttgatggatgctttgaaaaaactgacaaacaaaggtgttcctccccagatggatgtaattggacaatctgttccctttggattaagatcaaacgaagccttggttcaccgggaatcccgaacggacctggagggttccagcttcctatatggagtcgattaaactggggtaacctgggctaactgttcccgggtgaaatggtacccgtccaaatcccacaaaatacgaacccgagcttaaggttaaacctgggggcctatgagtggg

SEQ ID NO: 14164 - DNA, 711 bp, Saccharum officinarum
  misc_feature (632)..(632): n is a, c, g, or t
  Predicted polypeptide sequence is orthologous to G1772
agaacaaaagaccattggtcctactttattattatcaaaagtaccaagaagcagttccgagcacaaacagtccaccagcagatctggtggcctaagccagaaagaggattcactctaaagaattccctctaaacttcagaaacatcacttaaaagctagcgaacaggcaaggtcagcccgcaaaccaagccaaaccgaaaacaagttcaacaacaatcttggcctgaacatcaagcaagaaccattagaatgaagttcacaaacacactaaactatgacttgctgtccacagtgacagtcaattacaatcttagtttcaatttagcttgatccacccagccaacctggtccttgttcaaaacattccatctactgtgctcaccctcagacaagctgatttgctacatttgccatggaacttatgatcaagtcctgtacttggaatcggagggagtacacgatccaacccagcgccaagccagcatcaacaaatatgcgtattccaatctccactcttagtgcagaggtaatcatctgatattggcatcagagattcccctagaacggatcatcatgctatggcatccctgatccagggaacactgaagatcttcccgtcatctatcaatgtntctatgcagtgaaatggtgagatattggcatattttaactcccagattcctgaaagaaatacatcctccaacaaattac

SEQ ID NO: 14165 - DNA, 825 bp, Saccharum officinarum
  misc_feature (494)..(494): n is a, c, g, or t
  Predicted polypeptide sequence is orthologous to G1927, G2184
gaagctataataatagtttattacattcagtatatatatctgtcaaaatacaaatgaggacagcgactcattagtttcaaatattaccatcagatatgtttttttccttgcattttaccattttaaataagctctaagacctataatcatagtaccaccctcaaaatgtttctacctcttcacccttttgaaagcgaaaggatattcaaaccagaactgatactgaggaccaaaaaaattacagaggacaaggtcaccaggttgccacttcatctgtgtcacgtagaagaggatttccataaacccttgcaaaaattgagggcagagccagaagtaaaggtccatataatagaagcaagtataaccagtagagagatgaacatcagtctgccgcctctggtaacctgaatacttggggtgcttggttcttctcttgttgcttgctgtgacctgaagctagagatgtgctgaagtgttctgttgataaaagtgtnttcttcacctgcagtttgctgtgatcggaagctagagatgcgctggagtgttctgttgataacagtgttttcaatttcagcagctaatgctggactactaggtacagagtccaacaaggctgatagagccgcattgaaccatgattgtgaagctgtggagctctggttatgtacctcatttgctgcatgaatattcagagtgcctgatgcatgcgaggattagactacatgattcatgcttcatatgggtccggacattaagaagaagcctgatttggggtccttaacttcgttgtatattgatatccctggttctggattccactggtta

SEQ ID NO: 14166 - DNA, 733 bp, Saccharum officinarum
  misc_feature (640)..(640): n is a, c, g, or t
  misc_feature (654)..(654): n is a, c, g, or t
  misc_feature (698)..(698): n is a, c, g, or t
  misc_feature (714)..(714): n is a, c, g, or t
  misc_feature (718)..(718): n is a, c, g, or t
  Predicted polypeptide sequence is orthologous to G2030
gcgtaggtgcatgattgatgcagctgcagctgattactaagcgcaagcataacacaacgacgacggttcgacatacatcctgcaagagactaagatacaagaaggtatacctccgggagagatgcaagaagcaggagagaagaacatgcgtgaatacttgatgctgctaggagtccttgctgcgagtgtaacgtaccagacgggcctgaaaccaccaggtggcctgtggcacgacaacagcgatagtcattctgctggcagctccatcctccattacatcaacaaacgccggtaccatgctttcttctacagcaactccacttccttcatggcttccgtcgtcgtcatcatcttgctcctgccagagactctccacaaataccgattgccactctggccaatgcacacagctattttgcttgacatgctcggcctcctgggggcctatgcagcaggcagtaccagagactgggagacatccaggaatgtcatctacttggtcatccctgttctggactacattgcagcctatgcagcagtctcaatcttccgcaagagaagatggtgccagtgcatcggcagccgaacaaactcataaatcatccggcgcactgatgaagatcaaaagtgacaaaaaatncttttatttccagnttcattcaattgtgacacccatgtttgcattaagacattgagtngtttgttcatatgtgntatncaaaagtacttgcac

SEQ ID NO: 14167 - DNA, 782 bp, Saccharum officinarum
  misc_feature (529)..(529): n is a, c, g, or t
  misc_feature (632)..(633): n is a, c, g, or t
  misc_feature (648)..(648): n is a, c, g, or t
  misc_feature (690)..(691): n is a, c, g, or t
  misc_feature (724)..(724): n is a, c, g, or t
  Predicted polypeptide sequence is orthologous to G2035
ccattctcaatgtgcgggacaagaaaggaaatactgctttgcacatagctacacggaaatggaggccccagatggtacagcttcttcttagctatgaaacacttgaagtcaatgctatcaatggtcaaaatgaaacagctatggatttggctgacaaagttccttatggtgagtctaaaatggaaataatagagtggctgacagaggctggtgcaaagaatgccagaaatgtggggaaaattgatgaagcatcagaactaaggagaactgtgagtgatatcaagcacaatgttcaggcacagcttagcgagaatgctaagaccaataaacgagtgactgggattcgcaaagaattgcagaaactgcatagagaagctattcagaacaccatcaattcagtcaccatggtagcaaccctgattgcctccattgccttcgtcaccatattcaatttgccaggtcaatacttccaagatgtgaatagtggaggggacattggtgaggctcacatagccaagcttactgggtntcgtctcttctgccttctgaatgccactgctctcttcatttccctcgcggtggtcgttgtgcagatcaccttggttgcctgggaaactggtgcccagaagcannatatcaagattgtanataagctcatgtggacggcatgccttagcacaggtgcggctnntatctcgcttgccctatgtgtagtggcccgcancatgcctggatggcctcacagtatcagccatcggaggccgatcatgattgaaccatac

SEQ ID NO: 14168 - DNA, 661 bp, Saccharum officinarum
  Predicted polypeptide sequence is orthologous to G2051
gtcatccacctttactttgttttattagtttgtccatactccggacaagaaagaacaagagatacaacaacagatcaaccacatcgatcccaacaccctacccgatgaaaaacatgcatattatgtgtgtaaaattcagaaatgatatgaaaaacacatgaatagcaggaaataaataatcaaacaaacatacaacaataaaataacgaagaagaagaagaatcaaatgaaccgatcgacatgatgatgatccatcttgtatactagtaagtaatcaccatttccggtgcacgcattccgattcagtgttagaaacacactgcatgtggattgatggatcatccagtcatcagttcaaccaacgggatgtcttcctggtctcgcccttgctgcgcggcggcatgggcagcttgctgaacttgacgagcgcctccgaaaagttcttcttcccaaaaggtggcggtcccggggggttcctttaaatggcccagggcctccttttccctgagcagttgtcaattcgggtttaaaagtgacaaaccccgcccacgtttgtgggggaatacctgtggtccaaaaaaacccttgcctcgggcccccttctttaagaaaaacggggaaaaaaaccccccacaaaacgggggggccctccccgggattt

SEQ ID NO: 14169 - DNA, 725 bp, Saccharum officinarum
  Predicted polypeptide sequence is orthologous to G2110, G2574
agctggtggtggtggccgtggatgaacgaggccgaggcggcggaggtggtggagcccgaggtgagcatggccaccgccgcggaggtcgtggacgccatggccgtcgccgccggcgggagcgggtggttgtgcgcgccctcgtacgtggtgatcaggatcgacgtgtcctccgcgcaccgctgcacctgcttcctcaccgggcagtgcggcgccaccgtgcagcggtagtaggcgcgcgggcacgggttccccttggagatcttctgaccgtacttccgccattggcagccatcgggcatcgtgggagtgtcgcatttgaccctgacggaaaccctagccttcttgggctgctgctgcacctcgtcgtcagctccgtccccgacaccggtgctcgggctcttacgggcggtgcccgcggcggcctgcatagcaggcctggcgttgtcgtcgtcggcgctgccgctgctgtcagagctcaggttgaggacaggcgcggcggacgcgtggctcgccttatcgtcgtccatgggcgccgtggacgccgacagcccgctcccgcgcgcgaagccgagcccgagggagagctggtggtggccttcgtcatcggcggcaggggtggtcatctcatcagcggtgccggacgaggacgacaacctctcgtgccccttgcggcgggagggggcgccaccgccaccgcttttggcccctcgtgccgaggctcaggg

SEQ ID NO: 14170 - DNA, 587 bp, Saccharum officinarum
  Predicted polypeptide sequence is orthologous to G2116
gatttgaaacatatatataataattatggttaatatgaagtctactacattatcagtaaatataagaggaagcactgcatgaatatggtacgatacaaagcagtgtgcatagtgatggacaatctgttcggtacaaagcacgcacacacataatagcttatactgatatgtctattcaatccataaagttctaataggtgttatgacagaaaatagcaggcgcaatattttacaatggtcagtccaggaacctttggtgctcagcagaagctactaactcttgaggcattacttgtctagcactgcaaaagatgcctaacatggcagcacagcctattttgtggccttggttgaggcagactttcgggtgttgatttttggttggaggctggagccatctgttttgcgcctgattagtgcttttagtcttctgctctgatggcaagcgaggtgaggcgctcttgtcgtcatcagggaggtcatcagagccaaaatcttcatcagtgataagatcctggtagatgcaatcattttttggtgcggtatcagttgcagaggcttgtggaggtgtttgcgaagagcccgca

SEQ ID NO: 14171 - DNA, 1002 bp, Saccharum officinarum
  misc_feature (13)..(13): n is a, c, g, or t
  misc_feature (522)..(522): n is a, c, g, or t
  misc_feature (566)..(566): n is a, c, g, or t
  misc_feature (636)..(636): n is a, c, g, or t
  Predicted polypeptide sequence is orthologous to G2116
cggacgacctttntttttttttttagcttgccaacacaaaatgtacagggctcaacaaattgctgagaatacattgtatgttcaaaggagaggattcatgaagcagtcaacatggctaaaaacaacaaagtaccatcagagaatttcactccaaaatccaaatgccctgataataccgaacccagaaacaggaaatgagcccaaaacaaacagacttgaagggttcctggatcattctactacatggattgatcagccagtgcgataacgaacaatttcaactaattgaatgaatcaaataacaaataagcttacagagcaggaagcagcacaaggatgtcaggctattatgaacaatggggacctactggaacggcagattctcattggtaggtctcgttagaaggtgctgctgctttcactagcagagatcgagctgctctctgacttcacaaccagtggccccttcccaatgtccaaaccctgcagccggccaagagactcttgctgcattatgtctgngagagtgtttgggtgggacagcatctggtggtttggcacattgngatggggtgggtggaacggtggaggcaactgggtgctaccaaggtgtggagatgcattttgctgggaatngcggaagaaggtagagttgattgaacatggtaaaatctatgtatatgtctcgctgaatgggcatctaccagagcatgctaaacctttcacgtctgcttagtgcatattaaggatacgggttgagctgtgctcatgctgaactttttaagttgattttgaaaagcagcggccttttatatgggtgacggaagccgtttcacaaagttgccttcgtagttgaaaacagcctctcttagaaacgtatgctgtacaaattttgccgtcgggatggcgaatcgcaaattatgataagactttgctattcttgtcagacccagattttcggcccgactttcggagaaaaaggactaccgtaataattattta

SEQ ID NO: 14172 - DNA, 792 bp, Saccharum officinarum
  misc_feature (47)..(47): n is a, c, g, or t
  misc_feature (509)..(509): n is a, c, g, or t
  misc_feature (544)..(544): n is a, c, g, or t
  misc_feature (661)..(661): n is a, c, g, or t
  Predicted polypeptide sequence is orthologous to G2311
ggaaaggcatgcggtgcaaccaacctttagaagatttctaaccgcanagttacggcgacttgcagaatcaaacaaaattgtaagaatcgataagtcttataggctcccagattcctttgcaacagggaactccacttccaataaaactttaagttccaaaccagaggatccatcaaagccttcgaaggggtcaaaaaccatagattgtttactgcctccagccctgcactagaggcagcgatggcagctgctgtcaaggtggctgacgccgaggcaaaagcacatgacgcacatgatcagatgatggaggcagaaaggatcctcaagatggctgaggataccgagtctcttctcacaattgcagcagagatctatgaccgatgttcaaggggagagataaccacattagttccagtggcgcaaagggatttttgaaaatctattggagactttcgtcctgtacatggataggttctggaatccaatggcccgtattgctcctgtgttgnataatttaacagtttgggcttgacttgggatatgntctagggtaactaaataaccataagcgcaccggctgtcttcaaacctcttgtaatatgtaatcccatctttcccaacctgtcattgcaagctgcgatcgtgaatcctgatggcaagnaagggtttttaatccctggttgagagaattaagaagggaagaagtgttttaaacagattaaaagttgggcaggaaggtaaagtgttccttggataagaaaaattaaatcgggggggggacttgatcttttc

SEQ ID NO: 14173 - DNA, 760 bp, Saccharum officinarum
  misc_feature (485)..(485): n is a, c, g, or t
  misc_feature (630)..(630): n is a, c, g, or t
  misc_feature (644)..(644): n is a, c, g, or t
  Predicted polypeptide sequence is orthologous to G2457, G2459
cacgctgcttgctctctcccccgagcgaggctcctccgaagttcgaacatatataccaccgcccgccgcgccgccgccacctccacgccggccagccaccaagcaagcatggatatggtttcgcagtccgagcacctgtgctacgtccgctgcacctactgcaacaccgtgctcgcggttggggttccatgcaagacgctgatggacacggtgactgtcaagtgcggccactgcaacaacctctcctacctcagtccacggccccccatggtgcagccgctctcgtcgactgatcaccccttggggccattccagtgtcagggaccctgcaatgagtgcgggaggaaccaaccgctgccgctggcctcgccgacatcgactgagctcagcccgagaatgcccttcgttgtcaagcccccggagaagaaacaccgcctcccatctgcttacaatcgcttcatgagggaggagattcaacgcatcanagctgcgaagccagatatccctcacagggaggccttcagcatggctgccaagaactgggcaagtgcgacccgcgctgctcgacgagactgctctgctgcacttcacagcgtcagacctaagtggccactctcagtctgagccgcngattgagaaggcangacagcatcaactcactctcacaatgacgccattaaggcatcgagggcgagccaacagatcagacatcacttatatatattatgcgatcgcgacgcagcatgcttatcccacatct

SEQ ID NO: 14174 - DNA, 785 bp, Saccharum officinarum
  Predicted polypeptide sequence is orthologous to G2509
tcgccctgtttttttttttttactatcatctatactcttcattttaattttttttttttttggaccccaattccttccatgtggatcaactccagttatcagcacaggaagcacggttaccatggaaaataaacttggaactgactaccaacatttagctactggttaaacagcaaatcatcctactctacgaatcaaggtcagtacagcaggaacacgaaattatttccaattccctgctctcaattacatctctagaccacaactgtataaccatccacaactactcagggtactcaccacccacaactactcagggtactcatgcacgttacatcagcagtttaatcagaagcctagtatcaataagtgtgctagccctgcaatcaaagcaatctcattgcataacctttcaggcgctcccacaaccaattcttcagggaggaacagaaagttgcacggtacgaaggattagtcttatattaacaaaattaattttcctcggaatgtactctgcaaaaatacttctttatcatgttcttaacaagagctccaacgcatgatacccactattctgcacaggggtttgatgggagagactatcagtctcccttttaacagcaaattacaaggactgaagctagaactaggaagtgttaactaagtcattcccccatctcatcagttttgggagctctggtggctaccccttcttgtgcttatgcacatcccctgaatcttctgttccctcaagctcctcttcttttcaatgaatgttctttgga

SEQ ID NO: 14175 - DNA, 971 bp, Saccharum officinarum
  Predicted polypeptide sequence is orthologous to G2509
cttgatcccctagaacgcggccttgggggtgcaatgatgttgatcactaattttgttgtaatatatgtcctcagcgccgctgcgcctgtgattattatacatcaagtcttgaaaattaaaatggaagaaacaggcacgtaccggtacacgcactagcaaaagcaaaatatttacaagatgatggagaaaaactagtacacaccactcaccacacacacaggacagggctccccttcactggccaagccgagaggaactggccagaccaagtccagtaaatactcactactcactactaggagcgactgcatatcactcatcactccataacataacgtataggacaaattaaacggcaacagcaacgcagaagtactactataataaatagagcatgcatgcgtgttagataaccacaaggaccagcaaacatggcctgacagagacgcctggccggccccttaatcatcgaactcatccgatctcatcagtccgatctagcggtggttgctcctggtctcgtcgctgtagagcctttgtcgataaacaacgcggcgggcgggggtggccttgcggaccttctccaaggccgtctccggggtgaggcctggccccaagttcttccaaaacttttcccaaagtctctttcgggtggtggccgctcctttttctcgagccctccgaattgccaaaagccaccaggatggattcggacccctggggtttaccccgggaatttccgaaccagttccgggaggcgtaaccaggtttccctattatgagtgggaattaaagctgggcggaacataggcaatacggttcccgtgtgaaaaggtgttccgcttcacattcacaaaacatacagccgcgaaaaaataaggtataaccggggggcctatgtgtgggccacgcccatgattgggggggccacatgccggttccaatgggaaaacggtgggcccatgcgttta

SEQ ID NO: 14176 - DNA, 666 bp, Saccharum officinarum
  Predicted polypeptide sequence is orthologous to G2512
agaacgtgtattgatgaacatagacagacaggattacatgctgatgatgacttattacacggatcacggcacattgccgcgctacacagacgagtataatgaggggtcatatactactatctactggcacgtcacaagtacagagtatattgctgcgatcattctacaccgccgtcgcagtgggatcccacggccgcctcgtgccttgcctccggccacacaataaaactgagccggaagcatcgccgctgcaacgcggaacacataccaggagagcagccagaactaacatgcagctcgatcgatcatgcgtcgactagtactagtagtcgtaaagttaagtgtaggagtaggacctattttttttgttaaaaaaaaggaaattagagaaaccgaagccaccaattgacccagcatacgagatatgtatacagctggctactccagccggaagataagcctgaggtcgcgcgttgcggtatcggcggcgtaaacggaggccacatctactgccttcctacaggaaaacatgggacagtggggatcgaagccgtgggtcgggggaccttgaaaaacaccgagtcggagggacaccttgcgatggtgggattcgactttttggatgggtggtataaagtcgcacggaatggaatagaatgtcatcca

SEQ ID NO: 14177 - DNA, 736 bp, Saccharum officinarum
  misc_feature (554)..(554): n is a, c, g, or t
  misc_feature (605)..(605): n is a, c, g, or t
  Predicted polypeptide sequence is orthologous to G2559
ctcccctcctcgtgccagactgcccagccaccacaccattctttcctctccagctatctaagctagctagcgtcgtgtcttagtagtttgcaggctcacctgctgctgattgagaggaggagacccatctgaatctgactgaattcagcaccagctatcagagatagatggcggaggaggaggccaagaaggtggaggtggaggccaccaaggacatcgccgaggagaaggccgtcgtgccgctgccgtccccgcccacggccgccgccaagctggccgacgacgactccaaagccatcgtcgctgttgtcaaggacgctgctgagaaacctgcagctatcggaggttcaactgaaagagatgcttatctcgcgaagattgtatccgagaagagactgactctgatcaccgcctgggaggagagcgagaaagcgagagccgagaatagggccgccaagaagctcgccttcatcacgtcgtgggagaacgcgaagaaagcagagatggaggccgagcctgaaaagatcgaggagcaactggagaagaagaaggcngcgtacgaggagaagctgaagaacaagcttgcgatgctgcacaagacggcngaagagaaggcgggcgcaaaccgaagccaagcgcgggaggagatcatcctggccgaagagatggcgccagtcccggcccaaggcgaaggccccacaagctttttggcttttaaagcctgaaaaaataccag

SEQ ID NO: 14178 - DNA, 794 bp, Saccharum officinarum
  Predicted polypeptide sequence is orthologous to G2592, G2713
agaatctcctctaggagggtttccccaaaagtacccactgctagctaccccattgcccgggtgaactatgagctaaacctggttggcacaagggggcccaggcgtatgaattgcacgatgcattccatcccagcctcagcgctagaccctgaaggcacggtgcctggccaacccaagcagctcttcgtccctggctcatcttcctttggagaatcctttcgcagtgcaaacacctcttccagctcaaggttctcggttacagaccgctccttggacttcagctcctcgcgcttctcagagataagcggattggctcagcaagatgaggacagtggccaggctaaggagaggcctttggttctccgccataaggaaccaagggggcccgagacaattcacgtgtgggggccccaaattccgtggtcgggtgaccggggttctgtgaagaacttcagttgatcgctgcgccaaactaaatctgaatcgtcacacaagctcgacggaaacccgccttcgattcatctcagcattggatcatgacaatgatctgcagtttggcaaggtggcaagacatgtcaagaaggacttacgatacctctctcgggttccaaggcttcacatctgggtgacagcttcgaccgaagctgcttgtggaaagatctcactaaaaaccggattggtgtggagtcgtttgtgcaacaagcataattcgggtggatccggggtcttcggggggtgtagactggcgcttgccgggttctgagggatgacacgaggggctgatgtacgggcca

SEQ ID NO: 14179 - DNA, 704 bp, Saccharum officinarum
  Predicted polypeptide sequence is orthologous to G2592, G2713
aagcgagacttgtctagattggctcccggacccaaaaaaaaacacttcgcgttactatccactgtcaggtttctgaagcaacatctcacgaaacaatactgggatcaacagccacgggaaattatttacctgcaaaggctcagaatgcctctgcttatatcacttaaaaacacacaaaaacgatctctcaagcttctctcactgctgctgccctgctacgatacgctactcgtcccatctattcattcattcattcacaggccagcttggtgtcaaagctcgtcagacatatggcgaaggcctggaaggccgacagcgggtaccggtagtccatggtgaacatgtccctcccgaccttgccaaactgcaggatcaccgggtcatgggcatggctggacaaactactaagacggaccggaggcctgtggctgtgtcagtgtaggaggtgttgccgcctgcagtggagcagaagcaccccccactggaagctggctggggcccaaagctatcaactggaagttcttgaccgagggccacttgaccccccccgctgaagttgaggacccatcactgcaactggctatgccacctaggcacccttgtggcgcataaccaaagggcctttcttcttttgagtctgcccccccctctttttatctgaccctctctacgcgagctcggagaaactggagtttttcatgttc

SEQ ID NO: 14180 - DNA, 810 bp, Saccharum officinarum
  Predicted polypeptide sequence is orthologous to G2628
accctctcaaaagcgtttttttatttgctatattattgaaacaagatgtatgtacaaattgttaagataatttttcttcccattcaactcccaagcataaaagctgaatcctgaaaaaattcaagaccatagaagtatgattctagtggcgtgcaaacatcctaatgcgaattcaatgagtgaggtttctcacttccatggaatgatggaattgcatccaagacataccaccaagcagccctagctcaaatttgcatcggtgtacccaactgtgtcgttgagccaccagcggaacggcgcctcgccctccgcctctcgtactctgggtcgtcagtaggcagctcgtaccggcacactgggcacgtgttccggatggcgagccatgggccgatgcacgccccgtggtagaaatgcccgcacggcagccctgtggcgagctccccctgttccatcccttccttgcacacagcgcacccctgcacagtcttctcgactctgacggccaccacctggagccggtccaccgtcgcgcgcgccggcggtggggcgcccgccacgttcacgacgtgccccggcagaatttcgaactcgttgtccagcgaccgcgggagcaggttccacccgacgccggtccggaagatgccttcaagctccgcgttttcaatgtcaaagttaaacggggcgttttcggagaagatcgagtcgttgttcccgttgttgaaggccttcattaaggcccagaattttcgcttctgtggggaaccccaaaacattagagtgcggtttttcttttaggactggccttacccc

SEQ ID NO: 14181 - DNA, 789 bp, Saccharum officinarum
  misc_feature (685)..(685): n is a, c, g, or t
  Predicted polypeptide sequence is orthologous to G2633
aattattattcgcagcacacaaaaagagggggcgcaagcaagagaaggattaggacacgagaactagcatagcacaagagggaagaaaaaagcttgagagagagagagaggtggtgctggtgccgcggtggtggaggtggagttggatcgggctgtgcggatcggaggaggtcatgatcaactaatgcccattcatctattatggacttgcaccagttgttaaagtacagattaactggtgataacatcttctacgaatttcctacagagaacaacttcgcaaacactccttggccagctagtccactgaagtctgagttcagcagctcgccatacactcctctttcatcccagcttgagtgtgataatttgtctgctctcagcaatactccagataaccagagctccacagaaaccatttcagcacaaccaatatcaccactggaagtagacagctcatacagacaagcagctatccttcgggagaacacccaagtgagacctgatccattgtacgcaacatcaaggcataatatgcaacacgctttacgggaaatagagactgttctgatggcacctgatgctgaggatgcagccactagcaccaagcatgaatttgaggaacataaacctgctcagctgatgaggcagcggtcgaagacatggagtcatgaatcaaggcagncattccccaggagttgtacggggacacaatttgcattttggatacccccacagcaaagcttatgaatttccgcccaaaagaaaacggtttaagggagtttaaag

SEQ ID NO: 14182 - DNA, 986 bp, Saccharum officinarum
  misc_feature (600)..(600): n is a, c, g, or t
  Predicted polypeptide sequence is orthologous to G2717
acatataacctcaaacgctgtcatcagataatcgtatctagaaacatactatcacagcaatttgcattaactaagacagctttctgacattttcttttcactacagttgttctattacacgacatcacttcacttcaactaattaagggaaaaggctagagtttaattacaaagcaacacaatagggggaaaacaaaaaaaaacaaaaaaaacaaatgaagactacttccccgttcattcttgttatcatattgtcgaatgtcgattggctgcacagcacaggaccagcagcaagatgttgaaaacccctcccgttgatgcgtcatgatctataaggctatacaagaaactcatctatccagaaaatctttgcagcagaacaacagtgcgctgctggccaaaaccatgtgacggcatggttaaaggatcagcaagctcgaagcatcatggaagcagcattcctgcttctcattgataaagtgacagcatcgagaaaagcctttgcagcttcagcatcattttctgcagcctctgcaactcttgctgcttcctcagcttctgctatcgctacttctgcctcggcaactgccttggcagcanaggcagctgcctcctccttggtcatgcctttcatcttctccagttcagcaaccacttgaggcttagttagccgtttagcattataattttctgtatccatcactttagcagaggataccttagtgcttatccacccggagggagttgaactgggtgcaattctgaacttttggttaccttgaataattttccggagataaccaaggacttcaattttggaaaaaacgcggtttgaaaatcacagggggcccaaattggcctcaattatttaaaagggggcctttagggccccaaagggcgtaacccctcttagtctcaaagaagaatcgcccccaacggttttgggttttccatggggaggcgcaccaagggaagggccccataaa

SEQ ID NO: 14183 - DNA, 660 bp, Saccharum officinarum
  Predicted polypeptide sequence is orthologous to G2754
ccgaaacaacagagacctgactcagtgctcaagttacatagcaaggcctataccatacagaggacatccagctccgctttggagtaaagccatcagctaatgttgctggacgaagctgtaaatgcaacgcaggcacgcagcaacagaacagcagaaagcaagtcagaaaagcagcttgcagactcatcagaagttcacagcaagcctagcctactgctgcaggctcaacacccagatcaacagtttttctggggcatatacgcaaaaaatatccgcctgaacatcggccaacaggcgcctcatcgtccgcttgatgagtggctagcaaaatgggcacccaaacatggtgccgacatcgctcagctcgtgagcgacgagagcataccaccaccgctcttggttggcaccacgacctcccagccaggacctttcagcgggatcagtggcgtggcatcagcagcaccaggtggtccggacaggtcgctccggtccatcagcttcaagaggtcttcgtcgctaatgtcagtctggatcatccggtcttcctcgtcctgctcgtccctaagcagcgccagcagctccccctccgctaagacgttaggctttgctctttcttgttcaaactgtcccttccctatcaccggacgcgtgggtcgaccc

SEQ ID NO: 14184 - DNA, 758 bp, Saccharum officinarum
  misc_feature (575)..(575): n is a, c, g, or t
  misc_feature (585)..(585): n is a, c, g, or t
  misc_feature (718)..(718): n is a, c, g, or t
  misc_feature (735)..(736): n is a, c, g, or t
  Predicted polypeptide sequence is orthologous to G2768
cctccggccgaggatgggtggttaccttggctagcaacagatcggagtgtcgtgcccgccggcttgccggggtccccgtcgtccctcggagtacgtagcgacaaggcgacgcctttctgtttctgccccgccccgaggttggcttggtgtcttgtggagcgccggacgagagaggggaggcccgccggccggccggccggccgtagcgaccaacaccacccacgtcgtccgatcggcgcactgcttgcttgatcaatcagtcatcgtcggccacacggacacacgagacgacggagaggggagggagaagctgacagacatacacacggtacacccagctccagctcttcaactcggcgtcatcgtcatcgtcatcgtcctcctcctacatgccactgccactcaaggccagcgcagccacagcccccacagagtccctgccagccgaggcgagccgagctcgccgccgccgccatggctctcgtagccagtgattgtgagtgaccaccacccagccagccagccagtcccagtccgtccgtgccgtgccgacgtgccgtggcccgtggcgccgnctctcctctnaccgtctcctcggcgcactcgcctgcagccgctggcgacgagcggcgcgcccggccggtacgttacctcgggttccgttcggggcggcacggccatggggatcttacaacgggaggggcaacttgtggggggnggggttgtggggggagnngtttaccccccccccccaagaa

SEQ ID NO: 14185 - DNA, 944 bp, Saccharum officinarum
  Predicted polypeptide sequence is orthologous to G2783
ccatcgtctcaccggtttccctccccgtccgtccgccgccgccgccatgatgccgcagcagcagcccggcgtggccccgcctcctccccaggccgcccccggcgcgccgccgcactggggcgccatcccgccgcccatggcccctcagcatcagtacgcgccaccaccgacccagcaggccccgcccccgccgcagatgtggggccaggcgcccccgccccaggccgcgtacggtcaggcgccaccgccgccccaggcagcgtacggccaggcgcccccaccaccccaggccgcgtacggccaggcgcctcccccgccacaggccgcctactacggggcgccaccagcgccggcgcccgcgcccgcgccgatggccgtagcgcctgacgggcccagcgaggtcaggacgctctggatcggggatctgcagtactggatggacgagaactacatctaccggtgctttgcatccactggggaggtgcataatgtgaagctaatttttgacaaacatactggacaacttcacggctatggttatattgaattcataagccgcgctgatgctgaaagagttctttaaacttactatgggaccatgaagcccaaatgttgaggtgccatttcgggtgaaattgtgccagtgctggtgaaaaaacttgatgaccccccttggacatacaaaatcccgaagggtgaattggctggctgatgttaccgaccttatgtattacgaagaaacagttaaggccccatttccccttcttgggaaagggtgcaaaagatagttacaaaagaaggtgtccatgtccctaaaagggtgtatggtatattttgaattttgtgaaccttaatgaaccatttttcttgcgagtaactgaaatgaaaaggacggcatatcccctctcagggcccctccaattgggcccccttctctaacaaaa

SEQ ID NO: 14186 - DNA, 682 bp, Saccharum officinarum
  misc_feature (23)..(23): n is a, c, g, or t
  Predicted polypeptide sequence is orthologous to G2789
agtatttagggacgtagtcaaanactggtgtagggcatggaaggaactgggaaaacaagaggtagcaaggatccgagtacaaagaaagactgtacgtcggatcttacatactagagtacgatgtgttgtactccactagagcggacgacctgtttatttttttttaacatgcgaaatcatatgctgcaattcccacggaaattctccacgatacaaattcaagtaaagctcgaagaagaaagctaaatcacttaaccatctaagctgcgtgctggctgatcaattattagaacggcgccggacggccaccggcggcgcccgggttccatccgtaggctgcttctggcggcagctgcacgttgctgagcaggttcggtggcagtccctggaagaggcttggatccacgccgctggcggcgagctgcgccgattgctgcgcacccgcgagaattcctgcgctgtcggcctgtgcctgtgcagcgagcatgtcatcctcctccagcggaaaccgctcgtacaccgcgttggcgaaagatgctgccattatcaccacgggcccagctgctgtgagcgcgccaacgacgctgtcaaccaacacctgcccctgggcgacggcaagggaaaaggtgagccccgtggtttcaggcggatcgggttgcgggaggaatgatccgtaaaagga

SEQ ID NO: 14187 - DNA, 829 bp, Saccharum officinarum
  Predicted polypeptide sequence is orthologous to G2791
ctatgcacaaaagagaaaccagatagatcatccagatacagttcaagttactgaaacgcaactatcgctgagcaacctgatgcagttatacagcaaaaaagaaaagagagaaggcaaaaagaaaaaggcaaaatcaactgatgctcaataggtacgaaaaaactgattctgggaagaaaattagtagacagggctatgcactctggtcagactaacttcctatcctgtactctacgggctttgctgcattcttcagccgtctgagttctgtcttctgcagttgtgtcctcatgctcatgggaggagcatgtctttatttcaccgttcaggagggattgcagcagcggacacacctttctgagtggatatggcggaagcaagggcaactggcatcaagcagagccccttgttctgaaggtactgcatagcgctggtgatgctggttccattagcttcacaacctcttcctcaaagacgaaggtgtcttccgagtctagtgcgtccagtaatccttgaacgtaggttggacctgcacaaggttgaccgtggtaaccctcagtctgaaattctgtgagaaggggaagaactggctcctgaagctcctagcctactcctggtcaaaaaccttgcacctgaagctggaaaaaatttcacctaatcaattttttcattcccacaagggttgcctgggtgtgccttattgaactccgggaagaaaaccggcagcactcttcaacctattctaaaatttttccgctggcaagccggtcacgaatactatgaaggatcatgcgctggccccaaaaagcccatataacggtggttcccg

SEQ ID NO: 14188 - DNA, 967 bp, Saccharum officinarum
  Predicted polypeptide sequence is orthologous to G2834
cggacgcgtgggtgagggagagagagagagagggaggagggaggggaactcgagaggtcaacgaggggggagcaggcaggaaggctcggggctccttcctcctcctataaacccaccgcacccgccttccaggctcccattttctcgcccgggagccgcaattccgtcccgctgctcgggttacatactcgcccaatagaacaattctacatccaatgattgtacttcctgaggtagaagagcatactgaagccagacccgagcgggtgttgaattgaaatggaaggcaggatgacaagtttggaagccaccatgaaagcttcttcgtcgatggcaagtaacatggcaaggaatgctgaccctgaccaacagactctacgccccaattcggtggagcagttttattttccaagacctggtcaatctttgccaggcattcctccattctttgggcctccctcctccagtttgtatcttcctaatgacaatgaagctaaatttggcaaccagtttgaatcacatccttcacagaatacagaatgggacccgcaggctatagtgagcaacctaaccttccttgagcataagatcaagcaggtaaaagaatattggcaagccatgaataatcgaaagaaccaagtagctgttggtcccgtgaccagcggcaaacaagaactcataaccgttttctccatacattatgaaccagctcatatccatcgggggtcccgctcccttaaagaaaaacccacttcttaacacattccgcccgtcgtgggcttggcacaacttttgggtaccctaagggctttggctgaatgccaactaacaccaagttgaacacaacaatacttatattctcgcaacaaggaaaacctttgattttagtaacggtgaacatctttttccttgtacaaattatgaacttactcgtcccaacgccgaaccccgggggtggtacgggcga

SEQ ID NO: 14189 - DNA, 857 bp, Saccharum officinarum
  misc_feature (43)..(43): n is a, c, g, or t
  misc_feature (552)..(552): n is a, c, g, or t
  misc_feature (788)..(788): n is a, c, g, or t
  misc_feature (795)..(797): n is a, c, g, or t
  misc_feature (800)..(802): n is a, c, g, or t
  misc_feature (805)..(807): n is a, c, g, or t
  misc_feature (809)..(810): n is a, c, g, or t
  misc_feature (812)..(813): n is a, c, g, or t
  misc_feature (824)..(824): n is a, c, g, or t
  misc_feature (827)..(827): n is a, c, g, or t
  misc_feature (835)..(835): n is a, c, g, or t
  Predicted polypeptide sequence is orthologous to G2834
ccccttcgcgggctgcaacaggaaccgcgcgcaccgccgcttncgcccgctcaagtccgcggtgtgcgcgcggaaccacttccgccgtagccactgccccaagctctacgcctgcgagcgctgtggcggaaagaagcgcttcgctgtcctggccgaccttcgcagccacctccgccactgtggggaggaggcacaatggcgctgctcctgcggcaccaccttctcccgcaaggacaagctcttcggtcatctcgcgctctttgaaggccacacgccagcaatcactaagccaaacaaggatgtggtgacaggacctacagagtccaccattgatgctatggaggaagtggggtttgaagaaggcaatcctgaccgggaggaggatgaggagggtggttatgatccagagttcttcaaggagtggatggaggagcttggaggtggtgctggtggctccaattggcctggaccagcggcagccggacaatagcaatgttgcgagggctaattggatggtttggcaagatacatcagcttacatcaagtgaccangaggatcaatgaagactgaagaaggtgatagtaagaaaagaggtgcttccggagtcataatttgagggtttctctttccaatggtttggggttcgtctaaccagaactgtatggtatgggcgtgtgttgtctgtgctgtcaatgggccttccttgcattctcgggcgttcatgccatctgtgaattggatcaattggtaaccttatgggattccgcggaaaatgattttttttttnaaaaaannngannnccnnnanngnntaagccaaaanaanaaaacaanaaacaaaaaggggggcccctct

SEQ ID NO: 14190 - DNA, 853 bp, Saccharum officinarum
  misc_feature (493)..(493): n is a, c, g, or t
  misc_feature (530)..(530): n is a, c, g, or t
  Predicted polypeptide sequence is orthologous to G2846
gagtggagaaaacttttactttgccgctgtgattctgaaaacatttggaattatgggctgtgagttgtgccagctatctgactgccggacctctgctacggtgctaccgactttttctgaaagccaaggcctggtgtgcctagttaccctacattattacagtattccaggctatactggaaatctaaaaaaaagtacaggacacaacaataaaacaaggaaaagcaagcaatccattccgagtttccaacgaatagccgttgccgaggcagcagatactagctgaattaaccatgcagtcgtcgctatgccgagctcatgggtacaggcagctcctgtaggcgggcgcccagcagtccggcagggtgtcatcgtggtatgcctgcgaggtcagcgaaacagggaccaggcagagccctctgcccctcaagtcatgccccgtcccgctttcctcctctttcttctcttcgcctctgcgtcgaatgtgaccctngtacgtgttcttcgtcatgtacgggtcactaaacagncgtatctgctcatgaagaaatttgatgtactcgatcgtttcaaacagcaccgatgatgtatcagtcttcccaaaaggtgacacgatatgcttgaacgctgtgatcttttctccaacttcactttgggcgcttgaagctgggaggcgaagtcttgtgggaagcctctgcttagattcttcggtttcctcaaacgttcctctgatttctccttgaggtacacttggtgagatcatttcatggttgtccgccaatccatcccggctggaaattgtccgccggtgcttggctggaataaattggcttactgtgtttttagaactgag

SEQ ID NO: 14191 - DNA, 771 bp, Saccharum officinarum
  misc_feature (708)..(708): n is a, c, g, or t
  misc_feature (747)..(747): n is a, c, g, or t
  Predicted polypeptide sequence is orthologous to G2846
cgcgacgcgccgttctggaacccttctgctgctgggttcggcgtgccgccggcgccggcagcagctaaccaagctagcagtgtacgttctgtcaaaccatcgccgacggcgcgtactacagcaacccttgcattaaagactgcgttggaaggagtaggagagtctgctagctcaatcatcaccaagaagaaggcaaacggcgagccggccttcaagaaatcgaggctcgagacgccgtcgccgttgccaacgttcaaggttaggaaggagaagctaggggacagggtcactgcactccaacaactagtcgctccttttgggaagacggatacggcatcggtgctccatgagaccatcgagtacatcaagttcctccacgaccaagttggtgtccttagtgctccatacttgaagaacaacggccatcatcaagtgccccacttgaagagctcaagtcctgacaagtccaaggacgacagccatgccggcgaggtatcactcaagggccgggggctgtgcctggtcccgatatccagcacgttcgcggtagccagcgaggtgcccgtcgacttcgtgtggagtactccatttgctgcccacttcaggtagaagaagactccagctctgatcagaggcgtcgaacgaggcactagctagctaacacagatcgatcgacctggcctgatgatatatatatccatgcatgtntcttagtctagctctagtagtgtatgctcatggttcgtnatctctcgtaactgtagaactaag

SEQ ID NO: 14192 - DNA, 761 bp, Saccharum officinarum
  Predicted polypeptide sequence is orthologous to G2851
tttttgatttaactcagttaaaaggatactaatttacttgtcatatacatatgtgatatgaacttctctaagtacacccggcggcacataaatcaagaagacggcgcccgggacttgctctcctgtcctggccaacttgtacgagcagcattgcacggtatatatatgagtaaagatgttcactaataacttgctagattttaattacatatacatgatcaacgaaataaatttgctgagagggaccagagaagacgatctagatcttcttcttgaagccctcccttgcagatacagatgaagctttgcgcccccaaaaggtcatactactcgcatagcatcaagagcaatcagccttacagcaggtatccttctcccttaccagaatgactgctcatgatgttatgtttccaagcaaccatgcaccacccttgtgatgattcttagagagtacctgtggcctcatgaacatatacttgcacgaaacgaacagcagcgctcgccacatctattttttttgaaactagccgcttgccacatctagacgaccatgcatgcatgcttcagtggtgggtgaattctctagcggaggatcccaccgagcggcgccggggcccagtagtcaacggcgttgtcccctccaaagtgcgatgttcatgacacccggacgaggcacagccccgggctcctcaagtccttctccgtctcatcattcacaccctgctggtcattcaggtggattgcagggtggctggccccag

SEQ ID NO: 14193 - DNA, 720 bp, Saccharum officinarum
  misc_feature (707)..(707): n is a, c, g, or t
  Predicted polypeptide sequence is orthologous to G2851
gattctcagagagcggccgccctttttttttttttttgatagggtgtaaagtttgagggcaaaaactaaacaatgccttattacacgtttcgaccacgcatgctgcagtgacgacgcccaaatgatgaagacttaaatgagttacttacagatccacgcactcctagccttaattaattatctgcagctagcggccctccccatggcatccaaattgtttgatctcgctctagacaagatctctcgtacataaacacacaagttatatactctttcttcatccctctagctatcggtgtgcatatatcatatgcatagcatcaagaggagccagccttgaacattctctttccaccaggatggctgctcctgatgttatgcatgcagcccccatgccatgcatgccgcgtgatacacacacgtatacacacaagtgttcacagcacgcatcgtcctccatcatctacccaccgaaccccatgccgaacgccggcgcagctgccgcccagtagtctccggggccagcgatcacgtctcccacgtccagcgtgcagcttaccggaacgaggcacagaaccctgcttctcaggtccttcttcgcttcctcacagctttcatcctggccagggtcttctggaaatatgctgtgcctttctcctccgtgcacactaccctcgtggagctgctgctgatgcttggagctgcangagccgcccccac

SEQ ID NO: 14194 - DNA, 788 bp, Saccharum officinarum
  Predicted polypeptide sequence is orthologous to G2854
tgagaatgatcctaacaataccaccatatttgttggtgggcttgaccccaatgtcactgaagataccctgaaacaagttttctctccttatggcgaagtcgtccatgttaagatccctgttgggaagagatgtggttttgttcagtttgttaccagaccttctgctgagcaagcgctgctaatgctgcaaggggccttgattggtgcacagaatgttcggctttcgtggggtagaagtctgtcgaacaagcaggctcagcctcagcaggaatccaaccaatggggtgcagcagcggctgctggtgctggtggttactatggtggctatggacaaagttatgaggcttatggcagtgggtatgcacaacctcaagatcctaacatgtatggttatggtgcttatgctggttatcccaattaccaacagcaacaagctgcacagcagccacagcaacaacagtgaggcatgtttgctcgggtaggtcattgggttgtcgagatggaactaattaatattatttcaaagcactcttatattgcattcttgtcaatagaaggtggtttccaaaggctcctgattttgatgggcccatggcccggctcatctatttatatcatatatgcactgggttatgtctatgaacaagtggtgctctactgtgattgctatgttgaaacatgctttctaatttctttcatgcttctcggatctatggtacctgattactggggattgcatatctacggggaggcttattgccttttttggaactgtgccgttttgtttc

SEQ ID NO: 14195 - DNA, 924 bp, Saccharum officinarum
  Predicted polypeptide sequence is orthologous to G2854
atgctttagccgaacaagttctgcaaaattataatggtcaaatgatgcctaatgtaaatcaacctttcaaattgaattgggctaccagtggggctggtgagaaacgtggagatgatggttcagattatactatatttgttggggacttggcctcggatgttacagatttcattctacaagatacgttcaagagtcgttatccatcagttaagggtgcaaaagttgtttttgacagaactactggccgttcgaaaggctatggttttgttaagtttgcagatttggatgaacagacacgagcaatgactgaaatgaatggccaatactgttcgagcaggcccatgcgccttggaccagcatccaacaaaaagaatactggtggacaacaacagccatcgagtgctatttaccagaatacccaaggaactgattctgatagcgatccaaacaatactactgtatttgttggtggtcttgatccgagtgtgactgatgatcttctgaagcaaaccttcagtccatacggagagcttctctatgtcaaaatacctgtaggaaagcgttgtggatttgtccaatattctaacagggcatcagctgaggaggccataagggtgctaaatggaagccagcttgggaggtcagaacataagggctctcatgggggtcgtaacccctgcaaaccaggccgttctcagcaaggaacaaaaacccatgggaggggttggcttttattggggtattccccgaagggataccaatcccattttggtttgtgccttcggccccctcttaaaaaaaacttggtcgttttcacccgtttacccaacccttatttcctgggggtttggagaaaattcaccagagaggatggcccccctcgcccccaaccggattaaaataaattttgtttgtggccccttg

SEQ ID NO: 14196 - DNA, 702 bp, Saccharum officinarum
  Predicted polypeptide sequence is orthologous to G2933
tttgattggtaccggcctccctcggtttttttttttttttttttaccgtgagggggttatgttcccaattttcagcaaaagatgtgttgcaccatgtcttggcaggacatgcatgaaattgtggttacgaactattcatacatacatggtacagtttgtacagtgacaaaaaatgatctgccgttgctatgattcagagaacattatctgcgacaagactcgaactaaacgaatgtgtagttcagatttctgtaattcggcaaccatttcgatcctcagatgttttctgctgtgtaccgaatcatgcatcagaacaaagcaattaaccacattgtttccttttctgggcctcttgaagttttctgaacaccgatgcttccaaatcgctaaatccagttccatcaatgttgcttgcccttgattcatatgtttgtgttgacctcgctggtattccacccgattcttgaacaggagcaacatttaatggaaacagagagaaatggttttgtattgctaataactgtaaaaagagcaaaagtattggtttaagtcattgcacaatgcaagtaattcaattcaaagacaggacatgtcattcagcaatgatcccaaatatttagattttctgtaaccaaacacagaggaccctactttggtcgtataaataaaaacaacagcttatggacaaccagggaaagatat

SEQ ID NO: 14197 - DNA, 787 bp, Saccharum officinarum
  misc_feature (558)..(558): n is a, c, g, or t
  Predicted polypeptide sequence is orthologous to G2991
ctgcactgcagtgaataaaccagagtataggtagtaactgcagttagtctgcggcggcggcagcggcgcagtagctatgacggcggacggcgaaggcggcagcgagaaatcaaagttccggtggctggacgccgcgcgctacgcggtggccgccgcggtgaccgtgctcatcatggccgtcatcgtcaacgccgtcaaggtggtccttcgcaccgactcgctgcaactctccgtcgacaaaggctgcatctccacgacgacgcagtctccagcgccacagatggagcaggccctggtcatggagcttaagctccgggcgcagaatcccagcggccgagtccggatgtactacgtcggcgtcatcgggtacctgttcgaaaacatgacgtcggcgtcggcatcgttgaaaccggattacgactgcatagcctacctcccgctgaaggacatggccgtcgtccagcaggaggcgcttgataactcccttcgcctgacggtgaggaggaagcagatggatccgtcctacttcgacaagctgtacaatggcagccgcatcancgacatgacgctgcggctggcggggacctcatcaacgagggacgtccgagctcaacatgactcgccggaccacctactacttggaggagctccttgttggggggaacggggaccaccaaggttttcagttcaaggcgggaagccatttggcagccaacgaagggccttgaattaaactaaaataggggcatcttttcgattggttaaactttttttaactgccgggatt

SEQ ID NO: 14198 - DNA, 727 bp, Saccharum officinarum
  misc_feature (410)..(410): n is a, c, g, or t
  misc_feature (644)..(644): n is a, c, g, or t
  Predicted polypeptide sequence is orthologous to G3060
cataacattcaggggctttagtggcaaattaacgttttctcaaacttttttcaaaaaagctgaaatctaaagtttaatcgactgaaatcgcaatacaacagtctaaccgcctaacgctgcaaggaaaaaaattcacagtaccaaatggaaagagcacagggcttctctcatgcctaaagcacctcgactctcaagcagcacctctccgctgctcggtctccccatgggcaaagtggcaccggtcgccaaaagtgcaagcacccttcacaaatttctcgcacaacttcgtcttgtatttgttcctgccccccaaaccaccgcctcggcctcctgttgtctccgcggcaacaggtggttttttcaccggcatgcttgccctgatggtcgcaataaggtccctcaccatgtcnctggcttgcttgatctggtcaaaattgccttcaaactcaatgttcttctggctggggttaaactcctgatcaccgattgaaagcttgacccctgtaactctgcttatctgcttagtgttgaccccaccccttaccgattattccaccggcaaaagaggcatccacacttattttgggagttgccaaaacccccaaattttcttgctggaagggccattaaaaactttgttccanagggttcaggtcggcctccattatttacccccccataggaggtccttcattaaaacatttagggggggtttcccaaactcctc

SEQ ID NO: 14199 - DNA, 805 bp, Saccharum officinarum
  Predicted polypeptide sequence is orthologous to G3060
ggggggggtttttgtttggcgcgtttattttcgcgttttttttgttggtttttttaagcctagttagtcaaaatttggataatttttaccaaatacaaacaaaatgctataggaattctgatacagtgtttttctcccccaattctctcatctaaacgaggccctaatatacatggtgatgacaaattccgtcacgctgcaaactctgaatgtcgaacccaatcacaacagaagatagacagaagttggaacttgaaaccatggtaatactgatcgttttggcaacaaatgaccaatttgtacagatcaatcgcggaaacagtatatatagacaacaaattttgctgtggtacagactaaactatatcacacagacatctccatctccatacagcaggaagaacggaagacaaatgaatgaagttgggtgcaggggaactctcaggctgaggtcgggaagcaaagcacacaaaagccttccttcccgtgccgtgagcttctgcccgcggaacagagctcttatgaacgcgtacgtggcaagaggggcggcaccattaacaggtagggaacgcccttttggggggcttgcgggtgattcccggccgaacacccgcggggcgggtcgcaccggcggtcctcatggccaaaattgccaactgttgcatgattctgaacccagcagggttaccaaacctgtgggccaacttttaaacttcccaagaaaaacacaggtgtaagacaaacaaattcattttgggggacccttgggttaaccgggaattcgggaccgtacctggggcgtcca

SEQ ID NO: 14200 - DNA, 725 bp, Saccharum officinarum
  Predicted polypeptide sequence is orthologous to G3061
tatcttcccctagctagctaggtagacacatacacatatcagtagtggtgtatatatacaacaagtgcaagatcaggcgaagctgctagccgcccttggaggcttggacttcacctagtatgttccaccatcagcaggagctcctacaggcagaagctgcagcggcagatcgggagagcagcatgtccaacctcacctcctccgcgtccggcggcctcaacgcgccgcctgctgctgccccgccgccgccggcctcagctggcaacaacaagcgcaagcggaacctcccagggaaccccgaccccgaggcggaggtcgtggctctttctccggcgacgctgatggcgacgaaccgtttcgtgtgcgagatctgcgggaaggggttccagcgggaccagaacctgcagctgcaccggcgcggccacaacctcccctggaagctgaaacagcgcggcacgggcaaggaggcgcagcggaaaaaggtgttcgtgtgcccggaatcctcgtgcgttgcacacgacccgggccgcgcgctgggggacctcacggggatcaagaagcacttctcccccaagcacggggagaaaaagtggaattgcacaaattgctccaaaaagtacgcccccccccccgaaggggaagggccactccaagatctgcggcacccggaaattacactgcgactggggcaaaatcctttcgagcgggaaagtttcacacgcacc

SEQ ID NO: 14201 - DNA, 539 bp, Saccharum officinarum
  misc_feature (474)..(474): n is a, c, g, or t
  Predicted polypeptide sequence is orthologous to G3111
acgcttttttttttatatcaatataactatgtatgtatttgcgtaaattacaggagtgagaagtgctagtttacatacatacatcctacgcttcacccaacgctccaaaatatgtcctccaaaatcacacgccacacccaaaaatacagtagactgaaaaaaaaaacagtttttttttttgaaagacgaacgacgggtcaaggcaagaaggtgtcatatccaggagccggacttgcggccatgagcacgtgaccgcacctcccgcaggcgccgggcgccatgacgggcggctgcgactgctgctgctgctgcttgtgctgggccggggcggcgacgatgccggcgcggcaggaggggcaggtggcgcgcgtgcggagccaggcgtcgacgcaggcgacgtggaaggcgtggccgcagcgcgggagcacgcgcagcgcgtcgccctcggcgaactcggccaggcagatggcgcantcggcggcggcggcagggcggggcggggcggcggccggtgaagggcacggtggggcaacgccgtt

SEQ ID NO: 14202 - DNA, 981 bp, Saccharum officinarum
  Predicted polypeptide sequence is orthologous to G3967
taaaaagaaaaaggtatgttctgcttcttcatcagtaaccatatttaacaaagttacaagcatacaggttacgtacaagtcaagcagttaaatatgcttgtacaacatctgacgtcaggttgaaataaaatcgcatcatgggagcaagccccgcatatgcttttggaaacaccatcatgggagtatcagtttaatcacaccggcgagtcgtccttgatcgagagattagcgtcctactcaccggccctgcatgcagcagctgccagcactggccgtcaagtggccggcgatgtcaaatccgggactggccttgtcagcacgggagagggcagccgagctccttcgccgccgcactgaggaaggcgaacgtcagcccggtggcacggcggctgtgggcttcccattctatgcacctctcaacgtccgcttggcacttgatgatgcctgcgggccaacaccgcgtagaagggttctggatgccattccggtgttgttccccttggatgatcttgttggggttcatcgatccgttgttcaagatgtcacggaagaaggaaattgttgaaggcgcgcacgtgtgcactttgggtgcggaaccgctgggtccaacccgggaaattccgaaccggtaactggaaggcgtacaaactttccctataatggagtcggaattaaagctgggcggaaccatgggcaaggcggttcccgggggaaattgtaatcccgccaaattccacaaaaattatagccgaaactaaaatggaaaccgggggggccaattggtggcaaccccatttattggttgggccatggccctttccatgggaaaccgtttgccctggataatgaatcgcaaccgccggaaagcggttggtttgtggccaagtgttttcttttcccataaacgggacagtggtggcctcaccccggccctaaaaatttacaaagggccaccggtttgccccaaaggaaaatctgttg

SEQ ID NO: 14203 - DNA, 974 bp, Solanum tuberosum
  Predicted polypeptide sequence is orthologous to G28, G22, G1006
cactctcaacaatttaaacccataatcaacaactagaaatatgtttgaaaatatagattttgaaaatgattatgcccttcttgaatcaattaagcatcaattacttgaagattgggaatgggaaaatcctgtaacaagctccgataattcaacctcaacttatagccgaaacaatagtattgagtctaataattccttatcgaatgattttgattattcaactgacaaatttctttccgatttgcttaatgataatgacgttggatatggatcggatcctgtaatcccaaatgtgaaatcggagcctgaaatttggaatttcgcggaatttgcggcggcgacgcagtatacggcggcggaggtgagagtggaaccaccaccaccacaacctatagtgacagcgccgccacagacgctgccgacggcgaggcactatagaggtgtgagacagagaccttggggaaaatttgctgcggaaattagggatccggcgaaaaatgggcaaagagtgtggttgggtacgtatgagacggcggaggatgctgcgtttgcttatgataaagcggcgtttcgcatgaggggttcacgtgcaatgctgaatttcccactgaggattaattctggtgagccggaacccattagagtcaggtcgaagaagtcatcaatgtcgccggaatgttcttcttcgtcgtcatcggataatgcgccggggaagaggaggaagaaggtccctcaagtggtataaaatgggtcgggtcggtttttctcacggatcaaatatttgggcttggatagtttggtaaaacgtatgagataaacaaagatattttatgagattctaaaatcatcaattcaaccgtaagaaaaactaacctcaaaattattatcttttcccatgtaccattcaacccctagagtcgtttggtattatgaataagatataataatttcaggttaaaatttttattctacgt

SEQ ID NO: 14204 - DNA, 980 bp, Solanum tuberosum
  Predicted polypeptide sequence is orthologous to G28, G22, G1006
aagtttcaatcgatacgtaaaattaatatttctttcaaataattatcaaagataaaataatattaatgaaaatatattaatgaaaatcaaactttttacaacttcggattaaccctatgacgataatttttttcattggacttttgattcttctccactatcatagtccgatgcatagagtatttcgaatttattaagggttcgggaaaaatatgcacaaagtatttcgcgttcggaaaagtgccggctatttaactgaccaatagttgatggacacctgtcaattgttcgatttgacatccaatttgtatagcacttgatctactctccactcctccgtcacatttccgaacggcttttcttctccgtttcattgaaccgttttccgacgagcttaccggttcaggcgatgctcgtcttttcgccgtaactcgaaccggttccggttcattcaaaccgatccggtgcgggaaattcaaatgtgcttttgatcctctcattctataagcagctttatcataagcaatagcagcttcttcagctgtttcatacgttccaagccaaaccctagctccgttcttcgccggatctcgaatctccgctgcaaatttcccccacggccgctgtctaacgcctctataatgtcttcccttcggtgtttcagccgccggagctgccgtagtctccaccggagaaggtacaaattcaggcgctgactcaatttcttctctcggttccgattttacttcgccggcggtgaaactaaacggcgaccatccgacgctaagagcgtcctttaatagaccgtaaattaccatatcttcggaatcgtcgacttttagtggtaaatctccccatggttcagttaaacaggggattagacgactgaagcttgaattccggcgatacaccggaaaatctaccgggaaagtcatcggtagtaactgttgatccattttgcttttgatttttgttttttt

SEQ ID NO: 14205 - DNA, 967 bp, Solanum tuberosum
  misc_feature (81)..(81): n is a, c, g, or t
  misc_feature (96)..(96): n is a, c, g, or t
  misc_feature (101)..(102): n is a, c, g, or t
  misc_feature (116)..(116): n is a, c, g, or t
  Predicted polypeptide sequence is orthologous to G28, G22, G1006
ctcatacaaagactttcaaaaactcataatgtatcaattaccatttctacagagttagctccgacttttttccctggcagnaattccctggtgtanttgcnncggagttcaaagtntcaggtaggtctccatgcccagtgtttaaacccgaatccatgggtgtgaactatgcctgttaaaaagtttaaccgatttcccgaaagcataattgggtaattttatggggctttctaacaagggaggccttcagttatcggattggaacgcccgtcaaattttaacggtcagttggaaagttaaaacccgagcccgaagggaggagattgagccagctatgagtacttctgtttctccggcgacagagactgcggcggctccatcggctctgcaacctaaaggaaggcattacaggggcgttagacaaaggccatggggaacaatttgcagcggaaataagagatccagctaaaaacggtgcacgggtttggcttggaacttacgagtcggccgaggaagctgcgctcgcttatgatatagcagcttttaggatgcgcggtactaaggctctattgaatttcccgcatagaatcggtttaaatgagccggagccggttagagtgacggttaagagacgattacctgaaccggctagttcatttggtatcatcagcctcggaaagtggctcgctgaagaggaggagcaccggtgtagcggctaagcaagccggaattagacagttcagagccgtgggacagatgttattcaagttggtttgccaaatggaacaattttccaagtttgggcgaagcaggctatttggttcaggtttaacactattgggagctaaaagaaaccttccaagtcgtggcgcaaggggcctttggtttcacgccttttgaaaggttggtgccagacaaaaatttggcacattccacttcccaccttgtggttgaggaaagttgggac

SEQ ID NO: 14206 - DNA, 785 bp, Solanum tuberosum
  Predicted polypeptide sequence is orthologous to G28, G22, G1006
caactaaaaaaaatcattttctcttacaatcatgcaaggaaaaatatccttagatattgaacaaaattttcttgatacaatgcaatatctcttcaatgatcctgattttccccaaatattatcagaaattcaaactcctagacaatactcaactacttctgatcatcaaaacgcgatatttcctatagcgcaaaattttgttcaagataatatcccgatattacaagagatagaagaaaataaggagtcaacaacacctttggagcataggccgaaaaaatataaaggagtgagaagaaggccatggggaaaatacgcggcggaaataagggaccccgagagaaaagggtgccggctttggctaggtacatatgagacacctgaggatgcagcattagcttatgatagaaccgcgtttaagttacgtggttctagagctgtattgaattttcctcacttgattgaatctaatgtaacggagattaatagagtgaggccgaggagacgtcctcgttctccggagttttcatcttcttcttctcctcctcctcctcgttacgtaggagataataataatgagagtaataataacaatactgataggccgagttcaaagagaagaaatgttgaggctaattaatagcttagctacggtaaacaatttggatggtccaaatattatggagagatgttgacgtctaattattatttgcatgaattaattacaaggtcatcatgaaaagtttcgtgagttacttcttgttctttattaaaatacactatgt

SEQ ID NO: 14207 - DNA, 607 bp, Solanum tuberosum
  Predicted polypeptide sequence is orthologous to G481, G482, G485, G1364, G2345
ggagaagagaaagactttgaatggtgatgatatttgttgggctttgggaagtttaggttttgatgattatgttgagccattgaagaggtatttgcacaagcatagagagttagaaggtgaaagaattaatcaaagtaaaggtgttggtcttggaaataatattgaagataatcaaagggaaagagatgatgaattaacacaaaggggatctacaattccattcaaaatcaccattatggatcgtaagggggaaaacaattttctccctacaagaccttattaggcttcttcttcttcttcttcttcttcttttctctgtttaaccgttcagtatctggaatttactagtctgagtaatttggatttgctccatgtgaagttcattaaagggaagcgctatttatcaagagtttctggtccagacgaattgtcatgaaaaaaacttgggttgagttttacgtctatcttttaggcttcttcttcttctctcttttatctttgggtttaaccatcttgtgtgtgaaacatactgaccctattaatctggattctcgctgcatagggttggagaaatgtttcctctattggaaggtgtctattctttata

SEQ ID NO: 14208 - DNA, 741 bp, Solanum tuberosum
  Predicted polypeptide sequence is orthologous to G481, G482, G485, G1364, G2345
ttctattctgaagcctccaccaccacaattaccatatacttttggccgccatcgagtcagaatttaaagtttataatattctgaaacttcctctaccaccacaactaccacctattttggctcgctatcgagtcaaaatttgaagtttatatattctatctccgtccttgaccagaacctccaccaccggaaccaccaccaccacccccacccatatgattatatgacccatgactaccatacatttgatgaccaccttgaggatgatacatcattgaaccacccataccaccatacataccaccaccaccaccgttatacccacctccagaactaactccaccaccacctccggccatatctccaccacccccatctttctcccctgtacgacccatagtagttttttccccttccatttctctatacttggccaagtaaatcttcaatggctcaacatactcttcgaatcctaaagtcgtcatagcccaaagcaaatcatcaccgttaatcgtcttcctcttctctctctgacacttatccgatgcttctccggtaatgaaactgataaattccgatacacactcttgaactgtttccttagcatcctttgaaattttcgcgttcgccggtaaagctttcttcattattctgctcacgttagctatcggaaggaacctgtcttgctcccttggtgatccttcactgttcgcgttggtgtgacctcctgattcgttgtct

SEQ ID NO: 14209 - DNA, 916 bp, Solanum tuberosum
  Predicted polypeptide sequence is orthologous to G481, G482, G485, G1364, G2345
ctccaacatactgtttgttattagtttcataaaaaaaatccaattaccttagaaatttatctccatttttttgttcttaaagcttgtgtgtactgtcataggcagatcaagatagggacaagactgcgtacacaccactctcgtagaattgcatttagtatgttattgtttgtcagactatttttcatataacagagtaaggttgtgtatacattaggctctccaaatccacttgtgagattattcagggtaagttgttgttcttgtagttctccacaaagtattatctgagcaaagggtatatcgaaaaaagtctctctatcttcacaagatagtggttttatatttgatcaccaagatttaaggatttcgatggcggattcggacaatgaatcaggaggacacagagagaacagcaacattgagagttcactaagagaacaagacaggttccttccaatagcaaatgtaagcagaataatgaagaaagctttaccagctaacgcgaaaatctcaaaagatgctaaggaggtagttcaagaatgtgtttctgaattcatcagttttatcacaggggaagcatcagataagtgtcaaagagaaaagagaaagacaatcaatggtgatgatttgttgtgggcaatgacaactcttggttttgaagaatacattgagccactcaagatttatttgcagagatttagggatttagaagggcaaaaaagtggtgtttctggagagaaagataatggtggatcagtgaatataggtggttatgttgaggactatcatggcatgatgatgatggggaatcaacatcatcaaagacacgggtatggtaccggagtatataatcatcagacgggggagaatgctgcaggggttggtacaggagggtcgcgatttcctgatggtg

SEQ ID NO: 14210 - DNA, 924 bp, Solanum tuberosum
  Predicted polypeptide sequence is orthologous to G481, G482, G485, G1364, G2345
caaaatccaaaactctgcctcatctcagtcgtctccctttctcccttcttctccaacgtccgatcttccagttccctccatccccaggtatggcggatggtcaaggttcgtctaggtcaccggcgagtccgaacggaggtggtagtcatgagagtggtggggaccagagtccgaggtctaacgtacgtgaacaggacaggtttttaccgatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaagaaagactattaatggtgacgatttgctatgggcaatggcaactcttgggtttgaagattatattgaaccactcaaggtgtatcttgctcgatacagagagatggagggtgacacaaagggaacgtcaaaggctgctgatggctctactaaaagagatgggatgcaacatggtcctaattcacagcttgcacatcaaggttcatactcacaaggaatgaattatgggaactctcagggtcagcatatgatggtcccgatgcaagggacagagtaaaaatccgatcttcgttctgtttgagaagacggtggacttaaaaacatattctatatatagatcttctgctgtaacctctgttatcatgggtttatttattctaggtgctctctagtgaggtgccatggtcatattttaaaacgtttgtaaaatttaggagattgtttcacgaaattattatgggaccatggattgtttggtagtaataattgcaacggggcgggccgggtaaccccaattcggcctattaggtggaggtcgtattaaggcgcggctccactgggccggccgt

SEQ ID NO: 14211 - DNA, 830 bp, Solanum tuberosum
  Predicted polypeptide sequence is orthologous to G481, G482, G485, G1364, G2345
ggacagataccttccgatagcgaacatcggtcgtatcatgaaaaaaggattgcctgctaatgctaagatagctaaggaagctaaagatactgttcaggaatgtgtttctgagttcatcagcttcatcactagcgaggcaagtgacaagtgtcaaaaagagaagagaaagacaattaatggagatgatttggtatggtctttgaccaccttaggatttgaggactacattgagccactaaaggcctatttgattaggtacagagagatggaggtatgcattgcttccccgcatcaatgatatagagttgctttttgtctttacctctgatatgtcactagctatgccttggggattgtttctaatgtcagggagacaccaagggatcttctagggctggagatacgtctgctagaaacgatatagttggaggtcagctcagtccaactacacagtttgtctatgatgggtctttttcccaaggcttcgactatgggaactcccaaatgtgaatttctaaaattacaacggtgctgatgcgagtatcttctgccttccgttcatgttgatctatgtactaagccattcaatggttgctgataatatatgtttgaaagctctaggaaccgaaagtatgctgcaaatcttgaatttagccatacaacaaaacactttattttctgaacttctcttccagtactttgatgctctgtacatgtaacatgtgaattggattttattgttgtaaactgagagcaatcttctttttctgcaaaacttggtaagttctataggtgagtgaccttaactttctgtatgaagttggttttaa

SEQ ID NO: 14212 - DNA, 338 bp, Solanum tuberosum
  Predicted polypeptide sequence is orthologous to G481, G482, G485, G1364, G2345
cacgaacataaaacacaaacaaattaaagatcaacacaaaataagacaaaagtgtagaggagcccttttttgtttgtttgtttgtttggtactgttgatgcctgtgttgggctccaaatttacaactctgtttctatagagaagaaatttggggattgggcttccgaccatggcccattaagcgcaaagctcacgacttgtttgcctccaagcccacatgaggaatcaatgtactcaaggcccaaattagatcgtcacctccaacattcataaaatattctttttctaaatagatatctcacagagtttattacaagtaaaaaaaaaaaaaaaaaaaa

SEQ ID NO: 14213 - DNA, 1072 bp, Solanum tuberosum
  misc_feature (748)..(748): n is a, c, g, or t
  Predicted polypeptide sequence is orthologous to G481, G482, G485, G1364, G2345
ctgccgttggatctatgtgtatagcgcagaaaagctcagcatccattttccgccaaattcctttctcaagcaaaaactaacaaaatattctcttggatcaacctctacctacgatcatccataaagttagggttccggtacactgagaatggcggagccggcaagtccaggaggcggcggcggaagccatgagagtggcggtgacccgagtcctcagtccaacttgcgagaacaggataggtacctaccgatcgctaatattggacgcataatgaaaaaggcattgcctgctaatggaaagatcgcaaaggattctaaggacactgttcaggaatgtgtatctgagttcatcagttttattactagcgaagctagtgacaagtgtcagaaagagaagagaaagacgatcaacgggagatgattatactattcagccctgggctacccttgggattttgaggaactacatttgaacccacttgaaagggtctaattttgaactcgaataacagaggagatggacgggaagatgcccaaagggaatcttggcaaggggtttgggtgaattgcatccttggttagcacaaaagacgtgtagttgggaaacgtcaaggtttgggggtccaaataacgcaaggtccaatggttattggaagggttgcctctttggccccaaagggttttaggaccttattggaaacttccccaagttattggattatttcacgaattggaaccaaaggaactntttgggatttgctttacgcaaaaagaaaggggttgtgattaacgtttgcaaacagagtggttaagagcccttttggctgggtacacaagaatgtgcaggacaaggggtgtctcctttctatggacggaacccccggggtgtgaacacgtgggtctaagcagcgccaagtggttatgaggggacctattaaacaccgctataagagggagctccccttacgtaagatttttgtggcgcagaaaaatatttttcgggttgggcgagataaccttggagtttaaaaatctctctttcccgggcctggtaaaaacccgaggggggttt

SEQ ID NO: 14214 - DNA, 864 bp, Solanum tuberosum
  Predicted polypeptide sequence is orthologous to G481, G482, G485, G1364, G2345
tcattcattacatccgaaagatacataatcagcaaacctataaattcaactacaatacttaacacatactaatttataaaagcaataaaatatgttaatttaaaaagaaaaaaagaaaagaaaaataaacataacctaaaaataaggtgtatgcaatatgttgagaaaacaaagtacataatatttttttcaaaaataaaataaaaataaactaccattcaaccccatgaagattagctttagatgtcaaattctcaccataattttgtgaaaaattcccattattatagctctgaataaattcaggccttgctaatgagaattttggtaaccattattattatcattataactagtacccaataatattatttgtactagttataattggttcatgtgaagtttcatcatttctagccatgatattttttttccccttcactttctctatacttatttagataaccttttaagggtccaacataattttcaaaccctaatgttgtcatagcccataaaaggtcatctccattgatggtcttcctcttctctctttgacatttatccgatgcttcgcccgtgatgaagctaatgaactcagacacacattcttgaacggtttctttggcttctttggagattttcgcgttggctgggagagatttcttcatgattctactaacattagctatagggaggaacttgtctagttctttagagaagttatcggatgtgttgcccgataacgggctttcaaccgggctagttagggttttttttccgtcatgatgataatgataatgatgatgaacgtcgaaagaaattaaagaggagatgtgtaaggggttttgtttggtttgggga

SEQ ID NO: 14215 - DNA, 897 bp, Solanum tuberosum
  Predicted polypeptide sequence is orthologous to G867, G9, G993, G1930
cttcctaattttccttttctcatcaaacaaatcaacacacacacacaacaaaaaaagtttaaaaaaatggaaggaagtattagtagcatagatcaagagagtactactagtgactctctctccattgctccggcagcatcgtcgtcaacgatgataaaatcgttgacgacgataaaaccgccgccggagagcggcctttgccggatggggagtggtacgagtgtgataattgatgctgaaaatggtgttgaagctgaatcaagaaaactcccatcttcaaggtacaaaggtgtggtcccacaaccaaatggtcgttggggcgcacaaatctatgaaaagcatcaaagggtttggttaggcacatttaacgaggaaaatgaagccgctagggcttacgacgtcgcggcccagagattcaggggccgcgacgctgtaacaaatttcaaacccttgcttgagaatcaagaaagcgatgacatggaaatcgctttcttgaattcgcattccaaggcggagattgttgacatgctacgtaaacatacgtacctcgatgagcttgaacaaagtaagagattatttggatttactaaagatggtatgataaacagaaaaaatggacaaataattagttcgatttttggtagtacaaatgataaagtcaattgcaaagcgcgtgaacagctatttgaaaaggctgttacaccaagtgacgttggaaagcttaataggcttgtgataccaaaacaacatgctgaaaaacattttccattacaaaatggaaataattcgaaaggggttttgttgaatttcgaagatttgaatggtaaagtttggagatttaggtattcgtattggaatagtagtcaaagttatgttttaacaaaaggatggagtcgt

SEQ ID NO: 14216 - DNA, 722 bp, Solanum tuberosum
  Predicted polypeptide sequence is orthologous to G1274, G1275
ttcttcctataaatataaataattgtacataaatagaacaacatacaatatttcttataaaattaataaaagtcttgattattctcctcaagaagatcaataggaagaagatgactcattcaaaaagttgtttgctggcttttcattgcagtaaatgataaagggactttcatgattgtgttttccttcatatgtagtcatcaaatatcttgaatcatttccatctctttctacctttttctttactttgcaatctccacttgaacacttgtagtaattccttagatttatgttggttttcactttctttttcccatatttcctccatttgtatccatcatccaaggtctcaagttgtgtctttgttctaaaagcaattgcatgtttttcacctttcttttctttctcaatccccatgcttgaattttcatgattcatgtgtacatgtgttggtgtggcatcaaatgaactagctgatgatgagtttccactagtactataggtactagtacttatctcttgtttcatgaagagattttctgaaaaaattgaagcattattgtagctattatttgagtaattggaataatattcttgatcaccatcaactaacaaatcaagaaataaagtgtcataatcttgatacttattattattactattgttatggccataatcttgattcatgttgatgagaggatcatgaaagcaaaagaataggg

SEQ ID NO: 14217 - DNA, 742 bp, Solanum tuberosum
  Predicted polypeptide sequence is orthologous to G1274, G1275
tttctatcttttctttcccttcacaatggaaaattttccatatagctcatcaaaccctaaccctaatttcatcgatgcatcggagaattttgagctctcagattataattatctctttcttgatgatggatcaaatgacgattttttgtcacaaaatgaaattgttcaaagtgtttccgatagtagtggatcatattcaaataatcccactccaacaagtcataacataaaatgtatgaaaggtgtaaagaaggtggatgcaaagtctagggttgcatttagatttagatcagagttggaggtgttggatgatggatttaaatggaggaaatatggcaaaaagatggtcaagaatagttcaaatccaaggaattactacaaatgttcaagtggaggatgcaatgtgaagaaaagagtagaaagggacaatgaagattcaagctatgtcattactacttatgaagggattcacaaccatgagagtccttatgtgtttcactacacacaattccctcccaacaatattgcccttcacaatctttgcctttagaaccttttaaacgtgtcagtaaatttcagttatatatttgtataatggtaggttctaatagaccactttgatcatatgataaagtgtttctattaaacattttcgacttatgttttaaaaaaatgtgtgcacgtgttttcaagtgcccgatatatagataagttaatcacataaaatatgtctctttctttg

SEQ ID NO: 14218 - DNA, 343 bp, Solanum tuberosum
  Predicted polypeptide sequence is orthologous to G1274, G1275
aatcatgtagaggcggattcagaatttgaattgaattttcatcgtcgaggagggaagagagtagaaagagatcatggacatgattcaacctgtatgattactacatatgaaggcaaacacaaccatgaaagttgttcctctatcatatgcagccatgaaatgcccactgaatttcctcaatgaatggactttgaaaacaacttcataatttccataaaaagcaatcgggatccctttgtaattttcttgtacaaatataacataggacattatattatatacatacgtttaattatttcatcaattatatcgtgtgacatgtaaaaaaaaaaaaaaaaaaaaa

SEQ ID NO: 14219 - DNA, 955 bp, Solanum tuberosum
  Predicted polypeptide sequence is orthologous to G1274, G1275
gttatttctctccaaacacaatgaactccaccttcctagaaacaaacattcctcatatagaaaaccctaatttcacctttccctttctttactcacacatgactaatcaagattgtacttacaattttcaagatacttttcttgatcaagattttaaattttcttcatttcttgatcatcttcttgttgattatgttcctacctataacaactccaataatactcctcttttagaaattaatccctccatgcatgaaataagtagtagtagtagtgccaatagtgcaagttctaccacttccttttatgcaccaccaccaaatattaatcacttgaaagaaaaatccaaagtggggattataaagaaagagatgataaaaaagaatgaaagacatgttattgcttttagcacaaagactcaacttgagattttggatgatggatataaatggagaaagtatggcaagaagaaggtgaaaagtaacacaaattatttgaggaattactacaagtgttcaattcgaggatgcgaggttaagaagagagtagaaagagatggacatgattcaagctatttgattacaacatatgaaggtaaacacaatcatgaaatcaactcctttatcatttacaatcatgtagaggcggactcagaatttgaattgaattttcatcgtcgaggagggaagagagtagaaggagatcatggacatgattcaagctgtgtgatttactacttatgaaggcaaacacaaccatggaaagttgtttcctctattcatttgcaggccatgaaaatgcccactgaatttcctcaatgaaatggacttggaaaccacttccttattcccttaaaagcaatcgggaatccttggaatttcttgtccaaatttaccttggcaattttttttttcacccgttattattcccatataccggtcctttaaaaaaaaaa

SEQ ID NO: 14220 - DNA, 461 bp, Solanum tuberosum
  Predicted polypeptide sequence is orthologous to G1274, G1275
tttttttttttttttttttatataaaactctttaaatatagcattatacagtataaatcctgttggaagcaggaaaagagtacatgccaactgaaatgttctaattgatttcattttaagttacagatagacgcctccatctgactccagtcaagctggaacaggttaggagatccaatttactggcctgatttagctaagctacagtactcatagtaactttgaactgatctcttcttcatcgatcagaacggggatggaccttgatggttgtggacaccctcgtaggtggttatcacataccgagaatcctctttgtctcgttcaactctcttcttcaccggacaaccttccacggagcacctatagtaattcctgtaagttgatacacaaaacatgctcatgtgagttataataagtagttatcatacaagtttccataagctgctatagagcaaaag

SEQ ID NO: 14221 - DNA, 716 bp, Solanum tuberosum
  Predicted polypeptide sequence is orthologous to G1760, G152, G153, G860
gctttgatttcatttctaaagccctcaacaattaatccaaatccaagtaaaaccctagatgggaaggggaaagatagtgatccgaaggatcgataactcaacgaacaggcaagttactttctcaaagagaaggaatggattgttgaagaaagctaaggagctcgcgattctttgcgatgctgaagttggattgattattttctctagtactggaaagctctatgagttttctaacaccagcatgaaatcagttattgaacgatacaccaaaacgaaggacgattgtcagcaattgcacaatccagtgtcagaactcaagctgtggcagagggaggcagagatcttgcggcaacaactacaggatctgcaagggaatcaacggcaattattgggagaggaggtaagtggtttgggcgtaaaagaactaacagatctggagaatcaactggaaatgagcttaaagggaatccgtatgaaaaaggagcaaatattgaaggatgaaattcaagagctaactcgaaaggggagcataatacatcaagaaaatttggaactctacaagaaggcatatggtacaagagatgctcatgcagtgaatggaaacatcaactatatatatccgtatcgctttacagtgagtagagaagttcaggcccccatccatctgcagctaagccagcctgagacacaaaattttgagaatgcagtaggaacat

SEQ ID NO: 14222 - DNA, 679 bp, Solanum tuberosum
  Predicted polypeptide sequence is orthologous to G1760, G152, G153, G860
ctccttttgtcttctccatcaacagcaactttttttttcccttttcctcgaaaaattcctccactgatttgttcttctgcttcttctcgtgaattcaatttctctgagagagagagagagtgtgtgtgagatcggcgatggggagaggaaagatagtgataaggaggatcgataattcgacgagcaggcaagtgacgttctcgaagaggagaaatggattgttgaagaaggcgaaggagctagcgattctgtgcgatgcggaggccggagtcattatcttctccagtactggaaaactctatgaatattcaaacaccagttttggcaaagggaagcggcaatgctgaggcaacaactacagaacttgcaagagaatcaccgacaaatgatgggtgaagagctttctggtctgagcgtcaaagatttgcagaacttggagaaccaactggaaacgagtctccatggtgttcgtgtaagaaaggacgaaattctgattgatgagatacaagagctaaaccgaaaagggaaacctcattcatcaggaaaacatggactatataagcacgtaaacctaattcgtgaagaaattatgacttgtgtagcaggtatcatgtacatcactaaaagttcacatgttcagatcattgtttctatacagtgaagaggaacatatctctag

SEQ ID NO: 14223 - DNA, 569 bp, Solanum tuberosum
  Predicted polypeptide sequence is orthologous to G1760, G152, G153, G860
tttttttttttttttttttttttaagtccaagactaataactataggcatgaattacaaatatatgaacaacttagtgtcgcccctttagaagaggttcattgacaaagaaaagtatggcttagaacattgatgacgacactaataacacgcattacgcgaggcgaagcggtcaacacgttttgagcctcatttcaggacttaagcgtgcatttgataatacgggtctttaataatttaaacatatgtttgtgagttggaacacttggtcgagaagagaggctaatggcataatgtgcatattctccactaatgcagtgacagcctcaattttgtagttcctggcatttcatagtgttgtagctgtggttggcttagctggagatgaagaggtgtgagagggtcctcgttgacgcttaaactgtttgaactcatggcatttctactcactgcatttgcttctctagttccataaaccttcttatacaattccatattttcttgacgaacaaggtctagtttcttataaagttccttgttcccttgatggctgaagtctctctttcggtt

SEQ ID NO: 14224 - DNA, 470 bp, Solanum tuberosum
  Predicted polypeptide sequence is orthologous to G1760, G152, G153, G860
ctctcttctctctctctctctctgtagaatcagtctactatcaaaatctctcaaattatagcatttaatcgagaagagatgggtcgaggaaaaatagtgatacaaagaattgataatacaacaagcaggcaagttactttctcgaagagaagaaatggacttctcaaaaaggctaaagagcttgcaattctttgcgatgctcaagttggactcattgttttctcaagcaccggaaaactctatgaatttgccaacaacagcatgaggtctacaattgatagatacaacaagataaaggaggagaataataacatgaatcccatgtcagaggtcaaggtaacctgatttttgttttgtttccacaagtgtatgatatccttttggatgtccttgtatatatatatggataatatgctgattttattcatgctattctaaaacccttttaattaaaaaaaaaaaaaaaaaaa

SEQ ID NO: 14225 - DNA, 962 bp, Solanum tuberosum
  Predicted polypeptide sequence is orthologous to G1945, G2155
ctatcttattcacatcttcattatcatattataaagaaagtataattttaatttcttttttatcaaatgaaaagagagtatgtactagaagaaaaaaataaaaataaagatcattctagtaacacaaacactatgtttggtaaacttcatcatcaccaaaatcaatctcctcaacattttcaacaccatcaccaacaacaacaacagcagcaccttcagcagcaccagcaccagcatcagcagcataattttcaccatccagcttttcaactaactcgcgaatgccaaacttcagaggaagcagacagtactactcatcgaatgagtcctacaaacagaaacgatactttaaaccctcaaccggttaatgcagtagcaccgccgccgccgcagcagcagcagcagccaccttcctccgccggtaacgacggtgctacgattgaagttgttcgccgtccccgcggccgtccgcctggttcgaaaaacaaacctaaaccacctgttataattactcgtgatgctgaaccatctatgagtccttatatacttgaaattccaactggagttgatattatcaactctattaccaagttttgtagaaaacggaatatgggtctttgtgttcttaacggttcaggtactgtaacgaatgttactctccggcaaccgtcaactacaccggtttcgactgttacctttcatggcagattcgatatactgtcaatttcagcaacagttgttcaaccaaatgcgagtgttccatcgaacaatgggatagcaaatgggttcacaatttcattagcaggtccacaaggtcaagttgtgggcggtggcgtaatcggacctcttgttaccgccgggacggtgtatttaatcgctgcaacttttaacggtccgtcttatcatcggttaccggcggaagaggaattagtaaggaataattctggtggtggaaatgaaga

SEQ ID NO: 14226 - DNA, 989 bp, Solanum tuberosum
  Predicted polypeptide sequence is orthologous to G1945, G2155
ccaattttcttctacaacttcttatattctatctgttttttttcttttcttttttatatatctctataatatctattttaatttctataaatagagagacaaaaagaaataagtactttttattgataagaaaatgaaagaaaaatatgtagaagaaagaaaaaaccactctaacaatatctatacgtttgctaaacttcatcaaatccaaaatttccaggtccaccaccaaccggcagtatccaccgcagcgccgccgtcctcctccgctaacgacggcgccaccatcgaagtcatccgccgtccacgtggccgtccacccggctcgaaaaacaaatccaaacccaaacccgaacccaatttcttcacagcagcacgtgatgaacacgtgggaaaacccactatgagtccttacatcctcgaaattccaatcggaactgatattatcgattcgatctatcgattttgtgggaatcaaaatatgggtctatgtattcttaacgggtcgggtactgttactaatgttacacttaaacagccttcaattaacccggctgattctacaattaccttccatggaagcttcaatattctttcgatttcagctacaattataccaagtcgggtcgcgaatggattcagtatttcattagccggaccacaaggtcaggttgttggtgggccggtaattgggccacttttagctgctgggccggtatatttaattgctactacgtttaataatcctttctattacaagtttccggcggaggacgacggcgacggcggtcagtcgccggtttccggcgccggagatagtgggaagccaccggaatcaactcatcatgaatattgttatagttctaaccagttgccatcggatgtgatatgggcacctaccgctagacaattaccaccttactaaagtcgtattcagaatgtgaagtttacgaatttagatttaaaatttatcttgtgtcttggtgagt

SEQ ID NO: 14227 - DNA, 881 bp, Solanum tuberosum
  Predicted polypeptide sequence is orthologous to G2
aaaagtattcctagtaaaatatttggcttctctatgattgctccacctaataataataataacgacgataacttatcgtcggagagtgaaccgccggttacccggcagttttttccggttgatgagtcggaaatcggaagtggcaattttaatgatagatcttgtagatttccaagggcccattgggctggtgtaaaattctaccaaccggagccatcgacagcagtattgggaaagggtagtgagttgtcgcaggtgcaggtgcaggtgcagccaatgaaaaaaaagccggcgtggtccaaggtctagaagctcacagtaccgtggtgttactttttatcggagaactggccgctgggaatcacatatatgggattgtggaaagcaagtttatttaggtggatttgatacagcacatgctgctgctcgtgcgtatgatagggcagcaataaagtttcgtggagtggaggcggacataaactttaacctggaagattatgaggaagatttaaaacagatgaagaatctaacgaaggaagaatttgttcatgtactgcggaggcaaagtactggttttccgaggggaagttctaagtatagaggggtgacattgcacaaatgtggtagatgggaagctagaatgggccaattattgggcaaaaagtacgtttatttgggactctttgatactgaaaatgaagctgccagggcttatgataaagctgccatcaactgtaatggcaaggatgcagtcactaacttcgatccttgcatttatgaaaatgaacttaattcatctgaatctagtaataaagcagcagatcacagccttgatttaagcttaggtagctcgagctcaaagcaaaagagccgagaaatgg

SEQ ID NO: 14228 - DNA, 893 bp, Solanum tuberosum
  Predicted polypeptide sequence is orthologous to G2
gaaacaagtttatttaggtggatttgatacagcacatgcagcagcgcgtgcatatgatagggcagcaatcaagttccggggagcggaggcggacataaactttaccttggaggattacgaaggtgacttaaaacagatgagcaatttaaccaaggaagaatttgtgcatgtactaaggagacaaagtactggttttccaagaggaagttccaagtatagaggagtcactttgcataaatgtggtagatgggaagctagaatgggacaattcttaggcaaaaagtatgtttatttaggcctatttgatactgaagttgaagctgccagatcttatgataaagctgctatcaagtgtaatggaaaagatgcagttaccaactttgatcctagcatttatgaaaatgaagttaactcaaccgaatgtagtgataatgcagcggaccacaatcttgacttaagcttaggaggttcaagccaagaaatgggggacaataggggtcaaaattcttcatctaatttgcaattggatgtccattggggccaccaagggtcatcaaggcttaataagccacgtagccaaatcaattttgatggccaaaaaagaagtggatataatgagactgaaacattgcaactcttgagccaaacgcaccttaattcgtcaggcagagtgcaaccaaatattaatgaaatgcaaaagtttggcgaatttattagagatggtgaaacacatatggttcaagcctatccccggcaattcaattcatatcaagttcagacttcgagcaacaataatgtaggccaaattggggcaacaagtaattctcaagaatggcaccctaattatgagataattacaactgctgcagcatcatcaggattcccccagcaga

SEQ ID NO: 14229 - DNA, 663 bp, Solanum tuberosum
  Predicted polypeptide sequence is orthologous to G4
ggtagaaactgccttttcaccttctcaccggtaccggaaaaagcatgtgtggtggtgccataatctccgattggataccgccgcctcgatcgtcgagccgactcaccgccgaccagttatggggttgctccgatgtgcaaaacaagaagaagaagaacaagaagaggaatccttccaattaccactctaagtccttgagatctgaaaatgtagactttgaagctgattttctggattttaaggatttttctgatgatgaagaagcttattgtttggatatcaaaccctttgctttctctgcttctgaactctctggaacctctgctggatccgaatcattgatatctgttgatgcaaaggaagttgagaaatcttccaagagacagaggaagaatcagtatagggggatcagaaagcgtccatggggtaagtgggcagctgaaatacgtgatccacagaagggggtccgagtttggattggaacttttaatactgcagaagaagctgccagagcttatgatgctgaagctcggagaatcagaggcaataaagctaaagtaaactttcctgatgaagcttcagtgcctgcctcgaggcaagctggtaaggtaaatcctcgaaaggttctttctgatgagagctctaacccagttctatccaaca

SEQ ID NO: 14230 - DNA, 1012 bp, Solanum tuberosum
  Predicted polypeptide sequence is orthologous to G4
agttttgaataaattaatacaatacatattagtcttggtttggagataacgtaaacgcaaacgcaaacttcactcaaatgaagcgttatttacaaaacttagcaagggaagacgtttatgcagcttagtaggcgcctcccattaaagaaggtacatcatcgaagaaccagaggtccatggcgtttccaccatcctgaattgcacttgtattgaggaaggcatcaactgatgcatccccatttccctcaagatatgggatctgcaagaacttcatctgggattcaaaagccgataactcttcagatagcgtgttcacagtgttaccgtcatctgtcaatgaagtgctggaacaggacttcagttttttctctggtctggcatcttcatcaaaatgagtctcattggtttcgagaacttctgacagaacagatgagatctctggagtccttgcacacggttcaccccaaccgaaatcagagcagtcaaaagtgttacttccttcatcagagctgaagtaaacatttgtaccagctgaaggggaaactgaacccagtcccatatctccagcagtaaaacacacattctcatagccgtactgctttgttgctggtttctcttcgaaaaagctgaacgattcatcggatccaccatccaggttattaatataagtcatgtcaggctgaactgtgttcagggtttcctcacgaagtgcctcctggggattttgcttaacaacacgtctagaaacagacactggagcttcatcaggaaagttcaccttagctttcttgcctctgatccttcgggcctcaacatcataagctctggctgcttcctacagcagaattgaaattccaagccagaatcggaaatcctttccttgggatcacgtatttcaggatggccgaataaccccaaggaacgttgtctgaataacccgggactgaatgttctctttctctttgggaggatcttggcagcatcaccagtttggaatcacagatcttcacag

SEQ ID NO: 14231 - DNA, 1043 bp, Solanum tuberosum
  Predicted polypeptide sequence is orthologous to G4
atccatacagcccaattgtttttaagaaaaacttgaaatttaacatctctagtaagtagttaattaaacctaattacctatgcactgctctattgagtgcataatccatggcttaatcatgtttctctgtggatcattcttcttccaccaccagacacacatgaagccttatttacaaaacttaggcatgttgacttaaaagatacctcccattaaagaaggaacatcatcaaaggaccacagatccatagcattttcaccattttgagttgcacttgtgttgaggaagttaccaactgatgcatcccaatttccctccatatatgggagatgaaagaaattcatctggggtgcaaaagcaggaagctcttcagatagcatgttaacggtgtttccatcatcagctacgggattgttggtgcatgatttcagctttttctggggattggcatcttcaacaaattgagcttcattactatcaacagcagctgacagaacagatgatatctccggagtcctggagcatggctctccccaaccaaaatcagagcactcaaaaggagttgcttcctacatcagagttgaagtagatatcaccaccaactgaagggacgaatgaggccaaatcccgtatctgcaagaagcactgcttacatactgctttgtcatgggtttctcttcaaaaaatccgaaaagaatccataatggtccgctgttcattgattgctgagatccggattgaaagttgaatccaggctctcctcaggaaggacctcctgaggattcacccttaacagtgtgtcttgaattgcacagtgctggaactttcatcgggaaaatttacttagactttcttgtctcctgatctcctaaactcataatataagtctgcaactcctctgcagatgaaggtcccagcagaacccgaaccctttcctggctcacggtattcagtcgccctcgtgccaaggtcctgctagttcccctataatggattccctcttaagaatttatcacggttcttgtgaacacacgtttcaaat

SEQ ID NO: 14232 - DNA, 941 bp, Solanum tuberosum
  Predicted polypeptide sequence is orthologous to G5, G974
ttcttcttcttcacttttccttcttcagatttccaatcttttccttcatttcctcctccaactcctaccatttcatatccctacacttcttctttttacccatctactatgagctctgaggtttgttcgacttccacagagatgaattcccaaatcttatcaactcggttttctgggtatggaatggagcaacagggttcaattgggttgaatcagttgaccccaatccagatccagcaaattcaagctcaaatcaacttccaaaaccaacaacaacagcagcagatgatgttacagtctgcccatcatgcttccaccatgaatttcttggcaccaaagccggttccaatgaagcaatctgggtcgccaccaaaacccactaagctctacagaggtgttagacaacgccactggggaaagtgggtcgccgagatccgtttgcctaagaaccgaacccggctttggcttggtacatttgacaccgcagaagaagctgctttggcttacgacaaggcggcgtatatgcttcgaggtgattttgctcgactgaacttcccccaactccgccacaacggcaacctaatcggcggcgactttggtgaatacaatccattgcattcctctgttgatgctaagctaaaggacatatgccaaagcttggcacaggggaagagcattgactctaagaagaagaaaaccaaagggtcgtcggcggagaaagcggcggtggtgaagatggaggaagaggagagcaaaacggtagaagttggatccgaaagtgacgggtcgggttccgggtccggtggatcatcgccggtaactgaactgatattcccggagttcactgaggaagagacaacttgggacatgtcagaaaatttcttggtgcagaagtatccatctcatggaatttgattgggcgtctctataaaattagaaaa

SEQ ID NO: 14233 - DNA, 707 bp, Solanum tuberosum
  Predicted polypeptide sequence is orthologous to G12, G24, G1277
caaaagttctttcatataatatactatctaattttctccttccccatcttctttcttccttctgaaacaagtgagtatatttttttgaaactatgatggaaggagaaaagagaaagcagagggaacaccaacaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaattcatagttgatgaccatgaaaatcacgatctatcagctgcttctattaggaagaaagctactgaggtaggtgctagagttgatgctcttcaaactgcgattcataattctactgctattcctcatgaatccaattctaaatccacaaggatgatgatgaagcctgatttgaatgaatatcctaccccagaaagttgcgacgaagataattgaatctctgcttcaaattaaagccataagcggcgagttacagaggcgaaaaggggattattgttatgacgattacatatattgaggatccatgtatgaaatataatccgaagggattatatgttaatattatcaattatggtagttattaaaagaaattaatctccaaattacgattag

SEQ ID NO: 14234 - DNA, 854 bp, Solanum tuberosum
  Predicted polypeptide sequence is orthologous to G12, G24, G1277
tatgacaactggcttttccattattgaattccctctaaatttcccttagctcacataatacgccatctcccatcattagaacagccaaatttgattccaaaaacaaagaggaaatccaagagagataaaaaagaagaagaggatatttacacctacatctctagctatatagcctataggtgaaaatttgtgaggattttggggagcttttaacatggcggatggccaaccaccaccatatcttatgaggtccgagcagctaagcttttgttgaataaacaaaagggccaattgaaaaaattatactatccagcaggttactggtattactattattattattgattgtgtcggtgctttcaacatattttcttttcatttttcattttttttgaggagtcttttattatagagttaataatttaaaaaaatgcttttaagaaaatcaacgtagagtagccacaaccgctaccacaataaccttttcttcattcactaccagcttttgccttttcatgggtattctttctctctctgttattcctcccagtttattagctctagattacagggaaacaaaaattttgtaatttagtccctgtaatttcgcataattattatacagtaagagaaagatggagataggtggtgggggtcaaagtggagttgctgcaagttcaggggtttgttgtggtgggaagagaaagaacgaaaggccgtacaaagggattcgtatgaggaagtggggaaaatgggttgcagaaattagagaacccaacaagcgttcgaggatctggttgggttcgtattcaacgccggtggcggcggcgcgggcttatgatacggcggtgtat

SEQ ID NO: 14235 - DNA, 624 bp, Solanum tuberosum
  Predicted polypeptide sequence is orthologous to G15
tgcttgtcaaaggctgactatatactgggtgggactgaaaaacttttccaaaagctgttttcttccttatgatcacataataaagagaaagaaaagttctttatcatcaatttgtatggttcactaaaactgtcaattttgatgttcataggcacacaagaagaagcagcagaggcttatgatgttgctgcaatcaaattcaggggtgtaaatgctgtgacaaactttgacatatcgcgatatgacgttgaaaagatcatggctagtaatactctgcctgctggtgaattagctaggagaactaaagaacgagagccaattgaatacaacaacaacaacaatgacataggaggtgttggtggtcacaagaatgaggaatgtgttgacaacaacaacaatgggaatatcacagattggaacaatggtgttatatcaaacatctaatccttcagtaggattgaattatcgcaaccctacatcattctccatggcattacaagatttgattggcattgattcgatgactaattcaaataaccatcatgccacaattcttgatcatgaacagaacaagattggtaaccactttttcaaatgcgtccatctttggtaactagtcttggt

SEQ ID NO: 14236 - DNA, 1132 bp, Solanum tuberosum
  Predicted polypeptide sequence is orthologous to G19
ctttcactcaaaaaaaaaaaggaaaaaattaagagtaacaaaagatgtgtggaggtgccataatctccgattatgagcccgccggaaacttctaccggaaactctctgctcgtgacctgtgggctgagctggaccctatctccgactactggtcctcttcctcctcatcctcaactgtcgaaaacccttattccgctcagtcgccggtgactcactccgtcgataagcctaagaaatcagattccggcaaatctaatcaactcaaaaaaggtaataagactgtgaaggttgagaaggagaagagtactggaccaaggcagagaaagaacaagtacagaggaataaggcagagaccatggggaaaatgggctgctgagattcgcgatcctcagaagggtgtccgtgtttggcttggtacattcaacacagcagaggatgctgccagagcctatgatgaggctgctaagcgcattcgtggtaacaaggccaaactcaacttccctgccccatcaccacctgctaagcgacagtgcactagcactgtcgctgctgatcctccaccagcactactccttgagagttctaacataatatcttataacaattctcctttaatgaacttcggatatgatgttcagagccaaactccctactacccaatggaaatgcccgttgctagtgatgattatgaactcaaggaacagatttccaacttggaatcgttcctggaattggagccagcagattcatctgatcagttttcagggatcgtcgatcctgatcctcttaatgtttttctgatggaggattttgcttcaactcagcatcagttctattgatcctgagttgtttggtgagtgatgagtgactagtttattagcttttggctgtagtagtagtaatagagaaaaaagtacatatgatatgataataataagttgcgtgccttagcctgcaattgtaatagtatcaatgtttgttgtcttgtgttgtttatgctttctaaatcttggatttaccttataatgtttggtcatttggtgtatgtattgtaactatatatggagtactttattactaaaaaaaaaaaaaaaaaaaaaaaaaaaaaaaaaaaaaaaaaaaaaaaaaaaaa

SEQ ID NO: 14237 - DNA, 1138 bp, Solanum tuberosum
  Predicted polypeptide sequence is orthologous to G19
attcggcacgagaccaaaaccaaaaccaagcttctctcttgttataatatatatatatataaaaaaaactcgacctttgtacaaaccatttttcatatctgtatcaatctctttgtttctgccattttgagtaaaagagtttaaatcacactaaaatgtgtggtggtgcaattctttatgatattattcctcgtgaccgccgtttgtcatccaccgacttatggccaagctctgctgatttctggcaaacttcttctttttccaagccaatttccacccaaaatgttcctcccaagcctaaacgagctcaactctctagaggtagtgagcagatgaagaagaggcaaaggaagaatctttacaggggaatccgacaacgtccatggggtaaatgggctgctgaaattcgtgacccgagaaaaagggttagggtctggttaggtactttcaacactgctgaagctgcaagagcttatgatagagaagctcgtaaaatcaggggaaagaaagctaaagttaatttccccaatgaagacgacgaccactactacagtcatccagagccgcctcctttgaacattgtttatgaatcttatgatactactagtacttacaatcaagaatcaaataactgttaccccttccactcaatcgaaaacactgaacctgttatggaattcgcaattgctaacaaaaattcatctgggtctgcttataatggaattgaagatcagaatgtggaaggagaagagcagacggtgaaaaattcaaataacaggatcgtagaggaagaggaaaaaacagaggatgaagtgcagatactttctgatgaactgatggcttatgagtcattgatgaagttctatgaaataccgtatgttgacgggcaatcagtggcggcgacggtgaatccagcggcggacaccgaagtgggcggtggctcgatggagctttggagttttgatgatgttagtcgtctacaaccaagttataatgttagtttgattattgttttgtttaaattgttgcatctttttagtttgctgaattagaactaattgagtttttgtaatttttaatcaattgtgttgaaactatatttttahttcattactctattaaaaaaaaaaaaaaaaaa

SEQ ID NO: 14238 - DNA, 939 bp, Solanum tuberosum
  Predicted polypeptide sequence is orthologous to G20
gatctctcactctgcttcaaatgctgctctgattctctgtttactagagtttcagcttcattaatattctttctgctccaggactgtgttgcttatggcttccccttcctctgagcctactgccaagactgagggtagcagtggcaatgatgctggtggtggagaaacatcagaagctatggggcatatagggactgatcaactgttattatatagaggactgaagaaagcaaaaaaagaaaggggttatacagccaaggagcgcataagcaaaatgcccccatgtactgcagggaagcgcagctccatctatcgcggtgtcactaggcatagatggactggtcgttatgaagctcatctttgggataaaagtacctggaatcaaaaccaaaataagaaaggaaagcaagtttatttaggagcatatgatgatgaggaggctgcagcaagagcatatgatcttgccgctttgaaatattggggtcctggaactctcattaatttcccagtgacagattacacaagggacctcgaagagatgcaaaatgtctcaagagaggattatcttgcatcattaagaagaaagagtggtggtttctccagagggatatctaaatatcgtccgctatccagtcgatgggatctgcaattcggtcgtgtgcctggagctgattactttaacagcctgcactatggtgataatgccacagtggacaatgagtacatcggtggtttctgcatggatagaaagattgacttgtcaagttacatcaagtggtggggaggtaataaagctcgtcaaacagattcccatctgaaaatgtcggaggaaacaaaggttggctgtcctggagatattgataatgagcttagggcttcagaattatcaattcagcaaactgaaccatatgagatgctccgttttgggtgtgtaccaag

SEQ ID NO: 14239 - DNA, 844 bp, Solanum tuberosum
  Predicted polypeptide sequence is orthologous to G21
tagaaagaaaagaaaagaaaagaaaaataaaatcacaatggaagatcataatgaattctccatctctagttctactacaacttcatcatttacaagttgttgttctaataacaattgtttaagttctacttcaacttcttctacttcatctaattgtttccatgagagcattgcaaaaacctcaccaaatgatcattacaagtgcaaatccaagaaaagttcaaaaaaaattcaagatgggaatgaggaggaggatgataacaagaaaatcagacgaaaaaatgaaggtgttgttgatgaaaaacatccgacttatagaggagttcgtaagaggaattggggaaaatgggtgtccgaaattagacaaccaaggaaaaaatcaagaatttggctagggacttatcccacagctgaaatggcagctcgagctcatgatgttgcggctttagccatcaaaggggattcggcttaccttaatttccctcatttagccgatcaactccctcgacccgcttccacttcccctaaagacatccaagccgcagccgccaaagctgcagccgccaacatatttctagaggagaaaagccaattaaccgagctgcatagctcgcattcctcgactaatttagcctcgcaagaattactgaattctccatcaatggatcacgatgaccccttttttcgatctaccggatcttaccatcgataggagtggaccaaaacgaccggtaccagtacccaatttcgacgtggcagctggttggagccgatagcgggatgtttcgggcttgatgagccgtattgtgggagtgctattagacgagaattacaagtgtacatg

SEQ ID NO: 14240 - DNA, 614 bp, Solanum tuberosum
  Predicted polypeptide sequence is orthologous to G27
ggcattcgatacatacttctctaaccatctgtgcaatgcagtaactgtccatttgaatcaccgttaattaatggcggaacttgtacaatcatctcccatttccgtgtcaaaaacagaggaaccagaagagaaagagaaagagaaacgaatggaaaaacgaagaagagatgaatcttacccagtatacagaggagttcgaatgcgaagttggggaaaatgggtttctgaaattcgacaaccgcgtaagaaatcacggatttggctaggtacttatccaacccctgaaatggctgcaagagcacatgacgttgctgcgcttagtattaaagggaattcagcaattctcaattttcctcaactcgttgaatcgttgcctcgtccagcttcatttcacctagagaatgtcaagctgctgctgctaaagcagctgctatggatgaactaaattcctctgtttcttcttcttcgacattgagtgagtcgatggaggagacgatgacagtagcagcagcatctgaagatcagttaggtcagattattgaatacccgaattggaaggaatttttgagtcggaaagatgaagttgagtgacttcggtgaaggatgggtttacc

SEQ ID NO: 14241 - DNA, 839 bp, Solanum tuberosum
  Predicted polypeptide sequence is orthologous to G27
tattttcaacatcaatcaaacaacttcttcttcatctctaacaaaaagaccaataaccttaaaatcatcaaatcaagaaaccaatcacaacaagaaaatcaaatccagtactgaaaaaaccaagaaaattgatgactcaaaacacccaatttaccacggtgttcgaaaacggagctggggaaaatgggtgtctgaaattcgcgagccgaggaaaaaatcaagaatctggcttggtacttttgctactgctgaaatggctgccagagcacatgatgtagctgcaattgccattaagggtcacttagctttactcaatttccctgaattagcccatcaatttcctaaaccagcttcgaaatgcgctaaagatattcaatctgcagccacaaaggctgcagctttggatattttaccaagaaattgtatggaaaaacagagtacagatgagttaatggaaatgccctgttctcctgaagaaacagagtcaacagaatcatctttgaggagtaatagcgaagacccttttcttgatttgccagatcttcttatggatcttactcaaaaatttgataaattctgttacgacaattcaccatgggatttggctggagctgaaagcaatgactctaattacagtgaattttggcctcaagaagatctctgtttgtgggactacagactcgaagccccacaattgtaatagtataattgtttcaacagaacagggtatttaagctaaattgcgacgcataattgaagggtctctaaaatgtcggcattacagacaatgggacctgcatttgaaattcctgtattgcatcaatataattttccgatga

SEQ ID NO: 14242 - DNA, 970 bp, Solanum tuberosum
  Predicted polypeptide sequence is orthologous to G43, G46, G1419
cattcctcttcaattccattttaaaattctaaaagaatgggttctccacaagagacttgtacttcacttgatttgattaggcaacatcttcttgatgattttgctttcatggaaaactattcccaaagttgtggtgaatctgtggacaagagttgtttctcttttgaaacaactcaaagttcaaatcttgatgatatatcaagcttctttagtgctagttcaaaaacagagtatgatggttttttcgaatttaaggcaaaaccacatgttatgagctcgaaacagagtaacttcaaagaacgcaagccatctctgaacgttgcgatacccgcgaaacctgttgtggtacagaaagtggaagttgagagtgaaaagaagcattacaggggagttaggcagaggccttggggaaagtttgcagcggagattcgtgacccaaatagaaaggggactcgggtttggttaggaaccttcgacactgcggtggatgcggccaaggcatatgacagggcggcgtttaagcttagaggcagtaaagcaatactgaatttcccacttgaagttgctaactttaagcaacaaaatcatgatgatgagattaaaacatcagggagtaaaagggtgagagaaacagagcaattagttatcaacaaggaaaggaaaatagaagaagaaagaatagtcccaacagctgcagctccattaacaccgtcaagttggtcgacgatttgggatgaaaaaggtatctttgaggtgccgccactgtcaccattgtctcagcttgtaatgatataatttgggattatatataagtatttgataaatatgcacctgactataaactaagtctgaggtgaattaggattagaatgatgtgtctttggatcttcaatattttgtaatttcattgattaagcgttatttaatgtaaatacgcaatcaatctaaaatttgttcattttataatatg

SEQ ID NO: 14243 - DNA, 975 bp, Solanum tuberosum
  Predicted polypeptide sequence is orthologous to G43, G46, G1419
gcttcgtttctccacctgagaaggctggtatgaaacctcatctcttcatttcttctctttataacccatcctctacacactctcttttccactcaattttctcttcaactttgaatttgaacataaatagttgacattaattactttctccaacagaaattattttctttgtctgattagaagaagaaaaatgggttcatcaccacaaggaacttgtagctcacttgattccattagggaacatcttcttgatgatgatgttgctttcatggaatattactgctccaacacttgtttctcttttgaaactactcaaacctcaaaaacagattttgatggttttttcgaaattgaggcaaaaccacatgttatcagctcaaattctccgaagcagagtaacttcaaagaacgcaagccatctctgaacgttgcaatacccgcgaaggctgttgttgtagagaaagtggaagttgagagcgagaagaagcattacaggggagttaggcagaggccatgggggaagtttgcagcggagattcgtgacccgaatagaaaggggactcgggtttggttaggaacatttgatactgctgtggatgcggccaaggcatatgacagagcagcgtttaagcttagaggcagcaaagcaatattgaatttcccacttgaagttgctaactttaagcaactccaaaatgatgatgttgagattccacagccggtgagcaataataataaaaggttgagagaaacagaggaattagtaatgaagaaggaagtgaaaatagaagaggaaagagacgttgttactgcgtcaccattaacaccgtcgaattggtcggctatttgggagggtggagatggaaaaggcatttttgaggtgccgccactgtctccacatatggttcccagcttctgatgatcggaaatcgaactactccacaatagtaatttaaattgaaattgtcagtcagt

SEQ ID NO: 14244 - DNA, 907 bp, Solanum tuberosum
  Predicted polypeptide sequence is orthologous to G43, G46, G1419
gatcttctaactttgaatttaaacataaatagttgacattaattactttctccaacagaaattattttctttgtttgattagaagaagaaaaatgggttctccacaagagacttgtacctcacttgattctattagggaacatcttcttgatgatgatgttgctttcatggaatattactgctctaacacttgtttctcttttgaaactactcaaacctcaaaaacagagtttgatggtttttacgaaattgaggcaaaaccacatgttatgagctcaaattctccgaagcagagtaacttcaaagaacgcaagccatctctgaacgttgcaatacccgcgaaggctgttgttgtagagaaagtggaagttgagagtgagaagaagcattacaggggagttagacgaaggccatgggggaagtttgcggcggagattcgtgacccgaatagaaaggggactcgggtttggttaggaacatttgatacagctgtggatgcggcgaaggcatatgacagggcagcgtttaagcttagaggcagcaaagcaatattgaatttcccacttgaagttgcaaactttaagcaactccaaaatgatgatgatgttgagattaaaacagagatgaagtcatcaggcagtaaaagggtgagagaaacagaggaattagtaatgaagaaggaagtgaaaatagaagaggaaagagacgttgttactgcgtcaccattaacaccgtcgaattggtcggctatttgggagggtggagatggaaaaggcatttttgaggtgccgccactgtctccacatatggttcccagcttctgatgatcggaaatcgaactactccacaatagtaatttaatttgaaatgtcagtattgggtagatgaaggataaatatatggcacc

SEQ ID NO: 14245 - DNA, 868 bp, Solanum tuberosum
  misc_feature (734)..(734): n is a, c, g, or t
  Predicted polypeptide sequence is orthologous to G43, G46, G1419
ccaacaaaatctcatttttttcaaattctactttttaaaaatggattcttcttcactagatatgataaggcgacatcttcttgatgatgttgttttcatggaaaattattgttcctcttcttcatcatcagaaacaagtagtaccctttattctcaaacctcattgaattcggaatctttagaatcattaacctctgagatcaaacttgaaagcaatttctctttttatcctgatttcatcaatacagctcaaagtttaaatcttgaatctgcctctcgtttgttcgataactcaacaattgaattccaagctaaaccccaaaagaaaagaagtttcaatgatcgaaaaccttcgttaaacatttcaattccttctgtcaagaaaacagaggaaccaaaaacaggggaagtaaaaacagagtactctgttcagaaaatggtggaaaattcggagaaaaagcgatacagaggagtgagacaaaggccatgggggaaatttgcagcggagattcgtgatccaactagaaaggggacacgggtttggttaggaacattcggtactgcaatcgatgcagctttggcatatgacagagcagcatttaggctcagagggagtaaaagcaatcatgaatttcccacttgaagtaacgcaatttcaaaggcaagaaaatcctgagatttgacgaaacaatgtaggtaagtttgaattttgacatacgaaattctttgctggngcaaaaacggggttaacacgacggacaaacattggcgcacatgaattgacccgaagtttggtggtcgaaacaaaacgaagttgaaacacaagaaccaacattgtcgtagcaacttcccatttaacacaccttca

SEQ ID NO: 14246 - DNA, 1007 bp, Solanum tuberosum
  Predicted polypeptide sequence is orthologous to G43, G46, G1419
attcatctttcttctttcagtttagtctatactttttcctatacttgtcgatctcgatggaatatgttgatgaatttttagctttagagaaaatcagaactcatcttctcggagaatttcaccgaaaactttgaaatttggggcggaattaacgagtagtaagtgtactgatactgtgatggagagttgtaattctgaatctgctagttctgattctcttccatttgattttttcttcgatattgaagctgatttatttcaatttggagctggagtttctaattctagctccgaatcagctaattcggtgcataatcgaacagattttgttaaaattgaatcggagccgtcgatttcgagctctgattatgaggagaatcagagcaaatgctttcagtttaaatcggaacctcaagtattcatcgatcttacttctccgaaatcgagtagcgttagtgatcggaaaccttcactgaaaattgatttacctccggtgaagaaatatgaatggatcgattttggtaattcggctcactcgaatccgattgtttcggttcccgtgaaacagataaggaaagctgaagagaagaggaattacagaggagtgcgacagcggccatggggaaagtatgcggcggagatccgagatccgagacgccgtggttctagagtttggcttggaacatttgatacagcaattgaagcggcgaaggcttatgataaagctgcatttacgatgcgaggaagtaaagcgatactgaattttcccttggaggtagggaagactctgtcgtatcaagctccgccgttggaagcggcgtgaagcggggagagatcggggaacctgaaaaagaagtttgaaaatgtaggaaggattggcattaagcgccagttgaattcgtttgacccatgtacggaaggttactcctcatatacctttctcactgtgtcggtatcatatgaggtttatgatattcttgttttttttattatttccaaaaaaaaag

SEQ ID NO: 14247 - DNA, 1130 bp, Solanum tuberosum
  Predicted polypeptide sequence is orthologous to G43, G46, G1419
tttttttttttttttttggttggaaaaacaaactctattaattataatgtaatggagtttaatacatcacttaaagaggattaagtaagtaattaacatactttcatgcaaattacaaattaatcatctccaccaattccatcttgttctctcttctccttttccggccaatattcgccggagcaccagattttccggcatccaacggaaaattcagaatagcttttcttcctctcatcttaaagctgcacaatcataagctctagcagcatccatatcagtatcaaaagtacccaacaaatcctcgatccttttctacttggatctcttatctccgccgcaaatttcccccatggccttctccttacccctctgtaattcttcttcttattattgtcttcattagaaccggcggagctgtcggaaactggactgaggatggtatctgaatcaattttgaattcggggaaatcggagtggagattgaagtaacgggaaattggggagttgggttcatttgggtatgaggaattgggtgaatctgaaagggaattggatgtagatggctctgttttttactgaagtgaaaacaggggagatgtcggaggaggaggagattttgatcggaaaaacaagaattgagactgttgatgaatgattctgtagtgtgacatcttcgaggagatgttgtcatgatcctatgtgtaacctcctcttgtgtccgtcatatagcgagatattgcgaaaaattgcacgggaaagtgttgggtctcaagtctccaatagtcctgaacaaatttgggatgaaggtgtgtcccccggccaatacctggcacgccgggggatccataatctaaacggcgcaccgggggagcccaacctttggtccttaaggagggtaataggccgctgcggtacaagggacaagcgcccggggaaaggttccccacaaatcccaaataaaccggaactaaaggaaagcgggcggtgcaagagggacacacaccatatatgcttcccacgccgttccatggacgacgcgtagataacagcaggcggaaggtggataggccccccccaaaacgggtcgtgcagaacccaggagtcgagacgaatacagcagccagcac

SEQ ID NO: 14248 - DNA, 299 bp, Solanum tuberosum
  Predicted polypeptide sequence is orthologous to G44
gcctcgtggccgtggaaggcggcgtgaagcggcggagagattcggcggaagctgaagaagagaaggtagtgaagaagtgtaaggaagaggagtcatggccattaacgccgtcaagttggaatttcgtttttgaacagaattgtaacggaatgtttaacctccctccattatcacccttatctcctcaccttggctgttcgcagctaattcaaatatgagtgcaatacatgttattatgaatctagtttatgattgtatgtatatgaatgaacttttataaacaaattacctacttgttg

SEQ ID NO: 14249 - DNA, 466 bp, Solanum tuberosum
  misc_feature (31)..(31): n is a, c, g, or t
  Predicted polypeptide sequence is orthologous to G129, G136, G140
agtgatcccccggcctgaggtgatgccaggnagtcatcaagctatcatgagcttgtgcctccactcagcaattcgatactcgaaactatctacaagttaatggatttcaaaccaacaaccattaccctagacaagaccaaccccctattcaactagtctaatgtgcttgagagatggtcttctttctgatgtgatctacatataatccacaaaagaagactactattaagcttgaagattattggaactgaagatgatcaacttaagtatgtataccatattatattaattacttgttgcatgagctaagactcttgaatattgtatgttcattaagtggacatgtatttatttgcttggtgtacttccttttcaggcagtaaactatgaagaattatgcttgtcatattaagttcataactgtttttctgtccaaaaaaaaaaaaaaccacacacacacaaacac

SEQ ID NO: 14250 - DNA, 447 bp, Solanum tuberosum
  Predicted polypeptide sequence is orthologous to G129, G136, G140
gagcaaatgaacttgatgcctggaggcggcggaggtggaggaggaggatctgatcaataccatcatcagccaaattatgaagatgctcgcaataacttcctgcctgtaaatctcctggaaccaaatccccattactctcgtcgcgacgatggtgaccaaactcctctccagcttgtctgataatcatggagcaggttttctgaaatttggggtcgaagctcttccttcatcttcagaaatgtgtactacaatttttaacctatagtgttgtaaatcataatcataattattgccactgagatttaaactgtttattttcaagcaatattagtcagtattctgttaattaaggaatgaaaaatcttgtttgttatattatgactacttctatatacttttacaggcttctataaataaaaaaactattgaactaaaaaaaaaaaaaag

SEQ ID NO: 14251 - DNA, 853 bp, Solanum tuberosum
  misc_feature (342)..(342): n is a, c, g, or t
  Predicted polypeptide sequence is orthologous to G129, G136, G140, G146
ggaaaaagaacaatactccaaaaaagtccattaaattatctatcattcgaagaatgggagagggaaagtggaattgaagagaatagagaatcaaacaaacaggcaagttaccttctccaagagaagaaatggtttacttaaaaaagcttatgaactctctattctatgtgatgctgaagttgcccttcttcttttctctccttccggcaaaccttaccatttcgcgagtcatgacatcgaaaggactattttaaggtacaagaatgaagttggattgtcccaaaatagcgaccaaggcctcagagctatggaggtttggagaacaaagattgatgacatgancagaacaatagatgaacttgaagccagaaataagcatttggctggagaggagttatcaagtcttggcatgaaagaattgaagcaattggagcgtcaactcagaattggggttgaacgcattcgatctaaaaagcataaaatccttcatgaggagaacatccatcttcaaaagcaaataatgttgtctgaaatagaagggagttcaaggattcttgattcagatgcaagtgagttactttctaagggacaaagaataatatatgatttatagatcttcaatcatatggtcgtgtaaagagcctaccttaagtgaacgtatacttagtatatattataaaatagtgtgtacggtatatttaaagatgataatcctttcgtgtggtctgaatgtacttatttattgtctagaaatttttattccaagtcaatgttgaatttaagacaaggacacacaaaaatgtactatgttgatattataactttgaatttagcaacaaaaaagaaaaaaact

SEQ ID NO: 14252 - DNA, 907 bp, Solanum tuberosum
  Predicted polypeptide sequence is orthologous to G129, G136, G140, G146
ttttttttttttaaaaacaacatacttattatggttttattattgatatttaaatgggcattggttgtgtttcatctgttgagtttaagttctgaaacagaacaaaaattagttacagacatctctataacacagtgcattagaaaaagcagttggaagaactactgagcaccgactcctatcgatgaactcaacgaggagccattaaactaatttcaatagtttccagtactgctagttctatcaacaaagaataattgcaaaaattgataaaaatagaaagaaaaaaaaatatgcccttttctttattgtcttttttagggtttttgatcctttgaaccaattttgtttttcttctatatatcatctagatctgaaaactcaaaaaccaatattttcttgatttttcacttgtagaatcttgatttttttttttcaatttgtaacaaaaaatacacaatggtgagaggaaaaactgagttgaacaagaattgaaaatgcaacaagtagacaagtgaccttctcaaaaagaagaagtgggcttctaaaaaaagcatttgagctttcagttttatgtgatgctgaagttgctcttatgtattttctccaaaaggaaagctttatgagttctcaagttccagtacaaacaagacaatagaacgctattcagaagactgacaagagccctgggaagactccaacaggaaatttaacttgatcaattaaccacttgagcatttcgacaggcaggaaggttgccacacattgaactagaaaagcttgaatttcttggaagaactcctagaagaaaagtttttaagggacatgggtcctaaattccttcccactttgggattgaactcttcaccgggtttcgaacgacccgtgggaacacaaagtttaagca

SEQ ID NO: 14253 - DNA, 1068 bp, Solanum tuberosum
  Predicted polypeptide sequence is orthologous to G131, G135, G155
tatatatattacaaaaaacattattctttttactatcattaaaaattatccgtaaaaatgggaagaggaagagtccagttgaagcgaatagagaacaaaattaaccgtcaagtgactttctcgaaacgtcgatctggtttgctgaagaaagctcatgagatctctgtgctttgtgatgctgaggttggtttgattgttttttccactaaaggaaaactctttgaatatgccaatgattcatgcatggagaggttacttgaaagatatgaaagatactcatttgctgagaggcagcttgttcctactgatcatacatccccgggaagctggactctggaacatgcaaaacttaaggccagacttgaggttctgcagaggaaccaaaagcattatgtgggagaagatttggagtcgttaaatatgaaagaacttcagaatcttgaacaccagcttgattctgctcttaaacacattcgatcaagaaagaaccaattgatgcatgaatccatttctgtgcttcaaaaacaggacagagcattgcaggagcaaaataaccagctttccaagaaggtgaaggagagggagaaagaggtggcacagcaaaatcagtgggatcagcagaaccatgaaatcaactcatctacatttgttttgccacaacaattggactctcctcaccttggggaagcataccagaatactaatgtagtagataatggagaagtggaaggaggtaattcttcacagcagcaaggtgcagctaataatactgtgatgccacaatggatgcttcgccatcttaatggttaaaagtaccactaatacttgatggtcactatcaatataattacctaggtatatatatatatatatatatatatatatatatatatatatatatctatctctctctctctctatattgatgccacaatatattgtctaaacgtaccttcgaagacatgccacaatatagatggattattgtaaaaatattatagtatatgttaaaatgaacttaaatgtatgattttcgctacaacaaataaaggattttgcagttgttat

SEQ ID NO: 14254 - DNA, 1037 bp, Solanum tuberosum
  misc_feature (647)..(647): n is a, c, g, or t
  Predicted polypeptide sequence is orthologous to G131, G135, G155
ttttttttttttttccttgttgtatttgaaacaataattagttttattgacgctgcacagtattagttatctccggatacatcttgactttggctcatttcctagattattctcctggggcctctacaaggaactatttgacaagtacaatgacaattactagaggaaattcagggtcattctctgttgtccacaaattatatggggtgctggaaagtcggcgaaatccatagacatctcattcacttctctgtttttcttgatactagctatattgtcctccagatgtttattttcctcttgcagcagtttttccttctcatgaagacccttagcagattcaagcaacaaatgtgtctttctagatctgacttgtattagagcagtttgaagttcgttctccaaatggataaggtcagtcacaccgagaccatcatcattagtttcctcgagttgcctttctgttgtttgtagcagttctcccattgttgtgaaccctgagtatatagagtgctctggcacctggatttctgcagagctctctttttctgcttcgacgtggctttcatatcgttgaagtgtttctgtcagactgttattgctggagaattcatggagtctgccacgattggagatgataacaaccngaacatcgacatcacagagaacggaaatttctttagctttcttcaatagacctttcctccgttttacaaaaaaggcagacttgcctaacagtgtgggctttgaattcggttaatttcgtaacttcccttcgccccattttttccgcgggagaaaagcctaatccacaggatttccagatgtctaaacgttctaggtatgattcggcggtacttcctaaccagttcttaatattttcgtgttgttgtggtacagcagttaacccatttctggtggtttaacttctcttacatccaagttaatctttggggtccctcggttccgaattcctggcagcccggggggaatccaatagtttaaaaggggcgccacggggtgaactcacttttgtc

SEQ ID NO: 14255 - DNA, 924 bp, Solanum tuberosum
  Predicted polypeptide sequence is orthologous to G133
gattcaagatctcaaaaaaaaagaaaagagagttatggctcgtggtaagatccagatcaagaaaatagaaaaccaaacaaataggcaagtgacttattcaaagagaagaaatgggctattcaagaaggctaatgaacttacagttctttgtgatgctaaagtttcaattgttatgatttctagtactggaaaacttcatgagtttataagtccctctatcacgaccaacaatttgttcgatctgtaccaaaagactattggagttgatatttggacttctcactatgagaaaatgcaagagcagctgaggaagttaaaggatgttaataggaatctacgaaaagagatcaggcagaggatgggagaaagcctaaatgatctgaactttgaacagttggaagagctcatggaaaatgtggacaattctctgaagcttattcgtgaaagaaagtataaggtgattggcaatcagattgaaacttacaggaagaaggttaggaatgtggaagaaatacatagaaatctcctgcttgaatttgatgcaagacaagaggatccatatggtggattagttgagcaagaaggagactacaattccgtgcttggattccccactggagggcatcatatattagccttaggccttcaaccaaacaacaatcatcatcatcatcttcacagtggaggtggctctgatattactacttttgctctaggttgagtagtaattaattcaccttattgtaatattatcatattttcccctattattagtatattgatgtattctaaattaatcacatgcaatgtttcttcactagacatgcatgagagtactgactattctcctacttttgcttaattcagtgtgttaaaacctaaaaagaaactataaggttgtcaaactcttattgtttttggatc

SEQ ID NO: 14256 - DNA, 477 bp, Solanum tuberosum
  Predicted polypeptide sequence is orthologous to G134
ttttttttttttttttttaaaattaagtcagtccaactattaggtaataatttcaacatgaaacaaagtcttaactaggtactcaccacatataactagagttaattaattagtgtttctagctagtagaaacccaaattaaaattattagagatcttaatttaaagtattaataatataatgttacattctttcatgtagatttggctgcattggctgaactcgtaggccaaatggcatctggtactcataattatccctttctctttgatgatacacttcttcatgaatccctctcatatttccacttccacctatggctcccatctccttttggtgcaaagcatattgaagttgcttatgttcctcctccagaatttgatcatttttcctgaccatcctcaagatctcagactgcttggcactgatactagaaagtccattttgtaaggcttcttccataattataagctcttg

SEQ ID NO: 14257 - DNA, 452 bp, Solanum tuberosum
  Predicted polypeptide sequence is orthologous to G137, G145
ggcaggaacatgcattgacgagcacagaacctgaacatttgtgatggaggagcaataatctgcatggcagccaaatgcacagatgtgggctacgggcgcaaacaatcaaaatcagggcgatggtttctttcatcctttggattgtgaacctactttgcaaattgggtatcagaatgatccaataacagtaggatcggcaggtccgatgtgaataactacatggtggtggttgccttgaaagctcatgattctgatcataacattattattattataaatatgctcaatggttttcctatcatcataaaccattgaatctctcctaattaatttctgtatgttgtttgagaaagcgcttcatcctggactaaacggaggaatccataagacaatcccattattgttagtaaatcataaactagacttccttgaagaaagaaaaaaaaaaaaaa

SEQ ID NO: 14258 - DNA, 499 bp, Solanum tuberosum
  Predicted polypeptide sequence is orthologous to G137, G145
tagtggatcccgcgctgcagtctttcatatggcaggaacatgcattgaacgaagccaacagaaccctgaaacaaaggttgatggaaggaagccaactaaatctgcagtggcagccaaatgcacaagatgtgggctacggccggcaaacaactcaaaatcagggcgatggcttctttcatcctttggattgtgaacctactttgcaaattgggtatcagaatgatccaataacagtaggaggagcaggtccgagtgtgaataactacatggctggctggttgccttgaaagctcatgattctgatcataacattattattattataaatatgctcaatggttttcctatcatcataaacattgaatctctcctaattaatttctgtatgttgtttgagaaagcgcttcatcctggactaaacggaggaatccataagacaatcccattattgttagtaaatcataaactagacttccttgaaaaaaaaaaaaaaaaaaaa

SEQ ID NO: 14259 - DNA, 698 bp, Solanum tuberosum
  Predicted polypeptide sequence is orthologous to G147
ttttttatttttcaacttagaaattataagatgacatatataataagtagcaccatacactaaagaggctcacacactaaacatattacctaaattgaacataataacatacttatatgttcatgtctccaaagtgaaattactcgatcatcattattacatctccttaccaaattacgtagatgcttcacaataagaatagcttatgtagtgagcatatgttagaactggaatatctcattttgtacagttagtgggcattgaaagtcagtcaaattctgtgtcatgttagtcacggtgtattgctcatctatcttatcctgtaaatatttgtttgcagcttccagtatcccttccttattcttcagcagttggatctctgtgaaacataatatccatctttgctgaacgaatatgatacatccaaatttctaggtacttttcaagtggaatgcaggttccatccaggtgtcatttgtttccagggggcctcccccccaatacaatgttagctttaaagcccttttctggagtacgtcaactttcgttccttccaagacattgttgaacctcgctgccggaattcctggcagcccggggggatcccacatagtttctagaagcggccgccaacgggggtgggagctcaagttttgttcccctttaattgaagggttaaatttgcgcgccgcttgggg

SEQ ID NO: 14260 - DNA, 711 bp, Solanum tuberosum
  Predicted polypeptide sequence is orthologous to G154, G627, G1011, G1797, G1798
agcttcacttctattctatacttagcctcattgatataacttgcaaacataaaacttgtcagtttttaccaattttgagatatggtgagagggaaaacacagatgaggcgtatagagaacgccacaagcaggcaagttactttctcaaagcgaagaaatggtttgctcaaaaaagcttttgaactttctgttctatgtgatgctgaagttggattgattattttttctccaagaggaaaactatatgaattcgctagctccagcacgcaggagataatagagcgatataagaggcatactaaagacagagttcaacctgaaaaccaagctgggggacaacatctacagcatatgcagcatgaagcagcaaatttaatgaagaagatagagttccttgaaacatcgaaaaggaaattcttgggagaaggtcttcagtcatgtacccttcaagaagtacaacagatagaaaaacagttggagaggagtgtcagcaccatccgggcacgaaagcttcaagtttttaaggaacaagttgagcgactaaaagaaaaggagaaaatccttgctgctgaaaatgcaaaactgagggagaagtttggtggtcttcaacagagagaaacaccaagtgtagagaaggaaggagaagctctttgtacagatggtagcgaaaaatcagatgttgagactgaattggtttataggaccacccgg

SEQ ID NO: 14261 - DNA, 876 bp, Solanum tuberosum
  Predicted polypeptide sequence is orthologous to G154, G627, G1011, G1797, G1798
gatgcgcgggagaaagaaagaccaaacacttcagcctaacgggaatgagcaacgacaaaatgagaagatgaggtgcctcgggcaccctatttagaaagaagggtcaaaggttttgggcatgtagctttccccgtctccccttcgtcgggcggtgcttgtgtggagggtgcgccatactctttgggaatagggactataactaatgcaattacagcatgcagaagataattgagagataccgtgcacgtgcaagagaaataatgacggtggacaaaagcactgaactcgagcactacatggagaacttgaagcatgaaacagctaacatggcaaagaagatagagatccttgaagtttccaaacggaagctaatggggcaaggattagggtcatgttcaatggatgaactagaagacatcgacagccaactggagaggaccctcaaaattatcagggctagaaagactcaattgttcatagacgaaatagaacgtctaaacgcaaaggagagactattgctccaacaaaatgcaagtttacgtgaaaagtgcgggcttaggccaatgctattagagtcagcacccacacctgcacccgtaccagcaccaccaccaacaccaccagctcaagcgaaagaaagaggaaattgtagccaaagtacaaagagttgggaagtggagactgaattgtttattggcattcctcaaatgcgctgcttatagtagctcggttagtggctgagctagcattttttcatcaaaggaatttaaaatctgaagaagtaagcacacaaagaaggcaaaaggggttcaaagtctactctatatacattaaaagataaattttaacaatgtaattttcactgaaggaaaatca

SEQ ID NO: 14262 - DNA, 794 bp, Solanum tuberosum
  Predicted polypeptide sequence is orthologous to G154, G627, G1011, G1797, G1798
ttttttttttttttttttttaaaaaaaaaaactatattaaagtaatttagtttttttattacaaccctataaattataattacagtactggtaatataaaacttgaaacaccagcaattttcacaattaaagtgatgtaggtggtgtgtttaaattaggacaatatgaattttttctagtctctggaagtccaataaagagctctgtctcaacttccattatttgtctttcaacatctttctctacttgaggaaatggtgtcaaagtcaatggtagcacctcacaccttttcctcaagtctgcatttttcttcaatagaattttttcctcttccttcagttgagcaatctgttccttgaataacagattctttcttgccctaatgttgcttaaacttttttccaactgttcttctacctgttgaagttcatccaaggtggaagattctagaccatgtcctaaaagctttctcttagagtcttcaagaaattcaagctttctagtcatggttgcaacttcctctttcaaatgctcagtggttagttgatcagttaattttctgttgagtcttcccaggctcttgtcattcttctgatagcgttctattgtcttgtttgtactggaacttgagaactcataaagctttccttttggagaaaataccataagagcaacttcagcatcacataaaactgaaagctcaaatgcttttttagaagcccacttcttcttttgagaacgtcacttgtctaccttgttgcttttcaattctttcaactccatttttcctctca

SEQ ID NO: 14263 - DNA, 848 bp, Solanum tuberosum
  Predicted polypeptide sequence is orthologous to G157, G859, G1759, G1842, G1843, G1844
tttttttttttttttttttttttttttttttttttatggactaactgtcacccttacttttgatataacctctaatttacatagtcattgcattacatacaagttatcgagacgctgcagcagcatctctttatttatccttacacagtttttcagtgtttcaaccataccaagacaacatacaagagaagactacatagtagcacaccctagttagatgcagcagatataacctcggcaggacatatcccacggcaagaggagtggctgctctgctatattttgggaaggctgttatttatatcttgagcttctatctgatatgtgatgccttcagtgtgtttagactctagagaaaattcagggtcaccctctgttgtccacaatccatatgggttggtgcaatgttatttaaattcattgccatctcattttcttctctgttctttatggtacctatctcatcctccagaactttgttttcttctatcagctgcttttccttgtcatgaagattcttaattgattcaatcaacaagtgtgtctttctaaatctggtttgtgtcagagcagtctcgacttggttttccaaatggacaagatcagtaatgctcagatcatcaacatcaggctccttgatttgttttctaccgtctgtagcagttcttccattctccatgaaactttgcagggggggcccgggtaccccaaattcggaccttataagttgagtcggtaattaacggcgcgcttccaattgggccgtccggttattacaaaaccgtcgtgaacctggcgaaacaacacttggcgggtaaccccaaattaattcggcctctggcagaaaa

SEQ ID NO: 14264 - DNA, 753 bp, Solanum tuberosum
  Predicted polypeptide sequence is orthologous to G157, G859, G1759, G1842, G1843, G1844
ataaaactcatagcactttatgaaattcgtgaaagtgaaatggaagatggaggtacaaagcttcttatatacggccattttcatttgtgagaattagttagggtttgggagtttgaagaaatgggaaggaagaaagtggaaataaagcgaattgaagataagagcagtaggcaagcaactttctccaaacgaagaaatggactcatgaagaaagccaaacagctctctattctctgcgatgttgatgtcgccgtcctcgtcttctccagccgtggacgcctctttgaattctccagtaccaacagtctgacaggagttattcaccaatataacacccacatgaaagcagaagataaggtctctgcagaagtcgatgacacagaggaatcaaaatatgcaagtttcatgagaatggaagaactgctacagacggtagaaaagcaactcaaggagcctgatgttgatgatctcagcattactgatcttgtccatttggaaaaccaagtcgagactgctctgacacaaaccagatttagaaagacacacttgttgattgaatcaattaagaatcttcatgacaaggaaaagcagctgatagaagaaaacaaagttctggaggatgagataggtaccataaagaacagagaagaaaatgagatggcaatgacatctaaataacattgcaccaagccatatggattgtggacaacagagggtgaccctgaatttcctctagagtcttaacacactgaa

SEQ ID NO: 14265 - DNA, 814 bp, Solanum tuberosum
  Predicted polypeptide sequence is orthologous to G157, G859, G1759, G1842, G1843, G1844
gaacccaagagatttagttggagtgaagagagtaaaacaacaaaaatggttactctgtaacaacacacacaaaaaatagagctgggtaggagtaacggcgatcatactagaaacttctagacatctgaaatctgtggattagggcttttctccggcgaaaaaatggggcgaaggaaggtagaaattaagcgaattcaagacaaaaactgtagcaagttgctttttgtaaacggaggaaaggtctattgaagaaagctaaagaaatttccgttctctgtgatgtcgatgttgcggttgttatcatctccaatcgtggcagactccatgaattctccagcaataacagtctgacagaaacacttcaacgatatgaaagccacgtcgaagcagaaaaagagagctctgcagaaatccaggtgccagagcactctatatactcagggttcacaacaatgggagaactgctacaaacaacagaaaggcaactcgaggaaactaatgatgatgtctcggtgtgactgaccttatccatttggagaacgaacttcaaactgcttcggaatacaagtcagatctagaaagacacatttgttgcttgaatctgctaaggtcttcatgagaaggaaaaactgctgcaagagaaaataaacatctggaggacaatatagctagtatcaagaaaaacagagaagtgaatgagatgtctatggatttcgccgacttttcagcagcgccatataatttgtggaccacagaaatgacgctaaatttctctataatgcattgtacgtgtcaaataatcctttgtaaaggc

SEQ ID NO: 14266 - DNA, 946 bp, Solanum tuberosum
  Predicted polypeptide sequence is orthologous to G175, G877
cttcaagatttagtaaagtttcaatctttaccttctataatcagttacaagcaggagaattaatttggcttttgagttgctcatgctactagtgtcaacaattgatgggtggatttgatgatcatgttgccattatgggagattggatgcctcctagtccaagtccaagaacgtttttctcttcactgctaggtgatgatgttgggtcaagatcatcttttgagggcaccaatgaaactagtggaaacttagcttctggtcctcaagaacatgttggcaattctgatggaaatgctggagcacaagctgcaatcagtgaaccacaaccggtgaaattgagtgcactgtctgaccagaaaatgagctctcgcggaggactcttggaaagaatagcagctagagctggatttaatgccccgaagctgaacacggagagccttagacctgctgatctgatgcagaatcaaggagttcgctctccttatttaactattcctcctggtcttagtccaacaaccctgctagagtctcctgtttttctctccaattcactggtgcaaccatccccaacaactggaaaatttctattttcctcaggcattgagaatagaaactcggcattgatgatggaggatacagataagaggaaagataatgctttagagagtatcaattcatcgtccttttctttcaagccagttccagagactgctccatctctttttcctggcacgaccagcagagcgaacccgtccaatttttctcagcaaggatttccaaacattgaagtttcagttcattcccagaactcgcttgtatctcaccgtgtggaagctacacaaaacccgactcagaatggaacacttcagcaatcacctgatttccctagattttctgctgagaaggatgtcatggggtaataatgttaccctagagtctaggactt

SEQ ID NO: 14267 - DNA, 949 bp, Solanum tuberosum
  Predicted polypeptide sequence is orthologous to G180
tttgaaaatgaaaccccacacggagtacgaatacatggcgattcacaaaatacatccctcaataattaattcaccatcacaacatcatcaacaagaagaagaagaagaactagcaaagaaagaaattgttgaaaagaagcatcaacaacaaaagtactttggaatattattaggaaaaaaaaaagtgagaggaattaatggaaaggggtagtgaagaaagaaatcagttaaacaattacaatttacaagtatctttttcatcatcatcctcagcagcagcaccaaataatgttcatcatgaattgggatttatacactttgcagatcaaaacttgagcttcttagctccttcatcacaatcttctcagtctcttcaagctgctgctgccgccgccgccgccgccagcgtaattgttacgccatccgccgccatcaatacaaacgctgctgcggctggcgcgtccaataacgttggtggtggtggtggtggtttagggtttagccacaatgaattacttgtcaatagaccttcttggaacaacaacgaacaggtggaaacactagatcccaagggtataaatgacgaaaattgcagcggtaatgccagtgagggtaacaattcatggtggaagagttcatcttcagacaaaggaaaagtgaagataagaagaaagctaagagaaccaagattttgtttccaaacaaggagtgacattgatgttcttgatgatggatataaatggagaaaatatggtcagaaagttgtcaagaatagccttcatcccaggagttactatcgatgtacgcatagtaattgcagagtgaagaagagagttgaaagattatcagaagattgtcgtatggtaataactacgtatgaaggtagacataaccattctccttgtgatgattctaactcttctgatcatgattgtttcacctctttcta

SEQ ID NO: 14268 - DNA, 975 bp, Solanum tuberosum
  Predicted polypeptide sequence is orthologous to G184, G186, G916
tcattttggcttttgatcttctatattcctccaaatttcattttttatggacaaaggatggggtcttacccttgaaacttctccttctaattctgatagagctggtttcttcaagaacaagcctgtttttggttttaatttaagtcctaaatataacgctggtgaaatgttttcctcctccgatgagaaacgtagcatcgttaatgaagtcgacttcttctccgataaaaagcctattgtaaagaaggaaaattctcaaggcgataattctatcagaactgatgatcagtttgttgtaaatactggtttgcaacttgtgactgcaaacgcgggaagtgatcagtcaaccgtagatgatggggtttcatcggaagtacttgaggataaacgagctaaaattcagcagttggcacaattgcaagttgagcttgaacggatgaattccgagaatcaacgtttaaaagggatgcttgttcaagttaacaatagttattctgcacttcagatgcatcttgttacactcatgcaacagcaacagctgaattcaaaaactgaaaatacacatccccatgaggttgttggcgcaaagtctgatgaagaaaagaaaaaagagaataatgggaccatagttccaagacaattcatggagctaggcccaagtggttccaaagttgacccgatggacgaaccatctcattctcactcctcatcagaagaaagaacactatctggatcacctcggaacaacgtggaattagtgtcaagggataaggcaattaaccgcgaagaaagcccagaatctgagagttgggctccaaacaaggcccctaaattgatgaattcatcatcaaaacctgttgagcaatcaacagaagcaaccatgaggaaagctcgtgtctccgtccgtgcccgatcagaagctcccatgattagtgatggttgccagtggagaaaatatggtcagaaaatggcaaa

SEQ ID NO: 14269 - DNA, 959 bp, Solanum tuberosum
  Predicted polypeptide sequence is orthologous to G184, G186, G916
gtggaagcaaagtttgatcaagaaaaaatagttccaggaagattcttggaattaggtcgaagtgataacgatctatctcataattcccattcttcatcagaagaaagaacagtttctaaatcacctcgaaacgatacacaagttacaaggcataataaggccggcagagaagaaagcccagaatctgaaagttgggtacctaacaaggtccccaaattgaattcctcaatgccaacagatgcaaccatgaggaaagctcgtgtctccgttcgtgcccgatcagaagctcccatgattagtgatggatgtcaatggagaaaatacgggcaaaaaatggcgaaaggcaatccatgtccccgagcttattatcgctgcaccatggctgttggttgccccgtgcgcaaacaggttcaaaggtgtgctgaggatcggacaattttgaatacaacttatgaaggtacacacaaccaccccctaccaccagcagcaatggccatggcatcaactacatcagctgcagcaaatatgttgctatcaggttcgatgtcaagtgcagatgggacgttaatgaatccgaatttcctagcaaggactatgcttccatgttcgtcaagtatggcgactatttcagcatcagctccatttcccactataacattggacctaactcaaaaccaaaactcgttgacttataatcaaacaagtactccaatttctcaatttcaaattcctttccaatcaagccctcaacatccgaactttattacatcaatgccaccaccaccaccaatgcctcaggttttacataaccaatcaaagttttcaggcctacaaatttctcaagacattcatcaacctcaacaattacaacatgttcaaaaacaccgatcattttccgacacgctcaccggccgccactgctgccatcacggccgatcccaatttcactgctgctctgg

SEQ ID NO: 14270 - DNA, 1209 bp, Solanum tuberosum
  Predicted polypeptide sequence is orthologous to G184, G186, G916
gttactttcaggttctatgccaagtgcagatgggctaatgaatcccaatttcttcgcgagaactctcctcccttgctcttccagcatggccacaatttcagcctccgccccgttccctactgttacattggacctaactcaatccccaaacccgttgcaattcccaagacccccaaacccattccaagtcccattttcaaatccaactcacaacaacatcctagcaaatccagctgcacttttgcctcagatatttggccaggctttgtataaccaatccaaattctctggcctccaatcgtctcaagattttggaaggacaacaacacccttcaacgatgtcatcctcgattaatgcatccaaccacaaccctctagctgacacggtgaacgccttaaccagtgatcctaatttcactgcaacattagcagcagccatcacttcacttattggcaatccagggcaatcaaacaatggtaccaacaatacaatttgccacccacaacaaacgccccgccaaacaacacaataaccaacaggtgtcacaagcaattgggcaataaccaacagacaatggacacaattaaagtgacggaattcgagttttcccgacaaattgattgatagctttgtcaattaagctgctgtgcgcataatttccctttccaacaaagaatttttccttaattatttttttggccttaattagtaaatccagggaaaacctagattactaatccagggttgactacgaattcttgggtggtgttccaaacggtggctaaaacattataatcttcccatccttttctgggcggataaggtaattccacgaaatctttatccataccaggaacaaaatttggcacggaacaaaacacaacaccaacacacacaccacacacaccaaacctccgaggggggcccgcgacccaaatttcgtcccctatattagagttgtattaaaagcccggcgccacatgggcgggggttttaaacaggctgggaagtgggaaaaccggggtttcccccatttattccgctggtgagaacaccccttttgcaccggggggtatatagagaagcccgcattgcttccaaatgttggcgaatatggaaataggaggccctctggaaataagcgggggtgttgttccacccgccactatttgcacgcacggcgtctttttttttttacgggggcgcac

SEQ ID NO: 14271 - DNA, 456 bp, Solanum tuberosum
  Predicted polypeptide sequence is orthologous to G185
ctttatttaaaatgagattttaggactctgtataaataatctttctagactccattgacttcttcttctttgtaagtgttcaacattttactcctatattacatatacccaaattgagtgtttagcaagaaaaagtgttgtacatttgggaattgcagttttgggattattgatgacgaattactatgaggttgtgaaatctacttcatgtgaagattctttaaaggcaattgaggctgacattcagtatgccaatttgctgtaggttctcatctcttacttgcatcctgtatcttccactctttgattttcttccggtttgatgaattaagtttctgattggggaatgaacttcccaaataaagccatgccattggctcctgttacactgtagattttgaagttgaaatttgaaatttgaaaattttaatttttgaaaaaaaaaaaaaaaaaaaa

SEQ ID NO: 14272 - DNA, 614 bp, Solanum tuberosum
  Predicted polypeptide sequence is orthologous to G189
cagatcttgatttacttcaacagactgatcaactaatctaattaacaacgatcgagtttacattgattggaaaacccttcatcttttcaggggattaaagaaagctacacaatttttgattcctaagaagactctaaaatgagactacttgtttctgcaacagaaagtgaatgattatgttctccttcatatgtaacaatcagcatagttggatcatccaatgctctttcaacatgtttacgtgctggacaacctcttacactactacacttgtaatatcccctgttcatagcaataataataataatttagaatccaacattattaaacaaattcatgatcaattagctctaaatataccttggatgtggtgatcctttgattggcttctgtccatattttctccatgagtaatcatctggtgggatatctgacagtttcatgcttattgccggtactcgaactaccctcttcagccttaacttccttctcttggaacaatggcatcggccggaggatccactgcacttcccagatacggcattttccgataaactgcactttcgtttcagtgaagaagaagacaatggaggctttccggcagaattagagac

SEQ ID NO: 14273 - DNA, 918 bp, Solanum tuberosum
  Predicted polypeptide sequence is orthologous to G192
ctctctctcaagccaaaagtcagcgccttcttttgtctctctgcatttcctctctctagccgaaaagtcaaggccatagctaaaaaaggagaaattaacaaaatggaagaggattgggatctacatgcggtggtcagaggctgcgcctctagttccaccgccgctgccaccaccacagccactactaattcttgttgcagcaacttccaaccaagacaagatggcaacttttttagttttcaagatccatttgtgccaagatttgataaccccaaaagtgattttgaagagttgcataatctttacaagcctttcttccctaaatcacaacaaatacctctttctcctcaaaataatagtaataatatacccatttcacctctctctgttcttggaggactacaagatctatcaccccaacaaacactaaaacaacaacagcatattcatcagctaaacagtacaagattaacacaacccaaacagtctcctctctctgtatatggttccacaactactagtgcttcacatgttcaaagcccaagacctaaaagaagaaaaaatcaattgaagaaggtatgccaagtacctgctgaaggtttatcttctgacatgtggtcttggagaaaatatggacaaaaacccatcaaaggctctccatatccaaggggatattacaggtgtagtacctcaaagggttgtttggcccgaaaacaagtggagcgaaatagatccgacccgaatatgttcattgtcacttacacagcagagcacaatcaccctatgcctactcaccgaaattccctcgccggcagtacccgtcagaagccggcgaattccgaagctggtactgtaagtgactctaacaaacccactagctcatcgccggtatcttcgccggcgtgtcattcaccgggc

SEQ ID NO: 14274 - DNA, 949 bp, Solanum tuberosum
  Predicted polypeptide sequence is orthologous to G192
gatataacaacaatagctctgtattttgctttcaagatccggtcctcaaatcgagcatattattgaataaaaataaaattattgatgattttgaagagttacatcaactgtgcaaacctttctatactcaacaatccgaacaaataacggtcatttcatcacccaggaaattattattacagaatctaccaccatcaccatcaccgtcgcaacagcaacagcaacaatttacattaattcaacccaagagacctctgtcttgtactttacatgctcaaagtccaagaaccaaaagaagaaagaaccaattgaagaaagtatgtgaagtagctgctgatggtttatcttctgatatgtggtcttggagaaaatatggacaaaaacccattaaaggttccccatacccaaggggatattacaaatgtagtacttcaaaaggttgtttggcccgaaaacaagtggagcggaatagatccgacccgaatatgttcattgtcacttatacagctgagcacaaccatccaatgcctactcacagaaattccttagcaggaatcagccgccacaaaacggcgaaacccaccggctcgtcgccgccgaccaactctccggcaccggaaaatcaagaaagcagcagggacgaaaaagaggatatttttgaagatgacgatgatgaatttggtgtttccgatgttgggttggataaaatggaaccggaagatgatttcttcgacggattggatgaattggaaattccggccaccggagaagtctcgccggagaaatttccggggacttttcagttcccttggctagcgaatagcgctgcaactacggcggccggcggtggttgattgacctacaggaaaaggacacgtggcagaaaaaagttaaagaaatgatgcttttgttcttgttagtttgtagtatttttttttttttgtccgtt

SEQ ID NO: 14275 - DNA, 677 bp, Solanum tuberosum
  Predicted polypeptide sequence is orthologous to G194
gtgaaaatggaaagctacaaagacattaaaatggaagatcatcacccaatgtatttcattgacaataacaattttggagttactaaccattcattaatctcagattacaacataaacacatcgtctttgggtttcatggagttattgggttttcatcaagacttttattcatcagcttcagcttttgagttaccaaaagaagaaaactactgtcctgcagtttgtgtatctgaagaagaagaagtaaagccatcatctgtagtgcctgagaaccaaataattagtagtactactgtagctacaggtaacgtattgaatacgccatctacccctaattgctcctccatttcctctgaaggacatggagatgcagatggagaagtagaaaatcatgagcaacaaaacacaaagactaaacaacagttgaaagcgaagaaaacagttagtcagaagaagcagaaagagccgagatttgcgtttatgacaaagagtgaggttgattttcttgaagatggttatagatggagaaaatacggacaaaaagctgttaaaaacagtcctttccccaggaactattatcgctgcacaaatgcaacatgtaatgtaaagaagagagtggagcgatgtttcagtgacccaagcattgtggtgactacctacgaaggaaacatactcat

SEQ ID NO: 14276 - DNA, 790 bp, Solanum tuberosum
  misc_feature (647)..(647): n is a, c, g, or t
  Predicted polypeptide sequence is orthologous to G196
tttttgttcctcaggtagaagccaaaaacataaaaacaagaaaaaggaagatcacacagtcatgggtagaagtaagccaacaaaatcacaatctaaaacttcaagattgctacaaccacaatttcttgcctcaaaaaacagaaagatggctcagaaagttgtaatcacagtgcaaatggaagcaaaatctttaaagcagaaaaatgaagggcctccttcagattgttggtcttggagaaaatatggacaaaaacccattaaaggatccccttaccccaggggttactacagatgcagcagttcaaagggttgttcagctaaaaaacaagtagaaaggtgcagtaaagatgcatctttgttcgtcatcacatatacatccagccataatcatccaggtccaaatttgcctaaagactctgctacacaagagcaaatagtggatcaacatgtgtccctcgaagacaacaacaacgacgatgatgatgatgatgacgacacacaaagctgcaaatccccattgaatagtactactagtactactactggtaccagtattccccaaggcatacttgaagagaatctgttcagtgacagtttcttgggaacaatttcatatgatgattttctgcctctttcttaccctcaantaatgacaatttccaaaatccgagttgtcggaagagaatgactttttatgatgaattaggagaattggagctacctccatcttctacatccttcgcgggcattttcgaggaggcaatccttgtagaatcctcctcttagtaaa

SEQ ID NO: 14277 - DNA, 980 bp, Solanum tuberosum
  Predicted polypeptide sequence is orthologous to G197, G255, G664
gcaggattgtcaagatgtggaaagagttgcagattgagatggataaattatttaaggcctgatctcaaaagagggaattttactgaagaagaagatgaattgataatcaaacttcatagtttgcttggaaacaaatggtcagttatagctggaagattacctggaagaactgataacgaaatcaagaactattggaatacacatattaaacgaaaactcatcagtcgtggcattgatcctcaaactcaccgtccactcaacaccaccgccactaactcccacaccaccaccatcaccaccgcagtcaaaaccaccaccaccaccaccaccaaaaacatcaacatggatttcacaaacaacgttgaccaaaaacaacccactattatgattgccacgtcatcgtcatatgatgaaacaaaatgccacagtggtactactgaggaaacaaagccactagaaattattattccgaaaataccctcacaagttatgataaatcttgaactttcaattgggttgccattacatagtcatcatatttcatcaccagagtcaacggcctcatacaacttcttgaccaccgcagcaccgccgccaaccgggccgttacctgcggcggagacggtggcgaaaacggtttgtttgtgttggcaaattggatatcaaggtggtggtggtggtcagtggtgtggcaaatgcaaaaacacaaatggaatttacagatattgctgacctggcttttttggatattatttaagtaccttagtattaaattttttttcttaaatattactttaccattttgtgataagtgaatattttgggttttgggttttaggtttagatattaattttttttgcttttgcattttttgccttctaaatgtaatcatctactcacaaacttttgtagtacattggttgcaacaacttaccatggtatgaattggaatatgtatttaatttatcatttttagtct

SEQ ID NO: 14278 - DNA, 783 bp, Solanum tuberosum
  Predicted polypeptide sequence is orthologous to G197, G255, G664
gccggacttctccgctgcggtaaaagttgccgtctccgctggattaattacttgagaactgaccttaaacgcgggtaattttaactgaaaaaaaaagattaacttcattaatcaaattcaaagcctttctgggtaacaaatggtcactttattagccgggaaagatttaccagggaagaacagaataaccgagataaaaaatttactggaatacacattataagaaggaagctttttgagtcgggggcattgatcctacgacacacaggcccgttaacgagcccggtacaacgcaaaaaatcacaacaatttcatttgcaggtggagatcataaaactaaagatattgaagaagatcataataagatgataaatgtcaaagctgaatctgggctaagtcaattagaagatgaaattagtagcagtccatttccagaacagtgtcctgatttaaatcttgagctcagaattagccctccttctctacaaaattaccaacatagcccctcgaggtgttttgcatgcagtttgggtatacaaaatagtaaagattgcaattgcagtaaaaataatatgggtaatattgcaagttataattttttaggattaaagagtaatggtgttttggactatagaactttggaaactaagtgaatttttattataaatctttttttcccttgtgtatttgggttaaaaaagaagaagagagaattgtgaaagatatcgctattagtttaagttcttttcgaattttctcttatttgtaaaatttgaaagtatt

SEQ ID NO: 14279 - DNA, 705 bp, Solanum tuberosum
  Predicted polypeptide sequence is orthologous to G198, G1328
ttttttttttttttttttccgaactgtttgtctgttccttttttacaaaaaaagagagtaaaaattacataaattcattagtagaatcccaaatatttggaatattatcaaagtttaacatgttgctgcagtagctatctctttcatcttcagtagttgtgctgctgctattgttgaagtaagttgagtttgaattcaatggcgtaggacttgatgaaggtgtcgataaattcgacaaaacaactgattggaagttaaaattgttgttgttgttttcgttggattgaaatgttgaaccatcggatgttagaggatcatagtacccataattttgtaaaggaaaataatcatccgttaccccattgcttaattgccactcatcattaataacttggcaattattttgtgagttactaaagttttcaagatttgatgagaaatcctccatttttgttgttggtggctgcatgagttgagcttcatgactagaaaatggaacacatggggttgtacttatagttgtgcaagttggaaaatcttgaataggggcttgaatttggttactttggaccatttgtggcaattggttctggcaaatttgattatctgggatcaagcaagttgtatgagtcttgggcggttgggatgactcacaagaccacgtagctcaaatctccaagaacttccagggatttaacccaaaag

SEQ ID NO: 14280 - DNA, 879 bp, Solanum tuberosum
  Predicted polypeptide sequence is orthologous to G206
tttgctcataattcaggcaattctaacatcaactcattagatcttgtaaaaagatcatcccaaaaccgaattatcattaaagctacaattaatctggtaattatcctccattaatgacaaatcaagataattgtcatcgaccggtgcccatactacctcggaccaaatatcgtcagcaacttctaacaaattatccgacattatttgatttctcgattcagaactcgttgcaattgtgtttgaatatgaatattcacttgatgatgatgttgatgatgatgaacttggttgttgctgaatctcggtgtttattttaggacttgatatttcggaattattatccttagaattgttggcctcctccaaatgtatgtccacatttgaattttcgggctccgattgtatatctggaatttcttgaggctgagattcattcatttttttcttgagacgagtatgccaaatattttttatttcattatctgttcttccgggtaatcttgctgcaatagcagaccaactgtttccaagaacttgatgcaactttataatggtatcttcttcttgatgagtaaaattgccctcttttcaggtccctgagagtttgaggccccatattagctgttggaaccccaaattttcggtccatagtttctccgaaaatgaaactgtagttgtgcccaagttgaaaaccatctgcagatatggacattgccatggacatggcttctgagctgctcattgatacaaaaatgatacagcgaaaaacatattgcaagattaaagggagagttgctcattgagcagggaaagtatcggtgtgtcttaggaaacaagcaagtgctttcttcaacaaggtaggccattgctatttctggg

SEQ ID NO: 14281 - DNA, 1022 bp, Solanum tuberosum
  Predicted polypeptide sequence is orthologous to G207, G227, G230, G242
atcaatattcatcttctatctccattttcaaaaaaaaattacactattttttctgaaatggatttttttaacagatgttcaacttcatcttcttcttccgaatcatcttcatcagaatcttcgctttctggtaaaaaccctaataaatctgaaagaataaaggggccatggagcgctgaagaagataagattttaacgaaacttgttgagcgttacggagctcggaattggtctttgattagtaaatacataaaaggtaggtccggcaaatcctgccggctccggtggtgtaatcagttaagtcctaatgttgaacaccggccattttctccggcggaggatgaagctattttagctgctcatgctaaatatgggaaccgatgggcaaccattgcccgattacttccgggtcggactgataatgcggttaaaaatcactggaattcgacattaaagaggcgttatcagcaattaattcagcagcaaaatcagaacccgattgggttttctgatctgaaaattaatgggtcaggatccggatccggatctggattcgggtcgtgtatggagtatttaaatgctgatgagagtccaaaaggcaatagcaataataataataataataattacgctgttacgaataattgtagcggtgaatttgatgatccgatgacgactttgtcacttgcgccgccgggaatgggcggagatgagttgccggagaagaaaacggagagttttccggagggattttgggatgtggtgagaggtgttattgctagagaagtgagagaatatgttgcttctacggggtttcctaattgaaaaacaaaaagaaaaaaaatgtttattatattaatttgtcaattttaaagttgggcttttaagctttgataatcacttttgattgttgataagtatgcttataaattgattaattacatgttaaatatgttttggaagcttaaaaaaaaaaaaaaaaaaaaaaaaaaaaaaaaaaaaaaaaaaaaaaaaaaaaaaaa

SEQ ID NO: 14282 - DNA, 1239 bp, Solanum tuberosum
  Predicted polypeptide sequence is orthologous to G207, G227, G230, G242
cggatcaaaggtccatggagtcctgaagaggacgagttgttgcagacgcttgttgagaaacatggacctagaaactggactttaataagcaaatcggttccgcgtcgatctggtaaatcctgtcgtctccggtggtgtaaccagctttccccgcaagtggagcatcgtgcttttactcctgaagaagatgatactatcatcagggctcatgcgaagtatggtaacaaatgggcgactattgcccgtttgttatcgggtcggactgataacgctattaagaaccactggaactctactcttaaacgtaagtgtccttccatgtccgaagatttaagctttgaaactcctcaaccgcctttgaaaagatcgtctagtgttggtccttgtaccaatttttcttctgttatgaatccgggtagtccgtctggatccgacttgagtgattccagtctttcgggttttccccaaccgcttgtttatagacctgttccccgtaccggcgggattttccctcttcctcctccggttaagcagatcgaaattcctccatctgtacccgacccacccacatctctctgtctttccttacccggatccggatctattgaaaaaccaacccagtcccctaaatcaccaccactaccaccgcctcctttgccggtggttgataaaccgattcccccatctgcagccgtcatgggtcatcttcctcgatccaatcaaagttatgatttttgtgctgctcccaaatcaggagagaaacagttttttactccggagttcttatcagttctgcaagatatgattagaaaggaagtgaagagttacatgtctgggtttgaacaaaatggtatctgcatgcagactgatgcaataaggaatgcagtcattaagcgtattggcatcagcaagattgagtaatccatctatgattacagttgaactgttctatagtcatcaacaatggctgccgctgctcagcgaaatgacaccggagaagaaacaatggaagatcggagcagtcttcctcccccacccctttttttttttttttttattgcttaattacttccgtagaattccaatcaaaaaaataattttgcagtaatgtacagatgagcgagaggatgagagaagaaaactaaatttgaaaatgccgaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14283 - DNA, 1297 bp, Solanum tuberosum
  Predicted polypeptide sequence is orthologous to G207, G227, G230, G242
gcgagttctaagagagatatggatcgggttaaaggtccatggagccctgaagaagatgagcttttacagcaacttgttcagaaacatggccccagaaattggtctctaataagcaaatcgattcctgggagatccggcaaatcttgccggttgcggtggtgtaatcagttatctccacaggtggagcatcgggcttttacgcctgaagaagatgagactattattcgggcccatgcccgattcggtaacaaatgggctactatagcccgacttcttaatgggaggactgataacgctattaagaatcactggaactctaccttgaagaggaagtgttcatcgcttagtgccgatgaagggaacgaactcgccgatcaaatttttgaaaatcagcagccgccgttgaagagatctgttagtgccggatccgctatgccggtttcgggttttcatttcagtccaggtagcccatcgggttcggatagtgattcgagtcttcatgttacgtcgtcgtctcaatctcatgtgtttaagcctgttgctagaaccggcggcgtattcccgcagtcgatcgatatctcatctccgcctgttgatcctcccacctccctaagcctttcgcttcctggtgttgacttggctgagttctctaatcgttcggccgattcgactcagtcgaaaaatccttttcagttgctgcttccaccgatgcagattcccccaccgccgccaccaccaccaccaccgccgccgcaggcaacgacggtacctttcgaacgagtttctgcaattcaacagtctcttcagaaccctgatttcgggaagaacgcaggaggagaacagccagacaaggtatttgtgccgtttagccaggagttgttaggggtgatgcaggagatgataaagacggaggtgaggaactatatgatgggagttgaacaaaagcagcagtttcagcagcagcagcagcattatcaacaacaaccgcagcagtttcagcaacaaaaccatcaattgccaagtggtttagggcttggattgtgtatgcaacaagcttctgatggattcagggatagagctgctaatcgcatgagactaagcaaattcgattagtgaaacggagaaagaaaccgcctttgtttcattctctctttgtttttagggcacatgttgttagctctttaagcttcaactgtggaatcgtcaaaagaagaaaatagttttcggtggagtattgtacagggcgagggagagtttataaaatcatgttccattgaaaaaaaaaaaaaaaaaaaaa

SEQ ID NO: 14284 - DNA, 938 bp, Solanum tuberosum
  Predicted polypeptide sequence is orthologous to G217
gatggatatgcataataatgctaaactggggcaatttaattcaaaaaaagaattgctttctggtttgaaaagccttcctcagcccaagaatgagtaccagatagtcgtccaacaacctcctgaagaaaatgaagaaccagaagagaagatcgaagaagacatgtctgataggattgccagggagaaggctgaagaagaagcaaagcgacaggcattactccgtaaaaggtcaaaagtattgcaaagggagctccctagacctcccattgcttctctagaactaataaagagttccttaatgagagctgatgaagacaagagctcctttgttcctcctacactaattgagcaggctgataaaatgattagaaaggaacttgtgtccttgctagaacatgataataccaagtaccctctagatgagaagccagagaaggagaagaaaaagggggtcaagcgaaaaattgttgctgaacctgctattgaggattttgaggaagatgaattaaaagaggctgatggattgatcaaggatgaagctcactttcttcgtgtggcaatgggacatgagagtgaatctcttgatgaatttgtcgaagtacacaaaacaactttgaatgatatcatgtactttcctacccggaatgcttatggtctctcaagtgttgctggaaacatggaaaagctggctgctttgcagaatgagtttgagaatgtgaagaagaaaatggatgatgatactaagaaagcaacaaaacttgagcaaaagatcaaagttcttactaatggatatcagatacgagctggaaaactttggtcacagatagagtcaacctttaagaaaatggacactgcagggacagagcttgaatgcttccgagcattacaaaaacaagagcagctagcagcatcccacaggatcaaacatatgtggggaa

SEQ ID NO: 14285 - DNA, 471 bp, Solanum tuberosum
  Predicted polypeptide sequence is orthologous to G225, G226, G682, G1816, G2718, G3930
acaaggagttgtttggtacgaagatgagacaaatagactaaacgatcggttaggggttgtttggtagatgggcgctcttcaaggcttacttggtatcgggaatggaatagataaagcatttgaggccaaaaaggaagagagctcgaagcttgaattttcccaagatgaggaaatccttattactaaaatgttcaacttggttggtgagaggtggtcattaattgctggaagaattccagggagaactgcagaagaaattgagaagtattggaactcaagaaattccaccagccaataaatattttcttcttgctatatatagagctacaaaagcagaaaatatttattatcatttccttccttattatttatttgagatggttttgtagaacaatatgaaaaaaagaagaactgaacattggattggaataaatatactgtgatttagagcggaaaaaaaaaaaaaaaaaa

SEQ ID NO: 14286 - DNA, 840 bp, Solanum tuberosum
  misc_feature (607)..(607): n is a, c, g, or t
  Predicted polypeptide sequence is orthologous to G233, G241
tttttttttctctaaatctcgttcttcctttagctaattagtcctccactaagtaaaagaaaagtttaaaataacctcaaaattaaaatatcctagctaatggtcccaacttggaattttttttattttttttgggtccactctaaataatactagtcaagattaaacaaacaagaaatttcaaacttgccaactccaaaaattcctaaaaaaaacctattagctagaaataccactaattaatctcaaatttacataataatcaaaatagacccctcaaaattctggtaattctggcaaatcccctgtctttatgaaaacattgtaccaaaagtccatgtcctcctccatttttgaactagtagtaaatatgtccacattttcttccctcacttgtatttcttgatcatgaccaacaaccatattattctccgttgataatttgtctgtccagaaactctcatcgatcttgggaaaatactccgatgacgatgactctattttttcttcctttataatcaccatttgattatcatcaacaactaatgtcacacttgacatttcactagatgaaagttgtggtgagttgggggcaattttaatgtgntgttagtacttgtactattagtactaaaatcagaattattggaggattcagaaggtgtaggaccctttgtggaaacatgattaatcatggagtgtctttggaatttgagaacgctgataatcttcagcttttcttaagctggtgtgcaaagtttttattcattatctgtcgcctggtatctcctgctatgccgacatctatgcagatttcatgaagtgatatggctctctctt

SEQ ID NO: 14287 - DNA, 868 bp, Solanum tuberosum
  Predicted polypeptide sequence is orthologous to G237
gataatgttgaaccatcgatttagatttcgagcaccaagttatgaaattttactgttctccattccaattgatcctggagttccacttcatatgtggaagtggaaatttgagaagacatcaacacacctccaaagaatgaagaaggtatcatcgactgtgaaaagtcctacattgccgtgtcagatgaaggaacatggaatgtcccttgataacccaggtaaagattttacaataatcttattacacttatgtgaatactctgacatttgttaactcaattagacgttattggttcatgcatgagtatttttgaaaatagagtaatgcacctattgtttcaattgctctctggtgatttctgaaaacagagtactttctcccaaatttctttatttaattctttataggatcttcactgggtacctttcaaccaccagatggaatcacatcagcaatttttctttcgcagatcgacaatgaaaccattgtaagattagcttaagttaatgaatgaatagtttcctctgcttcaatctaaatggtttctggtacgatgaatttttcggtacttgcctttgcatgtggattgtttgatgatattgaaggaaagaacatggcatttgattttgggttaatgcttttttgggcagattgtagcgacagcagaaacaaaaaactatgagaaattgtcttataatctttgaaatgcttcctttctaagattatggaaagacgtttgagaaatttaggactgatattgctattatttcagctactggtttctttaatctagcttctgcacaggtgagttctacaatactctttaattggttagcttgtgatttttgaaagttttcactgatgaaa

SEQ ID NO: 14288 - DNA, 419 bp, Solanum tuberosum
  Predicted polypeptide sequence is orthologous to G249, G1322
aaaaaatactttttttcttcacaacccatccctcttctcttctttattatataaaaaaaaatggataaaagaacatgtgagtctcaagatgttgaagttaggaaaggtccttggactatggaggaagatttaattctcatcaattacattgctaatcatggtgaaggtgtttggaattcccttggctcgatccgctggtttgaagcgtactggaaaaagttgtagacttcgatggcttaattatctccgacctgatgttcggaggggaaatattacaccggaagaacaactgttgatcatggaactacatgccaagtggggaaaccggtggtcgaaaattgcaaagcatttacctggaagaacagataatgagataaaaaacttctggagaacaagaattcaaaaggcacatttaagaa

SEQ ID NO: 14289 - DNA, 784 bp, Solanum tuberosum
  Predicted polypeptide sequence is orthologous to G256, G666, G668, G932
acttctctgtaagacttaattccagtacacgtcagagaataaatagctttcataatcaagcaaagcacaaaattctactagctaattttttgctttgcttaattatgaaagttaaaatatacactaatgttaaaaagcattgtgtaccagacaaaaaataagaatgaggatgacatccatccctagttaaaatgctactactagaaactaattgggaatttgggagtaagaaaaacaaaagataatggaacacaccccaaatagaaaagcaaaaacaaatccttctaaattaataaatcgtcattttcatcaaacagccaactctccagcattactgacaattgaatttcatcatctatttctcttttgctttcaccatgaaatttaccagcagcttcaggtgtcgtagcttgagaaaattgatctgaattcgacggttcaaatgaagacgaatattcagtcatggcattattattattagtattacaagaatattgagtacttgacgaagcctttgattgctcggaattatttgtggattcacttttagtccactgtttgagtaatttggctatgttttcagcatttgatgcgtaagtagtagtagacatttttgcttcttgtttaatgtatgggtaacatccaatatcagtaattgtatagtcaggaattgggcttgatttatcgagtgacagtgcattttgtaaagcttgtttggctgtgttaatatcagcttgaagtgtctttcccatgggcctctggaaagttgattatatggttgata

SEQ ID NO: 14290 - DNA, 1166 bp, Solanum tuberosum
  misc_feature (558)..(558): n is a, c, g, or t
  misc_feature (840)..(840): n is a, c, g, or t
  Predicted polypeptide sequence is orthologous to G256, G666, G668, G932
ttttttttttttttagaatctaaagagtctggtaaatattattactagtactactataaactattcactacatgtgcatatatttaagattacttgtaatatatacacttttctttactcttgcaaattttagaatttttgctcaggctagctactaagtaagtaaacctgttaaactaaattacaaagctctaattaacaagtaacaaacattaaaaagacattaaagaaaaccccaaatttgaacttctatgttttttctgaagaaatatttactagagctgtcatttactagtaaatatttcttcaaaaaaagtcagcagattcacccaaacccattcccataaactcttcttcttgtgctggtgcattaatagcatcatcaaatagccacttctctagcaaagttaacgggacttgtgactcttccaaacttggcttgctctccgcttgaaacaaaaaaccattttccgaattcacattcggaaaatttggcttgctttccacctgaaaaatctcaggtgtgaaagcattaccttcgctaaaaaaggagtcaanatccctcaggtgttgcagcacttatggtaccttcactaggactcgaccctgaccctgaccccgacccaattgacgggttattcaacgagctttgagttgtctcagaagttgatcgacttaattcagatgatttgggggaatccttcatccaattttgaagtaacctggaaatgttttccgcactggatgcataagagctggatcctgtaacgggttgttgagcaagaaattgggctaaattggatttagcagattgaatcagatttgtcaaaggtgataaangcctcgcagaagggcttttctagccatgttgaatatttggctcgtgccgaaattctggcaagcccgggggaatcccattagttcttagagcggccgcacgggggggagctcaagtgtgtcccttatgaggttaatgccccgctggagtaacagggcaaaaccggtcccggtaaaaatgttaccgacaaatcccacaaataagacagaagtttaatataaaacgggggcgaagaggagcaacaaaaatgggtcgccacagccgttcaaaggaacaggtggcgacgttaaaacgcacgaggaggtgtatgggcccccaccaaaagcgg

SEQ ID NO: 14291 - DNA, 782 bp, Solanum tuberosum
  Predicted polypeptide sequence is orthologous to G258
cggcatttgggtgaaaagtttagttttaacctcaagagtggttcgggagggtagttggattatttgaccttgtttttggaaatttgacgattccattgagtctggaataactattctaatggagtagcatgtccagtttattttgataggaccccgaacgattcctaggggttcattcggaggctttttatttgagtttgagttgctggcagttttcttcgcaggtcattttttaccttcgtgatcgcgatgtgtcttcttcgtggcccataggctcgcgtccgcgataagctcccttttcccttgcggacaaagtgtctcgcgatcacaatgtttcttccgcgtctttcacgattgcgatgagtaaaattcacttagaatgaactcaaattcgggatttctcgcaaaaatcccattttcaaacccttggagctttgggaggcgattgttaagtgattcttggtgaattctaggttaggttgaggatcgtttcggttagcacgtggttgattatttgctccggtagagttgtttgggtgaatttcagccttgagaatacttttgaaagaaagaaacaagaattattagcttctcaaagtgcatcagctgtggaaggagaaactaatttagctggtcaaccttctcaattaacagaaatggatatctgggtgcaagctgttggtggaaagaaaaaggaaagagttaaaggtcttggctccctcgggtcgatctgtaaaggcgtcatctaaatcacatcagctttatcgagagaaattgatgag

SEQ ID NO: 14292 - DNA, 542 bp, Solanum tuberosum
  Predicted polypeptide sequence is orthologous to G259
cgcccttctactcttctccacttcatcataattaatatcattcattttctttcattttattaaaacaccttttctttttgctttttagtaactcgaacttataatttatgtacttatcatctgagcagacccttctcgtctaagttgaacgtagtcttttgaatgggggaattagaggatgaatgtgaaaggaatttgttagagtatgtaaggaaggcatcaacatcaccattcttgctaaaaacatacatgttggtggaggatccggcgacggacgacgtcatttcttggaattccgatggatcggcgtttatagtccggcaaccggcggagtttgctagagatttgcttccaacgcttttcaaacatagcaacttttctagctttgtccggcaacttaatacctatgtatgtttactatctccctcccaccctaaaaaaagttaacgtgtcgatattttatacgatcagatcacttataagattattatcttatttatttgcttggtaaagagaatgaaaataaaaaaaaaaaaaaaaaa

SEQ ID NO: 14293 - DNA, 769 bp, Solanum tuberosum
  misc_feature (709)..(709): n is a, c, g, or t
  Predicted polypeptide sequence is orthologous to G261
catatatcagtgtgtacagtgaacaaacattttaacaatcaagaacgtctgagctactgaacgcgtagagcagcaactattacctcataggaatctacccgagctctggtaaaccattcttaagggccaggaggaattagtttaaatgctaacagatcgagaaccatacaagatatccgcaaccatgacatatccagaatcagtatagacagtattacacacgtcgtgtgtttctactgatagcatgaaacaactgaatacccttatgtaacatggacaggcaacgccggaaaggatataactacataaaacatgaaattgtgccagactagcattactactgatcgactctatcattcactatatcatgtcatgcctgccacattacattctctctgctggagtaagatgtcccaactgttctgtaaggctaattacagtcttcctgttccaccaaaatttcccatcctcaactgtcttggattcacttattttgctctccatatcttccctttccggctttacatcagtagaaccagggttctcagtaaggaattgttcccagaatacatcatttactcctgttggcacattattactagcagtctctactcggttttctggcggagtaacatcaggagtagtgtttccattaggctcagagttcatgtcaatatcagaaaacttagatccaacatcaacagttagntgtgggtaagatatagcagggctaatcggcacaactgatagattcatccaagtctattga

SEQ ID NO: 14294 - DNA, 941 bp, Solanum tuberosum
  Predicted polypeptide sequence is orthologous to G263
gatgagaaaaggctgaaaattcaacttttagagaaagaaaagatagttatggtcgtgttgttcttggtgaagattggcaaagttgtagccaatggaagagtctaagataatcatcaatcgtcctaaaaacaatatagttcattctctagtctttcttttcggtttctattgttggggttgggaattcctcactgcccttttgcttttcagttattgcttcttctaatttcctcttttttttttttttcctaatagaatcttgtcaattaatttttcaaatccccaaaggggttttttttcaaaaatttgatagatttagagaaagaggggatgtcgcaaagaacagcgccggcgccgtttctgttgaagacgtatcagttggtggatgatgcggccactgacgatgtgatatcttggaatgaaattggcacaacgtttgtggtgtggaaaactgctgaatttgcaaaggatttgctgcccaaatacttcaagcacaataatttctccagcttcgttcgacagcttaacacctatggttttcgaaagattgtgcctgtcaaatgggaattcgccaatgagaacttcaaaagaggacagaaggagctcctcacagcaatacgccgtcggaagaccgtgacatcaaccccagctggtggaaagtctgtggcagccgggacttcagcatctccggacaattccggggatgacataggttcaagttcaacctcgtctccggactccaagaacccgggatccgtggacaccccgggaaagtcgtcccagttcacggacttgtcggatgagaatgagaagctaaagaaagacaaccagatgctgagctcagagctggtgcaggcgaagaaacaatgcaacgagttggtttcctttttgagccagtacgtgaaggttgcacccgatatgatcaaccgtatcatgagcca

SEQ ID NO: 14295 - DNA, 991 bp, Solanum tuberosum
  Predicted polypeptide sequence is orthologous to G264
gtcgtccctcgcccggcgtgtttctcttagttcaataaaatggatgtgatttcggcggcggtggcggccggcggcggtggaggtccggcgccgttcttgttgaagacatatgagatggtggatgattcgcatactgatgacatcgtatcatggactcagactggtcacagctttgtcgtctggaatcctccagaattcgctcgaattcttcttcctacttatttcaaacacaacaatttctccagtttcattcgacagctcaatacttacggcttccggaagattgatccagaaagatgggaatttgccaatgaggaattcttgaaggaccagaagcatctacttaagaacattcatcgtaaaaaacccattcacagtcatagtcaccctccgggttccacagttgatcccagaaagagctgcatttgaggaagagattgataaacttacacgtgagaagtctgggctcgagactaatgtctccaggttcagaccaggcacatctgctggcaaaactccaggtagaagaactaactggggcgggttggcagtatagagcaaaggccggagagtttacttgacctttgttggagaaagccattccaaatctcgactttggttgagcgtcttggtcaagaaactcgcagtccctggatatctcttgccatttaggttaagaaagaaggagattgtctccaattcgacagggactccacccagtccccaggaaagtatgttccgttggaacaaccattgcacggtcttagagttgaagtgtgggggaaccttttctcattcgaagaaactttctttccatgaatatagagttccacaggacttgaaattgttccacccttgcttgggtcgtcccggatactttacacggtcggtggtttcattgcgcgagcaccgccacaagtttcggctaattaagaaatgtcgtcgaaggacccctctggtcattggggaaatttcctttcaagggatggtc

SEQ ID NO: 14296 - DNA, 722 bp, Solanum tuberosum
  Predicted polypeptide sequence is orthologous to G268
agagctaagtaacaaaagattacttgtaaggttagaaataaatacaaattaaattcaaagtaagcaaattgctcaattatttacagtttttttttaaaaaaagatttctctccagaaacattgaggctttttcaattttgtattaaaccatctatcttctttaaaaataagtgttgtatcaaaacatataactaatgcgggatgctttgtgcactgagctgctcttttttattataaacgtttttccccaatcaaaagcttccaattggaatgaggtccctcgctgctatcatatttaaatgacacccatcctaaggcttgtgcaatttctacgagctcttcgataacaggtgtggtgtcgcgaatataaactcgtcccccgggtctaaaaattctgtctatttcaagcatgatagctgtcacattgcatctgtttttttcgactgaaaaaagagcagctgcgtggactaaatcatacgttcttggataagtatcaaatggctcacaccagtcatgcatgactccaatgaaaccccggtcatatagaacaggcagtgtattaggaccactaacgggaacaacattcataacccagcaatcgaagttgaaatcatgcaacgcagctgcaaaccccccatatacagctctcatgtccagcacgtttcgtaggtttaacgtttcccaacggaaagcaccaatatatccttttattacggcatacc

SEQ ID NO: 14297 - DNA, 973 bp, Solanum tuberosum
  Predicted polypeptide sequence is orthologous to G268
actataactctgcaatttctcgttttgcttatcaattttcagatgatttgattctgttaacttcattgtcgaagaagaaggagacaacaatgaagggagatgcattcaaatctactacagtaatcaaagttttagcctttgcattactctctatagcttttttttacttcggcaaacactggtctgatggatctcaacagcttgttttcttcaattcacgtcaagattcagcttctctcacaaacccaacaaacccctcttctcaatttgtttcaatttcccctaatttcaacaaatctgttgatttatcctccataattaatgacaccaccgtttctgataagccactggaaaaaacgccgtcggtggaggttgttttatctcctccaccgccaccaccgtcaccgcctccggcggttcagaagatgggggtgttggatgagaatggggtgatgaatgataattttgaagtaggggaatttgatccggaagttgtggataattggggtgttgggaatgagacggatgtagaggtaggtgatggggttaagagatttagggttaagaagtttgggttgtgtcctgatagtatgagagagtatattccatgtttggataatgtagaagcaattagtaagctgaaatcaactgagagaggggagaaatttgagcggcattgtcctgaaaaaggtaaaggattgaattgcttggttcctccaccaagaggttatcgagctccgattacatggcctaaaagtcgcgatgaggtttggttcagcaatgttcctcacgcacgtctagctgaggataaggggggtcaaaattggatattgatagacaaggacaagttcaagtttcctggaggtggcacccagttcattcatggagctgatcagtacttggatcagatggaaaagatgctccctgaaattgcattttggcgtcatgtccgagttgctttagatattggctg

SEQ ID NO: 14298 - DNA, 805 bp, Solanum tuberosum
  Predicted polypeptide sequence is orthologous to G268
aaatatattaatatatgttgcatagtttcttttttctgttctacagtttctggatttattgttaagatttctcagctcaagtaaacagcaaaacttatgactaaaagaaccccctcatagtcacagaacaatcaatggaaacaaatacaacactgagctataccatatgtcttcgatcgtgtgaagctataccatcttctgctgtacattttatatggctacatggttcaaacaacagccctggatctttctgccaatgttagcaagcattcgatctttcaggtccaattaacgtagaaacatgagttttgatgtgtccgtggagtgttggcttctccattcttatcatctgttaggctcgtaaaaggtgtttgtcacctgtcaatatcttgtaactagcatgaggaccctcagatgtgtctctcacagttacatgccaacccatggctttcccaatatcttgaagttcatccatgacagcaacagaatcacggatgtacgctcgtccacctggcctcaatatccggtccatttcaagcatgattgtggacatgttgcatcttttttgttcaatggagaagagaccatttgcgtgcaataagtcgtaggttcttgggtaagtatcaaatggttcacaccagtcatgcatgactccaagtagtccacgatcaaaaatgacaggtaaggtatttttaccactaacagagacaacattcagaacccagcaatccagttgattttcaatcattgctgctgcaaatcctccaaaaccagctctcatatccatcacatttctaagttttaa

SEQ ID NO: 14299 - DNA, 810 bp, Solanum tuberosum
  Predicted polypeptide sequence is orthologous to G268
ctaccgtcacgtttacgcctcccccaaaagtccattgtttcaatgccatgtaaaaccagcaaagaatttcttcagaaataactcaaccccacaaacccttttgtgaattccaacttcagttcttgaattttcgtttattttggtggtggagggaggaacaatgaaagggatgagcactagtttctcaggttcagaaaataatattgtttcacttacaaagactccagctttcgtcaaaatcatcggtttttcttttctatgtctttcccttctcatcattctcagaagtttttcatcagatatcactactgtctctaaccccacaaccccttctctaaaatttcctatgtctttcacttccgcacccactgccggtgacaatccatctccgccgccgtcggcggcggcagctgttccagagctccgacagccggggatggagaggacgggtattgttgatgagaatggggcaatgatgaatgagtttgtggtgggggagtttgatgaggaggtgatagacagtgtggtggatgagaagaatgggaatgatgagaatggaggaggagttttgaggggtaaaatagggaaatttaaagtttgtgatgagagtatgagggattatattccttgtttggataatatggagggaagtttggaaaggcattgccctccaaaaggaaaaggattggattgtttggtgccatggcctaaaggttacaaactaaggataacatggccaaagagcagggatgagatatggttatccaatgtggcccgtacaccctttgccaaaggaaaagcaggcaataa

SEQ ID NO: 14300 - DNA, 702 bp, Solanum tuberosum
  Predicted polypeptide sequence is orthologous to G270
gccaacagctatcctaaaccctcgaatcccaaacttcactccatttcctctatacaaacttcaattcatcaacttacctccttcatttcccaaaaacacttttcgctcccaatttcctcctcattctctcaatttctcccttcaaaacaactcgcagcaaccccacttccccctcgaagacgaagaacacgtaatcggagactgcatagtgtttgaagaaggaattttcgacgacccttttgttcaaaaatccgacaacaaccaaaataagccacaaaacaacaataagaagaaatcagcagaaattcaatccgagaatttaattcctgaagagtgggttgaagttcagagggaaattaacattactaagaaggaaaggcgtaagctttcacagcaattggagtttgggcaacgtgcagagaggaggaggctagagttaatgccaattggtagtaacagtaatgctagaggcagtagtattgaggattatttgaaagcgagagaagaaaagttgaagcaattgaagccgcttgtgcttgaaaacccagattttttaaaggttaaaagggataagaatgagaagaagaagaagaagagtgatgctgaattgagtgaaagggaagaggagaattccgtattgaggggtttcagtgaaagggtattgccgagagatcctagatcagcgggttatggtgggtggat

SEQ ID NO: 14301 - DNA, 615 bp, Solanum tuberosum
  Predicted polypeptide sequence is orthologous to G270
acggcatccactcacatgataaaaatccttctctggtataatgttgatataaacctccaagatcatgatggatggacacctttgcatctagctgttcaatcccgtaaaccgatatagtgaggcttttgttaattaagggagctgacaagactctaaaaaacagggatggtctaaccccacttgacatttgcctccattctggtcgagatataaggacgtatgagcttatcaaattgttgaaacaacttcccaaggttccaatagttggtctgacctaaaaatgcagctgctaagtacgaaattggcggatggctagcagtttggaagtgccagctttgttgagtttggctcttttgtgtcgcaccccgagagttatttgtacaacacttggcccttgagttgacctgagaagcgggttcagatttatgcttacactggtagggaaggaaatttctctttttgattctcacattgtactacagtgcaccatagtatgtgtaaatagaactgtatattgttacttagacattggattacagaacatttttggattttcaactctcagttgataaaaaaaggttgtgatacttaagatgttgggcatgatatttaggg

SEQ ID NO: 14302 - DNA, 831 bp, Solanum tuberosum
  Predicted polypeptide sequence is orthologous to G270
ttttttttttttttttctttatcacaacctttttttatcactgagagttgaaatccaaaaatgttctgtaatccaatgtctaagtaacaatatacagttctatttacacatactatggtgcagtgtagtacaatgtgagaactaaaaagtgaaatttcctctcctaaccagtgtaagcataaaatctgaaatcctggtttcttcgggaaaggggccaagtggtggtaccaaattacctcaagggtgcaacataaaaagagccaaactcaaagctggcacttccaaactgctagccatgccatctgccaatttcgtacttagcagctgcatttttaggtcagaccaactattggaaccttgggaagttgtttcaacaatttgataagctcatacgtccttatatctcgaccagaatggaggcaaatgtcaagtggggttagaccatccctgttctttagagtcttgtcagctcccttgattaacaaaagcctcactatatcggttctacgggattgaacagccagatgcaaaggtgtccatccatcatgatcttggaggtttatatcaacattatacaagagaaggatttttatcatgtgagtggatgccgttcgaacagcatagtgcatcaacgtggcaccatctttgtcacgtataagtggatttgcagattctcttaaaagaaagttaaaaatagcctgcttcttgccaagaattgctttatggatagctgtcaatccatccttatctggaacattattatcaacaacatgcttcaacaaagcggtgagaaggtaaaactcttcctgaggcagctaaagtatgtagagg

SEQ ID NO: 14303 - DNA, 751 bp, Solanum tuberosum
  Predicted polypeptide sequence is orthologous to G274
ggagatcatttaaggaattgttggaatattttcatgccattgggctgcaatggcgggcaaaaactcaggggataataggactaggacttctgtatcaatatttataatagctggtctatgctgcttcttctatttacttggagcatggcaaagaagtggttttgggaaaggagatagtatagcagtggctgtcaccaagactgctggtgagaattgcgatatactaccaaatctcaattttgaaactcgtcacgctggcgaagcaggcggtactgatgagtcagaagaagtcgaggaactcaagccatgtgatcctcagtacactgattatacaccatgtcaagatcaaaagcgtgctatgactttcccaagggaaaatatgaactaccgagaaaggcattgtccacctcaagaagagaagttacattgccttattccagcgcctaagggatatgttaccccgtttccgtggccaaaaagtcgggattatgttccctatgccaatgctccatataagagcttgactgttgagaaggccattcagaactgggttcaatatgagggtaacgtgtttagattcccaggaggagggacacaattccctcaaggagcagataagtatattgatcagcttgcttcagttgtcccaatcgaaaagggacagttcggactgctttggacactggttgtggggttgcaaagttgggtgcttatctttggaaaagaatgtcatagcaatgtcatttgcccc

SEQ ID NO: 14304 - DNA, 736 bp, Solanum tuberosum
  Predicted polypeptide sequence is orthologous to G274
ggttgatagagttcttcgacctggtggctactgggtgctttctggccctccgatcaattggaagactaattacaaggcctggcaacgtcccatggaggaccttcaggaagaacaaaggaaaattgaagagattgccaaacttctttgctgggagaagaaatctgagaagggtgagactgctatttggcagaaaaggatggatgccgactcatgccgttctacacaagaagattctgaagctacactttgtaaatcgacagatccagatgatgtctggtacaacaaaatggaaacatgcataacaccaagcaaaggcaatggtgatgatgaaggtctaagaccattccctgagagactttttgctgttcctccaagaattgctaatggactagtttctggagtctccgttgaggcatatctggaagacagcaagaaatggaagaagcatgttagtgcttataagaaaagtaacaaactcatcgacacaggaaggtaccgtaatatcatggacatgaattctggacttggaggttttgctgctgctcttcaatctcccaagttgtgggttatgaatgttatgcctacgatagccaagaaaaataccttggggagtcatatatgaaacgtggaacttattggaatttatcatgaactggtgcgactttgaaggcattctcttagaaatggaccgtattttgcggccagaaggagctgttattctgagagatgacggtaa

SEQ ID NO: 14305 - DNA, 767 bp, Solanum tuberosum
  Predicted polypeptide sequence is orthologous to G274
tccccaacccacccccagcccccaccaccgcaaaaaaaaaaaacatgtaaaacaactgagagttgtaaagagagacacagagagttgtaaatttgatgtatatacttgtagatatcattggaaaaaaacaaattaggggttttgcagtgttttctgttcttgatttaatttgaaactcatatctgagttggggacttacaaagcaaaataaagcaggaaagccagtaaaaggaagtgttggaaaaaaatttcatgccattgcaatggcaaacaaaagcttgggggacaataggaccaggacttctgtgtcaatatttattgtagccggtctctgttgcttcttctatttgcttggatcatggcagagaagtggcgttgggaagggagatagtatagctctggcagtcaccaagagtggtgagaactgcaatatcctaccaaatctcaattttgagactcgtcatggtggccaagcaggtagtattgatgattcaggaacagaagtcaaaaaatttaagccatgtcgtcctcgttacactgatcatacaccatgtcaagatcaaaagcgtgctatgcacttcccaagggaaaatatgatctatcgagaaaggcattgtccgcctccagaaaagaagttgcattgccttattccagcacctaaggggtatgtcaccccatttccatggccaaagagtcgggattatgttccatatgcgaatgccccctataagagcttgacggtcgagaaggccattcagaactggatt

SEQ ID NO: 14306 - DNA, 793 bp, Solanum tuberosum
  Predicted polypeptide sequence is orthologous to G275, G837
gagcaaagtggccagcaaaatggcctttgaggtcagagaagcttccttattggttgaaaagttctcaagttggagtttatggaaaagcagccccagaagactttgctgcagactatgatcattggaaacatgttgtgtcaaaatcatatttaaatgatctgggcattaactggtcttcagtaaggaatgtcatggatatgaaagctatttatggaggatttgctgcagcactgaaagacttgaaagtctgggttatgaatgtagttccaattgactcacccgacacacttccaattatatatgaccgtgggttgtttggcatttaccacgactggtgtgaatccttcagcacataccccagatcttatgatcttcttcatgcagatcatctattctccgatattaagaaaaggtgcacaatagaatcagtatttgcagaagttgacaggattctgaggccagaaggaaagttgattgtgcgggacaatgctgaaactattcttgaaattgagaatatggctcggtcagtaaaatggaaagtgaagatgtcttactcgaaggacggtgaaggattactatttgttcaaaaatcattttggcgtccaaatcaggaacagatagtcaagtcagccattgcataagcagagaagaaatttttccacaattagatacaaatctgatgttctttttatagtttagttcacttccactaaattaatagagaataccatcatgatatagcgatcatacgggatgtatgatttattggtttatgtactggagtttcatcatg

SEQ ID NO: 14307 - DNA, 669 bp, Solanum tuberosum
  Predicted polypeptide sequence is orthologous to G275, G837
ggaaaatcaagaaaattctgaatccagttcatcaggtgatgaatctcagtccggcgatgagagttcaaatcgagagagtgaggaagtaaattcgagagagaaagactcaacttcaagcgatggcgagtcagatactggaggtgaagactcaaatccagatgcttctgagacaacagagaaagcaaagaaaggagagacggagaatgaggtttttccagctgctgatcaatcagagattttgaaagaagctacaacacaaaatgggccatggtcaactcaggctgctgagtctgaaaaggagaatgagtcacagggttcttcatcatctacggatgacaagaagggcgataagtggaagctatgcaaaactgatgctggaccagattatattccctgtctggataatgtgcaagctataaggaaactccgacacactagccactatgaacatcgtgaaaggcactgccctgttgaagcttcaacttgcctggttcctctgccttcaggatacaagaagtcaattggatggcctaggagcagggatcagatatggtactctaatgttcctcatggaaagctagcccaggtcaaggggcaccagaactgggtcaaagtaactggagagtacttactttcccggtgggagtactcagtttaagcaaggcgctc

SEQ ID NO: 14308 - DNA, 931 bp, Solanum tuberosum
  Predicted polypeptide sequence is orthologous to G275, G837
tacaattcattcacatggttcacttctaacagctgctccccttttttctcagatctgttcttagagctgctaaaaggtggatagaggaaaattgtgaaggactgatagaatttaccggaaaaaatggcattaggaaagtactctagagtagatggcaggaagtcatcaaattattgctccaccgtaactatagtggtatttgtagctctatgtttagttggggtatggatgatgacgtcatcatctgttgttccagaccaaaatctagatttgtcctcacaggggaaaaagaatgacctgtcaacacaggtaaccgaaggtaaagagagttacaatggtggcaatgagagtaacaacaaagctggtgatgagggtaatccaactgatgagggaaaatcgaaacaatttgaggataccctgggtgatttacctgaggatgcaacaaaaggggatgccttagttagtcaagaagaaaatcattctaatccacaacagacagaatcaacttcagaagtgaaacaggaagagaaatccacagaacagaaagaggatgctggagaatctgagtcagaaactcaatccgagaaggcaacagatgattcagatgacaaaaaggaagatgggccaaacaaagtagatgataaggattctgaggttggggagaaaaatgaaaataaatctgttggagaagagatcaaagaaggttctgatgagaaaaaatcagtagaaaactcagttgaactgaatgataaaaaggatcaggaggtaggccaaggttctgatgagaaggctgatggtgagaagaaggaccagtcttccagtgccgtatttagttcggggactcagtcagaccttttgaaatgaaccacaactcaaaatggggcatttttaactcaggcgtcagaatcaaagaatgaaaaggaaatgcaga

SEQ ID NO: 14309 - DNA, 863 bp, Solanum tuberosum
  Predicted polypeptide sequence is orthologous to G275, G837
caatctgaaaacgaatttgattgtggtgcttttgagatttaccatcgttctaaaccatggcatttacacttgcaagaatgttcacctcctccatattacaaaatacaaaacctcaaggcatttactatccacaaatatataatgatgatactattaatttgctaaggaaatggtatgcgatagcctgacaagaataaagttacccaggaatttaatcagaaaactatctagtcaccgtggcatgaaagcctcttcgaacggaacacaaccagcatccttcacatgcaaggcagctaagcaatggcataagttagtgtctcgacgtcctttggtcgccacattgttttttggcaatacaacaatccctccttgtcctttgaataggtcatattgatttcatattgcatagacttgagcatactttctaactcgcttatagtctcctctttgtcacgcacaatgagcttccctcctggtctcaaaatgcggtcaacttcagcaactattgccagtaaaccacactttgttttaatcttggagaagagatggtctgcatggacaagatcatacgatctggggtaagtgctgaaggattcacaccagtcatgataaattccaaaaagacccctttcataaataattggtagtgtatctggagcgtctactgagacaacgttcataacccacacattcaagtctcttaaagcagctgcaaatcctccatagatagcacgcatgtccataacattccgcacagtagaccaatttatccccattccattaagatatgaatttgtcaacacatgtttccagtgttcataatctgcagtaaaatcttccggagctggtttcccatatactcc

SEQ ID NO: 14310 - DNA, 897 bp, Solanum tuberosum
  Predicted polypeptide sequence is orthologous to G278, G1290
cggctttctcctcatcttttccctttttctctgtcccaattcctcatataattcctaactagctagctatcccttgttcaatttcttttctctccccaaattcaatggctctttcttcctaatgatccctctatttcccctttctcccattaacatacagaacgtatgctctaatggatagtagaactgctttttcggattcaaatgatattagtggaagcagtagtatatgctgcattggcagcatgaacgaatcggaaacttcaccggcagacgtcaattccctcaaacgtctatcagaaacactagagtctatcttcgatgcgtcttcgccggatttcgacttcttcgctgacgctaagcttgtggttccaggcggtaaggaaattccggtgcaccgatgcattttgtcagcaaggagtcctttttttaagaatatattctgtgggaaagataggaagacgaagctggaactcaaggagctgatgaaagagtatgaggtcagttttgatgcggtggtcagtgtgctcgcctatttgtatagtggaaaagttaggccttcacctaaagatgtgtgtgtttgtgtggacaatgagtgcttgcatgtagcttgtaggccagctgtggccttcatggttcaggttttgtacgcatcctttacctttcagatctctcaattggtcgacaagtttccagagacacctattggatattcttgacaaagcctgcagcagacgatgtaatgatggttttatcccgcttgcaaaaccatttggccgttaaaagcattgttggaagagattagcttttcaaagccctgtcctttgaagattatttgtccacgtcttaattgttggatatccattaacccttgaataaagttccttgcctccatgg

SEQ ID NO: 14311 - DNA, 681 bp, Solanum tuberosum
  Predicted polypeptide sequence is orthologous to G278, G1290
gaagcttcattatctcttgctatggcaggcgatgatttgcgtatgaagctgttataccttgaaaatagagttggtctggctaaactcctttttcccatggaagcaaaagttgcaatggacattgctcaagttgatggcacgtctgaattccccctggctagcatgaggaagaagatagctgatgcacagaggacaacagtggatttgaatgaggctcctttcaagatgaaagaggagcatttgaatcggcttagggctctctctagaactgtggaacttggaaaacggttctttccacgttgttcagaagttctaaataagatcatggatgctgatgacttgtctgagatagcttacatggggaatgatacagcagaagagcgtcaactgaagaagcaaaggtacatggaacttcaagaaattttcgctaaagcattcacggaggataaagaagaatttgctaagactaacatgtcctcatcttgttcctctacatctaagggagtagataagcccaataatctcccttttacacaaataattttgtattagagatatgagaaaaacatagactctttttttcttttcatcatttgatgcgttatacatacaaacacatgtaccataaacttgtattgtgaaacaaaagcatttacatgctaaaacagaggaaaaaaaaaa

SEQ ID NO: 14312 - DNA, 889 bp, Solanum tuberosum
  Predicted polypeptide sequence is orthologous to G280
ctgtaacaaaaatggctactgaagaagcaagtttaactttgccttcttatcctgatatgataatggaagctataggtgcgttgaatgaagaagaagggtcgaataaatcagcaatatggaggcaaattgaagggactcatgttacactaccaccagggcatggtacactccttgcacatcacttgaatcaaatgaagcaagctgggcaattagttatgttgaagaataactacatgaagccaaacccaaacgcgccaccgcgccgtgggagaggccgtccaccgaagccgaaagcttcggttccggttccggatgggtatcctagaccacgtggaaggccaccgaaggagcgtgttccatacgcgccgattacggtacctatgaagaagacgacgactgaaagtagttctggtggaagtgggaagaaacgtggaaggccaaggaagtatccgatgacggaggagactccggtggcggtgaagccaataggtactccgagaggaagaggaaggccgccgaaggtgaaaactccggtagctgcaactgtaggggcttaattgaagaaagacaaattagtttagggacttgtatggcaaaatatgctaactgttgttttctcttttttatttgaatttaatgtttagtccctgtagttttgtttaattacatttgtaggaagaattgtgtgactggtgagtgaatcagtttgtagagaagaaaggagtcttggtaaaaaagcatgtctgtctgtattgtttggaagtaatccatcggcaaaatgctgtgaaagagctagagttactcattgggaatgtctttgcccaattgttactcccaaattggtcgccatgatcaacccaaagcgaattattcgccttattcaaggctg

SEQ ID NO: 14313 - DNA, 927 bp, Solanum tuberosum
  Predicted polypeptide sequence is orthologous to G280
tactctctctctccatggctactcaaagcttcaaccagttcccttcataccctgagatgatttatgaagcccttgatgaactaaatcaagaagggggtgcaaacaagtcatcaataactaagtacattgaaacaaagtatggagatctgaatgaggaactttcaaagatgctgcctttacatttggacaacatgaagcaaactggagacctgattttcctcaagaacaattacatgaaacctggtccagatgttccagcaaagaggggtcgtggtaggccaccaaaacccaaagctccattgccacctggtgctgttgaatctgttgaatctgcaccaccaaagccaagagggcgcccaagaaaagaccctaatgcaccacctacttccaagaagccaaagccagcacctgttcctggaggtcccaattcaacagatcttggttctactactgggaggcctaggggtagacctaggaaagttaggccacagcctgctcatgatgatgatgatgatgttgaggaaagctgaaaactttaaggcttgttattggagtcgtgctgatggtgatgactctaatgacttagttgtcttattttccccccttttttaggtattagtagtattatcttatgtaatagtttcagtttgagttgccctagtgtgactagggggtcatggtttcaaaactaagactgcgtagaatagactaattgtggtctcagttagagttgtcgttatgggactaggaggtcatggtttacagtgtgcaatagactaattgttgtggtccggttctttcctgaaccccgcacatagtgttagctttagtgcactggtcttttttattagtattgttttcttgcttaatgcccctattagttctagtagatgtgggtataagtttgtaggggattgtgtacttgtg

SEQ ID NO: 14314 - DNA, 950 bp, Solanum tuberosum
  Predicted polypeptide sequence is orthologous to G291
ccgaagttacaatggacgctctaaattcttacgcatcgtcggcggcgatggcgcagcaaacctgggagttagagaacaacatcgtgacaatagatgcgccgtcggggtcgacaccggaaaactctgcgtcagatgccatattccactacgacgatgcggcacagacgaagtttcagcgggagaagccgtgggcgagtgaccctcactatttcaagcgtgtgaagatctctgctcttgctcttctcaagatggttgttcacgcgcgttccggaggtacaattgaggtcatgggactcatgcagggtaagactgacggcgatgcaattattgttatggacgcttttgccctccccgttgaaggcactgaaactagggttaatgctcaagctgatgcgtatgaatatatggtcgaatattcacagaccaacaagcaggctggtcgtttagaaaatgtggtcgggtggtaccattcccatcctggttacggatgctggctctctggtattgatgtatctacacaaatgcttaatcagcaatatcaggagccctttcttgcagttgttattgatccaacaagaactgtttctgctggaaaagttgagattggtgcctttcgaacatatcctgaaggatataagcctccagatgaccccatctcggagtaccagaccattcctttgaacaaaatcgaagactttggagtacattgcaagcagtattattcattggatattacatattttaagtcctctctcgattgccatctcttggacctactatggaacaagtattgggtgaacacactttcttcatctcctttgcttggaaatggagactatgttgctggacagatatctgatcttgctgaaaagttggagcatgctgaaaatcagctgtcccattcacgttatgcgtccttaatggcaccccctcaaagaaagaaagaggaa

SEQ ID NO: 14315 - DNA, 590 bp, Solanum tuberosum
  Predicted polypeptide sequence is orthologous to G307, G308, G309
gctgggtcaatggcgagtgaaggcttaacctctgcaggggtttaatctggttcccctgggtttaaatatgtaccagacaagccaaacttgttagtggctttaatcacaaatgaagaaggatatagagtagaagaagaaagatgggtgtcttatgttgagttggcatagtcgcccgctcatcaccacatctgcttggcgtggctatgtcgctaagttttgggattagtcaatgggtgaggttgctctgcagctgtcctggaaaatcctgctactctgagaaggtttctttgtagttgtcctgcatcatccaatacgtagttttatatgttactcatcttttactgtttacaggtacgtcttagatgtatcagacagtccaaattgataacatttgtaagatggttcttttctttgacctcactgttattgagagaatctctgcagtagccattaaatttgataacgtgaagggcacaatcttttcaaaacagtctctttacctccacgagatagggtaaggttttgtgtacactctaccctcccgagaccctgcttatgggactacactagattatttgttgttgttgttg

SEQ ID NO: 14316 - DNA, 918 bp, Solanum tuberosum
  Predicted polypeptide sequence is orthologous to G307, G308, G309
gataatttatccacaagattcaattgaatcatcatatacagatgttttacaaatgcatttctacgaaacttgcccttatctcaaattcgcgcattttactgcaaatcaagcgattcttgaagcgtttacaggttgtaacaaagttcatgtcattgatttcagcttaaaacagggtatgcaatggcctgcacttatgcaagctttaactttacgccccggtggaccgcctgcatttagactcaccggaataggccctccacaaccgagataatacagatgcgttgcaacaagttggatggaagttggctcagttagctgaaacaatcggagttgaattcgaattcaggggatttgttgctaattcattagcagatcttgatgcaactatacttgatataaggccaagtgaaactgaagcagtagctataaactctgtttttgagcttcatcgattgctatcccggccgggagcaatcgaaaaagtgttaaattctattaaacagattaacccgaagatcgttactcttgttgaacaagaagcgaatcataacgcaggggttttcattgatagatttaacgaagctttgcattattactcaaccatgtttgattcgttagaaagctctgggtcttcatcttcggcttcaccaactgggattcttcctcaacctcctgtgaacaatcaggatttggtgatgtcggaggtttatttagggagacagatttgtaacgtggtggcttgtgaaggttcagatcgagttgaacggcatgaaacactgaatcaatggagggttaggatgaactcatctgggttcgatccggttcatctgggttcaaatgcgttcaaacaagcttccatgcttttagctctgttcgccggcggcgatggttacagagtggaggaaaacgatgggtgtc

SEQ ID NO: 14317 - DNA, 616 bp, Solanum tuberosum
  Predicted polypeptide sequence is orthologous to G307, G308, G309
gttcacgagagatgtccatggatacaattatggaagatgaagattcctttgtttctaatacaaatgcaatcatctacgcttcttctgatatttcaggctggactcacagtttgatctcagataacaatattcccaattcatcgtcttctgccaatgtagacgaccgccagcagcagatatcgactgctgctgctgggtgggtggattcggatggattggttatcatcagggtggcatctttccaagctgggtttaaattaattaattattaaggcaaaattggatgaattcaaccaaagaagaatttaggaatatttaaattgtttgattttcagggcactttgcaacaacagactgaaatctcgcggtggatctgaatttagtagcggtttattgctggatactggtaggactgtgaaagaagagactagcgctagttgtcaattcgttgatggcttgtgccgaggcgatccaagagaacaacctaagactagcggatgtacgactcagtgagataagattttatagagactatttggaaatgcttacgttgagcaaggatatagagaactttttttcctatttttatgaacaagataatatgttgctaaaatag

SEQ ID NO: 14318 - DNA, 1092 bp, Solanum tuberosum
  Predicted polypeptide sequence is orthologous to G312
ttttttttttttaacttgctcaaaaatatcatctttctatactaactttttaatctacagagagcaatgaaattgaaattaagcacttatagaagaaagtacctaacagaaccaggacacataactgatttagtgccatgaagaaacagtcaaaaggggattatctttccaagccaaggagagaaacccaggtgcagaatcaattaatccaaatgatgaactataattatagttccaaagaagaatttttgcttgactcattgcataatggctaagtgttactgatttaaaaccagccccttccattaattctctccaatgttctttatcttccatacattctcttctggttccgccgtcgtctaggcccaccgctccggcaattctcctgccaagtatcagtctttccacttgtactctctccggggagtctcgggtcaagctcggatccaacgactcgaaaactgttgagtagtatttcagtgcattcttaaaccgctgcaggaatcctacatcgttcaaattcacctcatactcacccaatgtcacaatgcttggattcaatgatttggctagactgagtgcagtttctacaccaacatttgtttcgtccagtaaattgtacagctggcaacatgaagttcacagctaaaatttcatctggatcaattcgaaaaactagacccgtttagttcctgaactggagtcaatatcggttcgaattcgaagttaagatccagaagcttcgcaaagtcacgaagaccgattccctgtaagctaaaagtgaagctgccgggaggagttacccaataccactgatggaataccagagattctaacaattgacctgggtttccccaggcttgattcttagtttgctaagaggctgtgtaaaaaaaggcaggcccatgtgggatacccatgaagcaatttccaaaatcttacaattggtggaattctctccgttggctttttccagtggcttcaagaaattcggtctgaattaggccgtcttaaggtggagacaaatactcttgagtatggggagcattcgctctcattaaaagggtttggttttgacaacagtgaagc

SEQ ID NO: 14319 - DNA, 753 bp, Solanum tuberosum
  misc_feature (735)..(735): n is a, c, g, or t
  Predicted polypeptide sequence is orthologous to G314, G2699
atttgatcgagataaaataaaacaaaagttaatagctaagtcaaatgaaattaattaactaaagaggaacccaagcagtagcaaacacaacactatgtcctttccatgtaagcacaagatcttcttcatccctctttagcccccacccagctgcatgctcatccaacatgttcttcacttccgtaactccctcttcactaaatccactgctcctgaaatttgcatttctcatccgttgcacccactgactcttcggctccagcctttctagtcgttgtataccctcctgagctatcacattctcaatcttccagcaaatatccgcttcgtaccactgcctttgcttgctccctcgcggaagaaatgtatccactgtatcataaggtatccataaataattaaacgcggatcttaatctgcacacgagattattagaagtaaaatccgcgtcttcatctactagcacaacaatcgttgggtccaaattccgaatggccttaagaaacatggcacggaacgaattggaaagaaccgttgtttcctctggtatgtaatgaagcatcatgtgacagtttattactagtgcttcgcccattatcaggacgtattagattttggacacgtagctgttcgaatacattcgaaaaaccatctgatgaacttgaaggaatactctaaattccatcatgacatttcgtgaaccttgcgaaatttaccaatttaagcacctaaatnctttcgtaaggaaagatc

SEQ ID NO: 14320 - DNA, 696 bp, Solanum tuberosum
  Predicted polypeptide sequence is orthologous to G319
gctcccctctctctctcatttcaaaattctctgctttccatctccattcttcgaggtgttaaaacaattctcaagaaaatgaagaatgtgattgaacaagatgaagtatattattctgccgtgaagggcccctatcaactgaatgaagatatctgtccagctttccctccaatgcagctttctgaagattctgctgcatttcagcatggttccaatctgcttactccaaaacaaaaacttgtttgtaatgaagctgcagatctggctcttctttctaactcatctgcaagctcttgctctagttcctctgatatatcggccaaggaaggttttgattctttaacattaacaccagaatttgattcagagtcttacagctcatctcctgatgagcaccaaaaatcggccttaagtggggtgaaaacaaccttgcaaggagactatttggagatggagaacaaggaagaaaatgcctatggtatcgaccatgaatctttggattgtacatcaaagcttagagaagacagggagtatgaaatggtgctgaacagtatcatggatcaggaacataaactcagtgtttacgaccaaaaaatccagttctcagaagaagagatacaggggcttgaagtatgaacttgagagaaatgaagcagttgccaagcttatagttttcctgaaagtgcagcttgatac

SEQ ID NO: 14321 - DNA, 817 bp, Solanum tuberosum
  Predicted polypeptide sequence is orthologous to G324
tctcccaggaggaatttcatgtccatctcgccctcccatagcgacaatcatacagcttcctcttcttcttcttctccaaaccctaactctaatcatggatccaaatccaaacaacagcagcagcaacccgacaacttctcaggaaacatggctaccactgcatctacttctggtggatcctccaaaaaggtgaacaactccggtagcagtcgagaaagttcacgacatcataacagtgatagaatctcactgcacggacaaagaaaatcagctaggaccaatgatccttccagcggaagagaccagtttggctccaacagtccccaaggagttgttacccgctcagctccaagaagaacccagatggttagtggaaaccacttactcaattttcagtatgatcccatttctcgtccacaatctaggttgcctcctcctaggagatacgtcaagaggaagccttacaacaaagacttgtttcttcaagcaaattacaagtttgttctgttggattcaggcaattacacgcctgactcgatggatccagacaaaatgttacactgggaggatattgtttgtgtgagatattccactccatttcatgtgcaatgccccatatgcttagaggatcctctttgtcctcagataacttcgtgtggtcatatcttctgttttccctgtgttatgcaatattttatgatctccgaagaagatgaccataaggatgatttcaagaagaaatgccctttgtgttttatgatgatatcttcacaggatttgtacaccattcaaaatgagaaacgtaaaacatatcggg

SEQ ID NO: 14322 - DNA, 934 bp, Solanum tuberosum
  Predicted polypeptide sequence is orthologous to G324
gttggttagctagagtagattcaggtttagttgatgacttggagaaacttccctttgtctgtgctgcaatggaacaattggagcagaggaagacgtactggaataggcaacatattgctgttcaaaatagcaaatctgacacagataatcgtttggagaagtgctcttatagttctcagccaacagaaagtgttcaggcccattctgctggacaatctactcatgtaatgccatccagtaatccaactgataagccaatattgcaggagaagtcaactctcaataaggtagtgagggactctcagcttattcaagctgcagatgttgaatcaattgaagaacgtgttggatcttcattgttcctatatggcaatgacaagagcctacagaaagacacaagtggcattactgatagagaagagatcagttcctacagtttctaccaggcagttgatggtcagcaccttatcctccatccactgaacatgaagtgccttctgcattactacggtggctatggtagtcttcctaacagaatcagtggaaagattttacaaatggagtccgtgacgcagtcggaggccatgagaaggcgctaccgcttcctaagtcatttttctttgacaacaacatttcagctttgtgaaattgatctcagcaagataatccccatggatgcactttctccatttatggaggaaatcagaagtagggaaaaacaaaggaagtggctagcgaggaaggaacggcgtgaacaagttaaagctgaagccattggcatgtacttagagcctttgccttttagcttttcagaaccttctttcacagaacaacctactttcactagcgatgacttcgaagctttgggaggtacgagtgtaactgtaacatcatcaagctcccctgtgctggaggcaggcaactgttctccaat

SEQ ID NO: 14323 - DNA, 944 bp, Solanum tuberosum
  Predicted polypeptide sequence is orthologous to G328, G2436, G2443
ggaggattcagcaacaaccatgaagctgcttcatcttcatcttcttcatctgcagtcatatcatctgcattttgagtaaaactcaagaacccataatcctccgtgctttcccttgtgggcccaccaatcatcatagaaccactgccaacggtttcgacagctggaggaccataaagggttcctggaaagtggaatcaagacgaatttagaatttaagtttgatgggttcaatctttaaatgttcttgctacttaatgctatacattttggaattatggttcaaaaatcatatttattgaaatatttgttattttttacatgtaggagtagaatttttgtgtggctacctaaaatggtcataattgggacacggtggtgacggcgcgccaaggggttggcagagtggatgtcagcgtcgcaggaggcacagagtgaggcagcatctgccttgcaaagaaaggctgcaggggcacgtccgcaggcctcgcaaacccacacacggtcgtgacgagaagccaacagatttgctgcatgcatgcggatgtcacaaccggcacacaagaaggtggaatcttccctgcagtaaacgtattttgcttacatggtgcttatgaactaccatttttaggaaaaagtattgcatcagtgctttcctatcctttgagaagtggaccttttattctttatcttcagtgatgggtcatttattgtgctgaaagagaatctgggacaaacactagatgagagagaggccctggaccaaaagagtatgttccaacgaaaggatgaccacagtggaaagcagaaagcagaattgagcttcaattatattgcaccagctcacaatgtcatatacagccactgagcatccagaggtcgttggtaatagtgtttttcctattacttgtggttgcactgagttctttttatttggaaaaggagta

SEQ ID NO: 14324 - DNA, 862 bp, Solanum tuberosum
  misc_feature (159)..(159): n is a, c, g, or t
  Predicted polypeptide sequence is orthologous to G328, G2436, G2443
gcttccatgaattactggcttatttgacttggattgtttatatcaatggagcattactctttcttttaagatcaaaatcttacacgagggcattgaaaatagaacaaggtgtattggcttattaagcttgtattcttaattgtcagataaaaaacatanttggaagatgtaattaatccttaaatcatcacgtctcaaatacaaaaatcacttacaagcagaattgtgacattacgctagtactatctgaacaaaatcttgcatacaccactatgcatcagagtgcaccaatgttagtgagacctcaattgattccaaaagccaaaggccccaggacccacttgttcaacctccctgttgcttgactccaccagaatcatcagccaccacaagataatgaaacaacttttcctacccattaacttgtctccacgtgtcacctgtggattctctccccacttggtagttgcctagttgtcattttccgtcctttgccccttcacatttcacagtgccccataagtctccagcattcttgctcaacttcactactccaactacaagttttacaacacaaaatagagagcaagaaagaaaagaaaagagaaaccaaaattagtcagtccaatgttgaaaaaagagaagagtggggggtttgatggaagtagcaacaattgggcaagggtgtgtgacagttgccattccgcaacatgtaccgtttactgtcgggcggatccgcctatttgtgtgcggattgtgatgcccgcatacatgcagcaagtctcatggcttctccgccacgaagcgttgtatgggggtttgcgaagccctgcgagccgtgcccctggcagcctttcttttg

SEQ ID NO: 14325 - DNA, 799 bp, Solanum tuberosum
  Predicted polypeptide sequence is orthologous to G343
aaaccttctcttattagagagagaaactccagagagtcgacactttttcgtcttctctaatttgctgttatatagctatagctctagctctacaataatggatgtctacggcgtgcactctgcacctgacttgtttcgtatcgatgatcttctcgatttctctaacgacgaaattttctccattaataacaactcctccaacaccgactctaaccaccaccatcaacctcactcacacaactcctcagccgccggagccgccaattattacgatgctcttcttcctaattcttccgacgatttcaccgataacctctgcgttcccagtgatgatgtagcggagttggaatggttatcgaactttgtagaagattcatttagtaattttccggctaattccgtaaccggaacgatgaatatcagttccaatactgcgtcgtttcacggaaggtcaagaagcaaacgttcgcgttctacttcaagctggacatcgtcactccaaaacactaacgctactacttctttgaagaacaaggagagttcagtatataccagagaaaggtcgtcttcaatggatgaagatgtgccacggagatgcacacactgcgcttcggagaaaacgccgcagtggagaactgggcctctaggcccaaaaacactctgcaatgcctgtggagttaggtacaaatcgggccggctagttccggaataccgacccgcagctaggccaacttttgtgttaacacagcattcaaattctcaccggaaagtatggagctccgtagacagaaggaagcga

SEQ ID NO: 14326 - DNA, 853 bp, Solanum tuberosum
  Predicted polypeptide sequence is orthologous to G346
attttgatggaaatcaatacaaataatatggttttagtaaacctaaaataaacctagactccatactaattgtgctaaaaatttaaaaactatagactcactactaattaaccctgccctatatacttgattttaaatcctctgctttctcatctccaaaactttcctatgagaacttgaatgtaaatcaactgaaaaagtagggctattcgcggggcgatactcagggaacaaccttccagacttataccggaccccacaagcgttgcacaacgttttaggtcctgtaggacctgcacgccattgtggggtcttatcgaccccacaatgctgacacctcctaccaatgctcgtacttcttttagctttagtcaatgatattttgagcaatgttagtccttgcttagtactagtgttgttgaatttcacttggttaccccatacacatgagttgtcacattgcaacgcgattcttcgccttctcttgctccgtgcaccaacggggtggttaatggggacttgtaggaggctagaggtgtggcttgtaaacgcgttttccttaacatttacgatgaaattgtcgtgtagtgatgtgttgctgctgctgttttccagtactgaatttgggctgtggtgatcaaatatgaccattagggacatgatcagagaatatgtcaaattctactgctggaaatgcatctttatttgaaagccattccaattcttcctctacataatcaggaaatgaagggctatgatcatctttgattgaattccaaagggtggttttgatggattccaaaggcaaggacggcaagaaactttgaacaatttgccatcaatcattcttaaa

SEQ ID NO: 14327 - DNA, 1088 bp, Solanum tuberosum
  misc_feature (770)..(770): n is a, c, g, or t
  Predicted polypeptide sequence is orthologous to G346
tttttttttttttttttttgacaaaggtaagtaggaaggattaaaaaacaaccaaatctttgttaggagctcttctttctggatttctatcttaaaagcatataataaaacaaactaagttcaaaattcctagtggattttgatggaaaatcaaagcaaatcactgaccatcaagaccattacaacaaaaacctatagtctatgctaactatagtaaatgaagaaaaatatccgaaaagacgctgcagatgactcactactgttctactctatatccacaagcttcatgaatcaacattcctcccactccaatcttatgctttctcatctccaaaaccttccggtgggagttggaatgcgcagcagccgagaaagaagggctattagccgggcgatactctggcaacagcctgcctgacttatagcgcaccccacaagcattacacagtgttttcggccccagagggcctgcccgccattgtggggtcttatcagctccacagtgttggcacctcctcccaatgctagcagcactcttagctgaattcattggtaacgaaagcaatggctcacgctgcttaacgttcttgaaacttggttgtgtcacctgcagacaatgctcgcttggcatgtcagcaaacccacctctccgtcttctacgtcttctcttgctccgtgcacgaacagggtaattaaccggaacttttaagttgacaccagacagctcgtaataagacatttccatttaacaacaccattgccacttgctngtgacttaagtgctggttactaattctccaagcaccgaaaccgggctatgttgaccaaataccataccggggtcctcggaaaaaatgccaaattctatccgtgaaatgcatcttggttgaccagcattccattcttccccaaacattcagggctggggaaaaaggcaaccagacgcgtttgttgacacaacgaacataacacaaaggcgggtctcttggcaagagaaaacggaaaattccaccaatcttcccttaaaacaagttcccccttccaaagaaaaaagctggaaaggcctctccccccaaggaaaaggcggg

SEQ ID NO: 14328 - DNA, 936 bp, Solanum tuberosum
  Predicted polypeptide sequence is orthologous to G347
gatcaagaataagatgtaagaaaaatatccaaaaaccaatctttggaaatcttgaattaccaatttctgtcggaattttcgctcagatttccatttgaattccaacccattttcagacgatctcaagtaccctttactgtattttttttttcgtgtttggttatatatatataatagagcggtaccctatcttccagatttgttcattgactggaagaataaatttacctcacggatcggcagaaattagctcttctaactcagtcgattcgacattcaaacagattgaaagatatgcagagtcagttgatgtgcagtgggtgcaggacaatgcttctttatcccagaggagcttctaatgtctgctgtgcagtgtgcaatgcactcacccctgtcccaccacctggaatggaaatggctcaattgatatgtggaggctgtcgtacattacttatgcatccacgtggagcgaacagtgtgagatgctcctgctgtcatacggtgaaccttgtcccaggtcctaaccagtttgctcatgtctactgcgggaactgccgtatgatgctgatgtatccatgtggagctccatcggttaaatgtgcagtatgccattacattaccaatgttaatgcaggagatggaagagcccatgcacctttgaaccctcctaacggcattgctacacctgcttcaggatcctcttcaactgccaaggctcgttcacaaaatcaaactgttgtcgtccaaaacccaatgtctgtcgatgagagtggcaagttggtgagcaatgtagttgttggtgtaacgacaacgtcatagcttgtcagcaaaatttgctgttcgtggacgacaattgagagttttgctcacaacaattggaaagatgagtataaagacagccgctgcatataaatatggtagtgtttagtgttaata

SEQ ID NO: 14329 - DNA, 992 bp, Solanum tuberosum
  Predicted polypeptide sequence is orthologous to G347
atttatttaacggagaagaagatgtagaaataataagaataaaaaatcacaaaggagaaattccgataagattaccgaatccaaattctgaaaatctataaattgccattcttacaatatttccattgtttttccagaatattgggaatcgccaattctgctgtatattacccaatttgtttcatcctacctacactgctatgcagagtcagttggtgtgcagtgggtgtaggacaattcttctttatcccagaggagctactaatgtctgttgtgcagtgtgcaatgccctcacccctgtcccgcctcctggaatggagatggctcaactgatatgtggaggctgtcgcaccttattgatgcatccacgtggggcaactagcgtgagatgcgcctgctgtcatacagtgaaccttgtgccaggtcctaatcaatttgctcatgtcaactgtggaaactgtcgtactatgctgatgtatccatgcggagctccatcagttaaatgtgccatatgccactatatcacacatgttaatgccgtagatggaagaatcccagttcctgtgcacacctctaatagcggtgctacatcctccgcaggacccacttcttcaacagctacgggccgttcacagaatcaaaccgtggttgttcagaaccctatgtctttagatgaaagtggcaagttggtgagcaatgttgttgttggtgtgacaacgacgacttaggaattatctgtgaaatgcaataacagaaggattaagattcctatgtctgtgaaatgcacctaactgaaggcagtaaggtttttgcttgcttccattggatcgatgagtacaaaagtggtgctatatagatatggtaatatttagtcctagtattaaatcatttctagattgaagaagtgtaccaaaggtctgaccatttgtggtatatttgcaaagtgattgaacatttaagctttagtaatgttgattttctggagtcggtaa

SEQ ID NO: 14330 - DNA, 239 bp, Solanum tuberosum
  Predicted polypeptide sequence is orthologous to G347
cagcaacagaggagcaggagcggctaccaataaccgtgttggtttcagtggatcgctggagaaacctgtggcgatcacgataatccttggtgcgggctacgagtccgcctggtgggtggacaagtcgttcctgtaggccggttgaagaactggcaccaacatctgaggagatcgtttcacaaaaatctgttaattctaccaatgaatatttttgagcagaaaaaaaaagaaaaaaaaaa

SEQ ID NO: 14331 - DNA, 997 bp, Solanum tuberosum
  Predicted polypeptide sequence is orthologous to G351, G545
ctcaactttcttctatcacttttatttctctaatataataataattctctccatgtcgattgaagctttgaagtcacccacggcggcggcgctaccaccgcttgaagagattgatgattcgcataatttggattcatgggctaaaggaaaacgatcgaaacgaccacgtattgaaaatccaccaactccagatcagtatttagcactctgtttactcatgctcgctaacgacgacggtaccggatttgggaaaggaaaaggaaccggttcgattggtgttgttattgaacaacagcaggagaaaaagttgttgaagccggtctttattaaagagaaaacagagcaattattcaagtgtagcgagtgtcctaaagtttttacttcttatcaagcacttggtgggcataaagcaagtcaccgtaaaattaacgttcctgccaccggaaacgatgataacaatccgtcgacgtctacttccacaagcggtaatatctctgctctgaatccgagtggccgttctcacgtgtgctctgtttgtcaaaaggcttttccaactggacaggctttgggtggacacaagcgccgccactacgaaggtaaactcggtggtaacaatcgttatataagcggagaaggccttcagagtggaagcgttgtgactacatcagacggcggcggcgcgtcgactccgattgcgcgtgactttgacctaaacatgcctgcctcgccgggatgccaattggatctgaccattgactgtggaggtagaagtcaacatccgattgaacaagaagtagaaagtcctatgcctgctaagaagccgcgtttatttttcgattgaaaattcttaatagtgattgaattctgtttaagtcaaattagttaattggttttacatgtgatattattttactatatactttttaggaaaaagtaccttttatcattatgtatagagacaaacattaggttattcattttctactagtttctgttg

SEQ ID NO: 14332 - DNA, 1104 bp, Solanum tuberosum
  Predicted polypeptide sequence is orthologous to G351, G545
ctcttccctctctgtttctctttataaacttttatttctaataataattctcgatgccgattgaagctttgaagtcacccacggcggcgctaccaccgcttgaagagattgatgattcgcataatttggattcatgggcaaaaggaaaacgatcgaaacgaccacgtattgataatccaccaactcgagatcagtatttagcactctgtttactcatgctcgctaacgatgacggtaccggatttggaaaaggaaaaggaaaaggaaccggttcgattgatgttgttattgaacaacagcaggagaaaaagttgaagccggtttttattaaagagaaaacagagcaattattcaagtgtagcgagtgtcctaaagtttttacttcttatcaagcacttggtgggcataaagcaagtcaccgtaaaattaacgttactgccaccggagacgatgataacaatccgtcgacgtctacttccacaagcggcggcgttaatatctctgctctgaatccaagtggccgttctcacgtgtgctctatttgtcaaaaggcttttccaactggacaggctttgggtggacacaagcgccgccactacgaaggtaaactcggtggtaacaatcgttatataagcggcggcggttgcggagaaggcgttcatagtggaagcgttgttactacatcagacggcggaagcggcaacggcggcgccgcgtcgactccgattgcgcgtgactttgacctaaacatgcctgccttaccgggatggcaattggatctgaccattgactgtggaggtagaagtcaatttccgattgaacaagaagtggaaagtcctatgcctgctaagaagccgcgtttatttttcgattgaaaattcttaatagtaatttgatgattgaattctgtttaagtcaaattagttaattggttttacatgtgatattattttactatatactttttaagaaaaagtaaaacatttataagtactagagtaccttttatcattatgtatagagacaaaaagtaggttattcattttctactagtttctgctgttcaatataatattcttttttatttaaaaaaaaaaaaaaaaa

SEQ ID NO: 14333 - DNA, 850 bp, Solanum tuberosum
  Predicted polypeptide sequence is orthologous to G351, G545
ttttttttttttttttttttttatattgcacccttctgtgtatactgccattgataatgtatccttgcaatggcaggacagttttctatacatgtattcaattattgagtttcttaaggaaaaaaaaggaacattttaatataacccttttccaaatgcttccgaggatttcaagtgcatcgcccctttactgcaccagtcgcctcagaagcaaaatgcagcacaatgttttcgagtgttgacaagtatgtcctccaaatatgtcagtgcgcggaagtacttttctataatgcaatgttaccaccatcatagtttacatgctgcttaaatttagttcatcctcataagatggttgtttgcggtaagtgttttggatcttatcaagctttaggaggacacaaagctagtcatcgtagtaacagagataaagtctacgaacaatctgtagtcatcacgtcaggtaatgcggttagtggaaggactcatgagtgttccatttgtcacaagacttttccaactggacaagctttgggtggccataagaggcgtcactatgaggggaaagtgacatcatcgtcatcgtcgttgaacggtgtggggtccgtcaacaactttgacttgaacattccggcattgccggaatattggtcgggttttcactccggtgaagatgaggtggaaagtcctcatccagctaagaaattaagacaattattttgagaagttcaattatagttgttacatgtctatttgaggtgggaggacaaaatattagcacaattatttttttggtaaatatagaatacaatctggagaaagtgattattgaatattactcgattcttttatt

SEQ ID NO: 14334 - DNA, 1024 bp, Solanum tuberosum
  misc_feature (725)..(725): n is a, c, g, or t
  Predicted polypeptide sequence is orthologous to G351, G545
ctcaagttttataattataatattcttaacactctctctaaacagacgaataattcaatcaattgagatggcacttgaagctttgaattctccaactggtacttcaagtccgcagacgtttcaatttgagagcaaaggccagcagcagcttcgataccttgagaattggactaaagggaagagatctaagaggtcacggagtatggatcgccagccgactgaagaggaatatttggcgctttgtttgattatgcttgcgcgtagtgatggctctgctaatcaggtacgatctctaccaccgccggtgccagtgatgaaaatccacgcgccgtcggaggagaagatgttgtataagtgttcggtttgtggtaagggatttggatcttatcaagctttaggaggacataaagctagtcaccggaaactcatcgccggcatcagcggcggcggagatgatcagtcaactacctctactactactaacgctaccggaactactagctccggtaacggtagtggaaggactcacgagtgttcgatttgccacaagtgttttcctactggacaagctttgggaggacacaaacggtgtcactaccacggcggtaaccgttaacggaaacgctaaacagtagccgttagcgctagcgtcggagttacgttcgtcggaaggggcgtggggtcaacaatcagccaccgtgaattttgactttgaacatcccggncgtttgcccgaatttctgggcctggaatttgggttcccggcgagggatgaggttaaagaaggtccacatcccggacgaaagaaaattcttccgggttattctcctacattccccaaaaattttggaatttttttctccaaccatttaattgttgactttagattgctaggaatttacgaattgttgtagcacacatttctatgttaatctttcctttcacattgtgggggtgggaggtaaaattttcattcaatcttattttgtttttgggcccatccggtgttagttgaaaatcactg

SEQ ID NO: 14335 - DNA, 732 bp, Solanum tuberosum
  Predicted polypeptide sequence is orthologous to G355
gcttctaacttcaaatctttctttcaaacttctaaattttataatacaatttgtataaatcttcaataatatgacatctatgaaaagaagcagagaagacaatatgcaaattgaagtagaggccatggctaattgtgccttaatggcgctgttgtctcgtttcaaaaacacttcttcatcatcagatcatcatgaaattaatgattttgaatgcaagacttgtaataaacggtttccgtctttccaagctttaggcggtcaccgtgcaagtcataataaacggtcgagattactcggagattttcttgttcaaaccaacaaaaagaacaagatgcataaatgttctatttgtggtgtggagttctctttgggtcaagcattaggcggtcacatgaggcgtcatcgtgatgaaattaataaaattacagatgaaaagacgatgattccgattttgaagaagtcaaatagcagcaagaggatattttgtttggatttaaacttaacccctcgtgatgataatgttgatttcaagttatggccaacaacaccaattgcatctcctgttttgcgatgccttttttaatccctttccttttagattaggaaatttgctaccaatttgttgattcttttatgatacttactcagatatctatatcaagattaattgctacgatgatttctcttttatgatacttactcagatatctatgtcaagattaattactaaaa

SEQ ID NO: 14336 - DNA, 668 bp, Solanum tuberosum
  Predicted polypeptide sequence is orthologous to G355
caaacttctaaatttgataatacaatttgtaaaaatcttcaataatatgacatctatgaaaagaagcagagaagacaatatgcaagttgaagtagaggccatggctaattgcgccttaatgcttttgtctcgtttcaacaacacttcttcatcatcagatcatcatcacattaatgattttgaatgcaagacttgcaataaacgtttcccgtctttccaagctttaggcggtcatcgtgcaagccataataaaaagccaagattactcggagagttccttgttcaaaccaacaaaaagaataagatgcataaatgctctatttgtggtgtggagttttctttgggtcaagccttaggagggcacatgaggcgtcatcgcgatgaaattaataaaacgtcgaggatgataccagtgttgacgaagtcgaatagcagcaagaggatattttgtctggacttaaacttaacccctcgtaatgataatgttgatttcaagttatggccgaccgcaccaattgcatctcctgttttgagaatctttatttaatttgttcattttagacattttgcattcattttgttgtatataatccttaattagttcgttcattcttttacttcagtaacgtaataaagtttgattcaattaaaaaacaaaaaaaaaaaaa

SEQ ID NO: 14337 - DNA, 972 bp, Solanum tuberosum
  Predicted polypeptide sequence is orthologous to G361, G362, G370, G1995, G2826, G2838
ctatctcatattttatgtataatttccctctccataaaacacacacacacacacactaaaacatacatatattcatacaaaaacacatacacacacaaaaaaactctagttatatatatacatacatatatacaatatggcggaattggagtttcaaagtaagcataataataatcgtacaagcaacggacgtttaaaattattcggtttcaacgtaacggaggatcaagaacaagaggttgaatcgacaaaaacgtcatcaggatcgccggaatctggcagttttccgacctcggacggccggaaatacgagtgtcaatattgttgtagagaatttgcaaattcacaagctttaggtggacatcaaaatgctcataaaaaagaaaggcaacaattgaaacgtgcccaaattcaagctagtagaaatgcatatatgaggaaccctattatatccgctttcgcgccaccatcacacctcctcgctccctcgggaagtgtgatggtgcccacgacctctccgtcgtgggtttacgttccccgccccgcgccaccttttcacgtgtctcatggttgtgtgttcccgaattctacgggggcgcggggtgtagggaacttacaatataccggcagtgtagcggaatctagcttaacgagtgttgggcctcaacaagttaaggcccatagtgctagagttgatgggccgtcattgagtagattttcgggtatggatgctgggcccaattttgatgatgcatttgggttggatttgcatctaagcctttgaattaatttttaattctatccaaaaataggattttgtacatctcagattatttatttatttatttactcaaagattatttttttttccttacatcaattttatgatatttatatctttttcttacattttttttcaattttattgtttgcaaatttagagttcaagttatgtgaaatattaaattcgtt

SEQ ID NO: 14338 - DNA, 321 bp, Solanum tuberosum
  Predicted polypeptide sequence is orthologous to G361, G362, G370, G1995, G2826, G2838
agcagtattggtctcctttggttctccattaatttatcgcgaatgcttctcatatgtccacccaaagcttgtccaagtacaaattcttcaccgcaataagagcattcgtgtttcttcgtcttagatttaatcgaatctgaagataagaaagaaggattgtgttactgcaagactggttcacaagtaaattgctcaatataaaagtccttgtttctcaggcaattcagttagctatagagattccttttaatacttgtactgatcctgacttgtcaaatgtcaataatgaaacttcacggataaaaaaaaaaaaaaaaaaaa

SEQ ID NO: 14339 - DNA, 679 bp, Solanum tuberosum
  Predicted polypeptide sequence is orthologous to G361, G2826
atttccacgttcgctccgccatctcacctcctcactccgccgggtactgtggtgtacccggcggggtcaaatccatcgtgggtttatgtaccacgcgctccaccatccttccacgtgtcacatggagggaggggcgtagcgaactttcactataccggcgttataacggagcccaacttaacaagtgttgggcctcaacatgttaaggcccatggtggtagagttgatggaaataatgggccatcattgagtggtttctctagaccggattttgggcccaattatgatgacccgtttggattggatctacatctaagccttgcaccagccgggtcatagaaatatcgtttactagccactcgttttttctaccttatagttatcgtcataaaatttcaaatttcaccgttgaaatttcaggatatttcgatagtctttatagtctttgaaaatcggccaagatttcaaatttcacaagtgaattttttgaatttcaattataagaactgaaaagtggctatttgtgaatttatgtcggctcacggcttggcttggatataatctataggagagtagaattataatttatcctaaaaatgggatcttgtacatgatcaaattatttatttagtttttcaatatatcaaagaaaaaaaaattccttacaaaaaaaaaaaaa

SEQ ID NO: 14340 - DNA, 936 bp, Solanum tuberosum
  Predicted polypeptide sequence is orthologous to G363
cgacctgttgttacctaagtatcaaatttgccccgcgttttttccggagcagcatgaagccaccaaatttcaatcttgaatctgaagacgagtccgaagtcagcagcagccaagttgcctccaacaattctgcccaagaaatttctcctgatccttacaaggacagcacgaccaattcgtcctgtctgacaaactctctcaatcttcagcaggagtcgaaaccggttacacttgacttgactcttggcttcaacagcggtgctgatcccgagttgaaggaaaatcccgaggctggcagtgaagtagtgcctcatcctccagctgcacaagtatcgaggatattctcgtgcaacttttgtaggcgcaagttttatagttcacaagctttgggaggacatcaaaatgcacataagagggagaggactctagcaaagagggcgatgcggatgggaatgctatcagagaggtacgctagcttggcatcgctcccccttcacggctccccatatcgatctcttggcatcgaagctcatggctccgtgcatcaacgtgcctcacaacaacaagaaaggcatatgcatgctattagaggcggggcaagatttgaacagggctatttcggggtgccagtatacatggaggatgatgacatggagatgttttggcccgggagcttccgtcaagttgacggggtcggtagcaacgtcgtgcttaattcaggtcagaggtccaacataaattttgtaccaatggctccaccacctaaaacacaaccatcattgcctgaccttaatttgaaactgtgacactcttgccattcacatttctatatctatttcgacatcctccttttccgaaaaaagaaaaacgcgatgttacgttgtgttacatctgcgttgtattgtacagggagattgattgaatgtcttagattga

SEQ ID NO: 14341 - DNA, 956 bp, Solanum tuberosum
  Predicted polypeptide sequence is orthologous to G363
acaacttcccctcttcctcttcaacaaaaatatgtatcctaccacaggacgacgttagtgatgcagatgtagttcattgttattttgatcaccaaattctgtatattagtccctccgttgtaacggattataagcgaattaagatggaagcatcatctggaaatgattctgatataactagtcaggttgcttctaacattgagttttctcagtttagtcctgagcccgtgtcacttgacttgtctctcgggtttaattctgttaccgatgaatttgccagccaagattcgataggattttcagtatcaagcacctgtgatgaacgcagcaatgaacttgcagcatcacaaacttcaggggaagcagtagttagaagagttttcacttgcaatttctgcaagcgtaaattctatagttcacaggcacttggcggtcaccagaatgctcataaacgtgagagaacattagctaaacgagctatgagaatgggaatcttttcggaaaggtatggtaatttggctgctctgcctttgcacgggtctactgcccggtccttgggaatcaaagcacattcttcaatgcaccaggggtttccacaagcaatgggatcacttgatttcaggacgagcgcgagatttgaatatgtacaccatcagagtccgtctttatacattgaggatatcgatgaggctgatcacttattatggcctggcagttttcgtcaagtaactaatgttgacatctctcatcatcctactattagttttactggatgttcgaatgtgaattctgtagagtggactccgtctgttgaaaaagacaattcgacaccagatctcacactgaggctctgagcagtagtacttgaatagcgagtcgcttcaatatttggctctcttacgaaaatgtgtgcattttggaatatatatattatatcactaaacggacgataaggg

SEQ ID NO: 14342 - DNA, 1043 bp, Solanum tuberosum
  Predicted polypeptide sequence is orthologous to G363
aacagtttctgtcatgtcacttcttattctctgctacaactttcttgaaattaaaaaaaaggttcttccaaaaagttgaattttgctacaggttcaagaagttttggagttcttctgattatttgtcgaagtgcaataaaactgaaactccgtaggtgaatcaactatcgacgaccatccattgatttaacactccctgttgttttaccaaagtctatatccggacccgacttatctccaagcaacatgaagtctccaaatttcaatcttgaatcagaagacgagtccgaggtcagcaactgccaagtgggttcaaacatatccgtccaagaaattcatcctggtccttcccgtaatcttcagcaggaatcagttcctgttactcttgacttgattcttggcttcaacagcagtgactccgagttgaaagccaacggagaggcgagtgacgaagtagtaccccatcctccaacggcagcattatccagagttttctcgtgcaatttctgcaggcgcaagttttacagctcccaggcgttgggcggacaccagaatgcacataagagcggagaggactttagctaagagagcaatgcggatgggaatgttatcggacaggtacgctagcttagcatcattgccccttcacggggctgcatttcgatctcttgggcgttgaaaggctcatgcttccggaacaacaaaggcatctcggcaacaaggaaaagcctattcatgcagttagaacgggggcgaggaaattgaaaccaaggctattttcgggaatgcccatatatccggggaagcaagaatcaaccggccagaggtcctggcccgggtagccttcccggcaaattaagaagggaattgggcgggtaatgatgggcgtataaatcaagggccaaagtccaacgccttaattttgggacgcgtaagcccccaactagggagaaacccactgtcgcggactcctaaatggcacactgggagacaccctcgggtggccgacaccacacacaacttggggcacaacacacaaaggg

SEQ ID NO: 14343 - DNA, 921 bp, Solanum tuberosum
  Predicted polypeptide sequence is orthologous to G363
caattttattccttgcctctctgatctctagccctttaagagtccatttggtcagtatcttcataaagcctgtctcttcagcaaaattgtgggggagggaagaaaaaaagacttctgcataatttcaacagccagcagaatgagaagtgctgaggatggcagccggggaacttcaatatttgagcaaggtgagtggttgagtttgagattaggaagaaactcaccttcaacatctaaagaatctgagtcacagacaagacctactcctggcaaggttttttcatgtaacttctgcatgaggaagttctacagttcacaggctctgggaggccaccagaatgctcacaagagagaaagaggggcagtgagacagtatcagtcccagaggatgatgacaatgatggctttgcctatcaacaatcccatgttcagatctcttggcatggttcctcacgcacttgtgcatagaacaggtagagatgtaagttcaactgtggcaaggttcagcgaggctagtacaggctttcaaatgacatctcatcccaatccggtagatgaaggatttgaattgaaatggccaggaagttttcgactaaatccacaacaatcagaagaccaggcttcaaatacaaataagattgatctgaatctcaagctgtaattattctactcatctattgcaaatgaaactattttctatcctctcatgtaacagcttcagcttggtgtcatcatcagttacatgaacttgactgtatgatctgcgagacctggtttagagtaaaaagatcctagagaagtaagtggctcttaaatgtcagatttccagttttatcagatgattgatacctaagatgttatattgtactttccaggttcctttttattccctactgaactaaggaacaactttttaaacgt

SEQ ID NO: 14344 - DNA, 898 bp, Solanum tuberosum
  misc_feature (31)..(31): n is a, c, g, or t
  misc_feature (57)..(58): n is a, c, g, or t
  Predicted polypeptide sequence is orthologous to G370, G1995, G2838
tgggttaaatatttattaatagagacaaatnatactgaggttaggatgtgtcttccnncatcaagaaccaattggtctacatcctgaagggaaaggagtggaattatattggtattttctcttccttaatccactctttggagaatacacaggagagagctttttcaacacggctctgtatttttctctccatttgttggttggcttcaattctaattcaagaaaactgtatcttccctatggtctgttaaattgacctcctccaggtaggataggtcttcagcagggcaatattccttggagagaaggtttgccacctgatattgcttctaccgcctaagaatgtcctggtttcctggtgccccgaaaaatctaaaaaaaagagaagaacaaattgcaaaaccgaaagaatggaagcactgtgttattttggtggctttgttacctgtgtgcagaaaaaagactgatgaggctaaatgttccttcacatgcaaatgtcctgctggtactgttacttctttgaatcgtcccattcccattaaaaaaaaggcaggttaattgaagcttaaatctgtcaaaaggaatgacagatgtcccaaatttactagaatttgaggggaaatgctttcctaacaatcactgatgcaccagccagcgaacaagctttgatatcagaaatcgtcttgattcttcatcggtattgcagtctcataatgcaatccaaaattttccggccccatggacttctttcaatatattgacctgcaaagcagttaaagtttgcccaaccgaacaaattttggaaaactttttcctttgtccaatttggcaaaaatattacctggaggaagtgcttcattagttacagcttcaagtcaatcctgctgcacaagatttg

SEQ ID NO: 14345 - DNA, 959 bp, Solanum tuberosum
  Predicted polypeptide sequence is orthologous to G374
ggcagctttagggtatcttgctgacccatcacagctgggaggacaaagtgatgaggtatccagtgaggggataaatgatgttcctcatcgactgctaaacgaaccacatggatcagttggagcaagagcgggacgtcaggctattgctcagggtaacagtgcagaaatggctgaagctctatttcgatattcagctcctgaagaggtgatggtgtttccatcaacttgtggagcatgcatggtgaagtgtgactgtaaaatgtttgttaccaatattccatactttcaagaagtaatagttatggcatcctcttgtgatgcttgtggttatcgcaactctgagctgaagcctggtggtcctatatctgaaaagggaaagaaaattacacttcatgtggaaaacattaaagatctaagccgtgatgtgattaagtcggatagtgctggagtagaaattcccgagcttgagttggagcttactagtggcactttgggtggaatggtgacgacagttgagggtttaatcacaaagatcagcgaaagtcttgagagaatacatggattcacatttggtgacagtcttgaggaagacaggaagagcaagtggttggatttccgagcaagactagacaagcttttgagcttgaaacaaccgtggacattgatcatcgatgatgcacttgcaaattcttttgttgcacctgcgactgatgatctcagggatgacaaacagttgacatttgaagagtacgttagatcgtgggaccaaaacgaggagttgggtcttaatgacatggacaccacctccgccgatgctgcttacagttcagcagatgctgcacccagcaagagtgctggcgattgataattttgcgtgtgtattcatttatattgctctggctttaaaatttaatgcaccttgattagattttgtgctttttagcttcatagatgtaaaa

SEQ ID NO: 14346 - DNA, 508 bp, Solanum tuberosum
  Predicted polypeptide sequence is orthologous to G377
cttctattagacggcacttgcccttcccttgtcaccgttccaatcgaggttgccaccgccgccgtcaagctcaaagtccccatactcctctacagcgattacctcctctgccgccgccggaaatgcggccaatcagtgaagggatgctcgatctgccttgaatccatggagctagatgaggaggtcagagagctcatcacctgcagccatgtcttccacaggggatgccttgatacttgggtgaacgatggacacgtcacctgccccttgtgcagatctatgttgctaccccctaagttgacctctttccgatctaattctctaaatccatccattactaattctagttagttttcgatgcttattacaaacttttgcataaactataacagatgcaaaattagtgttccaagtgatacagacatttcctgtacagattgccatacttattctaataaaaaatctgcaaaacttattgaaactttttcataaaaaaaaaaaaaaaaaa

SEQ ID NO: 14347 - DNA, 681 bp, Solanum tuberosum
  Predicted polypeptide sequence is orthologous to G384, G385
taagaaattgtactctttatcacatgacatcatgaccaaaaatcaaacattacatcctaataaacaacaaattataattcacatatggaaaacaacacaactaagcaaatataggataagtgacatactaagagagaaattcttcaatgatgcgatgttcgtagttgtcgtatgagtgagcttgcttgggaaccaaaattttacttgtaaaggccctaaccgaagtcttcttacaaactcttttctttgtttatcaccagggtgagtgcattatttataaaaccattctatttcactgagtatggcagtgaacgcacatctcttatatggatgtttattcggattaacttgatcatcaccagaattagggacatcaatgatatcacaaataaaatccatctcatttgccagtgttctatgggccgaggacgatatatcaaacaaataattgtggagcgccaccatctgcttgcgatgaaacctatatatatgacatatgaaactatgtgtgtgtgtttagtgctaaatttactgacaaaaatgattgagtgaatctttaagtaaatacttaaaacataattagactgaagaagtttgtttctatatggtcatccacgagaatcattcaaccatatgtcggaaataaaaggtatgcaatgaatttgattgttaggctttaat

SEQ ID NO: 14348 - DNA, 913 bp, Solanum tuberosum
  Predicted polypeptide sequence is orthologous to G384, G385
gtaagctctcatctctcaactctcaactctcaactctcaactctcgtcactcgtcactcgtcagtcgtctctcagttacgacttacaccgctgctcgtctctcaactctcgtctctcgtctctcgtctctcgtctctcgtccgtcatctctaaagtcttaggccagccgctactccttggctcctcgctgagtgctcgcaggtcgcagcccgccactgctcagtgctcgcgactcgaaggttaatgcttctatatagagaatatcaactaggtgagtttggagagcaaaagcaaaattgtatggcatagattgttggagtttcgagagtattgttaagtgttgattgttatttgttatagaagttgatgttgattgttgtattatttgaacagcaacacagccacaaccacaacccacaggtcactgttaattggtaagttgcaagttaaatgttgttgaaatttgaaggcaaaagacaaactgtatggcatagattgttggagtttggagagttgttgagtgttgattgttatagaagtttgttgattgttgtattatttgaacctcaacctgcaacacagccacaacccacatgacactattaattaaatttggttaaaccgaaaaccaaaccgaaattgtaataaccgaaccgaactgaatttatttcagtttggtttggtttcatatttttgccaaccgataaccgaaaaaccaaaccgaaatttacaaaccgaaccgaccgaacgcccagccctacataagccacaaccgtggaccgtgcttagtcaccgtctgcatgttaagggcacaaagttctgtcctgatccccctttaatgctggatgacatgttatctgcagacgagaatgatctgattgagtaccctattttctcacgttatctttatctt

SEQ ID NO: 14349 - DNA, 783 bp, Solanum tuberosum
  Predicted polypeptide sequence is orthologous to G384, G385
ataaaggttcctagccttaagtgcatagaaaagccacctggaaatgtggaacttaatgagattggtatatgcttagacccagaagcgaaatatacggttccctgtccacgaactgggtcatgccatgaattgggacctaggataaagttccgatgataaataaactcttcatttcatttcctattttgttgtgataagtaaattaaatgcaaactcttcaggcgagaagccaaatgttactctagcaggtcacactgtttaatattaggagtaaatttcttgtcaacgcttgaatagcattactcaactaaatgagattttaatatgtttacatctaaaaaaaaaaaaaaaaaagcaacttcattttggatgccagttccaactaagagagtctttgactttcttagggatgaaaattctagaaatgagtgggatattctttcaaatggtggcctagttcaagaaatggcacatattgcaaatggtcgtgattctggtaacagtgtctcactactgcgcgttaatagtggaaattcaagccagaataatatgttgatactccaagagagctgtctagacaccacaggatcctatgttatctacgctccagttgatattgctgcgatgaatgtggtgtcaagtggtggtgatcccgactatgtggctcttttgccttcgggttttgcaatactccccgatggctctagtaatgcttaagaatagtaatgctgctggtggctcggtattgaccggttgcatttcagatactagttgatcctgtcc

SEQ ID NO: 14350 - DNA, 588 bp, Solanum tuberosum
  Predicted polypeptide sequence is orthologous to G386, G707
gtttcaaaacgatagcttctaaagaatacaatgttgttacaaagagttaccaaaataaatgagacaaatttaggatacaacacaactaaacaactcctctcaaactttcaaattatttttccctctcaaacttaaaattaacatacccttacactttcatgtttcaaatcaccccatatgcataagcgaacattcagggtcttcctaattcctaagtcaatggcccgaaccaccactcttgcattgtattaagaatctgagttatcaattcaggcccttaacacttacaagagttcttctttttttatttttgtggttcgttcttgactcagctccctatagtccaattattttgaaaaagggcaaaaaaggaaataaataatttaactttcacaatgtagggctcctttgattttttggagagtgcatgagatgagattattgactgtctcaacagattccactgttagcttagctgtaggtaagctattcaccaatatttgaaaagctacagttaagagggacccacttactctcatatctgggcctgggccaggcccattattaagacttttcaccaaattaggc

SEQ ID NO: 14351 - DNA, 757 bp, Solanum tuberosum
  Predicted polypeptide sequence is orthologous to G388
gagcaaaactggccaagaggatattaggatgacctctaggaggaacttaactgatcctggtgaaccccaaggccttattctctgtgctgtttcttccatttggttgcctgtctctcgcaacgtcctatttgatttcttgaaagatgaaaaccatcgccatgagtgggatgtcatgtcaagtggaggtccagtgcaatccgttgcaaatttagcaaaaggtcaagacaaaggaaatgcagtctcaatccaagcagtgaaattaagagaaaacaacatgtggatcctccaagatacttgcaccaatgcttatgaatccgcagtggtctatgccccagtggacattgcaggcatgcaatctgttatgacaggttgtgactcgagcaatattgctgtgttaccttcgggattctcaatccttcctgatggcctagagtcgaggccttttgttatcacttctagaccagaggacagaagttcagaaggaggatccttgctaacagttgcttttcagattctaactagcaattctccaacaacaaaactttcaaaggagtctgttgaatccatcaacaaccttttgtcgtgtacattgcacaagatcaagacaagattccaatgtgacaatggatattagttcttctaggtagagagatgctaatttcattatacagatgatatagttctcctccatccttttcatctgaatagactgatgaaaaggattcagggacaatgcgttcttaccccgttattgtaa

SEQ ID NO: 14352 - DNA, 790 bp, Solanum tuberosum
  Predicted polypeptide sequence is orthologous to G390, G391, G438
ctggagcctaaatcagattctcctagtgctgctcggactttggatttagcttcaactcttgaagctagaactggtgggacacggccagctggtgaagttgaaggacgcagttacaaccatcgttcagtcttgacaattgcattccagtttgcttttgagaatcactatcgagaaaatgtagctgctatggctcgccaatatgtacgaagcattgtaggctctgttcagagagttgctatggctattgcaccctctcgactctgctctcagctgacacctaaatccttccctggctcaccagaagctgtcactttggcgagatggatttgcaggagctataagaatcatactggtggagaattgctacaggtggagtctcaagctgccggtgatgctgttctgaagcaactatggcatcacactgattcaataatgtgctgctccgtcaaaatgaatgattctgcagttttttcattttcaaaccaagccggacttgacatgcttgaaaccactctaatagctcttcaggatataatgctcgataagatcctagatgaagctggtcgaaaggtcctcctttcagagtttcccaagattatgcagcagggctttgcctatctgccggcagggctatgtgtatcgagcatggggaggccggtgtcgtatgagcaagctgttgcatggaaggtccttaatgatgacaactccagtcactgcctagctttcatgttcacaaactggtcttttatttaagttcaaaacatatgatctgtgtaaagcaggatgtgtg

SEQ ID NO: 14353 - DNA, 359 bp, Solanum tuberosum
  Predicted polypeptide sequence is orthologous to G390, G391, G438
ctggtccggattcagttgggatttttgccatctcacacaattgcagtggagtggcagcccgagcatgtggtcttgttagtttagagccaacaaagattgctgagatcctcaaagatcgaccttcttggttccgggactgccggaatgttgaagttatcactatctttcctgctggaaatggtggtacagttgagcttttgtatacacaggtgaataccttcacttcaatctttattatgttgtacttctgatttgattggctaccgcattgaggggatcaatgaatcatttctttcagatatatgctcctaccactctggctcccgcacgtgatttatggacactgagatacacaacaa

SEQ ID NO: 14354 - DNA, 966 bp, Solanum tuberosum
  misc_feature (517)..(518): n is a, c, g, or t
  misc_feature (529)..(530): n is a, c, g, or t
  misc_feature (569)..(569): n is a, c, g, or t
  misc_feature (576)..(577): n is a, c, g, or t
  misc_feature (615)..(616): n is a, c, g, or t
  misc_feature (669)..(669): n is a, c, g, or t
  Predicted polypeptide sequence is orthologous to G390, G391, G438
gaaagagtcatcaaggcttcaggggtgtgaataggaagctgtcagcaatgaacaagctattaatggaagagaatgatagattgcagaagcaagtttctcaactggtgtatgaaaatggctactttcgcaagcaaactcaaactacaaagcttgcttcaaaagacaccagttgtgaatcagtggtaacgagtggtcaacaccacttgacacctcagcatcctccaagagatgctagtcctgcaggacttttgtccattgcagaagagactttaacagagtttctttcaaaggctactggaactgctgttgagtgggtccaaaatggccttgggaaatggaaagccttgggttcccggattcccattgggaatccattggttaattccttcaattggtttgcacctgggcattggcaagcaagaagccttgttggccttggtttggtttaaattccaaccgaagggttgctgagaatcctttaagggaattcgcccttcctgggtattcgtgaactgcnncgggctgttgnnaagttctaaatatgctgcccacttgccaatggtggaacncattcgnnaacttctttacatttgcaggctttatggctccccaacnnaactttgggcggcctcccctcgtgaacttctggggcttgttacgctatactanctgttaccggatgatggtagctttgtggtttgtcgaaaggtcattgggaaatactcaaaatggtccaaagtatgccgcaagttcagaattttgtggaaagcggaaatgcttgcctagcgggaatacctgatttaaggccttggtgaagggaaaggccggctctatttgtcccatattgttagatccatattgaattttacaaggcatgtacacgtgtgccagaaaagtgttgcggtccaactggtattgagttcactctggcagttgcttgctccagaaagaacaaccaattgggca

SEQ ID NO: 14355 - DNA, 823 bp, Solanum tuberosum
  Predicted polypeptide sequence is orthologous to G390, G391, G438
acagaatgtgcctcctgctatacttctcagggttccttcgtgaacatcgatctgaatgggcagacaacaatatagatgcttatgctgctgcagccattaaagttggtccttgcagcttacctggggctcgagttggtaacttcgggggtcaagtgatacttccactcgctcacactgttgagcatgaagagttgctggaggtcattaagttggaaggtcattctcctgaggatgcgataatgccacgagatatgtttctattgcaactatgcagtggaatggatgaaaatgctgttggaacttgcgccgaactcgtgtttgctcctattgatgcctcgtttgctgatgatgcaccattgcttccgtctgggtttcgcattatttcacttgagtctggaaaggaagcgtccagtccaaatcgtacccttgatcttacttctgctcttgagactggcccagcggaaaacaaagcggccaatgaccttcacactagtggtggctcatcaagatctgtcatgacaattgcttttcaatttgcttttgaaagccacatgcaagagagtgttgcttcaatggctcgacagtatgtccgaagcatcatttcatctgttcaaagagttgccttagcactttcaccatctcacttgggttctcatggaggtcttcgtttgccattggggactcctgaaagcacatacattagctcgttggatctgccaaaggttacaggtgcttttgggcgtggagcttctgaaatcaaatactgaatcaacgaaagtgaatcaatcctcaaaagcctatggcatcactcagatgctattat

SEQ ID NO: 14356 - DNA, 907 bp, Solanum tuberosum
  Predicted polypeptide sequence is orthologous to G394
agaaatcaaccttccaggctctctttatagatttcaacaaaacaaaactcagaattgctactaaatatatacgatttctcactgatcatggatagtacttgtgatgatatatatagcagtgctggtcttgatttaggattaggcttttcatcaataggggaatcaaacatcaaaaaaacatggacaagtagctgcagttaaattcgatctcggttttgaaccctctctgaatttaagcctttcttccggtgatcatcagatggtagatctgaagacggaaaataaggatcaattatctgctgcttcgtcgtattcaaatggcagtgtgaaaagggaaagagatattggtagtgaggtgacagaagtagaaagagtgatttcttgtagagtaagtcatgatgaagattattatgaagatgatgatgcttcaaatggaaagaagaaacttaggctcaccaaagtacaatctgctctgttagaggaaagcttcaagaaacagagcactcttaatcctaagcaaaaacagcacttagcaaggaagcttaacgtaaggcctcgtcaagttgaagtttggttccagaatagaagagcaagaacgaagttgaagcaaacagaggtggattgcgagtttttaaagaaatgttgtgagacactaacagatgaaaacaggaagctttacaaagaattgcaagaactgaaagctttaaaagttgggcagccgttgtacatgaagctgccggctgcagccaccctcactgtgtgtccttcctgcgaaagagccggcgccgcccaaaactcaaccaagcctcatcaccgctacggctcctttaccaatccctccgcagcttgttaattaattagtattcaaattgtcttgttgattaattaaattcttaggaaatctccc

SEQ ID NO: 14357 - DNA, 980 bp, Solanum tuberosum
  Predicted polypeptide sequence is orthologous to G394
gttttcttttattccaacacatagatgggttttgatgatatttgcaatactggcctagttttaggattaggcttttcctcaacagccgatcacaaatcaaagaaaataacaacaccactagtaggcaaaggtccgtctcttggccttgaaccttcactaactttaagcctgatttccggtgatcgtacgtacgaacaacagccgattaaaattaacaaagatcatcaatctgctgatttgtacagacaagatagtgctgcctcttcctactcaaatgctagtgtcaaaagggagagagatgttggtagtgaagagacaaccacagaagtagaaagagtttcctccagagttattagtgatgaagatgatgatggctctaacgctaggaagaaacttaggctcactaaagcacaatctgcacttttggaagaaagcttcaagatacacagcactctcaatcctaaacaaaaacaggatttagccagagaactcaatttaaggcctcgtcaagttgaagtttggttccagaacagaagagccagaacaaaactgaagcaaacagaggtagactgtgaattcctgaaaaaatgctgcgagacactgacagaagaaaacaggagacttcacaaggaattgcaggaactaaaggctctaaaaatagcacaacctttgtacatgcagttgccggcggcaaccttaaccatgtgtccttcatgcgaaaggatcggcggcggtgtcggagaaaatccgtcgaaaaatgcttttaccattgctcaaaagcctcacttctacagtccattcaacaatccgtcggcagcttgttaattaaaggccatatatattagtaatataaatcttgtttagaaaaaatctcggaaagccgccactttttttggttagggcttgtatgactagtgcagttgtatgtgtagagtaaatagaattaaggtcactaatcaatattttttaatttgttttct

SEQ ID NO: 14358 - DNA, 1003 bp, Solanum tuberosum
  Predicted polypeptide sequence is orthologous to G409
acaaaacaacgtatatacagacaaaatcacataatacgccctcgccggaatcttattttcactgtcaccggccgttataactttttttttccagttcggaggtcaaataattaaactccgatctgaagaagtagttattctaactgcttctatttaatctgaaaacgggaaaaacccctgagctgggtaaggtggatttcgtgatgggattttgtatttgtcctttggaaactcctgctagattactgtggagtactagtttcttccgccacaagcttatgctcttctaaaactttgtcaactctctttttcatacacatcccctgctaaaaaaagaactctgttctggagtttattttctcttttctgtttcgccggaaacatataaataatcttctgtgggtaaataggcgatcttccagatcattgaaaatatgggatctgggcatatatttttcgacccgtcgtcgtgtcacggcaacatgctgttccttggcaacggagatcctgttttccgaggaccaagatcgacgatgatgaagatggaggactcctcgaagaggcgacccttctttagctcaccggaggatctatatgacgaggattactacgatgagcagtcaccggagaagaagcgccgtctcactcctgagcaggtgcacttgttggagaagagctttgagacagagaacaagctggagcccgaacgcaagacccagctggccaaaaagctggggctgcagcccaggcaggtggctgtatggttccaaaaccgccgtgccaggtggaagaccaagcagctcgagagggattatgatcagctcaaatcctcttatgactctcttctctctgattttgactccattcgcaaagataacgataagctcaaatctgaaggtgtttcattaatgggaaagttgcaggggaaagtggttggaggagcaggggtaagtgaaaaatctgatgtcctggaggtagatgctatgacagcgacccttcaagt

SEQ ID NO: 14359 - DNA, 835 bp, Solanum tuberosum
  Predicted polypeptide sequence is orthologous to G409
aggaagaaactctttttctctttcacttatttcctctttcatctagttatacatacttattttcttcactcaaatggcactgacccttcttcattgttcctttacttatgacataaccttttttcaaatttcaagattcaatcaagaaaccccatttctcactgcttaaacaaaccccatatagtttttttcacaattcttgcaccctagaaaacttcagggttgaaagtaaaaaagatatggaagttggaagggttattaatgaaagttctaatactgttttggttccaagtgaaaaactttctcattgtctctggatgtccaattcttccccctcttttcatggttctgcatcaatggttaatttcgaagatgttggtcgaggagaagtcactaaagagaggccatttttcccagcaattgacaaagaagaaactagcaatgatgattatgatagttgttatcatcagccagaaaagaagagaagacttttgcctaatcaagtgcaatttcttgagaagagttttgaggtagacaacaagcttgaaccagagaggaaagttcaattggctaatgaacttggcttgcagcctaggcaaattgctatttggtttcaaaataggcgtgctcgatacaagactaaagtacttgagaaggactatgatgttttgaaagctagctttgataaacttaaagttgattatgacacccttttcaaagagaatgaggatttgagaaaatgaggtccttttggtttacacaaaaattgcttaggagggacgaaacgggcaaggaaaactcagaaccaagttgcaacccaatatagtcccaatta

SEQ ID NO: 14360 - DNA, 908 bp, Solanum tuberosum
  Predicted polypeptide sequence is orthologous to G409
ctcatttatagtactcatcacaactttcttagtaacaattcaatagtccaatttttcacttcttgattctcctctaaactcctaataccaaaaaaaattagaaaatagtatggaggtagcaagagtttatgaaggttctaacaattgcttcatacttccaaatgaaattcttcctcctacttctaattgggtatctaactcttcctccattttccatggctctgtatccatggtaaatttcgaccaagatcgagtaccaaagtctaaaatgaggtcatttttagcacaacttgatcaagacgataatagcaacaacgatgacaattacaattatcaccaaagtgaaaagaagagacgattgttaccgaaacaagttgagtatcttgagaaaagtttcgaggtagaaaacaagcttgaacctgaaaggaaagtacaattagctaaagaaactggattgcagcctaggcaagttgctatttggtttcaaaatcgacgtgcccggtgcaagactaaacaacttgagaagaattatgatgtccttaaagctagctttgataaactaaagactcaatatgattgtctcttcaaagagaatgagagcttgagaaatgaggtacatttactcaaagataggttgatcaacagagtaaaagggaaggaaacttcagaacctattaatccacttgatcatgtagaacctcaaaatccttctattggagttgcttcaactttagcaatggtggcgtgcaagcaagaagatacaaaaaagtgatggtcttgattcagacagccgcgttttactgaacggtgattacacttcttttttggaagcctgctgattcttcgaatgttctttccagacagaacactctgatatctctcagaaaatgacctttatgtttccaaaa

SEQ ID NO: 14361 - DNA, 1102 bp, Solanum tuberosum
  misc_feature (806)..(806): n is a, c, g, or t
  Predicted polypeptide sequence is orthologous to G416
taacattcaagtacatactatgttagataagatatccatttaatttacaataagcacccaaaaggcacttgaggatgagtctcttgtccaaatgaaaggtaggtatgagtataaaactgatataattaacaagaaatccaattccagtcaaaatggaatccagttcttcctttttttcttcttttcttttttgcttaaaaaacatcatggcttacctaagaaattgcaagatgtacttgcacgtccaagctaaaattggattccagctctcttttcctttatcccatatttttttggtcatgcgttctttcacataactccaatgcttcatgtaaaggagtattgatgtcttcgacttccagcatctggtcactgcacatttcttcatgtgctctcagttgtttcccgcaaagaagtaaaattgacccttattgagaggcttctgaggaaccacaattgcagcagatgcaatgctgaaggacggttcctggctcaatcggctcaaggtccttccaagccttcgcttggcaggactttatggctagaacaacaaattctatcctttcctctgatgttggtggccccaaacaatttctctgattgtaggggggctctggcctggcagctcaataagccccatcaaaaattgtaatttccaatttggtcaacttccatggtcaatacccaaagatcttcaaccaccatggcggtccaactttggttggcccaacaggtccagttcctggcagaagtgggctttgacttggtgaataggccctcctgtaacagttggcaccaagaatgcnaggagccggggccacaggccaatgtgcctttggaagagaaaactttcaagtgggttattcaccagagggttattatccgaggtatcaccaattatcggtttccaaagcggttccaactctctattttccaccttggtgagctggatcactggccttgggctaaacctggtaataacttcggccaggtttccccttctggtaaaaaccgctttggagatttgtttacccaaccagcgattttaccgaaggttcatttttgcagcgtagagagagtatcttccgaaaaaattggaaac

SEQ ID NO: 14362 - DNA, 699 bp, Solanum tuberosum
  Predicted polypeptide sequence is orthologous to G418, G965
gaaatatagcactcaacttactagatttccataaattacccgcaacaagtcttttttttttacacataatctacgtatcaaatcactaaaatacgattacaaattccccatttatacaattgatatcccaatactattataaagtaaattcatacattataacattactttccatttcttaattatttctactctttaaacttaaaattgttgatgaaagtagtaataatactaattaataagctccaaagtctcttaattggaattgggctggcttccttggtacattttccgagtgccttagtcccaatgtgagtgacacatccccagcttgctgagatccaaatgcggccgtattggccgcatttgaattagccaccaaatcaaccgcgtccaccgcagtgaagtaatgatgattagaggtggacgcggttgtggtgtcgtctgattggagcattacaagttggtttcccaaggcgtactgcctataattgatgatgttttttgaagggtctctttcgttagcattaaattcagatcttactgatgatattggcattgttgttgctgatgacgtggccatgttggtattcttgtcgtgcattgggatttgtgcttggttttcttgttgctgttgctggtgctcttgatcttcctcttgatctggttcttcttccttgggttcttggtgaacatctc

SEQ ID NO: 14363 - DNA, 1939 bp, Solanum tuberosum
  Predicted polypeptide sequence is orthologous to G418, G965
acgagcgtttatgagacagccgggttgttgtctgaaatgttcaattttcagacaacatccacggctgcaactgaattgttgcagaatcaattgtcaaataactatagacacccgaatcaacagccacatcatcaacctccgaccagggagtggtttggtaacagacaagagatcgtagttggtggaagtttgcaggtaacatttggggatacaaaagatgatgtgaatgcgaaggtattattgagtaaccgtgatagtgtaactgattattatcagcgtcaacacaatcaagtaccaagtataaataccgcggagtccatgcaactttttcttatgaatccacaaccaagttcaccatcacaatctactccttcaactcttcatcaagggttttctagcccggtcggagggcattttagtcaattcatgtgtggaggagcaagtacttcttcaaatccaattggaggagtaaatgtgattgatcaagggcaaggtctttcattgtccttgtcatctactttacaacatttggaagcatccaaagtggaagatttgaggatgaatagtggaggagaaatgttgtttttcaatcaagaaagtcaaaatcatcataatattggttttgggtcatcactaggactagtcaatgtgttgaggaattcaaagtatgtcaaagcaacacaagagttgttggaagagttttgttgtgttgggaagggtcaattgttcaagaaaatcaacaaagtttctaggaataacaacacaagtacatcacccattattaaccctagtggaagtaataacaataattcatcttcttcaaaggctattatccctcctaatttgtcaactgcagagagacttgatcatcaaagaaggaaggtcaaacttttatccatgcttgatgaggtagagaaaagatacaaccactattgtgaacaaatgcagatggtagtaaactcattcgatctagtgatgggttttggagctgcagttccttacacagcactagcacagaaagccatgtctaggcatttcaagtgtttaaaagatggcgtggcggcgcaattgaagaagacatgtgaggcactaggtgaaaaagatgcaagcagtagttcaggactgactaaaggagaaacaccaaggcttaaggtgcttgaacaaagcttgaggcaacaaagagcttttcaacaaatgggaatgatggaacaagaagcttggaggccacaaagaggattgcctgaacgatctgtcaatattttaagagcttggcttttcgaacattttctacatccgtatccaagtgatgcagataagcatcttttggcacgacagactggtctctccagaaaccaggtagcaaactggttcataaatgcgagggtgagattgtggaaacccatggtagaagaaatgtatcaaagagaggttaatgaagatgatgttgatgacatgcaagaaaaccaaaacagtacaaatacacaaataccaacgcctaatattattattacaaccaattctaacattacagaaacaaaatcagctgccactgccacaattgcttcagacaaaaaaccccaaatcaatgtctctgaaattgacccttcaattgtcgcaatgaatacacattattcttcctctatgccaactcaattaaccaatttccccactattcaagatgagtccgaccacatcttatatcgccgcagtggagcggaatatgggaccacaaatatggctagtaattctgaaattggatccaacatgataacatttgggaccactacggctagtgatgtttcacttaccttaggactgcgccatgcgggtaatttacctgagaatactcatttttccggttaattaagatagtgtattcaaacactgctacataaattatgattttatatatatatatattgtcatccgattagtttat

SEQ ID NO: 14364 - DNA, 1840 bp, Solanum tuberosum
  Predicted polypeptide sequence is orthologous to G418, G965
aattcggcacgagggagtccatgcaactttttctaatgaatccacaaccaaggtcaccttctccatctcctcctaattcaacttcttctacgcttcacatgttgttaccaaacccatcatctacttcaacacttcaagggtttcctaatccggccgaaggatctttcggtcaattcattacatgggggaatggaggagcaagtgctgccacagccacccatcatctcaatgcccagaatgaaatcggaggagtaaacgttgtagaaagtcaaggcctatctctatccttgtcttcttcgttacagcacaaggcggaggaattacaaatgagcggagaagctggaggaatgatgttcttcaatcaaggagggtctagtacttccgggcagtatcgatacaagaatttgaatatgggtggatcaggagtaagcccaaacattcatcaagtccatgttgggtatgggtcatcattaggagtggtcaatgtgttgaggaattccaaatacgcgaaagctgcccaagaactactggaagaattctgcagtgttggaagaggtaaattgaagaagactaacaacaaagcagcagccaataaccctaatacgaaccctagtggcgctaacaatgaagcttcttcaaaagatgttcctactttgtccgctgctgatagaattgagcatcagagaaggaaggtcaaacttttatctatggttgatgaggtagataggaggtacaatcattactgtgaacaaatgcagatggttgtaaattcgtttgatttagtgatgggtttcggcacagcagttccctacacagcacttgcacagaaggcaatgtcaagacatttcaggtgtttaaaggatgcaataggagcacaattgaagcagagttgtgagttattaggagagaaagatgcaggaaattcgggattgactaaaggagaaactccgaggcttaagatgcttgaacaaagtttgaggcaacaaagggcgtttcaccaaatgggaatgatggaacaagaagcttggagaccacaaagaggcttacctgaacgttctgtcaacattttaagagcttggctttttgagcattttctacacccgtatccaagtgatgctgataaacatctgttggcaagacagactggtctctccagaaatcaggtatcaaattggttcattaatgctagggttcggttgtggaaacccatggtagaagatatgtatcaacaagaagccaaagatgaagatggagatggagatgagaagagccaaagccaaaacagtggcaataacataattgcacaaacaccaacgcctaatagcctgactaacacttcatctactaatatgacgacgacaacagcccctacaactacgacagctctagctgctgcagagacaggaacagctgccactcccataactgttacctcaagcaaaagatcccaaatcaatgccacggatagtgacccttcacttgtagcaatcaattccttctctgaaaaccaagctacttttccgaccaacattcatgatcccgacgattgccgtcgcggcaacttatccggtgacgacgggaccaccacacatgatcatatggggtccaccatgataaggtttgggaccactgctggtgacgtgtcactcaccttagggttacgacatgcaggaaatttaccagagaatactcatttctttggttaattaatacgtattttccccatagtaattaattaaaactgaatttgcttgagctcatcataatttatgcattgctttttgttataagaaattccataaattagctttgtgttaaaaaaaaaaaaaaaaaaaaaaaa

SEQ ID NO: 14365 - DNA, 1731 bp, Solanum tuberosum
  Predicted polypeptide sequence is orthologous to G419
gtgatcatggtccttcgtcttctaagaacattattagtgaacaattttaccaacatggtagtcatgaaaatatgttgacaacaacaactactcatcatgatgatcatcaaggctcgtggcatcacgataataacagaacattacttgttgatgatccatctatgagatgtgttttcccttgtgaaggaaatgaaaggccaagtcatggactttcattatctctttgttcctcaaatccatcaagtattggtttacaatcttttgaacttagacatcaagatttgcaacaaggattaatacatgatggatttttgggtaaatctacaaatatacaacaagggtattttcatcatcatcatcaagttagggactcgaaatatttaggtccggctcaagagttgctcagtgagttctgtagtctcggaataaagaagaataatgatcattcttcttcaaaagtacttctaaagcaacatgagagtactgctagtacttcaaaaaagcaacttttacagtctcttgaccttttggaacttcaaaaaagaaagacaaaattgcttcaaatgcttgaagaggtggatagaaggtacaagcattattgtgatcaaatgaaggctgttgtatcatcatttgaagcagtggctggaaatggagcagcaacagtttactcagccttagcatcaagggctatgtcaaggcattttagatgtttaagagatggaattgtggcacaaattaaggccacaaaaatggctatgggagaaaaagacagtactagtactcttattcctggttcaacaagaggtgaaacaccaagactcagacttcttgatcaaactttaaggcaacaaaaggctttccaacagatgaatatgatggagactcatccatggagaccgcaacgtggtctcccagaaagatcagtctccgttctccgcgcttggctctttgaacactttcttcacccgtacccaagtgatgttgataaacacattttagctcgccaaactggtctttcaagaagccaggtgtctaattggttcattaatgcaagggtaaggctatggaagccaatggtggaagaaatgtacttagaagaaacaaaagaagaagaaaatgttggatctccagatggatcaaaagccctaattgatgacatgacaattcatcaatcacacattgatcatcatcaagctgatcaaaagccaaatcttgtaagaattgactctgaatgcatatcttccatcataaatcatcaacctcatgagaaaaatgatcaaaactatggagtaattagaggtggagatcaatcgtttggcgcgattgagctagatttttcaacaaatattgcttatggtactagtggtggtgaccatcatcatcatggagggggtgtttctttaacattgggattacaacaacatggtggaagtggtggatcatcaatggggttaactacattttcatcacaaccatctcataatcaaagttcacttttttatccaagagatgatgatcaagttcaatattcatcacttttggatagtgaaaatcagaatttgccatatagaaaccttgatgggggcacaacttcttcatgatttggctggttaaaaaatgacagagattcttcattttggaccttattatatactctaattttaatatatattggtgatgaatgatgataaaaaaaaaaaaaaaaaaaaaaaaaaaaaaaaaaaaaaaaaa

SEQ ID NO: 14366 - DNA, 936 bp, Solanum tuberosum
  Predicted polypeptide sequence is orthologous to G427
gccctctgttgttattaattctctctcgttgcactttctgaaatcccaatagttcaaggtcttatcatctctactatattattccgggtttaattgattgatgagtttctgataatttatatgtagagtttcagacactttctgataagtaatgaaatacgttgtgaaattgtgtgttttataaaattgttcattgtcacaagaaatggatatgccggatgaaaattcaccaattttgagaactagtttaccggaacagtcatcgtccgacgtcaaaccgctagagcaccagcagccgccgacgtggctcaacagagaaatacttttaccacaaagtcaatatactgttgccggcgctggagagaatttgcagtccaactcaaaccagtggttatcaaggtcgattttacagaggaatataagcgatgttcaggcatccaatgattccgatttgaataaggacgaatttggtgagagtgaagtcgtgaattggcaaaatgcggggtataaagctgaaattctggcacatccattgtttgagcagttgttgtcagcccatgtggcgtgcttacgaatagcaacgcctgtagatcagttgccaaggattgatgcacagctggcacagtcgcagcaagtagcaggtaaatattccggccttggacatgggaatcttgctgatgataaggaacttgatcagtttttgacacattatgtcctgttgctttgttcttttaaagaacaactacaacaacatgttcgtgttcatgcaatggaagcagttatggcttgctgggaaatcgagcagtcgttgcaaagcttaactggagtttctccaggagaaggtacaggtgctacaatgtctgatgatgaagatgaacaggtggatagtgatgccaatttgtttgaggggagtttagatggtcatgatagcatggg

SEQ ID NO: 14367 - DNA, 958 bp, Solanum tuberosum
  Predicted polypeptide sequence is orthologous to G427
gatcagagtgagaaatataaagcggatattttgaaccatcatttatcagaacagcttctttctgcacacgtggcttgcctgagaatcgcgactccggtggaccagttaccgaggatcgacgagcagttgacggagtcacaaaatttggtggcaaagtattatgttgttggtcaaagtcaacggtctcttgatgataaagaacttgatcaatttatggcacattatgttctattgctctcttcttttaaagagcaactgcaacaacatgttcgtgtccatgcaatggaagctgtcatggcttgttgggatcttgatcaatctctacaaaatttaacaggggtagcatcaggagaaggtacaggtgcaaccatgtcagatgatgatgaagataatcaagtagaaagtgagacatattgtcattataatggaattttagatggacaagagagtaatggttttggtcctcttgtacctactgaaaatgaaagatttttaatggaacgtgtgaggcaagaattgaaacaagagttcaaacaggattacaaggggaagattgttgacattagagaagaaattttaagaaaaagaagagcaggaaagctgcctggtgacactacttctgccttaaaagcttggtggaaatcacattctaagtggccttatcccacagaggaagataaagcaaaattagtgaaagatacaggattgcaattaaaacaagtcaataattggttcattaaccaaaggaaaagaaattggcactctactccatcatcatcttctacacagaaaagcaaacgcaaaagtgcaggtgaaaaatcaagaaatgatcactttacatgacaggggagaagtgagcatatcatgtattaagtggaacttgaaagaatacgtttgatacgacgaaagtcattttctgttatgtaaaatactctcgatgttcgattagtgaaacgga

SEQ ID NO: 14368 - DNA, 996 bp, Solanum tuberosum
  Predicted polypeptide sequence is orthologous to G427
cactctataaaaaaaaaagaaaaaaaggaagccatagccatggagtttcaggaccacttttctcaagaaatggctcttcatcaacaacaacagcaacaacagcagcaacaaaacgcggtattgcgttccatgttacctgaatctcctcatcacgacgttcgaaaatcacctccgacttggctcaacacttctctccttcgtcaacaacacagtcagttcgccaacgcatcctcaccttcctcagccgcagctgcagctgccgtcgccggagggaacaatttccttcatctccagacatctaactccgactcgtcaaactctaaccagtggctctcacctactgcggctgccggcggtggaggtggagttaccggcggtggaggtgggcataatgatgagttatcggagtcgatgaattttgctaagaagatgagtcaacagcatagcggaggaggagaagaaaacaacaataataataatgaagaggagaactcgtgggagagagagaaatgtaaagcggatatattgaatcatcctttatacgatcagctactgtcggcacacgtttcgtgcctgagaattgcaacgccggtggatcaattaccgaggattgacgcgcagctagctcaatcgcaaaacgtggtagccaaatactctgtacttggacaaggtcaaccgcctctagatgataaagacctcgatcaatttatgacacattatgttctgttgctctcttcctttaaagaacaactgcaacaacatgtccgtgtccatgcaatggaagctgtcatggcttgctgggagcttgaacaatctctacaaagcttaacaggggtagcaccaggtgaaggtacaggagcaaccatgtctgatgatgatgatgaccaggctgatagtgacacaaactttttggaatggaggttttgatggaccagatagcatgggatttggtcctcttgtacctactgaaagtgaaaggtccttggatggagcgtg

SEQ ID NO: 14369 - DNA, 830 bp, Solanum tuberosum
  Predicted polypeptide sequence is orthologous to G427
gaaaacattgaaatactaagcaattaccagcattacaagaaaaagtgtcaatactccatagctcaaaagtacagttagtcttgtatactgaaaacacaaatctaccatatatgtttaccaattctgagtaccatatattacaatccgtcctaaactacgcgaattacctaacattttccccatgtcatagagatcacaattgacagttcagaattcttcatatcaccatcatgatacctatatatctgttgcttgattttgacgtttgtttttttatctcttgcgtttggactttagagatgtcacagactgtgagttgctatgccaattgcgctttctttgattgatgaaccagttattgatttgcttcagctgtaatcctgtttcctccacaagttttgccttatcatcctcagttggataaggccattttgagtgttgttgccaccaattctttagaacagtagtggtgtcaccaggcaactttcctgcccttctctttctcaatatctcctccctcacatcttcaattcttgatctaaatccctgtttgagctcaattttgagttcttgtctgaccctctccattaaagacctttcagattcagtaggaagaccaaatcccattcccattaagtcatgtgcatcacctccagatacatctaatgaaaaatccattttgtagttcatcttcatcatcagacattgtagcacctgttccctctccaagggttgctcctgtaaagaaagctgtaaattctgttcaatttcacgggcaggccataaacaggtttcaacagcatggacttctgaacatgctggttgaaagc

SEQ ID NO: 14370 - DNA, 1383 bp, Solanum tuberosum
  Predicted polypeptide sequence is orthologous to G428, G1594
gagtttctctcccttttaaaaaagaaaaaaaaaacacaacacccacttcaaatatcaaacaaatttctcatttgattatttctaagtgatttacactactttgtatttttgtttgtttttttttagatatatatatggatgatgaaatgtatggttttcattcaacaagagacgattacgcggataaagctttgatgtcaccggagaatttgatgatgcaaactgagtacaacaatttccacaactataccaactcgtccatcttgacttctaatccgatgatgtttggatccgatgatattcaattatcatcggaacaaactaattctttcagtactatgactcttcaaaataatgataatatttatcaaattagaagtggaaattgtggcggaggcagtggcagtggtggtagcagtaaggatcataatgataataacaataataatgaagattatgatgaagatggttcaaatgttatcaaggctaaaatcgtctcacatccttattatcctaaattactcaacgcttatattgattgccaaaaggttggagcaccagcgggtatagtaaatctgctggaagaaataaggcaacaaactgattttcgtaaaccaaacgctacttctatatgtataggagctgatcctgaacttgatgagtttatggaaacgtattgtgatatattgttgaagtataagtccgatctgtctaggccttttgatgaagcaacaacgttcctcaacaagattgaaatgcaactaggtaatctttgcaaagatgatggtggtgtatcatcagatgaggagttaagttgtggtgaggcagatgcatcaatgagaagtgaggataatgaactcaaagatagactcctacgtaagtttggaagtcatttaagtagtctaaagttggaattttcaaagaaaaagaagaaagggaagctaccaaaagaggcaaggcaaatgttacttgcatggtgggatgatcactttagatggccttaccctacggaggctgataagaattcactagcagaatcaacaggacttgatccaaagcagatcaacaattggtttataaatcaaaggaagagacattggaaaccatcagagaatatgcagttagctgttatggataatctaagctctcagttcttctcatcagatgattgagtttgaatggaaattgtgaaaatactgctcttcatttctctttttattatatataatatataaatagtatatttttgggaaagaaagaagttattttattaatcaaaatctctataaataatggtagagattaattaatgttgaattcttcttgatcatgtaaatattcaatctagctaattgtcaaaattaatgcttacctaaaaaaaaa

SEQ ID NO: 14371 - DNA, 936 bp, Solanum tuberosum
  Predicted polypeptide sequence is orthologous to G428, G1594
gggtttaaagaaacgtacttccatatatatacagctaagtatttttaattacaagttgttgttcacatactgtgtaactgtttgatgatggatgaattgagcaaacttcattctgctattgtatgttcacgcagtagacaacaacaacaggctgaggctgaggctgaggatgaggctgggccgacaattattaataacactcatactagttttgctattcatcattatcgtcaattagaagccgctgatcatcaaaataatactaaatccagcaccaatatgtcagatcttattaaagctcagattgcaaatcatcctctttatcctaacttactttctgcttaccttcaatgtcgtaaggttggagcaccgcaaggaatgacatcaattctcgaagaaattagcaaagagaacaacttaatatccagctcatatcacagtagtgaaattggagctgatccagaacttgataagtttatggaatcatattgtgcggtattagtgaaatacaaagaggagctttcaaagccgtttgatgaagctacaagtttcttgaataacataaagtcacagctcagttccctatgcaaagataatttaattacttcaacaagtttcaacaattatacatctgatgaagcaggtggtacctcagaggaggatctaggctgtgaggagatggaagcagcggatagtcctgctaaccgtgaaggcgataatgagctaaaagaaatgctgatgcgcaaatatagtggctatcttagcagtttgagaaaggaatttctgaagaagaggaagaaaggcaagttacctaaggaagcaagaattgtattgctggactggtggaatactcactatcgatggccttatcccacggaagaagagaaaaataggctatcagagatgacagggctagaccagaagcagataaacaac

SEQ ID NO: 14372 - DNA, 786 bp, Solanum tuberosum
  Predicted polypeptide sequence is orthologous to G431
tttttttttttattacattatttattgtgtgtgtgtgtgagagagagagatggttttcataggcaaaaacaaatagaaaggaacaaaatttagactcaagaagaaagtgtgtgtgagagagaggaagaataatggaaggtggaaatactaatacatcttgtttaatgatgatgggctatggagatcatgaaaacaacaacaatgggaatggaaatgcatcactttgtgctcctcaaatgatgatgatgatgcctcctcctcctccttctttaactaacaataataatgcagaaaccagcaacaacaacaatatcctttttcttcctttcatggacaccaacaacaataatcctcaagaagacaacaactcttcttcttcttcttcaatcaagtcaaagattatggctcatcctcactaccctcgtctcttggctgcttatctcagttgtcaaaagataggagctccgccggaagtggtggcaaggctagaggaaatatgtgccacgtcagcaacaatgggccgtaacagtagtagtggtggaatcattggagaagatcctgcactagatcagttcatggaggcttattgtgagatgctgacaaaatatgaacaagaactctctaaaccctttaaggaagccatggtttttctttcaagaattgagtgtcagttcaaagctttaacacttgcacctaattcttctcatgaattctgctctgggcgaggcaatggatagaaatggatcatctgatgaagaggttgacgtgaataacagcttcatcgaa

SEQ ID NO: 14373 - DNA, 537 bp, Solanum tuberosum
  Predicted polypeptide sequence is orthologous to G431
gttcatgaagaagaggaagaaaggcaagctgcctaaggaagcaaggcaacaattggtggactggtggcttagacatattaaatggccatatccatcggaatcccagaagcttgcactagctgaatcaacgggattggaccagaagcaaataaacaactggtttatcaaccaaagaaagaggcattggaaaccatcagaagatatgcaatttgttgtgatggatgctgctcatccacattactatatggataatgttcttgctaaccatttcccaatggatatgacaccgtctctactctgaatttatattctggagttatcccaatttcaacttctcaaaatgaatttttaagattctgtaatattattatcaaggatgtttaatttgcatattactttgtatgcatgtaatagtagaagttattgtgacctttttattagaccataagtgcttgtaatagctagaggtgtttctattatcatggttatctcttataaaatttattagtttgtacgtaaaaaaaaaaaaaaaaaaaa

SEQ ID NO: 14374 - DNA, 685 bp, Solanum tuberosum
  Predicted polypeptide sequence is orthologous to G435
cttgaatttttcataaactttctactatattatattattaatcaaaatgaatttcttgagttctcaaactcgaaaaattcatctaaaatgtcacaagaaaaggctcaaccaagatcaagtgaggctcttagagattagctttagctccaataacaagcttgattccgatagaaaatcccaacttgcccaggaactggggttaccacccaggcaagtcgcaatatggtatcagaacaagcgagcgcgatggaaaagtcaaagcctagaggttgactataagaccttgcaacaaagactagataatgcccttgaggataatgagaagttgaaattggaagttgagaggcttagaaaggagctaaacaaaaatcaagaagtgttgttgggattcaacaccacaactaataattattcatcaatttcaagttcatgtgatgaagttgggagtacttcatgtttgcaacttcatgatcaatccaagcataatcatcttgataaggagttttatgcttgtttaattggtgatgaaggccactttgggacacatcatgatgggcataatttctttgcttcacctttgtcttgataagctacatatgtatatggtaacttattaagtccaaaaaatgaaggatgtttatgacttttatgtgatatgtattgtgtttcttcttcttcttatata

SEQ ID NO: 14375 - DNA, 619 bp, Solanum tuberosum
  Predicted polypeptide sequence is orthologous to G435
ttttttgtacaattgacgaatatgatatttttttctcattagatttcccaaaattctcattcacttcaccaagttgaacaacattttttggtcccttcttccacacctatcataggataaagttcatcaatttgcaaattacaataattaacctcataattatgtacccatttagtactatagctaatcacatcttcacaacatgaactagatagtctaaattccctaatttgcccttgtgcacctgacttcagtccaattaacatttcatttgctttttccaattctccttgaagaatttcagtttctttttcaagttgccttttctcagataatgcattttcaagcttaacttgaagggcattgtagtcattttccatgcactgatttttccatcgcgctctcctattttggtaccaaatcgaaatttgtcgtggtggaacccctaattctcttgccaattgaagttttttctctagatcgagttttttagttgaatcgaaactcgcctctaaaagcctaacttgttcttgatttagccttttgtggtggtgtattgagtatttttgcaagtttgggaatgaaggaactatgcatgtggaaaaatatggatgggaac

SEQ ID NO: 14376 - DNA, 681 bp, Solanum tuberosum
  Predicted polypeptide sequence is orthologous to G440, G864, G1421, G1750
gccgccctaaccccaccgtcttcgccaccgcagctgttcgccgccggtagcttttcacggcagtaaagtcttaggtaccccgagagctccccaactcttctatatgctcagatactaaagatctatgaagccacagagagagattcagaaaatcagaattactggtttgtctgagagcttttgagtttcttttcaagctatggcctccaaggatgaacataaggaaaatgaggcagtcgaggaaccctcagaaattcccagagatgaaaaatcgatcaacccagtgggtgaaagttctgttgtcttgccgcgtgttgtgcgtatttacatgccagacagtgacgccacagactcatctagtgacgaggaggaaaagcttcaaggagagaagtccaagagacatgaaaggacgtgtataaaggaaatcatcattgagaatggaaagaccagggtcatttccaagaagacgtccaaagagaagaaagatataaagctgttccaagaaaatgcgaagaagtacaaaggagttagacaacggagatggggcaaatgggcagcagagatccgagacacaaaaaacaaaactcgactttggctgggcacttttgacactgctgaagaagctgctttggcttatgattaggcagccattgaaaatcagagcatgacctctaggggaga

SEQ ID NO: 14377 - DNA, 976 bp, Solanum tuberosum
  Predicted polypeptide sequence is orthologous to G440, G864, G1421, G1750
tgtctctctaaaatccccacactcatgtttctctctcttaataatcagcatctcactgtttttcaccattcaaaaaggactaaaaacatcatcaccttattcaaccatttggattcattactgttttttttctctcttataaactctttggtacttactctattttgtagttcgatttctttttttaatcgtctcaggctttgttgttctccgtgtgtgggactgactgtgggtgtgtttctccttttataatctcatcttttaatgttttgggtcttttttttgtcagtgaatcatcgtgttttaagcttctctttgacggttccattgctcgttctcatcttttaagagtgctacttttagtggtgtcactctcaaaagcacctttcttggctcttttttctccattctttctaatcggtttggcttagcagtgaaaaatagctaattcaggtttattcgatggatcatcatttgttgtgtccgatcaaatacaccgagcaccggaatgttatcaggaaagttactaaaccatctttggtgaaatcaaaaaaattcccagaagccacaaaatcctctcagttcaatccctctgttccgaggactgttcggatttctgtgacagacccagacgcaacggattcttctagtgatgaagaagacatgctttttggacggcgacgggtgaaaaaatacatcaatgaaatcagtattgaaaccgccgtcaagtgtgaagttagcattcctaacagtggcaatggcaaaacggtgaataaaagagcaccggagcctcttcagactaagcagaagccaatgaaagttcaacctcctcaatcggctggcgctgttaggaagttccgcggtgtgcgtcaacggccgtggggcaaatgggccgctgagatcagagacccggctcgccgtgttcggctttggttgggaactacgacactgctgaagaagctgctatggtttatga

SEQ ID NO: 14378 - DNA, 931 bp, Solanum tuberosum
  Predicted polypeptide sequence is orthologous to G440, G864, G1421, G1750
ttttggtataccatgacggaaaattcagttccgttgattaaattcactcaacacatagtaactacaaacaagcatgttttttctgagcacagtgaaaaatccaattcagagttacagagagttgtgaggattatacttacagatgccgatgctacagattcttccgatgatgaaggccggaatactgtacggagagtgaagaggcacgtgacggagatcaacctcatgccgtctcccaaatcgatcggcgacagaaaacgaagatcggtttcgccggattctgacgtcactcgtcggaaaaagtttagaggcgttcgtcaaaggccgtggggtcgttgggcagcagagattcgggacccgacccgtggaaaacgggtgtggttgggaacttatgataccccagaagaagcagcaatcgtttacgataaagctgcagttaagctcaaaggtcctgacgccgttaccaattttccggtatcaacaacggcggaggtaacggtaacggtaacggaaactgaaacggagtctgttgccgacggtggagataaaagcgaaaacgacgtcgctttgtcacccacctcagtcctctgtaacgatgattttgcgccgtttgataatctagggttctgcgaagtggacgcttttggtttcgacgttgattcacttttccggctgccggattttgctatgacggagaaatactacggcgaagaattcggcgagtttgactttgacgattttgcccttgaagctcgatagtgtacgaggggctatttcatctatttttgcaaatgggttcacactggttagttgactggtgacgtggtatttttggcgggaatatatatagtgattagcagtctctattcatacgaagactttgtgagagatttttgtttttatttttctgttaattgtggtgaacattgta

SEQ ID NO: 14379 - DNA, 574 bp, Solanum tuberosum
  Predicted polypeptide sequence is orthologous to G440, G864, G1421, G1750
ttttttttttttttttttttaagaacatcccagtaagttgggaactaaccaagtttaacactaatgataatgtacagcaaaatagtaaagcagtttcaaatccctggcatcatctgtgggtaaagatgatggctaaaacaagtagatctcccccttcagaagcggatgcagctttagtttaaccgttaacaggttcaaatgaacctagaattcttcacatggtacatagatgtatatgtgaaaaactactaaaagttcaacagatattaacttttgaacctcataatttcaaaggtgcaatggatccgcctatggaaggttgaaccaatcaagtttaactaacctatggatccgccttctgtctttttagtggtggcacgatgaagttgatcttgatggggttgtttttcttcgctggtggcttgaggatgtttgtcagagcattggcacctcttatttcaatggctgccttgtcatatgccaaagcagcttctaaagcagtgtcaaaagttcccaaccaaagccgagttttctttcttgtatctcgaatctctgctgcccacttgccccattt

SEQ ID NO: 14380 - DNA, 569 bp, Solanum tuberosum
  Predicted polypeptide sequence is orthologous to G446
aaaactcttgagcagtatcttcaaaagtttaaataacgaaccccatattgaaaaatgaaagtacactcctgcattcatcctcttccctgcactccctccaccggaattttggtctccggcggtcgtacggaagctaagcttgctgctaacaccagaaagctttattctttaactgtgaattcctctaattatgccccatttcattataaagatctgaaattttccagaagcagctctatggatttttctagaatggcaattggttcggtattccctaaagcttcaagctttccccctttttcttttcttgtgaagctacaccactatttgcgaattgttttggattttgctgttgttgaagtcatagttgttgcattttgttgaagttcagaaggcattattgtgaattgaacgccaattttttatttgaattttacacaagaacctgttagttagcacccattatccacagagtttagaaggctgtgattggtccaaagggcgggtcacagacggatttctcagttataaaaaaaaaagaacctgttaattagcagcctcaaatttta

SEQ ID NO: 14381 - DNA, 812 bp, Solanum tuberosum
  Predicted polypeptide sequence is orthologous to G446
gcaaagttcaatatgctaaagctgttttcttacagagtcatcaacactcataaattacaacactaatataacagaaacctagtgaatcatcttcttcttaagttgttcaacaacattacatttgcatgttgctccatgcaactctagtgatcaatcactgtgaactctcatagatcacttgtattgagctcagtttggaaattctgatgttgagccatttatgccttgcaatccagcagagttcagtagctgcattccttcctctcccatttgctggacttcagtaggcgataaaattctgatgcatcgaacacatccaacaaattcctcccaaggatcatccccaacaaggaggacatcattctcaaaatccacatataccaacttccagcttgagcctcgagtgtcattcagaagcccctcaagtccaaacattctttcaatttcagaccgcagttcttcataatttttaaaaccggagacatcaattgatcttcctacagatccagtcttctgaatcttcgtatatgtccgcacacgtggagcaacttgctgccatgagctattctgcaaaagattacattcatcaaaatttacattgcttgatgatgcaccacccgagttgtcagcaaattcttgtacagaaaaattctgagaatctgccaggctggctgatgtaatttgagattgaacatcttgactagaactgatgttgcctaatagaaaatctgaaggattctggaaatcactatgcttcaaattgcagaactcatctaacactgtgctcgaaggggggccccggtacccaattt

SEQ ID NO: 14382 - DNA, 704 bp, Solanum tuberosum
  Predicted polypeptide sequence is orthologous to G447
gacataggctatgatgaactaaggcatgatctagcacgtatgtttggaattgagggacagcttgaagatcctcaaagaactgagtggaagcttgtgtatgttgaccatgagaatgatatgctgcttgttggtgacgatccttgggaggagtttgtgagctgtgttcagagcatcaaaatcttgtctagtgctgaagtgcagcagatgagcttggatggggatttaggtaatgtgccagtaccaaaccaagctagcagtggaactgacagtggtaatgcgtggaaaggacactacgatgacaactcagctgcatcatttaatcgatgaaggtgctccaattaactttgtgatacattgtcctcaaggctgcaaacaactcagatctgctgattctaactgaaggcaattgaggtagtagaacattacattctaggcagctggtgggagcaactcatggcgtaaattcacataccttttgaagtccccgcatgcctcatggcagagttgatattagattagttcgatcgctactttattgtgaggtgtgcaaagcagttttaaatttattaattattatttttcagatcaagtaggtgtaaattagcttagaaattcaggcatgacaaaattacaggaagaaacattcctggtgtactaaatttaacagaaaatgtatagctttgacagttgtgggaaacttgtct

SEQ ID NO: 14383 - DNA, 875 bp, Solanum tuberosum
  Predicted polypeptide sequence is orthologous to G447
ggatgaaacaacccagtcttctctaccccttttgagttccagtggattagaagctatgtcccctaatagaaatctagttaaagatttgcagcaaaaacctgatgtgaagccctcattgaatatctccaagagccagaaccatgggttttcaactcctcaaacataccttaatactgcagttacccagatggattatttagatagttcatcttcagcaacctctgtctacttttctcaaaatgatgtccaattgcagcagacgactaacccgatgtctttcagttctcaagcagtcgtatttagagatagtcaagatggagaagttcagggtgaccccagaaatagtgttgcttttggagcaaacatggacaatcagttaggaatatccatgatgcctgattctttgatcacaaatagcttggtggggtcaaggaaagatgtatcaaataatatctcatcaggtggaggcatgctttccagctatgagaatcccaaggatgcacagcctgaactatcatcctcaatggtctcccaatcatttggagttcctgatatggccttcaattcaattgattctaccataaatgaaggcagcttcatgaatagaggtgcctgggccccaccacctcaaatgcctcgaatgcggacgtttaccaaggtacacaagcgtggtgctgttggaagatcaatcgacatcacacgttattcaggctatgaagagcttaaacaagatttagctcgtagatttggtatagagggacaactggaggatagacaaagagtaggatggaagcttgtatatgtggatcatgagaatgacaatctgcttgttggcgatgatccttgggaggaattcgtgaactgtgtccggtgca

SEQ ID NO: 14384 - DNA, 918 bp, Solanum tuberosum
  Predicted polypeptide sequence is orthologous to G447
cgcagatgcttcaaccctgaacactaatcagtggaagggtacagaaccattatttgattcaataggggctccccctacaaattctgctggcagtgagtcagcgcctcaagtcaaccgaggagtaagccaaagacgatcttcaggcaacttgtctccaacagggcctgataatagtgtcaactggctacaaaaatcctcccaattgcaaccttcttccccagtgacccagccacagttacagcagcagcagcagttatcaccattgcaacagagtcaggttctgcaagcagggaatagcaattcgtttgctagacccaatgactgtagactggattgaactgtcctcaacagataatggataattccttggtggctaattagtccctgaagggcagcatgcttgggaaacagcggtgtacagatgaagcttgttatccccgagggcatcacttcatggcaagttggtgaatttttcaaggtttagcagtactagatgaacggctgctaaaatttttgggtttctgtatattattgttgccctagagcctcaggaaggtagggacagatatagaggtatatgtacagggtttcactttatccgggtttccccccctttaaacgttacttttttcattttcgtaaagccccttgctccacctgctcacccaggggttcctattttgattttgcccccgtagatcattcccatgtatcattgcccgtgaattcaaggggtagttgtcatttttatggccaagccaaaggctgtgggaaattttgtgaatactagtcttttgtatactccctatttgtcagaacagtcaccatacatgactgcaccttcctagtagccctcctgattcttgtaaattgttcttgtttgcatttttgcaatctttaatgagatccaattgctgg

SEQ ID NO: 14385 - DNA, 939 bp, Solanum tuberosum
  Predicted polypeptide sequence is orthologous to G450, G456
attacttatattacttttgcattttctctctcatattttttccctttctctctctttttaatatttgcatagtactactactacatattgaagaaaattattgaagaaaaaagagtttgttttttgatggatttgaaagaaactgagttgtgtttgggactacctggtggtggtggtggcggaggaggaggaggtgaattaattcgcgataataataataataataataagattaatgggaaaagagggttttctgagactgttgatttgaagctcaattttcatcaagctaatgatgatatttcttgtgctatggagaataataagatgaagaatagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgttgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctcctcaatagttctgaatatgtgccaacctatgaagataaagatggagattggatgcttgttggagatgtaccttgggagatgtttgttgactcatgcaagcgtttacgcataatgaaaggatcagaagctattggacttgcaccaagagcaatggagaaatgccagagcaggatctaagccaattgatggtgtgccaaaactccatagataatgtttgaagttgaagggtttgtgagattatatattgttgttttcatgtgcttgtatttt

SEQ ID NO: 14386 - DNA, 826 bp, Solanum tuberosum
  Predicted polypeptide sequence is orthologous to G450, G456
aaaaatgtcattggagagagccaaattagcgaacggcttgacggaaaccgataattccggcctcaatttcaatgaaacagagctcactctcggcttacccggagaatcgcggaagcaaatctccggtacaaaacgtggaatctccgacggtatggaattaatcctaggaagctcaacttcaggcgaacgccgccgtgaagatgatcactcgaaaaacgaaatctctaccggaaacaaacctccagcaaaggctcaagtaattggatggccaccggtgagatcatacagaaaaaacgtgatagaaaagtgcaagtacgtgaaggtggcagttgacggagctccttacttgagaaaagtagatctggaaatgtacgatagttaccagaagttgttaaatgctttagaaaacatgtttacctgcctaacaatctgtaattctcaaagtgaaagcaagcttatggaccttacaaatggtgtagaatatgtacctacttacgaagataaagatggagactggatgcttgttggagatgttccatgcgaaaatgtttgttgatacgtgtaagagaattaggttgatgaagagcacggaggctattggattagctccaagaacaccagggagatcgtcgagttcaagctaaattaatctaaagataactgcatgtacagataccaactggcttgggggaataagattaaagaaggtcttgaactagtatctcaacaagcctattccaatgaaacaggctccctctttcatcagatcctcggactacaacatactgggatccttgagcaatcctcaagaaaggggaaaaaactt

SEQ ID NO: 14387 - DNA, 857 bp, Solanum tuberosum
  Predicted polypeptide sequence is orthologous to G450, G456
atctctcttcaatttccataagtaccatagccccatatagtatcattattcattttgtatagtagagaggaaaaagaagtaatggacttgaatctcaaggaaactgagttatgtattggggatgcctggtggtggaggagatcacaactattaagaaaagaggattttctcatactgttgatctcaaactcaacctcgataatccttccatgaacatcaacaatacttcttccaacaaggactctctcaagccaccaactaaggctcaagtggtggggtggccaccagtaagatcattcagaaagaacataatgtctcaaaaaggcaacaataatgtagaaattagtgagaagggagaaaaaacaatagcatttgtgaaggtctccatggatggtgcaccttaccttcgtaaggtagatttacagatgtaccaaaagttaccaacaactctctgattctttgaccaacatgtttagctcctttactatgggtaattatgggtcccaaggaatgatagattttatgaatgagaggaaactgatggatgtcctcaatagttctgactatgtacctacttatgaagataaggatggggactggatgcttgttggagatgtaccttggcagatgtttgttgattcatgcaagcgtctacgcataatgaaaggatcagaacgccatttggacttgcaccaagagccatggagaaatgcaagaacaggagctgagcaaattagttcagcaactcataaattggagactcaaaaaatgttgatcgaagaatgaagcaatcaatttccatggtgtctgtaattaatttgatagttaattagtatataaatatctagataattatc

SEQ ID NO: 14388 - DNA, 746 bp, Solanum tuberosum
  Predicted polypeptide sequence is orthologous to G451
aaaacaactcttcagctttaactcaactcaactactctaagatcaatcgattaacagcagaccgctctctaaattatgggaatttacgagaaggatctcaatgatcttgaggcaactgaactaagattaggtttgcctgggataatagatgaatcttcaacatcaactagtactgctaaaaatagcagaaaaagaccttcatctattgtaaatgaaaatgaacaacaagactcacctcctccaccaaaagcacaagttgttggttggccaccagttcgatcttacaggaaaaatcatgtgtctaaactatcagaatctgataatagttcctcagggatgtacttaaaagttagcatggatggagcaccttacttgaggaaaattgatcttaaggtttacaaaagttaccaagagctactcaaggctttacaaaacatgttcaagtgcactattggagtgtactcagaaagagaaggatataatggatctgattatgcaccaacatatgaagacaaggatggtgattggatgcttgttggtgatgtaccatgggagatgtttatcagttcttgcaaaaggcttagaattataaaaggatctgaagctaaaggtttagcatgtctataaaaacatggaaatatatatatacatacatgcaaatctactagggatgaaaaagtttcagttttgtaacactatctgatcttcgatcaattttatgggatatatagatctagatctacttg

SEQ ID NO: 14389 - DNA, 726 bp, Solanum tuberosum
  Predicted polypeptide sequence is orthologous to G451
gcatagaactttagattattattccatttgagaaccaacaaagagatgtgttaaaaccccaaagccaaataagaaggaagaaagaaagaacttcaagatagattaagaagaacaaaggaaaaaactcatttcatttgagaatactgtgtctgtctatacaattgcttccagagcaaatacattcttcatatgctattatcacactgcaggatctataaaaaccaccatggtttctaagcctgcacaacatataggaataagagtttcattttttaccccttcaaaacaaaactgctctttcttctgtttttcacttcccaatcagtgtaaaacaaacttccagcttcttgcaattcgacaacccaagctcaaaaagacccccttcccttttttttccctgagaagaattcataatcttcttctcaaactccacatcctaaccctcttgcttctgatcctttcattatccttagcctcttacatgatgataagaacatttcaaaaggaacatctccaacaagcatcaagtcaccatctttatcttcataagcaggagcaaattcagaccctttatacccttccctttctgaatattcacctatactcagcttgaacattttctctaatgcctttaacagttctggataacccttgcacaatttcagatcaatttttctaagataggggctccatccatactgactttacatacatcccacactcagc

SEQ ID NO: 14390 - DNA, 971 bp, Solanum tuberosum
  misc_feature (859)..(859): n is a, c, g, or t
  Predicted polypeptide sequence is orthologous to G451
gaaactagcattttcttcaccggaaatatttcagctttcatcggaaactcaccgtcgtagatcatatcatcaaatttgaagaaatggaaatggctggaacagagctaagattaggcctacctggaacagagccatcgtcttctacttctactagtaaaattagcaataaaagaacttcatcacatatgaacagcaatgatgaaccaccaccaaaagcacaagttattggatggccacctgttcgatcatatcgaaagaacattttagaagcgagctacgttaaagtgagcatggatggtgcggcttatttaaggaaaattgatcttaatatttacaaaagttatccacaattactcaaggctttagagaacatgttcaagtgctctattggtgtatattcagaaacagaaggatacaatggatgtaattatgtaccaacttatgaagacaaagatggtgattggatgcttgctggtgatgtaccttgggatatgttcattaattcctgcaaaaggctaagaattatgaaaggatctgaagctaaaggcttagcaagcctatagatctgatagattgatcagaattcagatcatatcatccgtgtgtttgatctcgaggttttgaacatgtatatctaactctattcctattggatttatccatatcgaaaatccttaacgaaagcttaggttccttcaagttttggtataaccaggtttttcgagtgtattagcagaaaagtaacagtttggatcatcgttttccttgtacattcaagttccgtcctatttgaagaatctatggggtatttccaaaaaagggatatcgggataatatgaagtattatgcggaagcaaanaaacacgagaaaaaagaactcgaaggcggcggcccgggaccccaattcggccaaaagtgagccgtataaagcgcgccaatggcggcggttacaaacgtcggaccgaggaaaa

SEQ ID NO: 14391 - DNA, 869 bp, Solanum tuberosum
  Predicted polypeptide sequence is orthologous to G451
cacaactgcttctttgtaccaaaggatagtaaacaaaggagcaatcttgatcaagaaagtgtttacaaaaatttggggctttttctgttttgagatttgaggtttttaatttggtgttttgggtatttcaagaatcaattttttttggagaaaaaaaaaatgacaagtatagtgggaaatcagaaagatctgaatttcaaagctactgagctgaggttaggtttgcctggtacagaagatcaagaatctgaccaagaaatatcaaattccaagaataacaacaaaagggctttgcctgaatcaactcatgatgaagaagattgtgaatctaagtcaagttctgatcatgtcaaaaccccacctgttgccaaggcacaaattgtggggtggccaccagtgagatctaacaggaaaaacataatccaaccaaagaaaacagaatctgaatctggaatgtatgtcaaagttagcatggatggtgccccttatctaagaaaaattgatctgaaaatgtataaatgttatcaagaactactaaaagccttagaaaacatgttcaaactcaccataggtgaatactcagaaagagaaggctataaaaggatctgaatttgcccctctttatgaagacaaagatggtgatttgatgcttgttggtgatgttccttgggaaatgttatgtcttcttgtaagaggctgagaataatgaaaggatcagaagcagaggcttgggatgtggagtttactttataaattataaaaattcccaattagaacattttgactgatgatgaaagtttttccttttttctcccttttacagtaaacaaagagtcctttcttccccttaggttctttgaattaaaaat

SEQ ID NO: 14392 - DNA, 679 bp, Solanum tuberosum
  Predicted polypeptide sequence is orthologous to G470
ttcccaataagctaaaatccttttcctgatcttgtgtttgttgcttcaccaagctagcaccaaatgcagcttggtccgcagagggacagaacccatgggaggagttatttggcactccaaatcctgataataaatctgtgagagatgactcaggcctccctaaaggtagccatttatctggaagatatctctttgatgcagaatgaatatcattctttccatcattcactgatggttgccatatcattggtttctcagacaagtctgtctcattactttctgcaaaaccgcctctaaaggtagataactcttgaccttgcaagaccctcggaaacccactggcttgggaatggtctgctgtcactcttgatgaaccttccctagtaaggacagatgaatcaggagatgagggcaaaatactggatctaggcctttttggccttgcgactggaggtgcattaagtgcaggagggctaagagctggttctattttccagggtgaaactcggtctggccttgaatgctagaattttcatcccaccggaccttcagacatctccacttagattcaagccacctttggggatcagcatcttcaatgccaactatagttccagtaaacctttgctctggagcttcttcaccttcgaacctcatcttaaacctcattccaaataga

SEQ ID NO: 14393 - DNA, 885 bp, Solanum tuberosum
  Predicted polypeptide sequence is orthologous to G470
gatttcagcttactgggaaaacaatggtcactagtgtcttctggtctctcacttaatctgatggattcaggattgaagggtgcagatactctttatcaaatgccggggaacatctagactcaatggttttaacgagtatccaaccctccctggtcatagaactgacaatcagcagggaaattggttaatgcccccgtccgtgttgccttgtattcagatgtccactcgttctggagaaattatgcctaaacccatgacttcaccacagcccgaagccatgaaacccaaagaagggaactgcaaactatttggcattccccttgtaagtaaatgtgctaccatagatcctgtcatgttgcggaaaaattctctgattgactcaacaagtaacatgcattttggtatacacccacatcaattccctataactgaatctgatcaaaggtctgagcaatcaaagggatcaaagctaccagatgacgggatcacagttcatgatcaggaagaacaattccaaacctctcatcctggtactcgagatagagagggcaaaggccttgttaattcaacaaggagttgcaccaaggttcataaacagggtacagcccttggaaggtctgtggatcttgcaaagttcaacaactatgaagaattgatagctgaactggatcacatttttgattttaatggtgagctcaaggctcggaacaagaactggctggttgtatatactgatgatgagggtgacatgatgcttgttggagatgatccatggcaagaattttgtggtatggttcgcaagatttttatctacacgaaagatgaggtgcagcggatgaaccctgggactctcaattcaaaaggcgaggacatttcttctgttgc

SEQ ID NO: 14394 - DNA, 820 bp, Solanum tuberosum
  Predicted polypeptide sequence is orthologous to G470
ctctctcatcacttacatgaagaagctcctccttctatccattgaagatagatacatacacacgcatttacatacagtttaaagagagagaaactagagcgagaaagctctttgaacttcaattttgagtgttgattgctgtttctagggtctcttttttttgcatgtttttgagctgaggaagagttcagtgctttttttctggtgaattttggaggaggaagttttattttgtgtttgtttttggaattgattagtgtggatatgagagatctgtgttgagaattagtgtacggaaatggctgcttcggaggtatcgattcaaggttacagcgagccgagtgatggttctaggccggtttcagatactgttaggagtagttccggtgtcggaagagttgatgctgatacggcgttgtacacggagctttggcgttcatgtgccggtccacttgtgacagtacctagagagggtgagctcgtgtactatttccctcaaggacatatcgagcaggttgaagcatcaacaaatcaagtggctgaccagcagatgccttcgtataatcttccatctaagattctatgccgtgtggtgaatgtcctgttaaaggctgaaccagatactgatgaggtgtatgcacaggtgattttgatgccggagccaaatcaagatgagaatacagtgaagaagggaccctatgctccctcctccacacggatttcatgttacactctttttgtaagactctaacaggctctgattaaaagcactcacggtgtgattttcccgtcttgaggacgacatgctgattgaatgcct

SEQ ID NO: 14395 - DNA, 978 bp, Solanum tuberosum
  Predicted polypeptide sequence is orthologous to G470
tttttttttttcagaaaaaacttcttttctatcgcattaccataattgctgatacaaaacatgtgatctgcccaaagcagttggataccacttccacaaaaatcaacagtaaggcaggtacatacatagtagaatcgaaatcttacttacagctacagctagagaaattggtatgtacaaagtgagattggcagaagcaaggttaatgaccaacgctgataatttacatatactatgtatagataggtaaggggccagatattggctccaaaaaagggttcaaaactgcaaatactgaagctgcatttatatgaagagaccatccccatccagaagtcaaagggagttgatattgtaggttatattcaaaaatccccaaaaaagtaacacctaggtggataaaagccatctcctcgctatcttattaacctcaattttggaggaaaacctaagattctgcttgaccagattcagaaggaagttgcagattcttcacttctttagcgtctgagccctcagcaacagaagaagtgtcctcaccttttgaattaagggtccctggattcatacgctgcacctcctctttcgtatagatgaaaatcttgcgaacataccacaaaattcctgccatggaatcatctcccaaaagcatcatgtcaccctcatcatcagtgtatacaaccaagcaatcttactccgaaccttgagttcaccattaaaatccaaaagttgatccagtacaagcaatcaaattcggccataagtgtgttgaactttggcaagaatctaacagaaccttccgagtggcttgtaccctgttttatgaaacctttgggtgcgacagtttccttgtgaaaaaactacttattgacctgttggcaatcccttaaatttatagcgcagaatgaacgggtaatgaacacttttttgccctgatcacttagtgggaatccacatcatcacacctttggatccctt

SEQ ID NO: 14396 - DNA, 707 bp, Solanum tuberosum
  Predicted polypeptide sequence is orthologous to G475
ttggcccaactagtttctcctcacagggatggaaactaacaaatgggaagggaagagaagcattaatgaagctgaagaggaagaggatgaacatgaaagtgttgaagaggacagcaaaaggaaaagggtattgactctctctcgtaggaagctagctggtgaagggtcggcacatccttcttgccaggtcgatcagtgcactgcaaatatggcagatgccaagccataccatcgccgccacaaggtgtgtgagttccattcaaagtctccaatagtacttattagtggactccagcagcgattctgtcagcaatgtagcagatttcatctgttagcagagtttgatggtgctaaaaggagttgccgaaggcgtttggcaggtcacaatgagcgccgccgtaaaattacatatgattctcatggagaaagtttgggctgaagcagcatcagcatcaatggcagtgaaataacctactttctgaagaaattacataaacaagatgtggtttaagcatgctctctatcttctgtcaattccaggatttgtaagcaaattgttatctgtgaacttcaagtatctagctaatagtactttcatttcccttatgtaaagggaaggacaaaaagaataaaccgctggcactgtctgctagtattcgaaaaatgaaatatttgtagtatcaatacatatcacatggtgctcgaaa

SEQ ID NO: 14397 - DNA, 512 bp, Solanum tuberosum
  Predicted polypeptide sequence is orthologous to G477
ctattccataacagggtgaatatttagtactacacagattaactcagacttacaagtcatgattattttgttaattgtcaaagagaaaaacattattattgaatgagacagcaccatgaggaacagttgtcactcagtatcaaatgaggaaaacaaaaacgaaaaaaacaacaaacaagaagtgaacatcaagattccaaagacttgctccctgatgctcccatatctgtaaagctgcgaaaggtgtctgctacttgagtgagttgctgcacacttcagcagttcaacgctcaccaattttgacactaatccagatatttgcatctgctcaagtgattctgagaccgggaaaagcattgccgtcctgcttcacttgcatggaaaacctttgatgctccacacgctgaagctgtgatgacaactggagcaaatcaatagtaggtccaccttcacaagaaagttgattcttagggttcaccaaatctgatccttcaatgatgcgattgatacca

SEQ ID NO: 14398 - DNA, 944 bp, Solanum tuberosum
  Predicted polypeptide sequence is orthologous to G477
tgaatttgatgatggaaaacgcagctgccgcaagcgtcttgctggtcataatgagaggagaaggaagcctcacactggtctgcactctggcagagcaggaaagcactttcaaccattttctggtacaaggtttcaaagtagttcctttgcaacatcatccttcatttgccaggatatacttggcggcagtcttcttcatcaaccaaaacatgatatgcatgactggtataagaatgtaaaggtcgaacattgttctaattacagtcctcaactaaccaggccatttacaaataaacactcacaacctagaccccatttcacttcataccatactgacaaacactgtccagctctccatgatgaaggaataacaactataacaagaagcaaaaataatgaaagtagcaactcatatctgaatgacattggaggctcagattttgtttcccgctctctgttccacagcacctcaatagggagcgaagtcttgaatgttatggactcggcctctccttttcaagggatatcaaactctggctgtgctctctctcttctgtcatctcaatcacaggacacatcaaattattcatctgtagttcctcctagtgctcaccaccttattacacctcgcagtaacacccattacaacatgacacagacatctgaatgtttcccaggagctagcccaaagggttcagcaagtacagtgtccaatatttataatttatctgaagtaatttctgcagagggtcacttggaacagatgctaagaaacaattgtggaagtctttcaaggatcagattacgtaaacaccaggaattctacttttcttgtggaagtatggtagccacatattggatttggcttccaagttgttcgtccggcagcttcatccaaggtgggaggcatccaaagacatttccttgaaaaatggaagcagcat

SEQ ID NO: 14399 - DNA, 703 bp, Solanum tuberosum
  Predicted polypeptide sequence is orthologous to G484, G2631
gctttcattgatgacaccactactaactccatctaccaaaatcttctttccattttgctgaaaactatataagcaatatacgtcaccgttacccccacacacttcgctcatgcgtgcttaccacgccccttttagcattcacaatgatgatgggacccactgctcatgcgcgacacgtatccatccgcgcgtggagaatcccttgttggatgcgctttgccctagtcgtctgcgaacacatccttctctctctatatccaccatgaaccaccaccgtactccgatcaccttcttcgatcttctttcaaattcttcaagtcggccgatttgctgctcctcttgccgatctactagtttcgcaacttttctttctgaggattaaaatggaaccgatggatatcgttggtaagacgaaggaggatgcttcgcttcccaaagcaactatgacaaagattattaaagaaatgttgccccctgatgttcgtgttgcccgagatacgcaggatcttttaattgaatgttgtgtagagttcatcaatcttatctcatcagaatcaaatgaaagtttgtatagagaagataaacgaacaattgcaccagaacatgtactcaagggcttaaaagttcttgggcttgggggatatactgaagaaagttatgctgcatatgaacaacacagttggagactgtggacactgtgaga

SEQ ID NO: 14400 - DNA, 698 bp, Solanum tuberosum
  misc_feature (629)..(629): n is a, c, g, or t
  Predicted polypeptide sequence is orthologous to G484, G2631
aaaatgcgaagggatgaaatatagtccctaatatcatcaataacttgtccctaatatccaaaattgagcgagactaaacccaaaataaaatattgctcttaaaaaaaagaaatcaggtgggtactttaactaaagcaaatatcatccttcaaacctaatttcatctcaaaaaaaccctagaccgcttctctatgcgagtgaaaatcatcgttcctcttctgcctctattcggttcatctatgttctgggtagatcgagcaataacgaaaggacacaaacatacaaatcattctgggtgtggacttgaccatgagcccaagaactctccgaaattctatctcacaaatctgaagattgatttcaagtgtctatggatgctcagtgttttttgacggtcctctgtttctttatttcaatgtttttgagtttgtactagagaagacaaacaaacacttgaaccagaacatatttttgaggcttttaggtgcttcaccttaccttgatttgaagagttacagttacaagtcatgatgagagttttgaagacttcatacaagttgtgaaattggttatcatttgtttgagaagttaggaaaatgtagattattattttcctaaaaggttgtgtnaacaatagcgtgcatgtgcattgtggttatattgctacaaatgtgatgttattacatatttctaataat

SEQ ID NO: 14401 - DNA, 743 bp, Solanum tuberosum
  Predicted polypeptide sequence is orthologous to G484, G2631
attttttgtagtgctctaattccgatctcgtttcttcaatctgtcagattctcgattttctcttcgtaagggctaaaaaatggaacctatggatatcgttggtaaaacaaaggaagacgcttcacttccaaaagcaactatgacaaaaattatcaaagaaatgttgcccccagatgttcgtgttgcccgagatactcaagatcttttgattgaatgttgtgtagagttcattaatcttatctcatcggaatcgaatgaagtttgtaatagagaagagaaacgaacaatcgcacccgaacatgtactcaaggctttacaggttcttggttttggggaatatattgaagaagtatatgctgcatatgaacaacacaagctagagaccatggacactgtgagagctggaaagtgcagtaatggagctgaaatgactgaagaagaagcattagctgagcaacagaggatgtttgctgaggcgcgtgcaaggatgaatggtggtgctacaggtccccccaagcagcaagattcagaagcagagcaaaccttgaatagctaactttactttttcgttgttgtgtaggaaaaaaagcatctttagtctgttttagtagcaggacgtctcttctattgtgtacaaaaaggctcctggcgcatgtgtccgcttgtgagggctctagttcagtttgtactcagatgcattatgttcatatattctgtaaattagtaaaaaaaaacaaaaaaaa

SEQ ID NO: 14402 - DNA, 683 bp, Solanum tuberosum
  Predicted polypeptide sequence is orthologous to G484, G2631
acggctgcgatcgtcattctctttcagatctgacgattttgtaatttgtaagggttagcatggaacctatggacattgtcggtagaacgaaggaggatgcttcacttcccaaagcaactatgacaaaaattattaaagaaatgttgcccccagatgtccgtgttgctcgagatactcaggatcttttgattgattgttgtgtagagttcattaatctaatctcatcagaatcaaatgaagtttgtaatagagaagagagacggacaattgcaccagaacatgtactaaaggctttggaggttcttggctttggggaatatattgaagaagtttatgctgcatatgaacaacacagactagagactgtggacacagtgagagcagggaagtgcagcaatgtcgctgaaatgactgaagaagaagcactagccgagcaacagaggatggttggctagaggctcgtgctaggatgaatggcggtgttacagttccctcaaaacagcctgattcagaagtggaccaaaacttgaataactaatattcaggacttccttgttttctgtaggcaaagtacatttgactcttttttttttataagtagttttgcttttgtgttatgtacaaaaagctcctgccagtgctagttatgtggactctcctttaatttgtacttgtctccatat

SEQ ID NO: 14403 - DNA, 615 bp, Solanum tuberosum
  Predicted polypeptide sequence is orthologous to G489, G714
ctgaagagaataaaggaggacactccagaaaaatgacattgcagcagcgataacaaggacagacatatttgatttcttggttgacattgtaccaagagaggacttgaaagatgaagtgcttgcatcatcaattcctagagggaacctccctgttggaggccctgccgagggcctcccatacaattattatatgcctatgcaatctgctccacaaattggagcttcaggggtgtatatggggaagcctgctgatcaagctctttatggccagcatccccgtccttatatggctcagccagtctggccccagcaacagcaacctccatcagattcttaagcatctggggcatcagattactgttggacaccagatggtagtctaagatgcaagtactggacaatacactaccaggatagcagactgcatatttgaattaacaatagggacatatagagaactagttcttcggtgtttcctacagtagcttaatcatcatatgatgagctcaatgaattagtaacaaaatgacccccttcttattttcgtgtgtttccagatatgtagcggtgttgaatgtttttcttatatttcatggtggtgagctcttatggatt

SEQ ID NO: 14404 - DNA, 1006 bp, Solanum tuberosum
  Predicted polypeptide sequence is orthologous to G489, G714
ctttgattgaaccctagctctcactctctctttctctctctaaaaaaagcataaaagtttcaatctttcaggtaatttgattggagaggcgaatccagattttggagcttcaatcagtgggagcccacagcctaaggtagccttgaattctccaaaagggaatcttgctcaaaatggatcatcatggaaatggacagcctccaggtattggagtcattactagctcagctccaatatatggtgctccataccaagctaaccaaatggcagggcctcctgcagtttcagctggtgcaattcaatctcctcaagcagctggtctttctgcttcgtcagcccagatggcacaacatcagctcgcttatcagcacattcatcagcagcagcagcaacaattgcagcaacaactccaaactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgactctgcgtgcatggaaccacactgaggagaacaaaaggaggacgctgcagaaaaatgatatcgctgcagccataactaggactgacatatttgatttcttagttgacattgtcccaagggaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgttgatcaagcactttatgcccagcagccccgtccatttatggctcagccaatttggccccagcagcaacaaccaccctcagattcttaagcagctcaaagcttagattacaggaatccagaagctaagagcagtgagtagtctgagtagcg

SEQ ID NO: 14405 - DNA, 1295 bp, Solanum tuberosum
  Predicted polypeptide sequence is orthologous to G502, G519
ggtcaaacaactgaaactaacaaagcagcagcagcagcaacaaacagagaagacaacagaggaagataaacaaaggaaattaagagggagatttatcgaatcgaaagggaaagggaagttacgaagagtgagaatttgaaggaaatgaacaaaggagcaaccggaaatcagcaattggagttaccggcgggattcagattccatccgacagacgacgaattggtgcagcattatctctgcaggaaatgtgccggacagccaattgcagtatcaattataactgaaattgatctttacaagtttgatccatggcagttgcctgaaaaggctttgtacggtgaaaaggagtggtattttttctcaccaagggatagaaaatatcctaacggttcacggccgaaccgagcagcaggaaccggttattggaaggcaaccggagcagataaaccggtgggaaaacccaaaacattagggataaagaaggcacttgtgttttatgctggaaaagcacctagaggaataaaaaccaattggattatgcatgagtaccggctcgccaatgtggaccggtctgctggcaagaacaataacttgaggcttgatgattgggtattgtgtcgaatttacaacaagaaaggcacacttgagaagcattacaatgtggacaacaaggaaactgcaagctttggagaatttgatgaagaaataaaaccaaaaatattgcccacacaattagcacagatgccaccacggccccgatcgacaccgacaaacgactacttccatttcgaatcatcggagtcgatgactagaatgcacaccacaaactcgagctctggctcagagcatgtcttgtcgccatgtgacaaggaggttcagagcgcgcccaaatgggacgaagaccacagaaacacccttgattttcagctaaattatctggatggtttactaaatgaaccatttgaaacccaaatgcagcagcaaagttgcaactttgaccagttcaacaatttccaagacatgttcttttacatgcaaaagccttactaaaattgtataaattcattggatctaaattgattgtgatccatgacattttctttgttctttggtggtgtaggtcaacttttattaattagtttagaaaagtacaaaatgcaagtcaaatttggtgggctgtaatgagcctttgataagcatagccaaagagtcatatagaagggcttattaatgttattattgtaaggtacatgtaaaacaaatgaaaatttgttaatatcaagttatcattcttc

SEQ ID NO: 14406 - DNA, 914 bp, Solanum tuberosum
  Predicted polypeptide sequence is orthologous to G502, G519
gaagaaaaagtaatggtggatttgcaatttcctgctggatttcgattccatccaactgatgaagagcttgtgatgcactatttatgtccaaaatgcgcctcacagccgattgatgttccgattatagctgaaattgatctctacaagtataatccatgggatcttcctgatttggctttgtatggtgagaaagagtggtatttcttttcgcctcgagatcggaagtatccgaacggttcaaggccgaatcgagctgcgggaaatggatattggaaggcgacgggtgcggataagccgattggtcgtccaaaatcgatgggaattaagaaagctttggtgttttacgcaggcaaagctccgaagggagaaaaaacaaattggattatgcacgaatatcgacttgctcatgttgatcgatctgctcgtaacaagaacaatagcttaagacttgacgattgggttttatgtcgaatctacaataagaagggtacaattgagaagaatcaactgaatattcgaaaaatgaatgttgaaatgtcgccggcggtgagtgaaggtgatgtaaagccggagattatgccgtattcagtttcaacaaagccgtcttcgacgtcgtaccacgtttacaatgacttcacatacttcgattcatcggattctcttccgaaacttcacaccgattccagctgctcggagcacgtgccttcgccggagttcacatgcgagaaggaagttcagagcgagccgaatgtgaaactgaatgagtgggaaaaaactgcccttgattttccatttaattacacagatgccactacttctgagttgcagagttgttatgagatgtcaccactacaagatatattcatgtatctgccaaagccgttttaagtggggccccgccgatttttcatttt

SEQ ID NO: 14407 - DNA, 990 bp, Solanum tuberosum
  Predicted polypeptide sequence is orthologous to G502, G519
atgaaagagtggtacttcttttcacctcgagatcggaagtatccgaacggttcacgaccgaatcgagctgctggaagtggatattggaaggctactggtgcggataagccgattggaattccgaaagcggtgggaattaagaaagcattggtgttttattctggtaaggcacctaaaggagagaagactaattggatcatgcatgaatatcgtcttgctgatgtcgatcgatctgctcgtaagaacaacaatagcttaaggctagatgattgggttctatgtagaatttacaacaaaaagggatcgattgagaagaatcggaaaatgaacactacctgttatatggatacagttggatctccagaagataggaagccggatattctaccaccgctacctccaccgcctcagccgcagcaattgcacaacgatttcttctatctgccgtccgattcagttccgaagatccactccgattcaagctgctcagagcacgtactctcaccggaattcacatgcgagagagaagtgcagagccagccgaaactgactgattgggagaaagctaccctcgatcttccgtttaattacatggatgccactaccggcgcgacaacggtggataatagcttgttaggttctcagtttcagagctgttatcagatgtcgccgctgcaggatatgttcatgcacctgcacagaccttttgagtggggcccagtggatcattttcagccgcaagcgtcaaaggagacttaaacgtccgtgactttgcacgtgcggccgtggtagaataatggtagtagcatcttttgcgttcacattggcaattgtgaaaacaacatttgtatatgtagataaaaaatattactagcaattaaataaattgcgaaaaaaaaaacaccctaataaagtttatataagtacataatgatcatgagactttttgtactacatgtggatgtactttagtatatggggtgttatcaa

SEQ ID NO: 14408 - DNA, 541 bp, Solanum tuberosum
  Predicted polypeptide sequence is orthologous to G525
ggtgagacatgtaattcacatgtgacgtgtttctccgattcagtggaggatcaaaaacctcaaacttatgatcattatcatgctcctctatcgagctcccctgtttcagtcgatttcccttcaaatgaaccaaaccaatcgatggcgtacatggaaaatttccagtatggagattctggattgatgcaagataactcgataatgaggcttttgatagataacaattatgggtcagaatcaaaacaaagtttgaggggttacgaagatcatgacttcaatatcacttcaactggcccagtggacatcgattgtctatggaattattgatatttgagagctggataaacatttagtagggacttgaaaaatgcattagaaattagaattgaatgtgggagttgggacagaggaattgtgcttataattattattcttcagatattgttttagattatttgcagtagtactacataaatatctgttgtgtatagatttgtctccactagaaataatacataagttaattggtttgttaatatgt

SEQ ID NO: 14409 - DNA, 872 bp, Solanum tuberosum
  Predicted polypeptide sequence is orthologous to G525
ctcttgttgggatgaagaaaactttggttttttacaaagggagagctccaagaggtgaaaaaacaaattgggtaactcatgaatacagattagaaggaagattatcacttaataatcttcctaaaacagtaaagaatgattgggtgatttgcagagtatttcaaaagacaactggtggtaagaaaattcacatttcagggcttgtgagagggaattctgatgaaaatgaaatggtcaattccattttgccaccattgacagattcatcgccaagtcacgtgcactgcttctccaattatgttaccactcaaaagaatcaagaaaacaacatgatcaattccttcaacaattctcctaatttccctcttctctcgaattccattgacatttttcaaagaaactctcttccaaattcgttcgcctggaaccaaaatgtccctcttcaacacaattttccacagccaggttcatttcctatacaagatcctgcaactctgaggaatttgcttgaaaattacggacagaacattcaacatcagagtttcaaaaaggagacagatatgatcagtgtatcccaagaaacaggtataagcactgatatgaacgctgaaattacatcagctcagcaggatcttgattgcttctggacttactgaaattctttgaccagaaaaaaaacgcaaaaaagaagaacagacataggagcttcattagtagtattagctattatggtgtgaaaatcatggttatatgtactagatttactaatcccctaagttgcattcaacatagtaaccatattatgttccaaaactataatcttacacaatttatttatttgtccgcattttaaccttaaaaaaaaaaaaaaa

SEQ ID NO: 14410 - DNA, 1047 bp, Solanum tuberosum
  Predicted polypeptide sequence is orthologous to G525
ttatggccttggtattcttgttacttctttttttcaatctttcaggttagttcccatggattctcctatcctaaaatttttccatcttctccattcttgatttagtattctagctcctggttttctttaatctgtttggcaaaaaaaaccccattttttatcactttatttcaaagccagctggtgaatcggtggtgatgaaaagattgtagtgtatatgtattaaggcggaagtaatttattcttgatcataaaaaagatggagaattattccggagttgttaaggatgatgatcagatggagttgccacctggatttcgattccatccaactgatgaagaattgattactcattatttgtctaacaaagttgtggatactaatttcattgctattgctattggtgatgttgatttgaacaaagttgaaccatgggatcttccatggaaggcgaaaatgggggaaaaagaatggtattttttctgtgtgagagacaagaagtatccaacaggggctgaggacaaacagggcaactgctgcagggtattggaaagctactggaaaagacagagagatttacagaggaaaatcattggttggtatgaagaaaactctggttttctacaaagggagagctccaaaaggtgaaaagaccaattgggttattcatgaactttcagattagaaggaaaattgtctcttcacaatctgccaaagacagcaaagaatgaactgcgtgatctgcaagagtgtttccaaaggaccagtggtggcaaagaaaattccacatttcagggcttttctggaacattgcatttcctaatgacaatgaaatcggggaatccattcagcgccaccaattgaccagattctcggcactggttcgaaaatcacagcacgtgccactggctttcttccaattgtctcactggttcaaaacaactgtttcctcttctgcacatccaatggatagttcccaacactctcctagtttcaatacctttcttgtaaccaattgccctttcattacaaatactcagtcattg

SEQ ID NO: 14411 - DNA, 1163 bp, Solanum tuberosum
  Predicted polypeptide sequence is orthologous to G536
actctagaaataaaagtaaaaacaaaatcctaaaatctctctactcctctcaattcaaaaaaagccctctttctctcaattttaaattcaattcagaaaatcgaaaaactctctcatttcattcagatctcaaaaaacttatttccgagaacacagagaaaaaaaatctaaacatggcggtggcaccgacggcgcgtgaggagaacgtatacatggcaaagctggcggagcaggccgagaggtatgaagagatggttgaattcatggagaaggtctccaactcccttggctcggaagaactaaccgtggaggagagaaaccttctctccgtcgcatataagaatgtaatcggagcgcgtagggcatcgtggcgtatcatttcatcgatcgagcaaaaggaagagtctagaggaaatgaggaacatgttaactctatccgcgagtacagatctaagattgagaatgagctctctaagatctgtgatggcattctcaaattgcttgattctaagcttattccttctgcaacatctggtgattctaaggttttttacctgaaaatgaaaggagattaccaccgctatttggctgagttcaagaccggtgctgaacgtaaggaggctgctgagagtactctcactgcctacaaagctgctcaggatatcgcatctgctgagcttgccccaacacatcccatccgacttggactggctcttaacttctctgtgttttattatgagatcttgaactctcccgaccgtgcttgcaaccttgccaaacaggcctttgatgaagcaattgctgagttggacacattgggagaggagtcttacaaggatagcactttgatcatgcaacttcttcgtgacaatctcactctctggacctccgatatgcaggatgatggggctgatgaaatcaaggaagatcccaaacctgaagaaaaaaattgaggggaattgaaaccctctaatttgcttttcacttctcccccagttgttttaattgggagaagctgattatcataatttccttgctagtattatgattttccattaagaggttctcttcttattggcaaaaaacaacttttatattgatgttttaaaagttccatcttttaatttaatgtggttcttgaggttaaaaaaaaaaaaaaaaaa

SEQ ID NO: 14412 - DNA, 1107 bp, Solanum tuberosum
  Predicted polypeptide sequence is orthologous to G536
ggccgctcaaatattgaatccattatggcgcgtgaggagaatgtgtacatggcgaagcttgctgagcaagctgaaagatacgaagaaatggtgcagttcatggagaaagtttcaacttcattaggctcagaggaactcaccgttgaggaacggaatctcctttccgttgcttacaaaaacgttatcggggctcgtagagcctcgtggcgtattatctcttccattgaacagaaggaggagtcgaggggaaatgaggaacatgttaaatgtataaaggagtacagatctaagattgaatctgaactttctaatatttgtgatggaattctcaagctccttgattctaatctcattccttcagcttctaatggcgattctaaggtgttttaccttaaaatgaagggtgattatcatcgttatttggctgaatttaagaccggagctgaacgtaaggaagctgctgagagcactctctccgcctacaaagctgctcaggatattgcaaatactgaacttgccccaacacatccaatccgacttggactggctctcaacttctctgtgttttattatgagattttgaactctcctgaccgtgcttgcaatcttgctaaacaagcatttgatgaagcaattgccgagttggacacactgggagaagaatcttacaaggatagcactttgatcatgcaacttcttcgtgacaatctcactctctggacctctgatatgcaggatgatggtgctgatgaaattaaggaaaccaaacccgacaatgaacaacagtgagggaactggtcctcagattatcatttgacttcttcctggttgtttttattgggagaagctgcttctttttatttctttcacctgtgtttcaggtttccctttagcgttctcttatccatggcaacgaacaactttgaatattgatgttcaattgtttcatctttactttaatgtggttctttctggtgcttagtttctatgaaagcatttcagttgtatttgtgaactgaatttataaaatggtatgtcaaagtgatactcagcaatcgggtttcaatcaaaaaaaaaaaaaaaaaaaaaaaaaaaaaaaaaaaaaaa

SEQ ID NO: 14413 - DNA, 1106 bp, Solanum tuberosum
  Predicted polypeptide sequence is orthologous to G536
attttctcaactttctctctctaaaacccctctttctctctctagaacacagaaccatcaatggcgtctccacgtgaagagaacgtgtacatggcgaacgttgctgcaagagctgaacgctatgaggagatggtagaattcatggagaaggtcgtcgccgccttggacacggaactaaccgtcgaggaacgcaatcttctctccgtcgcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaaccgagagaaaagaagctgcagagaatactctttcggcctacaagtctgctcaggatattgctaatggcgaattggctccaacacatccaatccgattgggtctagctctcaatttctcagtgttttactatgagatattgaattctcctgaccgtgcttgtaatctcgccaaacaggcttttgatgaggcaattgcggacgttgacaccctaggagaggagtcctacaaggatagcactttaattatgcaacttctgcgtgataacctcactttgtggacctctgatatgcaggatgatggagctgatgagatcaaagaaccatcaaaagctgataatgagtagtaacaacgtgagtgaaacctctttgcttaggattgaaaaccgatgatgtaattttactcattgatcaaaattggctgtttgtagtccttatcctgtgatttgtaatacctattactaaaggcgctgtttcttgccatttgttgttttcatcaagattactttttgtctctgtatttcttttgtatttggatgctctgatgaaactctcttatttcgtggaaatgaatatttatttttacgaagcaaaaaaaaaaaaaaaaaactcgagactacttctctca

SEQ ID NO: 14414 - DNA, 1219 bp, Solanum tuberosum
  Predicted polypeptide sequence is orthologous to G536
gaattgttgagaaaggaagagattctaaaaaccgctctcactttctctctctagaaaaacaaaaaactctctttctctctctaatatcaatggcgtcgccacgcgaggaaaacgtgtacatggcgaagctcgccgagcaagctgagcgttacgaggagatggtagagttcatggagaaagttgtcgctgccgccgatggtgccgaggagttaaccgtcgaagaacgaaacctcctctccgtcgcgtataagaatgtgatcggagcacggagagcttcatggaggatcatttcctccattgagcagaaagaggagagccgtggtaacgaagatcatgttgcttccattaaggaatacagatctaagatcgagtctgaacttacctcgatctgtaatggaattcttaagctgcttgattctaagctcattggctctgctgctaccggtgactcgaaggtgttttacttgaaaatgaagggagattatcatcgttatttggctgagtttaagactggtgctgagcgaaaagaagctgctgagaatactctctcggcttacaaagctgctcaggatattgctaatgccgaacttgctcctacacatccaatccgattgggacttgctctcaatttctctgtgttttactacgagattttgaattctcctgatcgtgcctgtaatctcgccaaacaggcctttgatgaggcaattgcggagttggacacattgggcgaagagtcctacaaggatagcactctgatcatgcagcttcttcgtgataacctcactttatggacctctgatatgcaggatgatggaactgatgagatcaaagaagctgcacctaaaccagataataatgaatgagcagcagtaaaaactggtgaaatttctttaggattgaaatatgctatgttgtaacttctttttcatttgtctggattcagctctttgttagttctagatcttgtgatttgtaatacctaaaatcaaccgtttcttgttcaattgttgttcttgtttgtttctatgttgatttctcttgtattcggattatttcctttttctcaagggaatgacttattgggaagttggatctaccttttaatccacaaatttgttagcttctcctttttcatattacatggatataaattcaaaaactttgtgccaaaaaaaaaaaaaaaaaaaaaaaaaaaaaaaaaaaaaaaaaactcgag

SEQ ID NO: 14415 - DNA, 1020 bp, Solanum tuberosum
  Predicted polypeptide sequence is orthologous to G536
gcggcgctgtcagagacatcaatcaccaggtaactttacagacaacaaacatggccgattcacgtgaagaaaatgtgtacatggccaagttggctgagcaggctgagaggtatgaggaaatggttgagtttatggagaaggttgcaaaggtagatgttgaagagctgactgtggaggaaaggaatcttctttctgtggcttacaagaatgtcattggtgcaagaagggcttcgtggaggataatatcttcaattgagcagaaagaggagagccgtggaaatgaagaccatgttagcagcattaaagaatatagagtcaaaattgaggccgagctcagcaagatctgtgatgggattttgagccttctcgagtctcatttagtaccatcagcctcaacagccgagtccaaagtgttttacttgaagatgaaaggtgattaccataggtacttggctgagttcaagacgggggccagagagaggaaagaggctgcagagaacactttattagcctacaagtctgctcaggatatagcattggctgaactgactcctactcatccaatcagactgggacttgcccttaacttttcagtgttctattatgaaattcttaactcacctgatcgtgcttgtaaccttgcaaagcaggcctttgatgatgccatcgcagagctggatacattgggtgaggaatcttacaaggacagtacattgattatgcagcttctccgagacaatctcacactttggacctctgataccacagatgatgccgaggatgagatcagggaaggttcaaaacaagagtcgggtgatggacagcagtgatatctaagtagcctagtcttgtactccttattttgtgattttcgacgactcttcgtatcactgctgaagttgtttgatataaaaacaggttttagtctgataaaagaaacatgtttagtacaatttgtttgtgatgctattgcatcgccatttaataattagagttggaataaaaaaaaaaaaaaaaaaa

SEQ ID NO: 14416 - DNA, 992 bp, Solanum tuberosum
  Predicted polypeptide sequence is orthologous to G536
gatcttcaaaacaccaaaaggaaaaaagggaaaaaattctccggcggaaattaccggcgaccgacgatggccttgcctgaaaatttaaccagagagcagtgtttgtacttagcgaagctagctgagcaagccgaacgatatgaggagatggtgaagttcatggacaagctcgtaatcgggtcgggttcatcggagctgacggtggaagagcgaaacctcctttcggtggcgtataagaacgttatcggctcacttcgagcagcgtggaggattgtgtcgtcaattgagcagaaggaggaaggtaggaagaacgatgagcatgtggttctagtgaaggattacagatctaaagttgaatctgagcttagtgatgtttgtgctggaattctgaagattttggatcagtatttgattccttcagcttctgctggcgaatcgaaggtgttttatttgaagatgaaaggggattattatcgttatttagctgaattcaaagttggaaatgaacgtaaggaagctgctgaggatactatgcttgcctacaaagctgctcaggacattgctgttgcggagcttgccccaacacatccgatacgacttgggttagctctcaacttctcagtgttctactatgagattctgaatgcatcagaaaaagcatgcagcatggctaagcaggcatttgaggaagctattgctgaactggacactttgggtgaggaatcctacaaggatagcacacttatcatgcagttgttaagggacaatctcactctctggacttctgatatgcaggagcagatggacgaggcttgacatgataccgctcctccaggagggtgagttcaaatgtcacaacaacagtctgtaaaatctacctatgcaattgatagcttttgtaatttttatatgccctgcttactttgatgattttttcttgtcaacttccggttgatactttttatgattttaattttatttctctagcttcc

SEQ ID NO: 14417 - DNA, 965 bp, Solanum tuberosum
  Predicted polypeptide sequence is orthologous to G536
tgagaaaatcaattctctttcgcctaaattttctctctacttcatccatggcggctccaatccctgaaaatctcagccgtgaacagtgtctttacttagccaaactcgctgaacaagccgagcgctatgaagaaatggttcagttcatggacaaactagtcctcaattccacgccggccggcgaactcaccgttgaggaacggaatctcctctccgtcgcttacaaaaacgttatcggctctcttcgtgctgcctggcgtattgtttcctccattgaacagaaggaggaatcgcggaagaacgaagagcacgtgcatcttgttaaggagtatagaggtaaagttgagaatgaactttcgcaggtttgtgctggtatactcaagttactcgagtcaaaccttgttccgtctgctactaccagtgaatcgaaggtgttttaccttaagatgaaaggtgattattaccggtatcttgctgagtttaagattggagatgagaggaagcaggctgctgaagacacaatgaattcttataaggctgctcaggaaattgcactgatagatctgcctccaacacatcccataaggcttggtcttgcactcaacttctctgtcttttactttgagatactgaactcatctgacaaagcttgcagtatggcaaaacaggcatttgaggaagccatagctgagctggacactttaggtgaagaatcatacaaggatagcaccctcataatgcaactcctacgagacaacctcacactttggacctcagatgctcaggatcagttggatgaatcctgattggcatggtgtctctatttaggaatgggctctaaatgttgtttgctttgttgtgctgacttattgtataagaaaaaagacagcttcgcttgacatatgttatgtttgatatttgactagtggtggtttggtacttggaaatctaggtagattatttat

SEQ ID NO: 14418 - DNA, 957 bp, Solanum tuberosum
  Predicted polypeptide sequence is orthologous to G536
gagagagagggagagcagaaatggagaaggaaagagagaaacaggtttacttggctaggctggctgagcaagctgagagatatgatgaaatggttgaagcaatgaaggcaattgctaagatggatgtcgaactgactgttgaagagaggaatttggtgtcggttgggtataagaatgtaattggagcaagaagggcttcatggcggatattgtcttcgattgaacagaaggaggagagtaagggtcatgagcagaatgttaagagaataaagacttacagacagagggttgaagacgagcttacaaaaatatgcagcgacattttgtcagtgatcgatgagcaccttgttccttcgtccactactggagaatctactgtcttctactataagatgaagggagattactatcgctatttagcagagttcaaagcaggggatgatcgtaaagaggcatctgaacagtcacttaaagcttatgaggctgctactgccactgctagttcagatcttgctcctactcatccaatcagacttggactcgcgttgaacttctcagttttctactatgagattctgaattcacccgagagggcatgccacttggccaagcaggcatttgatgaagctattgccgaacttgatagcctaagtgaagaatcctacaaggacagcacccttatcatgcagcttctacgggataatctcactttgtggacatctgatcttgaagagggaggtgagcattctaagggtgatgagcgccagggagagaactagttgaagttcaagaggtgtcggcgaatcattgtgatgctggctcctcagagacatgttagcttgtggaaagtctttgtttttcatataatgttcagggattcatgaatcatgcctattggctttgtactttcttcctccatatacataaaacattcccagagtacttgtcattttcagt

SEQ ID NO: 14419 - DNA, 919 bp, Solanum tuberosum
  Predicted polypeptide sequence is orthologous to G536
gcaaaagggagagaatagaggaaaatctgtgtcttcagtacaaaaaatctttgatttcaatttgagagagatcggaaatggcttcttccaaagaacgtgagaacttcgtctacgtcgctaagctcgctgagcaagccgaacgctacgatgaaatggttgaagcaatgaagaatgtcgcaaacatggatgttgaattgactgtggaggaaaggaatcttctttctgttggttataagaatgtggtaggttctaggagagcatcttggaggatcttgtcctctattgagcagaaggaagaatctagaggaaatgagcaaaatgtcaagcgaatcaaggagtacctgcaaaaggtggagtcggagctcaccaacatttgcaatgatattatggtggtcattgatcagcatctaattccgtcatgctctgcaggcgaatcaactgtgttttaccacaagatgaagggggactattatcgttatcttgcagaatttaaagctggcaatgacaagaaggaggttgcagagctttcattgaaagcatatcagtcagctacaactgctgcggaggcggaattaccacccactcatcccattcgtctgggactggctttgaatttctctgttttctactatgagatcatgaattcacctgaaagggcatgccatctggcaaaacaggccttcgatgaagcaatatctgagctggacagcctgaatgaggattcctacaaagacagcaccttgattatgcagcttctaagggacaacctcaccttgtggacttctgatcttccagaggatgctgaagatgcccaaaagggagatgccacaaacaaagctggtggaggtgaagatgcagagtgaatgggcctaatggttagaactactatgtgtatttggaggtgtgaggaccaggatac

SEQ ID NO: 14420 - DNA, 835 bp, Solanum tuberosum
  Predicted polypeptide sequence is orthologous to G536
agaagaagaagaagaaaaagataaaaatctccatttttttcaactcagagagaagatcggaaaatggcttcatccaaagaacgtgaaaacttggtgtacatcgccaggcttgctgagcaagctgaacgctacgatgagatggtcgatgcaatgaagaatgttgcaaatctggatgttgaactgacagtggaggagaggaatttgttatctgttggttataagaatgtggttggatctaggagagcatcatggaggatcttgtcttccatcgagcagaaggaagagggtagaggaaatgagcagaatgttaagcggatccagaattaccgccaaaaagtagagtcagagctcaccgacatttgcaataatatcatgactgtgattgatgagcatctgattccatcatgtactgctggtgaatcaactgtgttttactacaaaatgaaaggggattattatcgatatcttgcagagttcaaaacaggtgatgacaagaaagaggtttctgatctgtctttaaaagcatatcagacagctacaactactgcagaagctgaattaccaatcacccatcccattcggttgggtttggctttaaatttctctgttttctactatgacgataatgaactcacctgaaagggcttgccaattggctaagcaggtttcgatgaaggcaatatctgacgctggatagcctcaatgaggacaactacaaagatggcaacctttaatttctggcagctttctgaaggggaccattctcaccttgtggaacgtcttgaacattccgagaaggattggacgaacgagggtctaaaggggagatgctgca

SEQ ID NO: 14421 - DNA, 839 bp, Solanum tuberosum
  Predicted polypeptide sequence is orthologous to G536
ctctcttcttccgtcagagaaccaggtgtaatttcacatacaacaaaaatggccgactcttcgcgtgaagaaaatgtgtacttggccaagctggctgagcaggctgagcgatacgaggaaatgattgagttcatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaacactattaaagaatacagaagcaaaattgaggctgaacttagcaagatctgtgatgggattttgagcctccttgagtccaatttaataccatcggcctcaacagctgagtccaaagttttttacttgaagatgaaaggtgactaccataggtacctggctgagtttaaaacagggacagagaggaaagaaagcgctgagaacgctttgttggcatacaagtctgctcaggatattgcttttggctgaactggctcctactcaaccaatcaagctggacttgcccttaaacttttccggtgttcctattaatgaaattctcaaatcaccttgatcggtgcttgtaaccttgtgaaaccaggcatttggactgaaggcatcttcaagagttgggattacactggggtgaaggaattccttaccagggacagtacattgagtcatgcaacttaactccgaggacgaatcttcacgtcctttgggacttccggaccaattggggatgatgccgggggatgaatatccagggaaagcttcaaaaa

SEQ ID NO: 14422 - DNA, 670 bp, Solanum tuberosum
  Predicted polypeptide sequence is orthologous to G536
tttttttttttttttttttttttttattttttttttttttaaaagggaagctagagaaataaaattaaaatcataaaaagtatcaaacggaagtttgaacaagaaaatcatcaaagtaagcagggcatataaaaattacaaaagctatcaattgcataggtagattttacagactgttgttgtgacatttgagctcaccctcctggaggagcggtatcatgtcacgcctcgtccatctgctcctggatatcagaagtccagagagtgagattgtcccttaacaactgcatgataagtgtgctatccttgtaggattcctcaaccaaagtgtccagttcagcaatagcttcctcaaatgcctgcttagccatgctgcatgcttttcctgatgcattcagaatctcatagtagaacactgagaagttgagaagtaaacccaagtcggatcggattgtgttggggcaagtccggaaacagcatgtcctgagcagttttgtaggcaagcatagtatcctcaacagtttccttacgttcatttcccaacttccgattcacgttaaattacagataataattcccctttcaactctccaattaaaacaactttcggattcgcccagggagaaagttgagaggagacccaatcctggatcccaaaatctttcaaaaa

SEQ ID NO: 14423 - DNA, 1067 bp, Solanum tuberosum
  Predicted polypeptide sequence is orthologous to G536
cactttctctctctaaaacccctctttctctctctagaacacagaaccatcaatggcgtctccacgtgaagagaacgtgtacatggcgaagcttgctgagcaagctgaacgctatgaggagatggtagaattcatggagaaggtcgttgccgccttggacggcgaggaactaaccgtcgaggaacgcaatcttctctccgtggcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaaccgagagaaaagaagctgcagagaatactctttcggcctacaagtctgctcaggatattgctaatggcgaattggccccaacacatccaatccgattgggtctagctctcaatttctcagtgttttactatgagatattgaattctcctgaccgtgcttgtaatctcgccaaacaggcctttgatgaggcaattgcggagcttgacaccctgggagaggagtcctacaaggatagcactttgattatgcaacttctgcgtgataacctcactttgtggacctcagatatgcaggatgatggaactgatgatatcaaagaaccatcaaaagctgataatgagtagtaacaacgtgagtgaaacctctttgcttaggattgaaaaccgatgatgtaattttactcattgatcaaaattggctgttcgtagtccttatcctgtgatttgtaatacctattacctaaaggcgttgtttcttgccatttgttgttttcatcaaagattactttttgtctcagtatttctgttgtatttggatgctctgatgaagctctcttatttcgtggaaatgaattcttatttttacgaagca

SEQ ID NO: 14424 - DNA, 395 bp, Solanum tuberosum
  Predicted polypeptide sequence is orthologous to G546
gggccgagggtctgagtgtgtttgacggcgtttgttgacggagaagaagttagacaattgatgacgtgtaaacatatttttcatttttcttgtattgataaatggctttgttctaaatcaagttgtcctgtttgccgtgctgccgttaccgttaaacggctaaacggccggcggtgagtttcgatgatgatttccggcaaggtttgccggattctgctgcgttagtttgattgttgtaatgcattttttacattttgttcggatgtgcaactgaatttattactttcgatttcgatttatgtatatatatgtgaagaattagattatttacatatttattttgaattaatgaatttaaatcttgaattcgttttaataaaaaaaaaaaaaaaaaa

SEQ ID NO: 14425 - DNA, 525 bp, Solanum tuberosum
  Predicted polypeptide sequence is orthologous to G550
gtgatcattccgatggatcttcggttacagctgtaagttcaaaggataatgataatggattacctaacactccaaggaagaactacaacagctttccaactcatttaccttgctttactgaagctccttggccatatatatggagttctgtgcactgtagaaatgcagtacctccaccgggttacttcccttcctggcattcctatgccgttcttccctgcaaccacttattggggttgtacaataccaggttcttggaatgtcccttggatgttcccacccactgcatcccacaaccaaatgcctctaactcctggtcctgattctccaacttcggggaaacattcaagggatgagactgtgctgaaatcgaaaggcactgaggaagagcaacgaaaagagagtgatcctgggaagcgtctatggtttcctaaaacgttgcgaattgatgatccaggagaagctgcaaagagtcctatctgggcaatattaggaataaaacattgaggttggtgattcagttgg

SEQ ID NO: 14426 - DNA, 770 bp, Solanum tuberosum
  Predicted polypeptide sequence is orthologous to G558, G578, G629, G1198, G1806
taacaagatttgatgattctgctgtcttattttagctttttggcaaagcttgagccttttgctatagacccttttcgtctcttgaactaagatactacatctgatttttgttccaatttcaattgattacccacaaagttggctatagtccatgatggctgatatcagtcctagtacatcaacagatgccgatactgaagataagaacaggttcctaaatcaacaactgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggcaacagggaatatttatttcaggttcaggagatcaatcgcagtcgatgagtggaaatggagctttggcatttgatgtagaatatgcccgatggttggaagagcagaaccgacgaattaatgagttaaggggagctgttaattctcatgctggtgatgctgaacttcgcataatagtcgatggaatcttggcacactatgatgacatattcaggataaaggcggatgcggcaaaggctgacgtttttcacatattgtcgggcatgtggaaaactcctgcagaaagatgcttcttgtggcttggtggattccgttcatctgaactcctcaagctactcattaatcaagttggagccttttacccga

SEQ ID NO: 14427 - DNA, 1477 bp, Solanum tuberosum
  Predicted polypeptide sequence is orthologous to G558, G578, G629, G1198, G1806
gtttgggtatatcaagaagtgtaaatattaggatttttctaccattaatttgattcaaaattgaatcttgataagattttctttatcttctttcacacaaaattgaattcatttgggtttttcggttgagctgagattttgctgttggccttaaaagtccgtacaaatgaattattcaacatacactcagtttgttgcctcaagaaggatgggcatatgtgagccgatccatcaaatgggcatgtgggatgatttcaatgctagttgtccgagtacatcggcaaccatgattctagaagttgagaaatgcctagaggaccagatacctattatagacaaaagattagacattgagacagaagatacttcgcatggaacagtagggacttctaatagatatgaagcggaaacaagtaaacccattgagaaggtacttagacgtcttgcacaaaaccgcgaggctgctcgtaaaagccgtttgcggaagaaggcctatgttcagcagttagaaaatagtaaattgaagctgattcaattggaacaagaactagatcgggccagaaaacagggtctgtatgtaggtgctggtttagatgctagccagctaagttactctggaactgctagctcaggaactgctgtatttgatacagagtatggtcagtgggtggaagagcaaaatagacaaacaaatgatttaaggaatgctctgcatcattctcaaattagtgaagcggaattacgcattatcgttgatggttgcctgaaccactactttgagctcttccgcgttaaggctacggctgctaaagctgatgtcctatatatcatgtctggcatgtggaagacatcagcagaacgcttttttatgtggattggggggtttcggccatccgaacttctaaaggttctcacaccacatcttgagctcttgacagaacaacaactccgggaggtttgtaacctcaggcaatcgtgtcagcaagcagaagatgccctgtcacaaggaatggtaaaacttcatcagattcttggtgaggctgttgcagctggccgattaggtgaagggaattattctcttccgcagatggggcctgccattgagaagttggaagctcttgttaggttcgtaaatcaggcagatcatctccgccaagaaacacttcaacagatgtcccgcatcctgaatacgcaccaagcagctcagggcttacttgccttgggggagtactttgaacagcttcgtgttttaagctcacactgggctacccgtcttcatgagcctgcctaatgatgcaatagaagatcccttagtacaccattcgacgagttttgccttcagaaattatactatgtaagctaaaatttagctcttgtttatgtcaataaagctctcaatatgaatgtaggacattaaactagttgtacaaagggtttccgagagtctattgtggcttatgtttccgagcaacttttg

SEQ ID NO: 14428 - DNA, 1466 bp, Solanum tuberosum
  Predicted polypeptide sequence is orthologous to G558, G578, G629, G1198, G1806
ggaattttgattttcaagattccattcaatttttcttctatgggtgtttagaaggatttaggcttttagagttttgaagtggggaaaaaaaggtttcttgaagactttgctgttgttggctttaagtccaaaggcaatgaattcttcaacatatactcaatttgttgcctctaaaaggatgggtatatgtgacccaatccatcagattggcatgtggggagatttcaaaggtagcagtttcccagataccttgattcttgaagtcgagaattgcctagagaacgagatgcctattatggagaaaagactagagaatgagatagaggaaccatcacaagtgactgttggaatgtctaacagatatgaacctgaaacaactaaacgtattgataaggtgcgtagacgccttgcacaaaaccgcgaggctgctcgtaaaagtcgtttacggaagaaggcctatgtccagcagttggaaaatagtaaactgaagctgcttcagttggaacaagaactagaacgtaatagacaacagggtctgtatgtaggtgatggtttagatgctagtcagataggttgctctggaaccgcaaattcaggaatagcttcttttgaaatggagtacggccattgggtggaagagcaagatagacaaacagatgatttaaggaatgctctgaactcccaaatgggtgaaatagaattgcgcattcttgtcgagagttgcttgaatcactattttgatctctttcgcttgaaagctacagccgcaaatgctgatgttctctaccttatgtctggcacatggaagacatcagctgagcgtttcttcttgtggattgggggatttcgcccctccgaacttctaaaggttctcacgccacatgtggaaccattgtcagatcaacaaatccaggaggttagcaacctcacccagtcttgtcagcaggcagaagatgcgttgtcccaaggaatggtaaaactccatcagattcttgctgaggctgttgcagctggtacactaggcgaaggaattatccttccacagatgaccgctaccattgagaagttggaagctctagttagatttgtaaatcaggcagatcatcttcgccaagaaacccttctacagatgtcctgcatactggctgcacaccaatcagctcagggtctccttgccttaggagagtactttaaacgtcttcgtgctcttagctcactttgggctggtcgtctttctgaaccggcttaaagaagtaagaaacaaccattatatatgctacctggggttttcaactttgccaatcaaagctgtgtgaggtaaaatctgcctcgtgttgctcgtaaaaactatgagttggcgctcattcagacactacaaatctgtatataagttctgctatgctgtaactggaacttggaaattgcgtttattttcttttcacattggttttgatgattgtaaatca

SEQ ID NO: 14429 - DNA, 975 bp, Solanum tuberosum
  Predicted polypeptide sequence is orthologous to G558, G578, G629, G1198, G1806
ggatcggggtcaatggggcgatcaataagacctatggcctaggcttgtgacctccattgcactttggaggggtgcttgcctaaggtcggcccaagtggtcgagcctacgtcataatttgttacagcgggggcctgcgttcgcgcggcccctgcccaaatccttggcggagacattagctaacggatctcctgctactgaagggtcatcaggagatgtagctaattatatgggtcagatggcaatggctatggggaaattagggactcttgaaggttttctccgtcaggtaactctatttttgctgctgcttcctattctttgtttgtttaaattgtttacaatagataagctgcaaatgctcgttcagttgtttgaacatgtggaagtcgggggcaagcaaatgttgttctggaggtctttgtaactgcaaccagcatgcattgcccacagaatcttcagaatgtcttgtttgtattggtctttggacaaaaagtctggatactttgtcctcttgtatgtcctttaatgaggtcataaaataactgaagggttatgttcgccaacacattcttaaatcaacaattgtccttctgtctcatacttgtaactctcttgtgaattatatgattcaagacagccagtcatgttcagagatttctggtttgttatattagttttatgtcgtctctggaggcaaaatacgtgaagctaaaagtcattgcatctttctgactcttttaacaggcggacaacctgcgtcaacaaacattgcaacaaatgcatcgcatattgacaaccagacaatcagcccgtgctctacttgcaataagtgaatacttctcacgtcttcgagctctcagctctctttggcttgccagaccacgagagcaataagtatgacatgcatcgcaatactctactgaaactcggatatactacttcgatacactggccagtatatgagatccagctaa

SEQ ID NO: 14430 - DNA, 980 bp, Solanum tuberosum
  Predicted polypeptide sequence is orthologous to G558, G578, G629, G1198, G1806
gtttagcacaaaatagagaagcagcaagaaaaagcagactaagaaaaaaggcttatgtacaacaactagaaacaagtaggataagacttgctcaactagaacaagaacttcaaagggctagatctcaggggattttcatgggaggtggtgctactggtcccaatatcagctctggtgcgtcgatgtttgacatggaatattcaaaatggttagatgatgatcagagacaaatatgtgagctacgtacagcattgcaagcacatttaggagatggtgaacttagaataattgttgatgcttatattgctcattatgatcacatttttttactcaaaggagttgctgccaaatccgatttctttcacctcctcactggtatttgggcatctcctgccgagcgcgggttcctttggcttggcggttttaggccctctgaccttatcaagatgttgattgcacaattggaccctttaacacaacaacaaattgttggaatttatagtctccaacaatcatcacaacaggctgaagaagcactttcacaagccttagaacaattaaaacaatctttaattgaaattctagccactggttctgtcaatgatggcatgcatcatatggctattgcattgggaaaacttgccaatctcgaaagcttcgtttatcaggctgataacttgaggcagcaaacgatacaccaattgcacagaatattgacaattagacaagcagcaaggtgtttcatgatgattggtgaatattatggtcgattaagagccttaagttccctatgggcatcacgtcctagagagactatgatggcagatgacaactcttgtcaaacaacaagtgagttgcaaatgatacaagcatcacaacaccatttctcaaatatgagatgataattattcatttctgatatctctataatatatattaattaatattactcttttatctgtaaatgtataaatcatttt

SEQ ID NO: 14431 - DNA, 994 bp, Solanum tuberosum
  Predicted polypeptide sequence is orthologous to G558, G578, G629, G1198, G1806
cccttcttctttgtataattccataattcaattttaattttcttgaaaaactccaatttgcagaagagtttctttgtacttatgaacagtctatgaacatgagttctacatcaactcaatttgcccccacaagaaggatgggcatattcgaaccgttccaccatatgagtatgtgggaagacgcgtttagaggtgacattatgcccagtgttggtgcgtgtatggtcacaccggcaaatgacagggcagatgacaagtcgggatatacttctagtgaccaacttataccctctggctctgaggataatcaagcaggaaagagtgtttcagacaaggtacagcggcgtctagcacagaatcgtgaagctgcacgtaaaagccgtatgaggaaaaaggcttatgttcagcagctcgaaaaaagtaatttgaagctagcacaacttgaaatggaacttgagagagctcgacagcaaggactgtacattttaggttcaaatggtaatatgggcctaagttcaacaattaatccaggaatagctgcatttgaaatggaatatagtctctgggttgaagagcaacaaaaaaagaacgtagagttgaggaacatattgcaatcccatgtaagcgaagtggagctccagttgctggtagaaaccgtcttaaaccactactacaatctcttccgaatgaaagctgatgctgcaaaagctgatgtgttttacttgatatctgggatgtggagaacttcggtggaacgctttttcctctggattggaggattcaagccatctgaactcataaatatcgtgatgccacaacttgagccattgtcagatcagcagatcgtgaaaatctgtaatctgcgacactgttgtcagcaagctgaggatgctctcactcagggaatggataaacttcagcagactctggcacagaacatcctaactatgaccactggaacgggaaagtacagttctcagatggtttctagtat

SEQ ID NO: 14432 - DNA, 844 bp, Solanum tuberosum
  Predicted polypeptide sequence is orthologous to G558, G578, G629, G1198, G1806
cattcacacaactttcccaaaagtggagcaaaagctctagtataatagtcatgggctgagctcacagaacatttagctgaatggatgcaatgggtgatcgggaaggccctaggcttgtgagctccactgcactttggaggggtgaccgccggccagcacaagtcgtccaagcatcgcagttggagcaaaactttcagcgagcacctcaacagggcgaaagtgatgccgttctgcagggcccttaccatttgatatagaatatagtctatggttggaagaacacaccaaacacatcaatgaattgaggattgctgtcaattcacatgcacgtgatcctgaactgcgaagtattgtggatagtgtcattgcacattacgatgatgtctttagggtgaaaggaaatgcagccaaggcggacgtattccatgtcttgtcagggatgtggaaaacccctgccgagcggtgttttatgtggattggtggcttccgcccctcggaacttcttaagggcctgtagcatttgatgcagaatatagtcgatggttggaagaacacaccaaacacatcaatgaattgaggactgctgtcaattcacatgcaagtgatcctgaactgcgaagtatggtggatagtgtcattgcacattatgatgaggtctataggatgaaagcaaatgcagccaagggtaacatagagcatctcttgtcaggaatgtggaaaacccctgctgagcggtgttctatgtggattggtgacttccgcccctccttactgcttaagcttctagtcattcaggtggagcctctgaccgaccaacagataattggcattgtcaacttgcagc

SEQ ID NO: 14433 - DNA, 755 bp, Solanum tuberosum
  Predicted polypeptide sequence is orthologous to G558, G578, G629, G1198, G1806
atgagaattttttttccattaacaaacaacaaacatcaattgcaaccaacagccagaaggatgatacttgtacatacaatgaacaacgattaactaaggaccatcttcgaataggtaactaacacacctagtacaagaaaatagctaagactagataatagtatacagataactaattgtgctcaagatatctcgaggcaatgtgagtcgagatagtacacgagtactatacgtttgtcattgtgtgattccgagtgaaagacttttgaaagttgtgaactactatataatgacttatcttcacaatttcaaaggtgtaggaaatgactatgaataggaggaaccttgtagggatgagtacggcgtactagagttggtctttggggcgtgctaaccacaacgagctgagtgctcgaagccttgacatgtaatcacttatgacaaggagggctcgagcagcttgacgagtagtcaagattcgatgcaattgttgcaaagttcgttgtcgcagaagatcagcctgatgaaggaagctctcgagagtggcaagctgcctcattgcaattgccatttgccccatatagtcagctacatttcctgagccagtagggccgagagacgtagatgaaagtgtatcaacgagtaattgttgcagggcttccataccttgtgatagggcgtcctcggcttgctgagaagactgttgcaagttacatatgcctatgagctgctgttctgtaaacggttcaagatgg

SEQ ID NO: 14434 - DNA, 799 bp, Solanum tuberosum
  Predicted polypeptide sequence is orthologous to G561, G562
gttcttttatataatatgtactccatattttattattctatctagaaaaagagaaagtagatacaaaatgcagaaagtttgagacaaaaactgcaaaattccatcaattaaatctcaatttaagttggcataataatcttggttagcgtacctccaacaacaactacgcccaagtcccaaacaagttgtgatattgttagtacctccgaaaggaaataatcatctcagcagtgaattagtagagtgtctagttgctttctgacacatgggaagtattgaggatgggaagtcttctacgcctgagaaatcattttcgactgcacctgatcaaagcaattttcatgtgtatcctgattgggctgcgatgcaggcatattatggtcatcgagtagctgtacctccatatgttaattctgctgttgcacctggtcatgctcctcatccttacatgtggggcccgctaccgcctatgatgccaccttttggcacaccatatgcaggagtctatgcacatggtggtgtttatccgcaccctggagttcctattgtgtcccgtcctcaggcacatggaatgacatcatctcctgctgttagccaaaccatgaatactgcttctttgagtatggatgcttctgctaagtcttcggggaactctgatcaaggcttgacgagtcagtcaaaagggtttaatgggcttggaatgtcaattggaaatttcagtgttgacaatggtgatggcactgaccatggaccttctcagagtgggcaaactgaaggggtcagtgatggaagtacatac

SEQ ID NO: 14435 - DNA, 997 bp, Solanum tuberosum
  Predicted polypeptide sequence is orthologous to G561, G562
gaaacttttcactactaaaattcgccttctcttctacagtcttaagggttgcttttctgtacttagttgggacaacactcttatcagtgactacaaaaggaaattctgattgcacctctaatttagttcgacatctacttggttccttatacatgggaaacagtgaggatgggaaatcctgtaagcttgagaaaccatcctcgcctgcaccggaccagagcaatctccatgtctatccggattgggcagccatgcaggcatattatggtcctcgagtagctgtacctgcatatttcaattcagcagttgcacctggtcataccccccacccttatatgtgggggccacagcctatggtaccaccttatggtgccccttatgcagcaatatatgctcatggtggggtttatgcacatcctggagttccaattggatctcatcctccaggtcatgtgattgcgacatctcctgttgtcagccaggccatggatggtgcttctttgagtttagatgcgtctgccaagtccttgggaaattctgatcgaggcttgatgactaaactgaaggaatttgagggcctggcaatgtcacttggaaatggcagcactgacaatgttgagggtggaacagacaatggacattctcaaagtggggaaactgaaggttcaactgatggaagtgacacaaatggagctggggtcagtgagagaagtaagaaaaggagctgtgagacaactcctgataactctggtgatgataagagtcactcacgaagatgtcaaccttctggggaagtaaatgatgatggtgagaaggcaatcgttattgcagcgaaaatgacgggaacagtactttctccttgcatgacaactttggaaatgagaaatcctgccagtgcacatatgaaatctagcccaactaatggttcaccactcagccctgcactgccctatgaaaccctggtacagaatgagcgtgagctgaagcgggagaaaag

SEQ ID NO: 14436 - DNA, 789 bp, Solanum tuberosum
  Predicted polypeptide sequence is orthologous to G561, G562
gtccaactaaagaaccagtaggatgtattatgtaacatcataaacatactacatttatttatcaaatatgaagttcactccaacattaaacttacataagctattatagccacattcaactcaaaaatgaaaaaaaaggaaaagagcaaacatcggttctactgacctgtaaactacaattaggtaggtaaaattagaaatcttgcaacgtccgtaatcctattcagctgttcctctcccgtagttagcagtaattttggacttaaaattaccccaaaattacacaatcagactaaattttaacatctcaaattaaagtaagggttgtacccttcatcacccagctgctactgcatcacttctggggctgggatcaagtagttgatgaagctttgctccagagctgttgttctcataaacttcaccctcctcgtttgttgtatccgaggaacctgagttgttcactcttgctagcaggtttactgtgcctacaggttgcagtctcttatcatcaatcttacctaaactcacttcttttgtctgtcctagctcttcatttttcagtctctccattaaagcagcattatctagcttcagtttctccgagttctccattaatttgttaatctcggatctgagtgtcaagttctctcctgttaaagcctgaactcgtattgacaattcttcagcttcagcctgttttctcaatcttgatcgccttgcagattcccgattagactgtttccttttctcccgcttcagctcacgctcattctgtaaccaggtttc

SEQ ID NO: 14437 - DNA, 838 bp, Solanum tuberosum
  misc_feature (752)..(752): n is a, c, g, or t
  Predicted polypeptide sequence is orthologous to G565
acatcttcctacatttgggctctactgtctgaatctcccacagatatcgcctcaaaatgcaagatccgtcgaatccaaactccaagcagctcaatcagacgcagccattttcggctacattcaggccatcgcaccaccgcagagctcactcggaggtgaacttccggctccctgaggatctagatctggtatctgacccattcgatgcatccgccggaagtttgaggagatcgggatccgaggacgatttcttctccacttacatggacattgaaaaacttggctctggatccaaccctacagatgttccagggttcaacaatgccggcgcaggaagtagtggactcgtagctgactgtggtgatggagaaaggaatttcactaggcctcgacacaggcatagcaattcggtggatagttccagcttgctgctaagtgagagtattgaagctaagaaagctatggctcctgataaacttgctgaactttggaccattgatccaaaacgcgccaaaaggattttggcgaatcggcagtccgcttctcgctcgaaagagagaaaggcccgttacattactgaacttgagagaaaggttcagacccttcaaacagaagcaaccactctctctgctcaattaaccctttccagcgggatacaacacagtttactaagtgagaatacggaggctttaagcctcccgtttgcaagcctatgggcacaaaccaagccttcacgttaccggtgaattgcntcttgaaattgagagcccttgaaaagcaggaaagttgggaaacgactttaaaattggccccccagggggcacaatgtcctcttcag

SEQ ID NO: 14438 - DNA, 985 bp, Solanum tuberosum
  Predicted polypeptide sequence is orthologous to G567
gatatttattggcttaaaaaacttaaaaaagtcttagttttttttttctttttccggagagaaatatggatagagtattttcagtggacgatgacattggcgaccatttttggtcgacgccgccgacggcggagttgggcgttgattcacctacctctgccgccaccgccgccatctcctactcgaagatgatgaatcgcagctcttccgaatgggctttccagcgtttcctacaagaagccgccggtacgaccacttcatctcctcctctgccacctacaatggcgtcttcgtcgtcatcttcacaccaaaacgatgttgtcgagatcaaggatgagaatctttctactcctaatctcaattccagtacggcgttgaattcgaagccggcagcgacgtcgtttgcctctgcacctccgcagaatattcccgttgatgctgaagagtatcaagccttcctcaaaaatcgcctcgatttggcttgtgctgcagtcgcattgactcgggcgaagaatctaaagcctcaagattcaagttctattgcacctgataaaggtccagagactgctagtgcatcacaatcagtatctcacatctccactaaaggatctggtcaggaagtgagaaaagttcaagataaggattctggtggaccagttggaataccctctttaccctcagtgcagaagaaacctgtggtgcaggtgaagtcaacaactagtggttcatctagagagctatccgatgatgatgaagctgaaggagaagcagaaacgactcaaggaacggatccagctgatacgaaacgcgtaaggagaatgctttcaaatagagaatcagccagacgttcaaggagaagaaagcaagcccatcttacagaacttgagacacaggtatctcaactgagagtagaaaactcctccctactgaaacgtctgactgacataagccagaaatacaatgaatcagctgttgataatcgtgt

SEQ ID NO: 14439 - DNA, 912 bp, Solanum tuberosum
  Predicted polypeptide sequence is orthologous to G583
acatagaattatactagatgcttaatacatactaattaattctcaataacacttaattttgagatgatagcagatttcaacatttcctcatttaaaaactcttcaggaaccctaatcacgatatcttgaagcaacaaatctttaacactggaaatacttgcatggtaaatctgaaatttcagttctttcatcgcgttcatcaatctcgtacatggataattcatatccaaagattgaacccgaatcacaccttcagatccaataattttcacttcaatttccatcccatttcgtgccccgttgctggaaaataatgacttattgtttgccccatgatcagttacaataatagaggacgcactatgagaatcgtgttgttccataagtatatgttttttctggggattgattaatttggattctaagttttttattttagctttaagttcattgatataagtaacagcgtcacctagcaatgaagctttgtccattttggacacgtatgggactacgctccgtagagcgtagaatctatggtttaacttttcccttctttttctctcggcctctacgtgaacatccatagccatttctcgacttatagtgctcgaatcacccttctttcctcgtttaattgaccgattgacaacgttgttgatggttgaagagtcatcattttcgaaatcagaattacccgattcagataatagatttccaatagccatttcttgctttactattatatcttcttcttggttggggtgatccaccttttgcaaccttatgatgatctcccaatgttacttgattgacgggtagatgagaagtcgtattcatgttattgtttgatccaaatagagacctaatgaattgaacaaattcccaattttcttgaataatatcagagga

SEQ ID NO: 14440 - DNA, 2141 bp, Solanum tuberosum
  Predicted polypeptide sequence is orthologous to G583
atgacggactatagattatggagtaatagtaatactactaatacatctgatgataatatgatgatggatgcttttttatcttccgatccatcctctttttggcccaatcgaacctcgatttctccgactccggtgaacggaggagtgggagagacgatgccgttttttaatcaagaatcactacaacaaaggcttcaggctttaattgacggtgctcgtgaatcatgggcatatgctattttctggcaatcatcgtcgacgtcggattttgcgaccccatctgtgttgggttggggagatgggtattataaaggggaagaaaataagaacaagcgtagagcgtcgtctagttcaactaattttgttgctgagcaagagcatagaaaaaaggtgcttcgtgagctgaattcattaatttccggtgtacaggccaccggcgccggaagtggaggtgatgatgcggtggatgaagaagtgacggatactgaatggttttttctgatttcaatgacccaatcgtttgctaatggaaacgggcttccgggcttggcgatgtacagttcaagcccgatttgggttactggaacagagaaattagctggttctcaatgtgaacgggccaggcaagctcaaggtttcgggcttcagactattgtatgcattccttcagctaacggtgtagtcgagcttggttcgactgagctgatattcgaaagctcggatttgatgaacaaggttaaatatttgtttaacttcaatattgatatgggctctgttacgggctcaggttcgggctcgtgtgctgtgcatcccgagcccgatccttcggccctttggcttacggatccatcttcctcagttgtggaagctaaggattcgttaattaatagtagtagtagggatgtgcaacttgtgtttggaaatgagaattctgaaaatggtactcaaaatcagcagcattctcaacaaacacaaggatttttcactaaggagttgaatttttcgggttatggatttgatggaagtagtactaggaataaaaatggaaattcttcgatttcttgtaagccggagaccagggagatattgaattttggtgatagtagtaagaaaagtggaagcttgttttcaggccaatcacagttcgggcctgggaccgggctcgggctcatggaggagaacaagaacaataacaagaaaaggtcacttgcatcaaggggaaacaatgaaaaaggaatgctttcgtttgtttcgggtgtgatcttgccaacttcaacaatggggaaatctggtggaggtggaaatttcgatcactcagatctcgaggcttcagtggtgaaagaggccattgtagaacctgaaagaaagccaaggaagcgagggaggaaaccggccaatggaagggaggagccattgaatcacgttgaggcggagagacagaggagggagaaattgaatcaaagattctacgctctcagagccgtagtcccaaatgtctcgaaaatggacaaggcatcacttcttggagatgcaattgcatacatcaatgagttgaaatcaaaggttcaaaattcagatttagataaagaggagttgaggagccaaattgaatctttaaggaaggaattagccaacaagggatcatcaaactattcctcctcccctccatcgaatcaagatctcaagattgtcgatatggacattgacgttaaggtgattggatgggatgctatgattcgtatacaatgtagtaaaaagaatcatccagctgcgaggctaatggcagccctcaaggacttggacctagacgtgcaccacgctagtgtttccgttgtcaatgatttgatgatccaacaagcgacagtcaaaatggggagccggctttacgctcaagagcagcttacgatagcattgacatcaaaatttgctgaatcgcgatgaaattatctcggtagtgagctctgtataatgtatcttttctgtatataaatgtgaaaccattactagagatctcaagttgaggctttttagttcatgtaagattagagatattatgcagcttcatccttttgtattcttcatccaggaaataaattatgagaaaccaataattggtggctgatgaaaaaaaaaaaaaaaaa

SEQ ID NO: 14441 - DNA, 2302 bp, Solanum tuberosum
  Predicted polypeptide sequence is orthologous to G583
atgactgaatacagcttacccaccatgaatttgtggaacaatagtactagcgatgataacgtgtctatgatggaagcttttatgtcttctgatctttctttttgggctactactaattctactactactaattctgcttctgctgctgtggttggcgtcaattcaaatcttcttcatactaataataataatccgtctgtttttcctctatcttcttctacatctgtatccgcggctgcggctgttgatgctaccaaatctatgccgtttttcaaccaagaaacccttcagcagcgtcttcaagctcttatcgatggtgctagagagacgtggacttacgctatcttttggcaatcgtcggttgttgatttctcgagtccgtctgtgttgggttggggagatggttattacaaaggcgaagaagataaagccaaaaggaaattagcggtttcttctcctgcttatattgctgagcaggagcaccggaagaaggttctccgggagctgaattcgttgatttcaggggcaccagctgggaccgatgatgctgttgatgaagaagttaccgacaccgaatggttctttcttatctccatgacccaatcgtttgttaatggaagtgggcttcctggtcaggcgttgtatagttccagccctatttgggtcgccggaactgagaaattggcagcttcccactgcgaacgggttagacaagcacaagggttcgggcttcagactattgtctgtattccttcagctaacggcgtggttgaattgggctcgacagagttgattgttgaaagttctgatctcatgaacaaggttagagtattgtttaacttcagtaatgatttggggtctggttcatgggctgtgcagccggagagcgacccgtcggcgctttggctcactgaaccatcgtcctcaggtatggaagttagagagtctttaaatacagtacaaacaaattcagttccatcaagtaatagtaataagcaaattgcttatgcaaatgagaataatcatcaatctggaaatggtcagagttgttacaatctgcagcaacaacagaacaatcctcctcaacaacaaacacaaggatttttcacgagggagttgaatttttcggaattcgggttcgatggaagtagcaataggaatgggaatgcatcgctctcttgcaaacctgaatcaggagaaatcttgaattttggtgatagtactaaaaaaagtgcttccagtgcaaatgtgaacttgtttacgggtcagtcccaatttggggcagtggaggagaataacaataacaagaacaagaaaagatcagctacttccaggggaagcaatgaagaaggaatgctttcatttgtttcaggtacagttttgccttcttcgggtatgaagtcaggtggaggtggaggcgaagactctgaacattcagatcttgaggcttcagtggtgaaagaagctgatagtagtagagtggtagaaccagaaaagaggccaaggaagcgagggagaaagccagcgaatggacgagaggagcctttgaatcacgtcgaggcagagaggcaaaggagggagaaattgaaccaaagattctacgcgcttagagctgttgtaccaaatgtgtctaagatggacaaggcatcacttcttggagatgcaatttcatatataaacgagttgaaatcaaagcttcaaaatacagagtcagataaagaagacttgaagagccaaatagaagatttaaagaaagaatcaaggcgccccggtcctccaccaccaaaccaagatctcaagattggaggcaagattgtagacgtggatatagacgttaagataatcggatgggatgcaatgattggtatacaatgtaataaaaagaatcatccagctgcaaggttaatggcagccctcatggaattagacctagacgtgcaccatgccagtgtttcagttgtcaacgatttgatgatccaacaagccacagtgaaaatgggtagcagacattacactgaagagcagcttagggtagcattgaaatcgaaaattgctgaaacccccttagaaagtagatagaaatcgtcaagggctttgaattaaccttgtgaattgtgttccaaggcaatgcttaaattaaaggatctaagtaatgtttttgtactgaagtttgagagattaagacgaagaagactatcttcgtgttatttttccaacttgtacatagatgttaagcccgattaatcgggctttagttcatgtaattaaagataaatttgcagctaaaaaaaaaaaaaaaaaa

SEQ ID NO: 14442 - DNA, 940 bp, Solanum tuberosum
  Predicted polypeptide sequence is orthologous to G583
gcttttagtactgggtttctattatatggttaactgggtgctcaacaacttcaatttcataactgtgaaagagctaaagaagctcatgttcatgggaattcaaacttttgtatgtattccaacttcaaatggggttcttgaattgggttcaaatcaacaaattaaagaaaattggatcttgattcaacaagttaagtccattttctcttcaattcctgatcttggtcttgtgacttgtttagaacagaacaccagcatcaacaacaacagtaaaaaaccaaaaacagaggaaactgaaactgaaacttcagattccgattgtcaagtactagtggagaaaccagtagagaagaaaacccgaagaagagagggagaaaaccaggggccaacacgcgaaacaccgttgaatcatgttgaagcaagagacagaggagggagaagttaaaccatagattctacgctctgcgttctgttgttcctcatgttaccaaaatggacaaagcttcattgtgatcacacgcagtatcgtatatcaatgaattacaatccaaagttactgaattggagggtcagtcactagaaaatccaagaaactgaaaatcgagtgtactgatagtattacttatagaccaacccattagtactggtaacaacttacaacaaacaaaactccaagtggtattcaaacattcgggcataaatttcatccgtcagcaggcatccattttggtgtcccacaaacaactttaaaagttgggaagtcgcaagtccacgattgttgggcctgcgattgccctggttaaagggtgaccaacctgaaaatggttatttacccatcacagcaaaattggttggtgcgtcttcaaatcttgaattctgtcccaggccttttcggtttaagatttgtacagacatgtggtgaattccttaaacggttgga

SEQ ID NO: 14443 - DNA, 918 bp, Solanum tuberosum
  Predicted polypeptide sequence is orthologous to G590
cacgcatacgattcttttgcgttttctgcagatgatcattttgtgatggtggttattgtcaatggcggatccgtacagaacgaaccctcacgctgcttcatctctcgaatccgaagatatgtcttccttttttcttaattttcttcaaggtacgtccgcttccgcttctgcgactgctgcggctggtttttataaccgatcggtaccggcgccggtggctgagtcatcttctagcctcaatttctccgatcccggtcgattttatgctgccgagttcaaggaaggcgttgagaatgtgtttgcttctgctggcctcggggattgtgacggtatgaattcagataataggagggagtttttggaagatgataaggttgataacttcggttttagtagcgaggagtgtgatggacttgacatgccatctgatccgactcatccacgttcctcaaagaggagtagatctgctgaagttcataatttgtccgagaagaggaggaggagtaagatcaacgagaaactgaaagcattgcagaacctaattccgaattctaacaaaactgacaaggcatctatgcttgatgaagccattgaatatctgaagcaacttcaactgcaagttcagatgcttaccttgaggaatggattgagtttatacccaggatatgttcccgggtctttgcagtcgatgcaactcccatctggtaatgaatttgatgggagaagttttatgctgagtgcaaatggaggagctacacttcctgtgaatcgagaaatgccacagactgcatttgatatttccaatcagaatccatcaggcaaaccaacaataacctcacataacacagaaaacgctgtagctttagaaactacaattcagaatcattatggagttctttaacatttagcatcttctaa

SEQ ID NO: 14444 - DNA, 946 bp, Solanum tuberosum
  Predicted polypeptide sequence is orthologous to G591, G793
acaccatcttatcattttacttgtaaagaacacttttttaagtagtatttgttcaattgaatgcttttctgagaaattaaggtggtcgaaaacagctccgatccaagaaagattgaatctttatagttctgctatggctaacaacccttctgagggaccttctgatgatttctttgaccaaatcatgggatttcctgcttacaatggagcagaaactaatttggcgggaaatgatgccggagctataccgccggcgatgatgctccagcttaactccggtgatgggtcgggtcaatttactggagtgggtcttggggttgggttaggtggtggggggttccatggtcatggtgggggtgcttcttttcctttagggttgagtttagaacaagggaaaggtgggttcttgaagatggatgatgtttcagcacctggaaggaggtttagagatgatgttgttgatagcagagcttcttcttctgtcaaacctggttttcatggacaacccatgccttcaatgccgcatccccctgcaatacgtccaagggtgagagctaggcgaggacaagctactgatccacacagcattgcggagaggttacgtagagagaggatagcagaaagaattagagcattgcaagagttggttcccagtgtcaataagactgatagagctgtaatgctcgatgaaattgtagattatgtcaaattcctacggctgcaagtgaaggtgttgagcatgagtaggttaggaggagctggtgcagtagcaccacttgttacagacattccaatatcatctgtagaggaagagagcagtgaaggtggaaataataaccaaccagcttgggaaaagtggtcaagtgatggcacagaaaggcaagtggctaaacttatggaaggaaatgttggtgctgcaatgcaatttcttcagtctaaggcacta

SEQ ID NO: 14445 - DNA, 936 bp, Solanum tuberosum
  Predicted polypeptide sequence is orthologous to G591, G793
taatttcgccgggtaaatctccggcatggcagcaaaccaaccggaagcctacgccgatgatttcctcgagcaaattctcgctattccttcctatggcttgccggttgctgatgttggcactccatcagagacgacgtcgtttacctcggcgtctgccgtatctcatcttaactctgccgctgctgctggcctacagcaacctatgttcccgttgggattgagcttggataacggccgtgatgacgtcagcgaagctggtgcttatgcagtgaagcatgaaagagatggaatgaatatcggaaatttatatgtaggtctagaacacttgcaatctcatgcagttcgtcactctctgccttctgttcaccatgtccagccttttcaaggcccaccaacaacgagcacaacagtaactgtaccgcagccaccttcaattcgtcctagggttcgagctcggaggggacaagccacagatccacatagcattgctgagaggctgagaagagagaggatatctgaaagaataaaggctttgcaggaactggtacccagctgcaataagacagatagggcagcaatgcttgatgagattctggactatgtgaagttcttaaggcttcaagttaaggtactgagcatgagtaggctgggaggagccagtgcagtggcacaacttgttgctgacattccattgcaatctgtggagggggacagtggtgaaagtagatccaaccagcatatatgggataaatggtccaatgtagacacagaacaagaggttgctaagctcatggaggaagacgtcggtgcagccatgcaataccttcagtctaaatcactctgcatcatgcccatatcacttgctgcactcatctatcctactcagcaaccggatgaccagtcactgggtcagcctgaagcggcagccccatcata

SEQ ID NO: 14446 - DNA, 749 bp, Solanum tuberosum
  Predicted polypeptide sequence is orthologous to G592
ggtcgactccgaaaagtttcaagactcaagttggattctcatccgggaaacctcctgcttctcccaggctaatggctccaatctctgaatttagagataaagtcttggaagaaaagagcacggggaatgaacataaaaacgatgagaactgcattacagatttccccatgccttcttgggaagattcacacattttgtccgacgatttcctcaaagctgaagacattgagattgagccatactctaatgaagatgcatcccataatcagaatagtgaagggctggctcgcccgccaattcccttatctcatcatttgagtttgcccacaagtatcatggagaagctcttgcaagattcagtacacttgaatgtcagagcaaagaggggttgtgcaactcaccctcgtagcattgcagaaagggtgagaagaacacgaataagcgacagaatgaggaagctgcaagagcttgttcccaacatggacaagcaaacaaacacagcagatatgttggattttgcagtagattatattaaagagctggagaaacaagtcaagatattagcagaaatgcgctccaaatgtacgtgcataaataagtaaaaagctacagatcaaaaggtgaaagtaggatgaaagggaaatgataaattgaaatcagctagcagaagtggattccctttgatacttgaagaagacaatggggatgggcatttgggtggggtagatatatagaagcaaattcatttg

SEQ ID NO: 14447 - DNA, 963 bp, Solanum tuberosum
  Predicted polypeptide sequence is orthologous to G592
acaacatagttaaattccaataaacaacagcataatacaataatcatgtgctcctatacatctagattgtacccactagactgttattagatctactcaaactcaataatacattgaaaactacacttgtcttattgctaaataaaaacaagtaaaccatatttccagcatattagggcagaaagagagttcatttactctccttttccatcttcccatctaacttcacctattactatctgtacagacgaaaatttcatgttgttccatttgaatattgcagctgcttacttgtacacgagcatttcgcctttttatcgttcagtgtctggacttgtttctgaaggtctttaatgtaatcaactgccaaatctaacatatcagctgtgtttgtttgcttgtccatatttgggaaaagatcttgcagttttttcattctttcactaatccgagtacgtctcatcctttctgcaatacttcgtgggtgcgtagcacagcctcgtttagcacgtattttgcaaggcactgaatcttgttgaaactgtaggtatttttctatggcagccatctcagaagatgtcttaggcaagcttaaatgatgagttaaacccagaagaagtgtagtttctttgattcgtcattctgaattagtcattccacgtgaaactattaggagaacattttccagaatcaccatctctacttctcttcaaaagaattgaacggacgagtcgttccaagattcattctcagcaatgctaggcatgaaagttcgaggtaaatgattgattagttggaataacttatatgattgctgaaaaccattagtttgatgtaactgccttcctggttagtcccctacacttgttccaaaaattcccaagttcttctcataaaatccttcgaagaaatccagtggttaacctgcttggtcggattaaattaagccccattccattacct

SEQ ID NO: 14448 - DNA, 984 bp, Solanum tuberosum
  Predicted polypeptide sequence is orthologous to G597
tcagtattactgggtggagtagtaacaataagtgaaaatagagccaaaaaaatcagttgaagaatcagttcaaagcatcaatggaaaacgtgggatcaccctccgcctccgccgccgacgatggtacgccggtgcaaccaatctcctcctcgactcctccggtgccgtcatttccagctcccctcggcactaccggtgtccctcccgtcagtccaactgaaacgcggaaacgcggaaggtcaagccctgggatgactactccttcaccgtctcaggtcgccggcggtggactttcgtctcctacgcagccgcaggaagatggagcaagccctgggatgactactcctccaccgtctcaggtcgccggcggtggactttcgtctcctacacagccgcaggcagatgaatcggcggtttctactgggaaaaagcagcaaagtgttgatttgggatcagaagcagcagcgcttggatttatgcaatcacacgtgatcaagatagaagctgggcaggatatattggccaaaataatgtcattctgcgaaagtacctctaaagcagtgtgcattctgtctgccaatggttccatatctaatgtatcacttcgccgaccagatgaacctgtaacacataagggactgtacgagatccttagtctgacgggtttcctctttgtcttggaatctggtggtcaacgcagcagagaaggttgcttgactgtgatacttggtaatgcagcagatggtgatgtttggggaggcaatgtggatgggctctttacagcagcaactgatgttcaggttattgttagtagcttcagcacagaaaaacaggggcaggtgaagtcagacaactttggtacaccagcaacattagcatcaacgtccagaagtcctatgtcagttggaactttatttgggtctgtcagccctgttagtccgctaggctgaaactaggaagagaagccctcctggagttgctgct

SEQ ID NO: 14449 - DNA, 942 bp, Solanum tuberosum
  Predicted polypeptide sequence is orthologous to G597
gcaatttccgttttgtagatttcaatccgtctgcttcgccgtccggcgccgacgatcctcccggcgatcccaatagccatttattccggcaactgctcaaactctttctgtgaagaaacccagatagatacctcctggtttcagcaaaaaagcaacaaattgagaattttggcaaacttgaccaacttcttaatgggttttttattcgataaccgtggtgtcagagccagctttggcacacatccaccgagcaacgagcaacaattaccaggttcaacaggatttggattcccacctcagattatcgaaatggaaataggagaggatgtggcatcaaaagtactgtcatttactcaaaattgtccaagggatgtttgtatcctgtcagctactggtgtattatcaaacgtgtctctaataaaaactgacacgtccggagaagctacgacctttgagggacagtttgtgatagtgtctctatctggttcgtttctgctgtctgaaattggcggtcaacggagcagaacaggtggattaagtgtctcattagctaaacctgatggttgggtttttggtggttctgtgacgggtgttctaactgctgcatcacctatccagataattgtaggtgagttcgttgcaaatggtcaggtacctaccactaccaaccaacaacagataccaggatcgataggatctggagtcacacaacatattatcactgtgaaaacaggagaggatgtgtcatcaaaaatagtgtcatttattcacagtagtccaagggctgtttgtatcatgtcagcgactggtgaattatcgaatgtgactgtatttcaagctgatgcgtatggaggagaggcgacttatgagggactgttcaaaatacagactctatctgggtcgtttctgccatttgaaaatggcgatccacagagcagaatg

SEQ ID NO: 14450 - DNA, 972 bp, Solanum tuberosum
  Predicted polypeptide sequence is orthologous to G597
gatgtaatgaccagtagagatcatttcagtgttgccggagttcaaaattctccggcgaatgttccggcaacgacgccggtggttcagaatatgcatatgggttacagagatgaaaatacagctgtgtttgccccgccaccgtaccagtcggctgaaggttctgccggagctgggactgtgatgttgcagaacttgaacaataattcgtcggagcctatgaaacggaagagaggaaggcctaggaaatacgggccggatgggtctatggcattgggtttgaatcctgctggttcgccgccggttgctggaggtcctctcggcggtagcttgtcgccccgagatccgggtaattctgctggtgctcaaatgctttctggaggaccagcttcgccaaattctttgaagaaaggtagagggagacctcctggatctggcaaaaaacaacaaatggacaatcttggatcgacaggatttggattcacaccacatattatcgctgtgaaaacaggagaggatgtggcatataaaataatgtcgttttctcagaatggtccaagggctgtgtgcatcttatctgccagtggtgcaatatcaaatgtgactcttagacaaactgccacgtctggtggaactgcgacctatgagggacggtttgacattttgtctctctctggttcatttatgctgtctgacattggtggtcaacaaagcagaacaggtggattaagtgtatcattagctggatctgatggacggattttaggcggttgtgtggcgggtgttctaactgctgcatcaccagttcaggttatcgtcggtagcttcattgcagatggtcggaaagagccaaaatcagcaaaccattttgaggcattacctgctccgttgaatgccaatcttggtgttgggtggtggtttgacaggggccaatagcccaccatcacgcggcacttatagtgaatcatctggtgg

SEQ ID NO: 14451 - DNA, 998 bp, Solanum tuberosum
  Predicted polypeptide sequence is orthologous to G597
gatgaactcatttctcttcaatggattctgaagaatccccatttgcacaccacccatcccaatttctacaaccacccctacccccaccacatagccatggaacaatggcggtggcaccaccaaccccaccaccaccccaactcctacccaaccaacaagaacaattcagctcgtacattttacctacaaatgtcatttttcagcaaccccaacaacagcttaaccttcaatttccattcaattcagtttctgatcaaaacccaaatcccagttttcttgatgatggatcatctgttgctgctgctggggctgttgctggggctgttgctggggctgttgctggggctggggctggggctggggctaagaagaagagaggtcgccccaggaagtattcaactgatggtaacaacggttcgggtgtttctgctactccaattgctcaaattccggtgaatcaggctgattctggcgttggtggtgttaatgggggtgcttctttggagaattcctctaagaaggttcgtgggaggccactgggctctggaaagaagaaaaagcaagaagctttaggtgcagttggatttggatttacaccgtatgtgatccctgtgcacatcggggaggacattgcaaataagatagtgaatttctcactgcaaggaccaccggcagtttgtattctagctgcaactggagtcgtctgcaatgtcaccctcaggcagtccataataggtggtggcactgtgacgtacgagggtcgattcaacatcatctcattatcggggtctttcttgctatcagaaagtaatggcaaccgtagcagaacaggtggtcttagtgtggcactgtctgggccagatggtagagttttgggtggagtcgttgctggaatgctcaaggctgcctctccggtgcagctggttgtgggtaccttcactccagaaaggaaaagcttatgtctgaggcaccatccttcactccaccctccatgtgct

SEQ ID NO: 14452 - DNA, 838 bp, Solanum tuberosum
  Predicted polypeptide sequence is orthologous to G597
cacgcatcaatgcagcacttggtgtcatccgatggtgctacgacgccctactaccctatcatgccgccgatttcatctccacctccgacgacggagatttatcaagttcccacccccggcattaccgttccccttcccgatctatcagtgataacaatccctaattcaattgagccggttaagaggaagcggggaaggccgaggaagtatgctcccgatggttctgccaactcggggttagtgtctcctccgtcggcggcgcagtctggcggtggagtttcgcctacggagggaggagatgtacctttgcggaaaaaaggaagggggagaccacctggttctgggaggaaacaacaattgggtgatttaggatcagcaggtgcagggactggattcaaaccacatattatcacagtacaagcaggggaggatgtatgggcaaaactaatgtcattctctcaaagtacctctcaagctgtctgcatcatgtcagctaatggctccatatctaatgtgacacttcagcaagcagcaatgtctgttggaaatgtaacatatgagggacagtttgagatcctatctctgtctggtcactttttaccatcagaatctggtggcgagcgcatcaagacaggtggtttgagtgtgttactagctggacctgatggccatgctctaggtggtggtgtggcaggagttcttactgctgcatcggctgtacaggttattataggcagttttggtatgcaaggtccaaagcagttgacatttggatcattcctgatggttttgggcggtgccaatccttgcttggaccccccttggattcaacaggggg

SEQ ID NO: 14453 - DNA, 1002 bp, Solanum tuberosum
  Predicted polypeptide sequence is orthologous to G600, G2768
gaccttgcagcagactttgggatgggatttaatgctggcccaccaatcatgagcagagaagaatttgaggctagaaaggctgatctgagaaggaagcgtgagagtgagagacgtggagagagcagggagttccctaaagacagggaacatgcaagggaagttgggagcactgctgatggtccttccctgaaacccaaatctaaagctccgtcgagctccagccgtccccgccaacctgagaggccttccccagaccttgaccaccgccgacgtgagaggccatcaccagaccttgatcaccaccgccgacctgagagaccatcgccagatcttgaccaccgctgccgtcctgagaggccatcgccagaccttgaccaccaccgccgacctgagaggccatcaccagaccgtgattacccccgccgatctgagaggctgtctccagaccgtcgatcgcgtgaccctgaacttcctcgcccttcttccaagaaaaagtatgaagattatgacgatcatcaccatgaggaccgccatcagcgcgagcatacccatcgcagtagcagtagccatcaccgttcagaatcttcagctagcgccaaaccatcctccataggcccatctgaaccgcaatccaaatccgttgataagaggaaggcgagtgttttttctcgtatcagtttcccagctgaagattcagcagcagcttcaaagaagcgaaaggtgccatcctcgagtgaagtgccagtgagttcttcggcgagccacaggggtggcacaacaaatgggtatcatggagagtacaaaacgactactggatcaaggaagagtaccactgcgagtgtggattatgagagcagtgatgatgatcggcacttcaaaaggaagccttcaagattgagatagtaaatgatgagggagagactggatcaaaaagaatcttgcatggatataaatacagattcagaaagcgcgggcatctttgaaacattcaaatctggatcg

SEQ ID NO: 14454 - DNA, 989 bp, Solanum tuberosum
  Predicted polypeptide sequence is orthologous to G605, G1944
tgatgcaccatcagattaccatgtggcacctaggaccactgaaaatcccagtcaagtttctggatcagcacctcaaataatgactattgcaccaactccggccaccggtgccggcgccggagcactggcgttagtgaagaagaagagaggtagaccaagaaaatatggaccagatggagttgctgtaccgtctacggcggcagcgctttcgccgaagccgatttcgtcggcggctcctgtgtcgtcgccggtgattgatttctcatcggagaaacgggggaaaatccggccggtcggattagttagtaagcctcatatgcctaagttggaggttgaaaattcaggtgaatgggtctcatgctccgttggtgctaattttacgccccatattatcaccgttaatactggagaggatgtcaccatgaagattatatcattctctcaacaagggcctcgagcaatatgcattctttcagcaaacggtgtaatttcaagtgttacactgcgtcaaccagactcttctggtggcacattgacgtatgaggggaggtttgagatactgtcattgactggatcatttatgccatccgagacaggaggaatgagaaacagatccggaggaatgagcgtttctctagcaagccctgatggacgtgttgttggaggtggagttgcgggtctactagttgctgccggtcctgtccagattgttgtggggagcttccttgctggaaatcaacatgaacaaaagacgaagaaaaacaaattggagcctataacagctgctgttgttcctctatctagtccagatattgaagaaccatataatcagtcttcagcaaaacctactatgcccgcttcctcgattaactggtcatcatcgttggcaactgagtcaagaagtaagacagctgacatcaacataacgttgcctgcataggagtccgtccgtcccttttctattgatctcacatccatttgttgtttaa

SEQ ID NO: 14455 - DNA, 925 bp, Solanum tuberosum
  Predicted polypeptide sequence is orthologous to G605, G1944
caaagtacaaaatgtggcatttaattaagaggatgaatatgcctgttaaaactagacataaaccattaaaacactaagaacctagaccgttgtaaccttcgtaaccaaagcgtcacgaaaacatcataaatctaaaactctacagccaaacaccagaatagcaaaggctatctagaaaactagtttggattactgcacagagacctcaaacaaacatcaaataggaggtgagaaagatcaataggaacctcgttaaagacgcgtagtccttatggtctagtaaaatcacattcaaatttcaccctatgctggaagagttacatttatttcagctggtttattcctagaatcaggggctgaccaattatctacgcggaaagaagaggaagttggtgtagtttgttttactgaggagtgataagggtcttccgtctcgggtagaggaacagcagcaataataggctccggtttgtttttcttggttctctgttcatgttggtctccagcaagaaagctgcctataacaatctgcacaggactggcagctactaatagaccggctactccgcctcctacaacacgcccatcagggctagctagagatacactcattccaccagatctgtttctcattcctccagtttctgatggcataaatgatccagtcaaagacagtatctcaaaccggccctcatacgtcaatgtgccaccagaggagtctggttgacgaagtgtaacacttgaaattacaccatttgctgaaagaatgcatattgctcgaggcccttgttgagagaatgatataaccttcatggtgacatcctctccagtatttacagtaataatatgaggtgtaaaattagcaccaacagagcatgaaacccattcacctggagtttctaaatcaactttaggttgctgatgt

SEQ ID NO: 14456 - DNA, 970 bp, Solanum tuberosum
  Predicted polypeptide sequence is orthologous to G605, G1944
aatttcaccaactctctcaagaaattttgaaagcacaaaaaaaaaaattaaaaaaaaaaaaaattctttccattttcataaaattagtttgttcttttaagttctgttctttcttctgcagtaacagagtatcagttagtcattagatttgcactgcacatggtcagatgatctttctttagatacaattaattctagcatttgcagatttgctgagtttgtacttctcttggtattttgcttgttatatattttagcatttgaaaaaagattgtatttttattagtatttgttattatggggttttgagttcttgaaaaacaaatatatttttgctgttttgggagcgtaagttatttggagttgtcttaagggtttaaggggttttgagttcttgagtacaaaaatctttttgctgtttttggggcttaagttatttggggcttaaggggttttggttattttattattgtgtatatgcatggaggagaaagaaggagttaatagttctggggttacagttaaaggtgatgaagctcctgagagctacagagtggttcccaggagtgaaagtaataatattgagtttagtggatcaattgtagcaacaacacctgtaaatgtgacagaagagacgaagaagaagaggggtagacctaggaaatatggaccagatggtaaaccagccgttgcattatcaccaatgccaatatcagcttcaattcctcttgctggagatttttcagcttggaaaaacagtggaagtcgccccgttgattcctttaagaagaagaacaagtttgaggtcgaaactccaggggaggagatggcatactctgtcggtgcaaattttacaccgcatgtgatcactgttaatactggtgaggatgtcaacatgaaaataatttcatttgctcaaacaggatctagagctatttgtgtgctggctgcaaatggtgcaatttcaaat

SEQ ID NO: 14457 - DNA, 963 bp, Solanum tuberosum
  Predicted polypeptide sequence is orthologous to G605, G1944
tggtgacaaaaagaaaagaggaagaccaagaaaatatgatgctgatggaaatttaacacctcaatatataaaagctgctgctgcagcagctgctaaagcagcagctgcagtaggaagtggtggtggcggtgtcgtcggcggagctgtcacttcacctggaggtggtggagtgacatcgccgccgactggttttactataacgtcgccggtactttcttccggtggcttttcttcatctaaaagaggacgtggaaggcctactggtgctggtaacttgcaattaattgcttctttgggtgaactgtttgctcacactgctggaggtgattttatgcctcatgtggttactgttcatactggagaggatgtggcaggaaaggtatattcttttgtgcagaagggttcaagagggatctgtgttctgtctgcaaatggtgctgtttcgaatgttacgattcgtcagcctggttcttctggaggtctattgacatatgagatggtggttggaagtttcatgccaaacgcttttaaaacacacaacaaaaggaagcatcatcagatcgaaccaagaatgcctccagtcatccacagctctccggacccggtttcaatgataagacctgtctcacaagcaccaccggcgagcaacattactcagactcagacatctcaaataccaatccacaaccacggtgaagctgacaacagcacgagcaacaaagacatgccgaattccacctctacagacacttctgactgtaatggatctgaaccaacattcgagcagagatcatatccagatattaacgtgtctatacctatggagtaaagtaaagctcgacgaatcgaaccaaaacttgactatagttcttttctgcttagctgattccttgttttgtgcttgtctgtgctgattgtaattttgaggaatcattagggactgctttattagaaacttttttt

SEQ ID NO: 14458 - DNA, 888 bp, Solanum tuberosum
  Predicted polypeptide sequence is orthologous to G605, G1944
atttctttctctcttttttttcttcttttttcagtttgtaaaattttgatctgtgacatagaaaagtttgcaaagcattaatagctgctgaaaaaaatggagtcaagggaagctatgaatgctggagttacagtgatagctccagaagctccatcaaactatcatatggcatcaagaacagaatctactccgttaccacccggaacattggctgtgattacccctccggtagctactgcctttacaattagctcagagaagaagaaaaggggacgtcctaggaagtatgggcctgatggggcagttgcaaggacaatttcacctatgcctatttcagcatcggcgccaccaacctccggcaacttcttgtcggagaaagtgagtgttgcccgtcctgcttcggagaaaaagcctcgaaacaaagttggggctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcaggggggaactttaacttatgagggtcgatttgaaatcctttctttgtctggatcctttactccaacagagtttgggggttctcgtactactagcaaaaccggaggaatgagcatttctttggcaagtcctgatggtcgtgtagtcggaggtacacttgcaggactgctaatagctgctagtcccgtccaaggttgtaatgggaagttttctaaccaaagcacttaccaagaagggccaaggccaaagaaaacaggaaaggcagaaac

SEQ ID NO: 14459 - DNA, 601 bp, Solanum tuberosum
  Predicted polypeptide sequence is orthologous to G611
gtatcgaaaagacaaaaggatgcacttgatatgcaaaatggcgttgataccagtaatgcagatgatgatagtaatagctctgaagatgatggatacgccacttctgcaattcttttaggatcaagtattgcagtcaagaatgccgtacggcccattaaacttccagaagtaaaacgcatccctccatatacttcatggatatttttggatagaaatcagagaatgacagaggatcaatctgtggttggtcgtagaagaatttattatgatcagaatggtggggaaactttaatttgtagtgatagtgatgaggaagtacttgaagaagaagaagaaaagaaggtgtttgcagagtccgaagattatatgctgcgaatgactgtcaaagaagttggcttgtccgatattgtgttggatttgctaggacagtgcttgtctagaaaacctagtgaagtgaaggcaagatatgaaggtcttgttaaggaagatgatgcaggcacttcaaagaatgagttcacggaaagttctttagatttatatcttgccaaagatcttgatgctgctctggattcttttgataatctattttgtcgtcgatgtc

SEQ ID NO: 14460 - DNA, 788 bp, Solanum tuberosum
  Predicted polypeptide sequence is orthologous to G611
ggaacatgttctagttgccattaagaaaagacagaagaaaatggcagtattagaatctgactctgttgcaagtgaaagcctaggtttcaaagatttgaatcttcactctatttcacggaaggaaaacgaagatgcgagtccatcttcacaaaaagcacaatgtcatagtgctaaaaggtctaggaagaaaaactctccggttttggacaataaaaattctttgcaaggcaaggcttttggttgcaaattgatggaagcttccagtgcaaagcctgtgacaaattgtgatgacacattggggaaaaatgaatatgtgggtgagaataactgcaaacaagaaatagatggtactaaatcttggagacccattgaaaaggctctctttgaaaagggtctagaaatgttcggtagaagcagctgtttgatcgctcgaaacctcatgaatggtttgaagacatgctgggaggttttccagtacatgaacaattccgggaataagctattctcaggcacaggtgatgggatggatggcattcttgaaggtggttccaatggtgatggtcaggaaatcatgggtaatgaacctcgaagaagatccagatttttgcgtagaagaggcaaagttcgccgattaaaatacacgtggaaatccactggataccatgcaattaggaaacggatttctgagaggaaggatcaaccctgtcggcagtttaatcatgtggctgtcaaggcccttgtggaaaggagtgttcctgcattgtaaatggggacctgctgtgaaaata

SEQ ID NO: 14461 - DNA, 813 bp, Solanum tuberosum
  Predicted polypeptide sequence is orthologous to G611
tgccagccgatgtgtggaaagcattgtccttggtttgcagaatggtacttgctgtgaaaagtattgtggctgctcaaaaagctgtaaaaatcgtttccgtggatgccactgtgcaaagagtcaatgcagaagcagacaatgtccatgttttgctgctggacgtgaatgtgatcctgatgtctgccgcaattgttgggttagctgtggtgatggttcattgggtgagcctcctaggcaaggagaaggtcaatgtggtaacatgaggctcctcctaaggcagcaacaaaggattctgctgtcaaattctgatgttgctggatggggagccttcctgaagaaccctgtttacaaaaatgattacctgggagaatatacgggtgaattaatttctcatcgagaagcagataagcgggggaaaatatatgatcgtgcaaattcgtctttccttttcgacttgaatgatcagtatgtcctcgatgcctatcggaagggagacaagctgaaatttgctaatcactcatcaaacccaaactgctttgctaaggtaatgctggtttgctgggtgattcatcgagtttggggatatttggcaaagcgaacggtattgaaagctaagtgaggagcttttcctatgattatcgttatggtcctgatcaagcgccaatatggggctaggaaacctgaagggctcaaaggaccgcatgattccaccaggcgcctcaaggtcgaccaaagaaacaccaataatctccattgaggaccagcatgcgttaaaccatttctatcctaatgtggagtggttaaacaccggag

SEQ ID NO: 14462 - DNA, 520 bp, Solanum tuberosum
  Predicted polypeptide sequence is orthologous to G616
agtgcagaatcataaaattcaaatgagggcaaattcttcaatacaaatgagatgtcacaaaaacacactcaaacttgctatgtttcgaacctgtgcgccaactgaagtcgggccagaagaagcaaacaaagggatttctcccatagaaataagatagtactcaaaatgaataacgcagaatgaggaattaagaagcatataatatataaggcttgttgcagaggaaatcattagcttccttttgggactccagaggctgcttccatcttcaattgccatggaagttgatgttagtttagttctttccttttcctttctgatctgaatgtccgtggccgtggtcatacccatttccatagaagagatgtaaacgagcatcatattcagttgtgggaccaagatatgatccgtctgtgggagaaaacctctggtaatgaggcaaagtagaggaagaattggactgaagggtccccctattgaaaccagatgttgaagaaatgctgaagttcaaattgtactc

SEQ ID NO: 14463 - DNA, 778 bp, Solanum tuberosum
  Predicted polypeptide sequence is orthologous to G618, G2057
cttttttccaatgggttcttcaacctcaggtaactcttcagctatgcagttccacagcttccaagaaccccatatgttgtcaagaaccaatagccagaaccaagatttgagtctctctttacagtttcaagatcctattttgcttcaccaccaaaaccagcaagctcaacaccataaccaaactaaccatagggaacaagagcaagtgcaggttcaagcaccagcccacttcacaggaaacaccccacttgggtttgacacctctggctggtctatgcatcagagacttggttcttggagtgacagtagagacactggccctggtggtagtggtggagcagtaacaggacctggtgggtacttgttcaattcgccaccagcaccggcgctgctgcagcagctattcggccaaaatcagtttttttctcagaggggaccccttcagtccagtaacacatcttcggttcgagcatggatggacccatcaactatagcaattgcctcaggtgatccaagtcatcaccatcaagctgttttgccaatgtatccatcaacaattcctggttatggatttgcctctgaagtaggcgaattctctgggtttcgtattcctgctcgaatccaaggtgaagaagaggagcacgatggcatttccgataagccatcctctgcttcctctgattctcgccattgaattagctccaaaaatttgatctttctcaaaatccctgacagggatatgctctacttgaatgcaattggacattacagaagtgat

SEQ ID NO: 14464 - DNA, 747 bp, Solanum tuberosum
  Predicted polypeptide sequence is orthologous to G620, G1821
tggaaagcttggtgtttgtttgatttgaaggattttgcgtcaaaataagtacaagtcacaagcaatcactagttaaatactaaaaatagagaggtagcaaaataaacaaacagccaattggagacaccatttggctcacttagttcaaaagaaacattcctaaacattgcaaattaagtttcaacaacatcataattccttcagcagaaaacgtgatcactctttaccctcatttgcaagagaatcaacttcattatccacagtagacactgtagactgagaagttcttccatttgatgcatcctcttgcgtaaaaccgtcacccattggtggtggatgattcatatcaaaattagaagccagatgattgggcatgatgctgcagcctgaagctggatcaaccataggacgcttcaacaacaaaggctcctgtttcagggatccacccacaccaccattaacctcacgatagcgatgcaagtacaatgccaagggtttgatgtagtcatcaaaaccaaaatcattcaaggcagaaagcacattttcagccatgatgatcttgtgctgctcacgctggcaattatcgttggcttggcctgttacaaagcttataaactcagagacacactcttggatggacactttggattcattggataccttggcatggggaagaaggatcttgcgcatgattatgaccacgcttcctattggcatgaatgggtctttctcctgaatggggcattc

SEQ ID NO: 14465 - DNA, 905 bp, Solanum tuberosum
  Predicted polypeptide sequence is orthologous to G622
gtgatgatactgtgaaccggcaagtgccgatgtcagagaagaaaaaggcaagaaacattggggtccaaaaataagaggcttcttatgcatgctgatgatgctatggaacttagaatcacttgggaagaaatacaagaattgctacggccatctccaactgccaagcctaacattgttgtggttgaggactgtgaatttgaggaatatgaagaagcaccagtctttggaaagaggacaatatttactgcccgatcttctggggatcaggagcaatgggctcaatgtgacagctgtgctaaatggcgtagattgccttttcacgttctccttcctgcaaagtggacttgttctgacaatatttgggactcaagaagatgctcttgtgctattcctgatgagattagtccgagggaactggaagctctccttagagttggcaaggaccctaagaggcgaaaacttgtagaaaacaatgaagatttagagtcttctggcctagatgccttggcaacagttgctgctagcgacatgggagatagcattggcgacatgggagagccttcggttggagccacaacaaaacatcctcggcatcgccctggttgcagttgcattgtgtgcattcagcctccaagtgggaagggcaagcaccatcccacgtgtaagtgcaatgtctgtttgactgtgaaacgtcgttttaaaacactcatgttgcgtaagaagaaaaagcaatcagatcgagaagcagaacttgcacaggcaaaagatcaggtccctcctaaagatgaaccagaaacagatgggatgacgagtggaatagagttgcttcaaatgaatcattccgagaacgaacgcatgaatcactctgatcatgaaaggattcgaacggggatcaagtggaggag

SEQ ID NO: 14466 - DNA, 841 bp, Solanum tuberosum
  misc_feature (751)..(751): n is a, c, g, or t
  Predicted polypeptide sequence is orthologous to G629
tttttttttttcgaaaaacattctcatgagaaatcacaacatgatattagacatgccatttctcgacgtatgttatttacatatcaatttctcatctccatggcgttcaaaagttgctcggaaacataagccacaatagactctcggaaaccctttgtacaactagtataatgtcctatattcatattgagagctttattgacataaacaagagctaaattttagctttacatagtataatttctgaaggcaaaacctcgtcgaatggtgtactaaggggatcttctatggcatcattagggcaggctcattgaaaaccgggtagcccagtgtgagcttaaaacacgaagcccgttcaaagtactcccccaaggcaagtaagccctgagctgcttggtgcgtactccaggatgcgggacatctggttgaagtgttcttggcggagatgattctgcctgattttacgaaccctaacaagaagctttcaacttctcaaatggcaggcccccattcttgcggaagagagtaaattccctttcaacctaaaatcggccagctgcaaacaaggcttcaccaaagaaatctgatgaagtttaacccatttccttgttgaccaagggcatcctttctggtttggcttgaccacggattggccttggagggtttacaaaacccttcccccgggagttgtgtgttccttgttcaagaaagcttcaaaggaatccctccgtggccgaatttccttgcaagnccgggggaatccactagtttctaaaaaggcggccagacaaccgccggtgagagctcccagcttttttggtccccttaatgaggggttaat

SEQ ID NO: 14467 - DNA, 747 bp, Solanum tuberosum
  Predicted polypeptide sequence is orthologous to G635
cttagaattgcttcggatggtattatagtggtcagtatggaaatactacgtcctcaatccacggatggtatgacagagaaagctttgaaggggaaaaataagaataaccacacgctgcttgtggcttgacaaagggaaacttctggatgcgctccataaagctgcacatgcttcactttcaagctgtccattgaattgcccattgtcccacatggaaagaactgtgtctgaagttcttaggaaattggtcaggaaatacagtagtaaaagacctgaggttattgccattgcctttgaaaatcctgcaggagtcctggctgatgaaatcaatggaaaactttctggaaaatcacatgtaggttttggaatttctgcactgagaaatgtgttggatgaagatcagaaaagaagacaggcaagtggagcacgtgcagaagaaggtaatggccatggctatccaattgatgatgcagctgagcaagtgaaaggtgatgatatggatattgagagacttacgcatgatggagcaactacttcaagtgcaaactcactggatgaatattctaccactgaggaggaatcagaatcgtccagaaaagagagcattcaaattgattctggctttccacaatctatgatgaaatcttccaagcctttgaagagaaaccagatggaaaccatgatgagataacagaaattgattacgttgcgcggggaactccacagcaagttccaagttgttcgggg

SEQ ID NO: 14468 - DNA, 725 bp, Solanum tuberosum
  Predicted polypeptide sequence is orthologous to G636
gcaacccattcaactacagttaccaacggatttaccccaagtatcccataggcataccgaggaacgagagagtgaatcaatgaaaactattggaaatcaagagaatgttatgcaacaagacaacgacaaggaaaacattgacaaacaagagattgacagtgctggtgagaattcaaactcgtttcaaacgaattcatcttctcgatggcctaaagcagaagtggaagccttaatcaagctaagaacaaacgtcgacttgcaataccaagacaataatggatcatcaaaagggcctctatgggaagacatctcatgtggtatgaagaagcttggatacgatagaaacgcgaagagatgtaaagagaaatgggagaacataaacaagtattacagaagagttaaagaaagccaaaagaaaaggccagaggattcaaaaacatgtccttattttcatcaattggattcaatctatcaaaacaagtccaagaaacaattgcccattatagaaaatccgggttccaatatgaaggccggagagatactaatgcaaataataaaccagcaacaacaacaacaacagcaacaacaagcatcagaaagaacagaatgttgaacaaaaggcaatacaataatggaaataatagtttgatgaaggacaagaaggattttcttttttacttttgtgggtagtgtaccattttttaggaagtgggaccaaatcatgg

SEQ ID NO: 14469 - DNA, 749 bp, Solanum tuberosum
  Predicted polypeptide sequence is orthologous to G636
gagagaactcacgctttgataggactctctgcattttctccaacagaaaaaaagaaaaaaaaaggaaaaaaagaaagctgatgttgccttctctttcctaaaaactctttcttttccattttctgtttctttctttatatgtcaataccaatcccaactctgcattgctttctgcaactgtcacattatatataatattgagaaaatagagagacattcctccattttatgtccaccccatttatcaagactcaatctttagggtgatctgaggatttggattgcttggtttataagggaatagggagagttgtttcagaattggcattgtgttggattggttgtgtgttgtatgagagaattgtgagtcattgatagttgacgtgtcataatattttaggaggggcttttcactgatctgccattgcttgttttcttggtgattgtgaagacttgtggtattcgaattttgcctgatttgttatcttgtttagtttggtatgattggagaatttctttatgttgagcttaggtagtggtttaaacagatgccagttgaaattgtttggattttgggtgatatatatgggagatggtctctgatgatatattacatttttcatagttgttggaggttcaggttgaagtaatagctaccacctcatggtctaattcaactcgattttcgaaagggttcttgaaacttggccatgagaagccctttagtcaataaactatcattaattttc

SEQ ID NO: 14470 - DNA, 862 bp, Solanum tuberosum
  Predicted polypeptide sequence is orthologous to G636
acttcgtacaaacttagatgtcaaataccaagaaaacggacctaaaggtccgctttgggaagagatatcatctggaatgaagaaaattggatacaatcggaatgcaaagagatgcaaagaaaaatgggaaaacatcaacaaatacttcaagaaggtgaaggaaagcaacaaaaaacgacccgaagattccaaaacttgcccatatttccaccagctcgacgcattgtacaaggagaaagccaaaaaccccgaaacaacatcttcattcaatccttccttcgctttaaatcccgaaaacaacccaatggctcccatcatggcacgtccagaacaacaatggccacttccaccacaccatgaaagtactacccgaatcgaccacgaaaacgaaagtgataacatggatgaagatgatcacgatgatgatgatgaggaggatgaagatgacgaggaagaaaataatgcttatgagatagtagcaaacaagcagcaatcctcaatggcagccgcaaacaccactaccagcaacgcaacaacaaccgtttgagctaaaattagcacagatctcattaaaaaaaagcagaaagagaagacaagtgtgggggtgcagagattagtggggaagtgagtggagcattgggaatagcaagtgggtcaacagattcttgcagagaaaatgtcagatcggatcagatctcagaaatttccggttggtataagaagacggtgactgaaaattagctcacttgcgagaaaaaaaaaatgtgaagagaatttacaaatcatgtcaacgtttattttgcatttgttttaggtaaggggtatagtagtgtagtttagggggtataagttattgaacttc

SEQ ID NO: 14471 - DNA, 994 bp, Solanum tuberosum
  Predicted polypeptide sequence is orthologous to G643
gatcatctaacttcttcttcatactgctcttcttcccaattccagcagctatgttgagcgtcaggcattagattcagaaaaattgggcttcaaaaatggagaggagcggcggttcactacggacgcgttcacaggcggcgcctgactggacattacatgagtcagtcactcttgtgaacgaaatgaaagcaactcaaattgaatgcggcaataccctagcctctttccagaaatggcagtcgaccgtgcacaattgcaactcactgggcgtgaatcggagtttgaatcagtgtaaacggaggtgggaatctatgttggaacagtacaataaagtgaagccctgggaatcggcctattgggattcgttcgatgaggagaggaagagggaattggatctgccggagcagttcgatttcgagttgtttaatgcgattgctaggtatttgagtttagagggtgaggatggcggcggtgctgaaactgacccggataccgacccggaagcacagcaggttcaaggaaataatgctttcttggaaattggtcctaaaaggcaacggcgaaggacgaagacaaaaaggtacaaaatggaggaaagattgaatccatggagacgcatcttaaatgaaaacaggaagtatgagcaatccaagatggggataaagcatgaagctagcatagatgcaaatttggaagccccaaggcatgagaattcaagtttagaaataaagcgcgagacatccagtccggaggaaatgactgaacttccaaaccttagcatagttagtaaggtaaaggctgagcagtataatgtagataatccagaagaaatgatggctgcaactcttagagaaaatgcagaaatgatcactgcaattgctgaaggaaatacaatggatgatagagattgcatgcttgctgatttgaacattttgatgctggtcgggttcatttgatcagaagtcaaggcaaccaaacttatcgattgcctcgg

SEQ ID NO: 14472 - DNA, 1341 bp, Solanum tuberosum
  misc_feature (592)..(592): n is a, c, g, or t
  misc_feature (1030)..(1030): n is a, c, g, or t
  misc_feature (1032)..(1032): n is a, c, g, or t
  Predicted polypeptide sequence is orthologous to G646
ttttttttgtcactcagctgaagatgacttttgaaaaaaaaacacaccaccttttataatttccaaaaaaataaattaccaggatgtgcctcctccacccaacattccattccaaaacccattagattgatctgctgcttgccctctattttcttcaaactgatcatcaacagttgaaacattaatcttcaaatcatccatagggaaaaacaattttgcctcttgattatcactgcttccttgtaaacttccatacccattttcaaatccatccaaagaaaaattgatacgattactatgcttcaaatcatgtaaattcgaaagcccagtagttgatgacgggtacaaattattattcggcatgaatgtagaagccgaattagctgatgggtggatcaaaggtaacgccatgaaatcagaaaagctactgaaattacccggagtagtagtactgggtatgggattataagttaaattgaggtcgttagggtttgccagatctgtaaataatttttgggatgatgataatgataacgatgatgtggttgaagacgatgatgaattattgttgctatggtcatggttagatctntggttttttctggaaccgcctcctactggaacattccttaaagagcccccttcagtccagtaccttctacacgtcttgcagaaatatctgggttgagtgagactataattgttgtaataacggaattttgtgttcgttgaattgcatcttgggcaatttaaccggttgctctttctgtggtctcggtttccttgatccaaatttgatgaggttcatcaacacctttcattattcctataccctgtggccactggagaagaagttatcctttggaccaacggggcaaaaaaagcggaaacgaaaaaggtaaaggcaacatgggcaaggagagtcttcatcttctgtgcgcgatttcgtgaaccgcgggatccacctattttctagaagggggcgcacacagggggggaaacctccacgactttttgtgtcccctttagngngagggaatatataggcggcctgggggaaacaaggggccagcacagtgatatcacgcgggagagaaggagttaccggccgaaaatcccacgacgaaatttagaaggcggcggggcataaaatgttaaaagagccggcgggggcgcactctagaagaggagaacacccaccaatagagggtgggcggcccgcaccgccgttcgccagaggaggaagaacagtaccgcgcggctgtttaatatataacaacgccggggagagaggaagggatgtttggtgcccagctccacatcaacaacaaccgcgtgggg

SEQ ID NO: 14473 - DNA, 634 bp, Solanum tuberosum
  Predicted polypeptide sequence is orthologous to G652, G1335
cacacactctagaagggttttagggtttcgtttttgtgaggtaaaaaaatggcggatgagagttgtgagaggctgacgggaatcgtcaagtggtttagtgaccagaaaggttttgggttcatcactccctccgatggctctgaagatctgtttgttcatcagtcaggcatcagatctgaagggttccgtagcctagctgaaggtgaggaggttgagtatcagattgagtctggttcagatggcagggctaaagcttgtgacgttactggacctgatggagcgtctgttaaaggaggctctcgtagcggtggaggtggaggaggaggtcgtgatggaggtggctacggtggaggccgaggaggtagccgtggttatggaggtggtgacagtggctacggaggtggtagccgaggttatggaggaggcggtggtggctacggaggcggtggaggtggttacggaggcggtggtggaggtagcggcggcggcggctgcttcaagtgtggagaatctggacatttcgctagagagtgtccacaggatggcggcagtggcggaggcggtggaagcaggtattctggtggtggaggcggaggaggtaggtactccggcggcggtggaggtggtggtggcg

SEQ ID NO: 14474 - DNA, 872 bp, Solanum tuberosum
  misc_feature (478)..(478): n is a, c, g, or t
  misc_feature (497)..(497): n is a, c, g, or t
  misc_feature (607)..(607): n is a, c, g, or t
  misc_feature (616)..(616): n is a, c, g, or t
  Predicted polypeptide sequence is orthologous to G652, G1335
gctttccaaaacatgtatgtggacatgtacagagagtattcattgacgcaccaacaaaactacaactccccattacaaaaagcatgatactactaactatcaaccagtacaaaataagataaaacaagcaaacactagagataatccagactaacagtaacaataagtaccgtaaacataacaacttgaaaatagcaaaatacaaaaacacagagatcacgatcaatgaccgccgcttgtgcactcgcgggcgaaatgaccttcttctccacacttgtagcagccaccgccaccaccacctccaccgccgccggagtacctacctcctccgcctccaccaccagaatacctgcttccaccgcctccgccactgccgccatcctgtggacactctctagcgaaatgtccagattctccacacttgaagcagccgccgccgccgctacctccaccaccgcctccgtaaccacctccaccngctccgtagccaccaccgnctcctccataacctcggctaccacctccgtagccactgtcaccacctccataaccacggctacctcctcggcctccaccgtagccacctccatcacgacctcctcctccnactccaccngtacgagagcctcctttaacagacgctccatcaggtccagtaacgtcacaagctttagccctgccatctgaaccagactcaatctgatactcaactcctcacttcagctaagctacggaaccttcagatctgatgcctgactgatgaacaaaacagatcttcagaaggcatcggagggagtgatgaacccaaaactttctggtcactaaaccacttgacgattccccgtagccttcttaaaatctcatacgcattt

SEQ ID NO: 14475 - DNA, 980 bp, Solanum tuberosum
  Predicted polypeptide sequence is orthologous to G652, G1335
ccaaagggaacacatactaagggtttttagggtttctgtttgtgaggtgaaaaaatggcggatgagggagaacaaaggtgccagggaatcgtcaagtggttcagtaacgagaagtgctttgggttcataactcctaaagatggttctagcgatctctttgttcaccagtccggaatcagatctgagggtttccgtagcctgtctgatggtgaggaagtagagtacgtgattgagtccggcaatgatggccgtagcaaggctgttgatgtcaccggtcctgatggagcaccggtctctggaggatctggcggcggcggaggtggccgagatggtggttatggtggtagccgaggtggaagccgtggatacggtgatggagacagttggctacggtggaggcggtggctatggaggaggaggcggtggttacggcggtggaagaggtggtggaggaggcggctgctatcagtgtggtgaatcaggccactttgctcgggaatgtacccagagtgaaggcggtggcggtggttggtggtcgatactccggaggtggtggccgaggaggcggagcgccggggcggtggtggtggtggacggaggtggtggttgctacaaatgtggagaggacggccattttgcccgtgaatgcaccagtggtggtcagtggatcgtggctttgtagccctgctatggtttatccgtttacggttctgtttttagggtaccctatcttggtatgttggttgcgggagtgctataattggggtttttaaatattccttggctcctttatgtaggttccaattttacatttttgaaggctttaaaggtatgtggggaaggtccttaatatttggccgaatgatgcaaatgtgattactcctcttgttaccaagttaacacacataacattggcgttccgaggcacatattcaatttataagcccgatggtaaatttctctcctttagagaaaaaaaa

SEQ ID NO: 14476 - DNA, 890 bp, Solanum tuberosum
  Predicted polypeptide sequence is orthologous to G652, G1335
tttttttttttaaaccgtaggcacgtaaagtttttatcttaaaaggtcgaaaccacaaagaaagattacctaaaagaactcaaaaaaagaaagacgaaaagagatgataatgcaagactaatttacaaggaaagagcaacgaaatgtcactcctcaaaacaaggacgacaagacttgtagtgcactctcgtccaggaacagtgacgcataatttaagccccatgcgaccactgtacagagaggcaaaacgcaagccctcaagaagctctcaaaagcagaacatgagccgtgatgagccactaagagaagacatctaaacctgtacaggacaactttatgcgctcaaaaaggttcatcaaaaaccaccgacgtgttgccttggagtattcccgtatcttcctgatgtcatgttattggtagcaggtgcattgcttacacctgggcaatctcttgcccaatgtccatactgatggcatttataacactcaccaccaccaccactgctcatccctgaagttgccctattgccaaaaccacctccatatgcctggctctgaccactcatcatgcttggacagtttgaagcactatgacctgttccaccacaactattacagctcatatacatgcctgtaaagagccagtcggagcatttttgtgttccagtaggctgatttccatatggaccttgccgatttccctgcagtccactttctctgttgacactgcctgcagtagagccagggcggagcgaactgtgaggcagtaagctgattcccatattggacctttgccgatttccgtgcagtccactaatctctgctgaataaccggtattggttgccaccattaaatttgcaacaggggctcattgggttctttgcgtttaa

SEQ ID NO: 14477 - DNA, 987 bp, Solanum tuberosum
  Predicted polypeptide sequence is orthologous to G653
ctgctttttcctcttcttttttctcccattcatcattctctctttggctcattctcccagaaaaacattctcttcatccgccattaacgctcgccgcatcacaaacttgcaatccacacataatcaacaacttgcagcaatatttattttgatcttccaatagtcaaagaggttggaggatcagatctaggattatttttgttgtgttgaagtcatgtcgtttacagggactcaacagaaatgcaaggcttgtgaaaagactgtttacccagttgagcttttgtcagctgatgggattagttatcacaaatcttgcttcaaatgtacccattgtaaaggaactctcaagctgagcagttactcctcaatggaaggtgttctgtattgcaagcctcattttgaacagctctacaaggagtctggcaacttcaataagaactttcaatctcctgtgaagtcagctgagaagttaactccaatgctgacaaaatctccaagcaaagctgccggcatgttttctgggacacaggaaaaaatgtgccacctgcggtaaaacggcttatccacttgagaaggtgacagtggagaaccaaagttatcacaagtcgtgtttcaagtgttctcatggtgggtgctctttaaatccttcgaattatgctgccctcgatgggattttgtactcgcaaacctcatttttcacagcttttccaggagcaaaagggagtaacaatccatttaatcaaggtctgccttcaatgaaagcgtccagcagcaactgtcccaaattcttaaactgtaatccccgtcaattatttatccacgcagctggtctttaaatatttggttccttcctcttttccgtatatctccaattggtgttgccctttcggttactgggtgtgaatcctgatcttccacaacctgttgaaaaacttaattccttcctgtggtggtggttgtcccttaaaccttcgggatggttaaaat

SEQ ID NO: 14478 - DNA, 789 bp, Solanum tuberosum
  Predicted polypeptide sequence is orthologous to G663
ctcctatgatgtgtacatctttgggagtaataaggaaaggtcatggactgaagaagaagatatccttttgaggaaatgtattgataagtatggagaaggaaagtggaatcttgttccaactagagctggattaaatagatgcaggaaaagttgtagactgaggtggctaaattatctaaggccacatatcaagagaggtgactttgatggggatgaagtggatctcatcttgagacttcataagctcttaggcaatcgatggtcacttattgctggtagacttccaggaaggacagctaacgatgtgaaaaactattggaacactaaccttctaaggaagctaaataccagtactaaatttgctcctcaaccacaacaaggaattaagtgtgggcaagccaatgccataataagacctcaacctcagaaattcagaagctccatgaagattaatgtctcttggtgcaacaacaattagtatcgtaaataatgaagaagcatcgaacgacaacaacgatatgcaatggtgggcaaatatactggaaaattgcaatgacattggagaaggagaagctgaaagaacactaccttcatgtaaggaaattaattgcaatgaaattgataaaacaccaagtttgttacatgagggaggcaactccatgcaacaaggacaacgtgatagtggttgggatgaattttctctagatgatatatggaatctacttaattagcgggtgattacacgaatgactgagaggtgatggtctgaacttttgattcgttgtctta

SEQ ID NO: 14479 - DNA, 490 bp, Solanum tuberosum
  Predicted polypeptide sequence is orthologous to G663
cagaaatggtagtattataattaaaatatatgtcttagaactatatattattaaaaaaaatgaatactcctatgtgtgcatcgttgggagttaggaaaggttcatggactgaacaagaagattttcttttaagaaaatgcattcaaatatatggtgaaggaaagtggcatcttgttcctgctagggctggtttaaatcgatgtcgaaagagttgcagactaaggtggctaaattatctaaggccacatatcaagagaggtgactttgctccagatgaagtggatctcatcttgagacttcataaactcttaggcaataggcaagtctatgtgtttattagactgcgatcattttattcaaaagtttatgatgttagggatttacgatataattttctttttaatgtattatatatatatttataaatattaccatttcttaatatgtgtaattatttcatttaaaagttacgaaaaaaaaaaaaaaaaaa

SEQ ID NO: 14480 - DNA, 1125 bp, Solanum tuberosum
  Predicted polypeptide sequence is orthologous to G663
aaaggttcatggactgaacaagaagattttcttttaagaaaatgcattcaaatatatggtgagggaaagtggcatcttgttcctgctagagctggtttaaatcgatgtcgaaagagttgcagactaaggtggctaaattatctaaggccacatatcaagagaggtgactttgctccagatgaagtggatctcatcttgagacttcataaactcttaggcaataggtggtcacttattgctggtagacttccaggaaggacagcaaacgatgtgaagaactattggaacactcactttcaaaagaagttaaatattattactcctcctcctcgccctcgtcctaatcctcatctacatattaagcataagagcatcgtggttactaagaatgaaataataagacctcaacctcggaacttctcaaacgttaagaagaataattctcattggtgcaacaacaaaagtatgatcacaaacacattagacaaagacgacaaacgttgcaaggaaattgtagtaaatatttctgagaagccaacaagagaaaatacatcgtcgatagacgatggagttcaatggtggacaaatttactggaaaattgcaatgaaattgaagaagaagtagctgttacaaattttgaaaaaacaccaacaatgttgttacatgaggaaatatcaccaccgttaattaatggtgaaggcaactccatgcaacaaggacaaagtcatgattgggatgacttttcaactgatattgacttatggaatctacttaattaaatagtaatttctttttttgatttttcgtgatgtccggtacttatattagaatctgactgaattcagattcacgcgactccttatctagggggactcgaacccaacacctctgattaagaatgaatgagtacttattactccgacatatggttggtattaaagaaatatgtaatggtaattaatattattgtaaacttgtaatagggatccaatcgtcctttatactttgtatcctaattacaagttgttaggaatgtaattttaagaattattgtaagtgcatgcactctatttttatatttgatgtgaatttaaggattgagcataaatatgaaaaatcaaaat

SEQ ID NO: 14481 - DNA, 1071 bp, Solanum tuberosum
  Predicted polypeptide sequence is orthologous to G663
actcctatgatgtgtacatctttgggagtaataaggaaaggttcatggactgaagaagaagatattcttttgaggaaatgtattgataagtatggagaaggaaagtggaatcttgttccaactagagctggattaaacagatgcaggaaaagttgtagactgaggtggctaaattatctaaggccacatatcaagagaggtgactttgattgggatgaagtggatctcatcttgagacttcataagctcttaggcaatcgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaagtgtgggaaagccaatgccataataagacctcaacctcagaaattcagaagctccatgaagattaatgtctcttggtgcaacaacaatagtatcgtaaataatgaagaagcatcgaaagataacaacgatatgcaatggtgggcaaatatactggaaaattgcaatgacattggagaaggagaagctgaaagaacactaccttcatgtaaggaaattaattgcaatgaaattgataaaacaccaagtttgttacatgatggaggcaactccacgcaacaaggacaaggtgatggtggttgggatgaattttctctagatgatatatggaatctacttaattagcgggtgatttacacaaatgacctgagaggtggatggtcttgaacttttaattttgcttgtcttatcctattgataaaaattcaagttttacaagtccttatttttattcttgaagatttgcctatggagtaaattgaggtaaaaaattcgagaccacacatataattaggtgcatggcctttgtattatctacgtgtgtgcttttgtgtttttaaggtgaacaagtttatagtggaatgtgaaagtattccaagtgtgaagtatgtaatatgatatatgaaatgaagtgattattatatt

SEQ ID NO: 14482 - DNA, 1120 bp, Solanum tuberosum
  Predicted polypeptide sequence is orthologous to G663
atcatgagtactcctatgatgtgtacatctttgggagtaataaggaaaggttcatggactgaagaagaagatattcttttgaggaaatgtattgataagtatggagaaggaaagtggcatcttgttccaactagaactggattaaacagatgcagaaaaagttgtagactgaggtggctaaattatctaaggccacatatcaagagaggtgactttgattgggatgaagtggatctcatcttgagacttcataagctcttaggcaatcgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaatactagtactattgctcctcaaccacaagaaggaattaagtgtgggcaagccaatgccataataagacctcaacctcagaaattcacaagctccatgaagattaatgtctcttggtgcaacaacaatagtatcgtaaacaatgaagaagcatcgaaagacaacaacgatatgcaatggtgggcaaatatactggaaaattgcaatgacattggagaaggagaagctgaaagaacactaccttcatgtaaggaaattaattgcaatgaaattgataaaacaccaagtttgttacatgatggaggcaactccatgcaacaaggacaaggtgatggtggttgggatgaattttctctagatgatatatggaatctacttaattagcaggtgatttacacgaatgacctgagaggtggatggtcttgaacttttgatttcgcttgtcttatcctacggataaaacttcaagtttaacaagtccttatttttattctttgaagatttgcctatggagtaaattgaggtaaaaaattcgagaccactaatataattaggtgcatggcctttgtattatctacgtgtgtgcttttgtgtttttaaggtgatcaagtttatagtggaatgtgaaagtattccaagtgtgaagtatgtaatatgatatatgaaatgaagtgagtattatatt

SEQ ID NO: 14483 - DNA, 1012 bp, Solanum tuberosum
  Predicted polypeptide sequence is orthologous to G715, G1646
gattgaaattatcgctcagaaaaaaaaccatggcaaaccactctgacgaggcggcagcgaatgcagaggcggcggcggcgactgctcagccgactgtgaacgatcatctcctccagcagcagctgttttgggcagctcagcttcaagagatcaaacagataagagattttagggtccacagtcttcccatttcccgagtcaagaagatcatgaaatcggacaaggatgtccatatgatttctgctgaagcgcctattctgattgctaaggcatgtgagctctttattcaggagctcacccatcgttcctggcttaacgcccaggaataccagcgtcggactctgaaaaagaccgacttcatcacggtgcttagggagactgaactctttgatttccttgtggacgccatttctatggatgagaccgaggaagaagttactggttttgtgcctggcatgctgggcaacataccaagtcgtatcccgtactgttactcaccaatgggacctcctgctccaccaatgggacctcctgctccatcaatgggaccacctgctccaccccggggaatcatgggaaggcgtgctatgccttgggttgcaccctcagtgcacgtcccgcctccgttgtacccgcggcagtccggttggcatgctgctggcggtaatccctatgctacaggagggagcagtggacagggtaacggtgatcctcaaagttaaagatcatgttctctgttgatccaaatgctcagtggcactggcacaatggaagctcttagtcactaatgctgcaggtcctgtcaactatggatgcttcttattgctactgtctatgggtactggctcaacagtaaaactacttttaatcaaatgcttccatgttgtttcattcatggcttcatttggattgctgtaactgtcaatctgcccgtgtttctctagggaagaaagactagtcaagaaagattttgaggagataacaacagaagcatttgctcctgctacagcaa

SEQ ID NO: 14484 - DNA, 1049 bp, Solanum tuberosum
  Predicted polypeptide sequence is orthologous to G715, G1646
ctgttaatacaggaaaaattgcccctttgttccttaaaacatggaaaacagccctcagcaatcggcggcgaatgcagcggcggcggctgcagcggctcagtccgctgggtattccgactcagccaccctctacccacccattctccctttcagcaaacagcagcagcagtttacagaatgtttttgggacccttaaccaaacggcccagggaaaaattcgaaaccaggttaaaccggaattttaaagaaacccaattcaaacctttcccctttgcccggaaattctagaaaaattcattgaaaaagcttgaacaaagaatgttccgttaattgaatcttccggcttgaaaccacccatatttggttttgcccaaagggccaattgttgagccttttccaattccttggaaacctcaaccttattccgtttcccttggcctttcaccgccttgagggaaaaacaaagcgaacgggactctgcagaagaatgacatcggctgcggcgattacgcggactgacattttcgatttccttgttgacattgttccgagggatgagatcaaggaagagggtgctggtcttgggcctggcatggtgggttccacagcaagtggtgttccgtactattatccaccaatgggacagcctgctccacctggggtgatgatgggaaggcctgctatgcctggggttgatccttcaatgtacgtccagcctccgccaccaccatcgcaggcgtggcagtccgtttggcaggctgctgaggataattcttatgctggtggaggcagcaatggacagggtaaaccttgatggttaaagttaaaatccatgtatgttgttgatccagatgccttagtagcagaacggaagctattattaccaatgctacaggtcctctcacatgtgaatgcaccttattaccattgtccacgataactgattaactgctatgacttaatcctttagccgtttgtagtaaaaacctgtgtgtactttatccacaatgcttataatgtctcggttttcacagtattataaaccttac

SEQ ID NO: 14485 - DNA, 916 bp, Solanum tuberosum
  Predicted polypeptide sequence is orthologous to G715, G1646
ttttttttttttagcaacccaaaaggatattaaagagtaaaatccaggaatacacaaaagtcaagttttatacagacaaagattcaagtcggttacagttaaacagtatccatggacagaagccataaaaggtggattcacatttgagagaagaaattacatttcactatcataaccattagtttcacatgtgctgttaagcctccaaaccggcagcagcgagatcttttaaatttggccatcaaggttaccctgtccactgctacctccactagcataggaattatcgtctccagtctgccacacagattgccacgcctgtgatgggcggagggtgcacatacattgacggatcaaccccaggaacagcaggcctaccaagcatcaccccacccggagccgggctggcccatcggagggtaatagttacggcacaccactagcagtagaacccacaatttccgggtccaagcacaacaccctcatcctttaatctcatccctagaaacgatgtcaaccagaaaatcaaaaatatcagtacgagtaatcgccgcagcgatgtcattcttcctgtagagtccctgcgcttgtttttcctcaggcgtgaagccaagaacggatggtgagctccaggaatgaaacagttcacaggctttcgcaaacagaaccggagcttcagcagagatcatacgaacatcttcatcagttttcatgatctttttgatacgagcaaggggaaggttgggtgggttttcgaacatcatttgacttgctccgatttcttgaacgcttgttaaagtccaaaaacatctgaaagctgtggctgttgttgttgaaacgacaggtggtatggagtctggcggggatattgtggtgaactgagcggcgttgccgttgtgactggcgcgggggggct

SEQ ID NO: 14486 - DNA, 837 bp, Solanum tuberosum
  Predicted polypeptide sequence is orthologous to G718
cttcatttggtaaagtgaaaactcacaaaaacttctcttctcaaacaaaaaattggtgatgaaacaagtagctgaaaatgatgttgtggagttaacagatggacttggactggaagggattgagctctgtttctgtatttgaatagttatccttgtcgacttatagttttctcgccgtcttaatcagcttcgtactagttactggaatcatacagctctgtcaaagagattcaagtcttaattactgttttgcattccatgagtctggaaatttggtaaagccatctcatagtttctttcccaagatggagtggaatgttaagtgggactggggaaatctcgtaatgtttggttcaaaggcctctgaaagtccaaaagaactacaattaacagattggggagttgaagaagagggagaacttgatgggggatctttcaatttgtcaagtggcggtagtggcacgggtggttatggttctgatgtgaagtgtggttcttccatcaaaagctcaatatcagcttctaccgactcttcaccaaaggagggctttaaagcatctaactttgcttttgaggcatttaatgcctctcctgatgatcctagtaagaaattggaatcctccaaagctgaggtctctagaaactcaccacccatggaggcttcagttggctctgttgaaccagtgataggtctaaaacttggtaagcggacatgtgaaacctttggtggtggaagcagtgctaaagtttcatccttccccccgaaccccacatcatctgctgctgcaacaaagaaagcaaaatcatctagtcagaatgcaccaattcctcactgtc

SEQ ID NO: 14487 - DNA, 943 bp, Solanum tuberosum
  Predicted polypeptide sequence is orthologous to G720
ttcacaaggcatttcattactggaggaaagaatgtctctgagtcacttaatccggttaaagaatctcttttgtccatgctagagctccaaccagtaaagcgcgaagcagataatgagaatactaatgaagctgtggtggaaaaccaaaaaacatcatcatcctgctgcgataaatatccagctccttcaaccccacaacagaaacaaggagtaaggtcagtggatgatggtgatctccaagatcatactatcttgtcaaatgaacaagatagtggggtgcatgaaggggacacaaaatctgtcgaaactacttgttgcgattctgttgctgagactactgtcttggcagattcttctgagcgactaggagaggctatcacaaaggaggagcatgattctgctgctgatcaaaatatggaggatcctattgctacttgttcacgaagtaatgacaatggcagtgcttgttctgctgacccgaacaaagcttatggtctccatagttcaagtgggacaaaagctaataagaagaaaatgaaggtagactggacacctgaactacacaagaaatttgttaaagcagtcgagaaaattggtatagatcaagccattccttctcgaatactagagctgatgaaagtagaaggcctgacgagacataatatagctagccatctccagaaattcaggatgcagcggaggcaaattttgccaaaggaagatgaaaaaagatggcctcgtcctcaacctagagattcagtacagaggacctattatccacataaacctgtcatggccttcccaaactatcattctaaccatgcacccacagctggtcaattctatcctgcctggataccaccaggaggttacccgaatggtgcacatatgtggggttcgccttattatcctggatgggcaccacctgagacatggcactgga

SEQ ID NO: 14488 - DNA, 966 bp, Solanum tuberosum
  Predicted polypeptide sequence is orthologous to G720
acccataaactaaggatggtttattcattatttttccaaagaaatcaatggagcacactcatcagcccaaacatccaaatttgggctagaaaaaaaaggggaaaacccatatttggatccattatttacaacaacccgattttgaccttcgagtcaatgccatacacgtggctaactctgtgccaatcatttattcattcttgagacatcagaacctcctcgggtcgggtcgggtcgggtcgggtcgggttatgtcatggtgcatgggtccatcaagtaattggagattattattttctgacatacaccacctgtgggacctagaaaaaaatagattgacttttcatctcatcttcgataacaggagccgttgatttgtgaagggatgattgagatccctcgtctagaaagttcgtcaagaacaccctctgtggaaggaggttttaggcccaaaggaagtggtaaccatggtttggttattgcctcctttattactttatcaatcacctcatccgccgggtgaagatcaaacgacttctctagcatgctatatctgttatgcattccgtgaggccgatacactccaggcattctgaggatatgatggatatgatccaaactgcggtgacatgacaggggagccccatgtatcagcatgcagctctggacgaggtgtccagttgccaagttctctgcaggctttccatcccggaatagtaagggttgaaccccagaactttgtaaacccgttcgcgataactttgctggttggtaacccaagcaggaataaaatttgaccacccggggccacctgatttcgaatgatattggttggccaatggtccatgaatacgggttcattcacaggaatcagttaaaccttccattgggaacctcgaaattccataagaggtttgcgagaattaagaggccatcttctcttttctcacatcccttttgggcaac

SEQ ID NO: 14489 - DNA, 792 bp, Solanum tuberosum
  Predicted polypeptide sequence is orthologous to G728
tttttatcgattctgagagcaactgaagcaataagattcaatttttttgtttgttgtaaagatctaatctgagatagtggaagatctggagaaatgggttcgatcccagcagaattgagcttagattgtagacctagttttattcccaaatctattactgattttcttcgacaactttctttgatccgtaatgttcctgataaactatcacagattgatgattatatgtccagacttgaagatgaaatgaggaaaatcgatgcattcaaacgcgagcttcccctttctgttcttcttgttaaagatgcgattgtagctctaagagaagaatcaatgcaatataaaaaatcgagaacagaaccagtattggaagaatttatcccactgaagaagagttcccatgaagatactaaagctgaaattactaaagataaggatagtagagaaaagatgagctggatgagctctgttcagctctggaacagcgaatctcactgcgaaaatactgatgaagtggttaataaacagccatctaaatcagaattgaaagtggatactcagcgatctcctgaagaaggaaatagttcagtaactgaagatccattccaatcttgtaaaaccatgaatgtgggaaaggcattttcagtacctttcaaggggtattctggtttctcagtgacagcggttaggaaggacaataaagatgaactaccaggattatcacttcatactcctggaattacgaactgagggaggatactgtgactagtggtttgaattcaaaccaatggt

SEQ ID NO: 14490 - DNA, 773 bp, Solanum tuberosum
  Predicted polypeptide sequence is orthologous to G729, G730, G1040
ggcatctaactttttgttaaaatgatttagcaaaatcaactaaaaaagctttaaccttttttggtcaaaacaaaattgaaccatattcctgcagtcacgtacagagaaaactatagtctaatagttagggcaacttaattaattataattactctacataatccaaattatttaacacttgagaagattcaaatcatttgaggatgatccagcttgtcccattttccagtttggtcttcctagtgtaaattcaagatcaagcaatgtatcatttgaagatgagttattggctgtctcaaatccatccatatttgtatatatgtgaggataattagcaaatgtcctttctctatttgagtggctccatgcatttgtctgatcaggcatgaatgatgaaggatccctcaaatgagacatattttgtgatatggtacttggttgtgataatgcatcaatctcctcaaaagatttttcatattcaccattattaatcccattgttttggttcaaaaatatattaatttctccctgccctttagctgtagctttgtcagtgctcttcactgttctatacatctgtaagtgactcttcacatgagctaaggttagatctttcacattcatcaactctagcacggattttggtgttgctcgttcatgtccacctaggagctgaacggcatgaacaaaatgagcatgaagagttgaagtccatctcattctcggagctctaacgcttcttttcactccactatcatctcgaactctcttga

SEQ ID NO: 14491 - DNA, 551 bp, Solanum tuberosum
  Predicted polypeptide sequence is orthologous to G729, G730, G1040
cacatcaaatattatactattaaagtattataaaaattctttacactatcagataactagtgccctctttgcttttggcacaaaaactaatttccacatataggtccatcttttttactagggtttagctttcgcgctaagacccttttggctataaaaaaaagtacgaattcacatttttgggaataattttttagaatagcatatgaaagttcaccttgaagagttgttccaaaaaccctgaaaatcattatcttgatgaatattccttttatcttgttgaactgataattcagactttcttgaatattcttcattttcaactagaggtggatccaggatttagagtctctgagtgccaagtaaattcatctattatatcaatttagacttcgaatcaaaatattcatcaaccatcaattcctctgatgtatctccggatgacaaattatcgaatacctcagattggcctgaagaagctgatctatcagttgtcttcacagtccgatacatctgtaaatgggatttaacatgtgctaaggtgagatctt

SEQ ID NO: 14492 - DNA, 674 bp, Solanum tuberosum
  Predicted polypeptide sequence is orthologous to G732
ctagctcgagtatttttttttttacatgctattggagtttctgaatcttgaaatggttattaatatactactacgataactacaaatcgaagaaaaagactttccaattacaactgcataattaagtcctgaaagagaaactgaaaatgagattacaaacccacatttacaagaacaccaatattcctcgagaggatttattcttaataaaataataatactactactacttgacaaaagagaaatcttagcaagatcactaatatttctactacttgatgatgataatacataaaaagaggattctctctgtttgattatttttttttcccatcatcaaccatgatctgactaatttttttttgaaattcattggctcgactaatattgccacgtcagtactgcaagacatcggcagtcataatgggttgattggcagatagataattccaagaattggtcacgttgaacccatcaagcataatgtcattttgtgcaaaattgaagctataaggctcattgtggtccatgacaagtccattacaattgttgtatgcatccaaaactgcaatgatttcattaagtgactcaagcctacggctaagttcattaattgagctctccatattgaattttcagctcaacatgagataatgttgtgtgtaacattcata

SEQ ID NO: 14493 - DNA, 983 bp, Solanum tuberosum
  Predicted polypeptide sequence is orthologous to G735
gatcaacaactctggtctcaaagtctcatctctctctaaccaagggagagagagaatggatactgtgttttcggtggatgagattgccgatcaattatggtcatcgccgccaccgatgaggttatctcatgacttggattcttcttccgccacttcgtcctctaaaatgatgaacaggagctcgtcggagtgggcttttcagcgtttccttcaggaggctgcagcagctgacactacttcctcgtcttcttcacagcagatcaggcttaatcataatttaattcctgatcaatcgaagcctatgtcatcgtttggctctgaacctccgattgattccgatgaacatcaggctttcctcaaaagacgcctggatttggcatgtgccgccttcgctttgaatcgtgcaagctgtgtaaaatctcaagattcggcttctttgccacccgaaaaaggatcactggcagctaatgcatcactctctggatctcagcttcctccaaaaggatctgggcaagaattggcaaaagttcaagataaggatgctggtgagccaattggaatacctcccttgcctgcaatgcagaagaaacctggtatccaggtaaggtccacaacaagcggttcatccggagagcaatcagatgatgatgaagctgaaggagaagcagaaacaactcaatcaacggatccaactgatgtgaaacgtgtgaggagaatgctatccaatagagaatcagctagacgctcgagaagaagaaaacaggcccatctgacagaactagagacacaggtctctcaagtacgagtagaaaactcctctttattgaaacgcttgactgacataagccagaaatacaatgaagcagcagttgacaatagagtattgaaagcagatgttgagacattgagagcaaaggtgaagatggctgaagaactgttaaaagagttactggggttgaatcctctattcccagctatgtctg

SEQ ID NO: 14494 - DNA, 905 bp, Solanum tuberosum
  Predicted polypeptide sequence is orthologous to G740
ctttatttgcacaagctatggctaatcaagccaaccacggggcccaaacccctcaggctcctaccccggcatctcgggtgagagacttcgtgcggatgaatcccccggaattctatgggtctaagttaaatgaagaccctcaagagttcattgatgaagtcctcaagatattagctatcatgggcgtgaagtcagaagataaggcggagttggcggcctaccaactaaaaggggtggcccaaatatggtacaaccaatggaaggaagagaagggggtaaactatgtggtgcattgggaagagttcaaaacggctttccttaatcgattctttcctcttgagcttagggaagccaaattggtggagttcatgaatttaaaacaagggtctatgagtgtgagggagtatgccctcaattttaaccaactttcaaggtatgctccacacttggttgccgactcacggtctagaatgaacaaattcgtgatgggtgtgtccgacctagtgagtgaagaatgccggtccgcaatgttgattagtgacatggacttgtcccgcttgatggtctatgccgaacaaatggaggagggagaagttgaggaagaggaggggtcatgaggccaagagggcccgttttgagggcaagttccaaagtagaacgggaggccggtttcatcaaggtcaagggtcttctcatgcgctccataaggggtttgccaatgatgttccaagggcccaaggtgttaggggtatgtgtcctattgatgtatgtccgaagtgtggtaagggccatggtggcccgtgcttgagaaataccggtgcttgctatagttgtggggaaatggggcacaaggcaatggattgtcctcgaaatcgcacaagggtaaggaggtccgtccacaaggt

SEQ ID NO: 14495 - DNA, 683 bp, Solanum tuberosum
  Predicted polypeptide sequence is orthologous to G748, G1900
tgtgcctagtccatggagtcttccttggttaactccaccatcgccaaccgcaaaccaaaaaggatcaagctctgctcctaattcgcctttagggaagcactcaagggacggtgaattgcttaaaccaaacaatcccgagggtcaaaagaactcagaggggtctgttttagtgccaaaaacattgcggatagatgatcctgatgaagctgcaaagagttctatatggtccacactgggaatcaagtacgactccgttagcaggggagggcttttcaaggccttgcaaccgaaaagcagtgaaaaggatcaccctgccactacatccccggctttgcaggctaatcctgcagccttctctaggtccctcagcttccaggagagagtctaaagtgagcaattgtctccttcagctctgaggtacatagttgttaaccaacttatcttccggaagatggatgttggtctgagaatcttaagatgcctcaagtgctccaactgaaactgggaaagctattgttcaaattagtgtttatccttcccttgtaacatatttttgcttggtcagtgtgtgttttccatgtacataaactttatacagctgacagtagaaagtggaagagagaaacgtttagatgtatatcatgtacctgtcaaagttttagtctggaaggcggcttagcttc

SEQ ID NO: 14496 - DNA, 782 bp, Solanum tuberosum
  misc_feature (638)..(638): n is a, c, g, or t
  Predicted polypeptide sequence is orthologous to G748, G1900
agtgaaatcttccaagactgaggatgatcagaatgatgcatcgaattcgcagcagaaaacactgaagaagccagataaaattctcccctggccctcgttgcaatagtatggatacgaaattctgttactacaataattacaacgtcaatcagcctcgtcatttctgcaagagttgccagagatattggactgctgggggtaccatgaggaatgtgcctgtgggagctggtcgtcgcaagaataagaactctgcttcgcattgtcgtcacatcatgatctctgaagcccttgaagctgcaagaattgatcctccgaccggatttcatcatccagtgttcaaacccaatggaactgtcctatcgtttggtcctgacttgccactgtgtgactctatggcctctgttttgaatcttgccgagaataagacaccaaatgggatccgaaatggtttttacagacgagaacacaagaatccttctggcataggtggagaaaatggggatgactgctctagtggatcttcagtcaccacttcaaattcatcggcgggatgggttaaaaaccgccccctgaggcagttatgcaaactataaatgcctttccatctccagttccttgtctcccagagagtaccttgngcctattccatacagctgcttgttcctttccctgccattacccctgctggatatcctatgccattctgcctcaccttattgaaattgaatgtgcctggtccatggagtcttcttggtaactccacatcgccaacaggaaccaaa

SEQ ID NO: 14497 - DNA, 899 bp, Solanum tuberosum
  misc_feature (667)..(667): n is a, c, g, or t
  Predicted polypeptide sequence is orthologous to G748, G1900
aggtggagatactggggatgagtgctatagggggtctaacatcccaactccaaatatgatggtggaagaaggtaaaggagagacccacaaggctgttatgcatggtataaatggcatcccatctcctgttccttgcctccatggagtaccttggccttttccatggaatgctgcagttcctatgtcggctatttgccccattcccttccctatgccattcttccctacaccttattggaattgcagtgtgcctccttggagtaatccttggctgagtccacctctgcgagcagcaaacgagaaaacatcaggttctgatcctacttcgcctttagggaagcattctagagaaggggatttgcttaagccaagcaatcctgggggcaaagaacaatcagaccaaaagtattcagaggggtctattttggtcccaaaaacattgcggattgatgatcctgatgaagctgctaagagttctatatggtcaacactcgggattaaatatgattctgctaacaggggagagtttttcaaggccttacaaccaaaaagcaatgacaagcacaacaaagccaatacatctccagtattgcatactaaccctgcagccttatctagatctatcaccttccaacaaagtgcctaaagatgatcctatgaatctccngtaggatgaaaaagtagcaaaggtaaggataatggctttttttctcccatttgagctccagcgggaaagtacttgatccactttcatgggaatttcctgccttgaatggaccacttacaagggcaaccagattcactttccagaggctgaagagggtaaaaatcctcttcaaggttgattcccactggaacacctggcggaaaaggcttatttgttagcaaaaccttattgt

SEQ ID NO: 14498 - DNA, 894 bp, Solanum tuberosum
  misc_feature (738)..(738): n is a, c, g, or t
  Predicted polypeptide sequence is orthologous to G752
cttacttatatccttgtaattcattcttaataaaaacctgagcttacagcttaaaatgtcaaatatttacaagtgaaccacaaaatgtacaagaatcaaggaaaaaggagaaaaataaaatgctagaaccaaccatctggatgaacttgtacagtaagggaacaattcagcttccccacatctggaattttggtgtctaaatttatttttattttattttttcgtcggatttggtgtttgaattgatctgaactaagatggtgctgttgttagctttgatgaagctgctgctgatgtcttgcagattgggcaccaattcttgtgctttaaccattgttgtacacattccatgtgataaccatgcttgcattccaactttccgacttcatccccaatcacataatcctcctgacaaatactgcatttgatctcagcttcatccccatcacctccaaatacccctagttccgagtgcatgccttgataaatgcttctttgaagacactttgatactgcctcctccggcagagctgtgctgacactgcccatcctctcttcaagagctagtaattcctcataggacatgctatctatatccagtctcatgtccctatgctggtcatagaagttaaaggccgctaagcagcaagttcgtctccaatgcaagcagctcatatgttaactcttcatctggctttccattcctctcaaatgttgcccaattaaattaccttgagncaacttccatccatggttatatcgcttgtaagggtttggtggttccaatcaaaatccggttaaataaccctagtttcgggcagaaaatgaaaggggcactacactggcggtaaaatcatccaatatcatttcccaggaaacctattagaaaattaa

SEQ ID NO: 14499 - DNA, 757 bp, Solanum tuberosum
  Predicted polypeptide sequence is orthologous to G760
tgaagaagttgaatttggagatgatatctatctagatggacatgaccttgagcagattcttggggctgactcacctgtggatgttgctccacttcctttgaactgctatagcgagggtaatgctagcaacagtggggatataagtaactcctttgaagaagcacaaaactggcttcagcaaccggatgagcaggaatcatttgatcctgcgattcaacagatcaatgcagatacaaatcctgtcaagcatgaattcatgagtgaaccaagcaatagtatgaacactgaagatgtggattacttgcttgatgaaccagttgtaactgcaactgataaccttcaattcagtgatggagcattccttgaagctagtgatctttcaagacccattgaggttgatacgtcaggttttgacatgcttgaggattaccttacattctttgatgcggacgataacttccaaagtatgggtttcaatccaccaatgatgaccgaaggtgatgatcatgtgtctgacttagcatctccggaggagaagaacattggcgaggtaaatgaccaaccaattgcaccaagtgaagagccggaggatcaaaagaagaatgttgcatcatcctccaaactggaacccatctaatttggatcagattataagtatccatttatgaagcaggcaagctgcatgttgggcggtattcctgctcctcctgcatttgcttcggagttcccttcaaaagtgcagctctccgtatgaatt

SEQ ID NO: 14500 - DNA, 927 bp, Solanum tuberosum
  Predicted polypeptide sequence is orthologous to G760
caggctgaagacaagagatttggagtggtacttctttagtgttcttgataagaagtacggtaatggagcaaggaccaaccgagcgacagaaaaaggctactggaagacaaccggaaaggatagggctgtccatcgtaataagtctcaggttgttgggatgaagaagactctagtttatcacaatggtcgtgctccaaagggtcagagaactaattgggtgatgcatgagtacagactgattgatgaggcgttagataaagctggaattcctcaggatgcatttgttttatgcagagtcttccagaagagtggtgcagggccgaagaatggggaacagtatggggcaccttttatagaggaggaatgggaagatgatgagttacaagttcttccgaaggatgagactgctgaggattttgtatttggtgatgatatttatttagatgcaaatgaacttgaccagattcttgggaccgacaaagctgtggctggtgcttcccttcctttggattattcttatggtgaagatggaagtacggaggagacaaataactcctctgatgctcaaaattggctgcagcaacctgacgagcttaaaccaattgatctagctgtgcaacagaattttaatgctgagcaagtcaatcatgaatatattggtgaatcaagcaagaacatgaactctgaagatggggattacttgcttaatgaaccaattgtaaatgggactgatgatctccaatttaacgatgaagctttcctcgaagctaatgatctttcaaatcccgttcaggttgacagctctggttttgacatgtttgaggaataccttacttactttgatgcaaatgatgacttccagaatatgagttttgatccttcagttttctttggaaatgatgatcaaatttctgaatcagcactgct

SEQ ID NO: 14501 - DNA, 921 bp, Solanum tuberosum
  Predicted polypeptide sequence is orthologous to G772, G776
cttaattgggtatcctcaaaaaagttaaatttacattcttggcgttctgggtgtttctagttttttcttatttggttgagaaatggaacaagaaggatcgaaaggggctgtgacggtggctgcttcagcagcggcaccaacgtctttagcaccgggattcagtttccatccgacggatgaggaattagttaggtactatctacggcgaaaagtgtgtgggaagccattcagatttcaagctgttactgaaattgatgtatacaaatctgaaccttgtgaccttgcagaatattcatcggtgaagagcagagatatggagtggtactttttcagccctgtggataagaagtattgtaatggatcttgacttaaccgagctactggtcaaggctattggaaagctactgggaaagatcgtcatatcagccataagtctcaggccattgggatgaagaagacactcgttttccatagtggtcgagctcccgatggcaagagaactaattgggtaatgcatgagtacaggcttgcggacaaagagttggagaaggctggaatcgtgcaggattcctttgttctatgtagaatcttccaaaaaagcggtttgggaccaccaactggtgacagatatgcaccatttatcgaggaggaatgggatgatgattcagccgtgcttcctggaggagagacagaggatgatgcagtgaatggtgttgacgcacgagttgagagcaacgatcttgaccaggatgctccgcccaagattgcttgtgatagtgagaacgtgattgaacttcaaagtcttccatttgcttgcaagagggagagatcagaagaacctgaacttctctctttaagccaaactaagaaatcgaagcatgatgttccgagctctagccgtgcaaatggttctgaagattc

SEQ ID NO: 14502 - DNA, 973 bp, Solanum tuberosum
  Predicted polypeptide sequence is orthologous to G772, G776
ggaccttagagattattcatctctgaagaccagagatttagagtggtattttttcagccctgtagataggaagtatgggaatggatctagacttaatagagccactggacagggctactggaaagctactggaaaggatcgtcctgttcgccacaagtctgagaccattggaatgaagaaaacgcttgttttccataatggtcgagctcctgatggaaagagaactaactgggtaatgcatgagtacagacttgccgatgaagaattggaggcagctggagttgtgcaggatgcctttgtgctctgtcgaattttccaaaaaagtggattagggcctcctaatggcgacagatatgcaccatttattgaggaggaatgggatgacgacacaaccctcctggttcctggaggagagacagaggatgacgtggccaatggtgatgaagcgcgagtcgagggaaatgaatttgaccaggatgtgcatgggaaggctccttgccaaagtgagaacctgcttgagcctcgacctctttcgtttgtttgcaagagggaaaggtctgaggatctcgaactactctctttagctcaacgcaaaagatcgaagcatgatgatcctagctctagccatgcaaatggttctgaagattcaaccactagccaacaggatccaccaacaaagacgatgacgacaaattactcccctactctcttaacattccccttattagatccccttgaaccaaaagaagctcaaccttctaactcccttaattttgactcttccaatcttgaaaaatctgttcctccaggttacttgaagttcattagcaatttagagaatgagatactaaatgtctcgatggaaagggagactgcgaagattgaagtgatgagagctcaagctatgatcaacattctttcatcacgtctcgatctcttgaaacaagagaacgaggacttgaggagactcgtt

SEQ ID NO: 14503 - DNA, 919 bp, Solanum tuberosum
  Predicted polypeptide sequence is orthologous to G773, G1412
cttctctccatttcctaaaaacttgcaacacttttcttctctctctacattttgcttacttgtaagataaaaatgggcgttcaggaaatggatcctcttacacagctaagcttgccacccgggtttcggttttacccgactgatgaagagcttttagttcaatatttatgccgtaaagttgctggtcatgatttttctctacaaattattgcagaaattgatctgtacaaattcgatccatgggttctcccaagtaaggcgatttttggagaaaaagaatggtatttcttcagtccaagagatcggaagtatccaaatggatctagaccgaacagagtagctggttctggttattggaaagcaactggaactgataaaataattactacggaaggtagaaaagttggaatcaaaaaggctttagtgttttatattggtaaagcacctaaaggaactaaaacgaattggattatgcatgaatacagactcagtgaacctacaacgaaaagtcgaagttcaaggctcgacgattgggttctatgtaggatttacaagaagaattccggtgggcaaaaaccgagttgttctgatttacagagcaaggatataaacaatggttcatcatcgtcatcctcgtctcaatttgacgatatgctggaatctctaccagcaattgaagatcgatatttctcattacctagagtgaattccattaggaattttcaacaagacgaaaagctcaatcttcaacaattgggttctgggaactttgattgggccactatagcgggattgaactcatttccggaattagcttccggaaatcaagttccagcaccggggaaatcaactccggtgcttatgaacacaaatcagtatcacaatcacaaccacaacagcaatttgaaataatttcaat

SEQ ID NO: 14504 - DNA, 1565 bp, Solanum tuberosum
  Predicted polypeptide sequence is orthologous to G773, G1412
attttgaagaaaaaaaaatatttgaaaaaaagaatagttttttaataaaaaaatatgggtgttcaagaaaaatatccacttttgcaattaagtttaccaccaggattcagattttatccaactgatgaagaacttttagttcaatatttgtgtaagaaagttgctggacatgattttcctctacaaattattggagaaattgatttatacaaatttgatccttgggttctacctagtaaggcgacatttggagaaaaagaatggtatttcttcagtccgagggataggaagtatccgaatggatctagaccgaatagagtagcaggttccggttattggaaagcaacgggaacggataagatcataacttcgcaaggaagaaaagttggaattaagaaagcccttgtgttttatgtgggtaaagctccaaaaggatccaagacgaattggattatgcatgaatatagactttttgaatcttcaaagaaaaataatggaagttcaaagctagatgaatgggtgctttgtcgaatttataagaagaattcaagtggaccaaaacctcttatgtctggtttacacagcagcaatgagtacagccacggttcatcgacttcgtcctcgtcccaattcgatgatatgctcgaatcgttaccagaaatggatgatcgattctccaatttaccgagattgaactctcttaagaccgagaaattgaaccttgaacgcctggattcagccaatttcgattgggcaatccttgctgggctcaaaccaatgccggaattgcgcccagcaaatcaagctccaggcgttcagggtcagggtcaggctcaggggaatgtcaataaccacaacaacaacaatatgaattttctcaacgatgtttatgcccatcctactacgaatttccgaggcaataccaaggttgaaagtattaatctagacgaagaagttgaaagcgggaacagaaatcgacggattgatcaatcgagttacttccagcagagtctgaatggattttcccaagcgtatacgaacagtgttgatcaattcggaatccaatgtccgaaccagacgttaaatctggggttcaggcagtaggacactgtatatacagaagatctggatttagatttcattgccccaacggattcgaagaaagaggaagtaccgtttcgtggccgatgaaattaacgtcttcgaatgcaagttgcgtctgaagtcattaggctgagggcacgtctgcttggaccttatttgcaagttgtgtctgaagtcattaggctgaggccacgtctgcgtggagcttatttgcaagttgtgtctgaagtcattaggctgagggcacgtctgtgtggacattaaaataacgttataatgtacacaaacaggaaatatatgcaggggcatgtatattcttttaggtactgggcttatagtttgttttattttatgatacatttccagatttggatgtattttgtaattcttacatttctgtgtagcaagttatagaagatatatagaagttacttttaaaataaaaaaaaaaaaaaaaaaaa

SEQ ID NO: 14505 - DNA, 484 bp, Solanum tuberosum
  Predicted polypeptide sequence is orthologous to G773, G1412
cttataactcactgtcttgataagaaaatgatagaccatcactttctcaatcataatgttcaggatttcgtcttcttcttgtaccatcctcaacaactttcagagatgcaccatccttctctagcaatagaatggtacattatgagcccaacatgcaagaagtatacagagggaggtcgatgtaacagctcgaagaattatggatattgggaaccttgttgaatagattctctcatccacaaggatggtaagctgattggttatcagaaaactgtaaaatacattgaggggaagcttaagaaggataggaagcagactgaatggataatgcatgaatacaaacttgataggggaagagaagttagaactgctattacttctgacgacatacatgtatggtactttacttattttaaattaagtgaaaggaaatacttagttgtaagagttgggaatttcggtatacaaaaaaaaaaaaaaaaaa

SEQ ID NO: 14506 - DNA, 510 bp, Solanum tuberosum
  Predicted polypeptide sequence is orthologous to G778
gagttgccggagtttttgatatcaataaccttagccgccccaatatccccggacttccttcctttctccacccttctgccgccactgccgccttcatgcagcctatgacctcctgggataactccagcgccgcccctcctcctcctcctgctatgcctgatcctttagctgccttactcgcttgccaatcacagccaattaacatggatgcgtatagaaggatggcagcattgtaccagcaattccaacagccaccaacaggctctggccctaaaaattgatagtgtatataccatatagtagtagttactatcattttgtaaagttctcctggttttctttacggttggattgactaggagactcttttacttgtttcgaattgtcatttttgtctgtatacttttgactttgccagctaaacacataaacttgtcccaaatctgtatttcaaatttcatctaaaaagttgaatagactgttgccttcgtaaaaaaaaaaaaaaaaaaa

SEQ ID NO: 14507 - DNA, 726 bp, Solanum tuberosum
  Predicted polypeptide sequence is orthologous to G782
ctgatattgagagccttaatgtccaatatcaacaaagaatgaggactatgtatccatgggctgggatggatcattctatggtcatgcatccgccttcatatccgtatccaatgcccgttccggttccaactggaccagttccaatgcatccatctctgcagccctatcctttcttcggcaatcataatcctgcagttgttccaaacccttcatctttcgttcaatacatgactcccaatacattgattgaacagcaaccgactcagtatatgtctccaattatacaaccaggtagtatgaccagacaagaatccaggaacaagtcatcagatcaaggagagagcagaattgagaaaagtgaagattccaatgaagtggcaacagatttagagcttaagacacctggatctacatctgagcaggacctttcatctggacaaaagaaatccagaaagttgccaaggaaggataacagcctcaccgatggaagttcctcaagtaaatgttcatcatcccatagtgtacatgctgtttcttcaaatagtgtagttaggggaacaaagacgggtgattgacgtttgaaaccgaataggaaccaggttattaccattttaattacttttcctttctagcttcttctgctccatctggtgtataaaaaggtttacagatagagagtcagggagctgttgctaatgcaatgggtttcgaatttggatatttctc

SEQ ID NO: 14508 - DNA, 912 bp, Solanum tuberosum
  misc_feature (625)..(625): n is a, c, g, or t
  Predicted polypeptide sequence is orthologous to G782
gcactgcgcaaaaagagaaaaacaaaacagtgcataaattgttgttcttcgacttcaagaaccctagtttcccgattcaattcgcggccatatactgcagaaaatggatcaattaaaccacggcggcctctatcaaccgaatcagcttccaaatcattgtttaacagagttaaatcagcttccttctgatgtttccatgcctcccaatggcttgcattctgaatcaagcagcaaacaaaaacctgaagcagaactcaaagactctattgctgcaagaaaagtgcagaaggcagatcgagaaaaattaaggagggaccgcttgaacgagcaatttttggaattaggaaagacccttgatcctgagaggcctaaaaatgacaaagcatccatcctaagtgataccgttcaaatgctgaaggatttgactgctcaggtcagcagattaaaatctgagtatgctgcacttactgatgaaagccgtgagttgacccaggagaaaaatgatctcagagaagagaaggcgtctcttaaatctgatattgagagccttaatgtccaatatcaacaaagaatgaggactatgtatccatgggctgggatggatcattctatggtcatgcatccngcttcatatccgtatccaatgcccgttccggttccaactggaccagttccaatgcatcccaatctctgcagccctatcctttcttcggcaatcataatcctgcagttgtccaaaaccccttcatcttttcgttcaatacatgactctcaatacatttgatttgaacagcaaaccgactcgtgtatattgtctccaattatacaaccaggtagtatgaccagacaagaaatcaggaacaagtccatcgatcaaggagagagcgaattgagaaagtgaagattccaatg

SEQ ID NO: 14509 - DNA, 1088 bp, Solanum tuberosum
  Predicted polypeptide sequence is orthologous to G783
agatagctctcatctcgggaagaagattcagaagaaagttccaaaaagaattcacaaagctgagagagagaaaatgaagagagagcatctgaatgagctttttcttggtttggctgatgctcttgaactatctgagcagatgaatggaaaagcttctgtattgagtgaagctgctcgatttgtaaaggacatgctttctcagatcaagcatatgaggacagaaaatacaactttgctgtctgaatctcaatatcttagcgtggagaaaaaggagcttgaggatgaaaatagagctctagaggctgaaattagcaaactgcagactgaggtcaaagcaagggaagctgagactagtcttgacctaaatctagctcctcctgaaattcatcatacagagtttgcctcacaaactaactatatgagattgcctgcttcggagcacgcatttcagcagtcacagatgatgaaccctgtgtacgtctttcccttgagttctaatccccaggcttatccagcgcctgatgctgcagattccatggctatgcccacatctactgtgaagaaaccacagcccagataccccactccaaatgatgtatggccatcccaaatccttgaaaagaggcctcagttgttgcgacaggaggttcaagatggtgcataataatagtagtctagtagaaacgagacattcgttcatagggaatggcatgtataattagttaggtaatgtaggatttagacgatagcagcagcagcagattcgcaatactttggacttgcaagtctcattgttttaaccttttgtgtatttgatcgcattaaaaaaacaaaaaaacccgggggggcggtaccatctcgcctaatattattgtaaaacaggctacatggcggtgtttaaaactctgaaaggaaaacctggcttactattaagcttgaaattccctttccagggttataaagacccccacacgctcacaaagatgccatgtatagaacccttcggcaacgcggcgtttgtatcacacgcgacacattaacacaccgctttttttcattcacacgggcccacacaggcctgttatttc

SEQ ID NO: 14510 - DNA, 738 bp, Solanum tuberosum
  Predicted polypeptide sequence is orthologous to G789, G1494
gggaagatcgggtagtagttatgcaagagcatgcaatcaatctacagcgaccaatagccagggccacaaaaggaagagtagagacggtgaagaaccagaatgccagagtaaagctgatgagctagaatcagctggaggaaacaaggcagcccaaaaatctggaactgcccgaaggagccgtgctgcagaagtgcataatctctctgaaaggagacggagggatagaatcaatgagaaaatgaaggccttgcaagagcttcttcctcactctactaagacagacaaagcatcaatgttggatgaggctattgaatacttgaagtcacttcagatgcaactgcagatgatgtggatgggaagtggcatggcatcaatgatgtttcctggtgtccaacactacatgtccagaatgggaatggggatgggtccgccttcggtgccttccatgcacaatgctatgcatttagctaggcttcctttggttgatccagcaataatccctttgacacaagctgctcctaataatcaaggcgctgcaatgtgccagaattcaatgttgaatcaagttaactatcaacgccatttgcagaatcccaattttccagatcaatatgctagttacatggggttccatccacttcaaggcacttctcagcctataaacatttttgggcttaggttcacatacagcacagcgaagtcagcatccaactaatagtaatgcacccgccactttga

SEQ ID NO: 14511 - DNA, 725 bp, Solanum tuberosum
  Predicted polypeptide sequence is orthologous to G791
gctggaccatgtgcatctgattcaaaagcacatagggagaagatgcgcagggacaagctgaatgacaggtttcaagaattaagttctattctggaaccaggaaagcagcccaaaatggataaatctgttatcctgggtgatgcagttcgtatggtggtgcagttgagagatgaagctcagaagctgaaagagtcgaacaacaacttgcaggagaaggttattgaattgaaggctgagaaaaatgaactccgagatgagaaacaaaagctaaaagcagagaaagacaaactcgagcatcatctgaaggccatgaacactcaacctggatttttaccacaccctcctgcaatgccttcccctttctcagccccacatcaagtctttgcaagcaaaatgatgccatatcttggctaccctggaatccctatgtggcagtttgtgcctcctgctgcagttgatacctcagaagatcattctctccgtcctccagttgcttaatttgtggtgacttcttgttaccagaattatgcaaatgtttgtttcctatgtcaacaattttgttgacctttgttgacattttgttctcctaatatgagcagattggtatatatactataatgaggtagttgatcaactgattatgtacactaatatgtaaatctcgctgaagtttacatgaatacctaccttgtgttatatcatctaaccaacatagcatcctcaag

SEQ ID NO: 14512 - DNA, 943 bp, Solanum tuberosum
  Predicted polypeptide sequence is orthologous to G791
gtgggaatcctaattggttatttgattatgagttgataacggatattacttctgctgcttctgttaccgtcactgattttcagtctccggctactattgatttcagctggcctgctcaaacaatctatgcttcctctaatctcattgctgaaacagattacacatttgcggattcagaagtcagtaaggaggcaagctcacgaaagaggttaaaaagtgaatggtgcagctctccgagatctaaggcatgccgagagaaattgcggagggacagactgaatgagaggttcctcgaattgagctctgtccttgatcctggaaggccaccaaaaactgagaaagttgcaattctgagtgatgctcaaaggatgctgattgagctgcgaactgaaacccagaagctgaaggagtcaaatgaggagctgcaagagaagataaaagaacttaaggcagagaagaatgagctccgtgatgaaaagcgaaggctaaaggaagaaaaggagaatttggagcagcaggttaaaagcttagcttctaaaccaggatttctctcccatccttctgccgtgggagctgcatttactgcacaaggacaagtcgctgcaggcaacaaattgatgcctttcattggttatcccagtgttgcaatgtggcaattcatgcaacctgctgttgttgacacatctcaagatcatgtgctccgtcctccagttgcttaaactgaatttgccaggtgacttgctactggaactttgttctttttgttgctcctgtgagtgctaaaggtgacaaacaactgagacaatttgctggttgtatttatatgtctagcttttatgtatgagtcagtcttgatgatttgctaaatcatgtatatgacgggtatatactcacccgaaaaacagttacgtattatgattccctagatgggactccttctgaa

SEQ ID NO: 14513 - DNA, 958 bp, Solanum tuberosum
  Predicted polypeptide sequence is orthologous to G791
cccctttgtttaaattcttccccttttcactttcccatttccaatttttttttctggtcaccggaaatattttcttgaaattccggcggttgatcggagatggttctaccggaaaacaccaactggttgtatgactataattatgaagatatagtctcccctgatgtcaatttctcagtttctgggtattcttggtctatgcaggggtttaatggttcaactaatgctagtgttgatattgatggctcacttggtgaatcagactgcctgaaggaaagcggttgtaagaaaaggacaagagctgaatcatgcacctcgtcaagttccaaagcttgtagggagaaattaaggagagagaaactgaatgacaagttcatggaattggcagtgcttcttgagcccggcaggcctccaaaaacagacaagagtggcattcttgttgatgctgttcgtgtggtgacacagttacgtgatgaagctcaaaaattgaaagactcaaatttggatctacaagaaaagataaaggagttgaaggttgagaaaaatgagcttcgagatgaaaagcagaggctgaagtcccagaaagagaagctagagcaacaactaaagactatgagtgcacaacctagcttcttgcctcctgccatgcccggtgcttttgcttctccaattcaagctgcaggaaccaagctggtgccaatcataagttaccctggagttgccatgtggcaattcatgcctcctgctgcaatagatacctcgcaggatcacgtgctccgccctccagttgcttaagtttgctgctaaacctatgataattgacttaactccgatatgttgttctagttaaacgctctttagctgtgttagtttattcgtcgagtccttttggtgtatttggtggataatagtagttctcttgtaatctttgcacttttaatgtgttaaatgctggttt

SEQ ID NO: 14514 - DNA, 992 bp, Solanum tuberosum
  Predicted polypeptide sequence is orthologous to G791
ctcatcggagaattttccgggagaattcaattttttccatcttctggccggcgatggatcggagatggtttcaccggagaacaccaactggcttaatgattatggatttgaagatagttccgtccctgattcgaatttctcaccttctgcatctgggtttaactggcctgtgcagaatttgaatggttcaaggaatgttagttctgaaattgatgggtcgattggtgaatcagattacccaaaggaaagtggttctaagaaacgggcaagggttgaatcatgtgctccaacaagttccaaagcttgcagagagaaactgcgaagagataagctgaatgacaagttcatggaattgggtgcactccttgagcctggcaggccccccaaaacagacaaatccgctattcttgttgatgctgttcgcatggtgacccagttacgtgatgaagctcaaaagttgaaagactcaaacttgaatctgcaagaaaagatcaaggagttaaaggttgagaaaaccgagcttcgagatgaaaaacagaggctgaaagctgaaaaggagaagctagagcaacaactaaagactacaagtgcgcaacctagtttcttgcctcctgctataccttctgcattttgcctgctcatggtcaatttccaggaagcaagctggtgccaatcatgagttacctggtgtcgcggatgtggcaatcatgtctttctgctgctgtttgatattcacaggacatgttcttcggtcctccaagtgcttaaactgttgcagtttaaagcctaacgaaggttgcttcaatggtccgttaaataacgtaaataagggcctccgtgatatgttgggtcaatcccttccggtttggggatatagaaaattgcgattccactttaaggttataggtgggtttttctcaataaaaaatcctagcgtcttcttttaaaaacacaactcgggggcggcacacctttgtgatacgcctggtaaa

SEQ ID NO: 14515 - DNA, 725 bp, Solanum tuberosum
  misc_feature (699)..(699): n is a, c, g, or t
  Predicted polypeptide sequence is orthologous to G791
cacacatataatttcgttccacttctccatctcctcctcattttcctccttttttcctcttccacctaacacgcaagtgggattgggataccctacaatcttcaactgaaattttccggcgccggtagttctcacatcggagaaaatggcggaaacagaggaagacggatcaaattggcttatagaattagggttaatggaagaccttccttctcttgaacccaatgctcaatggccctccaacgctttttccattccaaataatctcagttctggattagaagattcctatggcaactcagatagtttaaaggaatgcggctccaaaaagagggtgagatctggagcatgtgcatctgattcaaaagcacatagggagaaaatgcgcagggacaagctgaatgacaggtttcaagaattaagttctattctggaaccaggaaagcagccaaaaatggataaatctgttatcctgggtgatgcagttcgtatggtggtgcagttgagagatgaagctcagaagctgaaagagtcgaacaacaacttgcaggagaaggttattgaattgaaggctgagaaaaatgaactccgagatgagaaacaaaagctaaaagcagagaaagacaagctcgagcagcatctgagcgcatgaatactcaacctggatttttaccacatcctccctgccaatggccttcnccgtttttctccattccgcaacatca

SEQ ID NO: 14516 - DNA, 696 bp, Solanum tuberosum
  Predicted polypeptide sequence is orthologous to G798, G1897
aaaataaaacagagctactacaacaacaacaaaaaaatgccttctgatgtgagtgaccgaagagcaaccaaacaacagcaaggaggtgcaccggctccggagccggagcatcttccttgcccacgttgtgattccaccaacacaaaattctgttactacaacaactacaatttctctcagccacgtcatttctgcaaatcgtgccgccgttattggacgcacggcggcactcttcgtgacatccctattggtggtggaagtcgtaaaaatgcaaaacggtcccgtacaatcactactaactccattaacagtagctgcttgtcctccacgctctctcctcgcgactaccatcacgcgcctaacccgtcacacgtttccccttttttggttcctctaactgccgatcatggcggttcactaccgtttgacgtgaagccgagtgtgaacatgtgtgggagtttcacttcgttgctgagcagtgctcaagggcctggtgggcttttagcacttggtggatttgggcttggagttgggtctggaattgaagatatgggctttggtcttggtaggcccatttggccatttcctggagtttcacataacagtgttgataataacaataatggtgctggagctagtatttttggaagcacgtggcagcttgctagtggtggagagggaagcttccttggagct

SEQ ID NO: 14517 - DNA, 907 bp, Solanum tuberosum
  Predicted polypeptide sequence is orthologous to G801
acatactacttgttttttactttgttgggattttgctcattctctggctacttacaaaagtggtgaatcttgatttgttaagtatttttacatatttgttgtttggggctctgttttttctcccataaatctcacatcaaagagctttttctattacttgaaacttcaactgaagctgctttcttgatttgtctaagtttttttttttttacatatttgttgttttttcctctttgtttggggttttgcttaattcagctctgtttccccccataaacataaattccaaattaaagagcttggtgaatttgttgttttttctttgttggggtttgctcaattcagctctttttgctcataaactccaccactactctatttggactttgattttcaaatatttgtttccttttcattgttgggttttgttcaattgagctctgtttgtctataaatcccagcaatcttccaccaccaccgtttttactagtgttttgtgcttctaatgtcgacgtctgcagaaggaaatggagctataattgatcctcagaggcaacaacaacaacaacaggcttctggggttggtacaaatggtgctttaacagtgaaaaaaccgccggtaaaagaccggcatagcaaggttgatggtagaggaagacgtataaggatgccaattgtatgtgctgcaagagtttttcagcttactcgtgaattgggtcacaaatccgatggacaaactatcgaatggctgcttcgtcaagctgagccttcaattatagctgctactggtactggtactatccctgctagtttctctactgtatctgtatcggtacggaactcaactgcatctcttgtttcatcgctctcggctccacttgatcagaaatcatcacatatgatttca

SEQ ID NO: 14518 - DNA, 944 bp, Solanum tuberosum
  Predicted polypeptide sequence is orthologous to G801
cgacgtcggtagaaccaaacggcgccgttttactcgattctaccgccggctccggtggtggagttgctaatagtaatggtgctttgacggtgaagaaacagccggcgaaggaccggcatagtaaagttgatggaagaggaagacgtataaggatgccaattgtttgtgctgctagggtttttcagctaactcgtgaactaggtcataaatccgatggacaaacaattgaatggttgttgagacaagctgaaccttcgattatagctgctactggtactggaactatacctgctagtttctctactgtttcagtttccttacggaattccatttcttctgtttctgcttctgctccggttgatcataagttgccgtcgccgtcgttgttacatccgttgatttctccggcgccgtttttgcttgggaagcgtttacggtctgaggatgatgataacggaagtggagataaggatgtggttcctagtgctgggttttgggctgttcctgctaggccggattttggacaagtttggagtttcgctgcaccgccgccggagatttcacattccgcggcgatgatttcgcacccgtcgaggcttcttcagcagcagatggaagaggcatcagttggtagagttgggaattactttcctatagctcaagggcatctgaatttgctagcttctctgtccggttcaggttccggaccgcagagaagggatgatgatggacaatgaagaatatatgaagtatttgctgtttatgatatgtataaattgaagtattgttgttcttgtttgttcgtattgttaatttttaggtattaggtagtgtagtgagtgagaaatgaagctaggttttgttgccatttgttgaattattgctaggattagagtgtttgcttgttcgatcgttccatcattgcatttgttaggggtttcagt

SEQ ID NO: 14519 - DNA, 991 bp, Solanum tuberosum
  Predicted polypeptide sequence is orthologous to G802
tttctttgctacaacttcccaatttcataatacacaattgggttaaattttcaaatatcaaaagaaatctttgttgttaggtactttccctcaccccacctccacagatggaatttagagagtcaaatagcaaaaacaaccaagatggtgggaacaatagcaataacaataataataacaatagtaatgaaaataataacaatgcgatttctactaaagttgttaagaagccatcgaaagaccgtcacacgaaggtggacggtcgagggcggcgcatccgaatgccggctttatgcgccgccagggtttttcaacttacgaaagaattgggtcataagtccgatggcgaaaccatagagtggctattgcaacaagctgaaccttcgattatagctgcaacgggaacaggtacaattccggctaatttctcaactcttaatgtctctttacgtagcagcgggactacaatttcagctccgccgtcgaaatctgccccgcttttcattcacggcggcgctaccactatgctgggtttccaccaccagattccgggaaacagttttgggcaagacccagatgagaatttcatgaaaaagaggtatagagaagatacaactgcagcaacaacctcaccgtcatcatcatcagctaaaccggaaagaaccggagttcaaggtcacgaaccggatcaagaatcgaaacccggttcattgaatccctctagttacataccggctcccgccatgtgggcggttgggccggcggccggtaacgtcggaaacacgttctggatgttaccaggtacctcatcaaccatgcagagaattggtggtttcgagttaccaggaggtggccggttcagtccggttcaactaggatcaatgtttttgcagcagccacaaccggttcagcagctggggttgggtgtgacagagactaatatgggaatgtgggcatccatgaatgcatataatagtagcagtaggggtag

SEQ ID NO: 14520 - DNA, 1003 bp, Solanum tuberosum
  Predicted polypeptide sequence is orthologous to G802
aacaaactaccaccaataacaccaccccttctccacctctacaccaccagcaccagcatcagtaccagctactctcccagcaccatcaccaccagcagcagcttcaacaacaacatggggagagcatctgttccttttatgacctctatttctatccagccttcggcacaagctccaattactaattctgctagtcctactgctactagtgcttctccttctacttcatctccaactccaccgcagcagcagccacctcatctagtggacgcttctcttgcaattgccactagatcggactccttagttgacccaaataagaaatctcagcctcagcagcagctggcaatacaacaaacacaacatgtgcaacaacagctacagccaccaccgaagcgacaaacaaaggatcggcacaccaaagttgacgggagagggcggcgcatccgaatgccagccgcctgtgcagctagggtttttcaattgaccagagaattaggccataagtccgacggagaaactatcgaatggctcttacagcaagccgagccagccatcatcgctgccactggcaccggcacaatcccagccaacttttcaactctgaacatatccctccgtagcagcggctccactctctcagctcctccttctaagtcagctcctcattcttttcacagcgctttagctttagccgctgcccatcatacccctcatccttttgaagaaggattctcgcacatgctaggttttcatcataatactcacctcctgacgcaaaatccaatcgcagactcaatacctggaggtagcggtggtggcgatggtactggtggtggagagggggcggataattaccttcggaaaagataccgagaggatttgttcaaagaggaaggttcaagtaatcaacaaggagaagcttctggaggatctagttcaccttcaaataagcagttcaaaggaaattcatcgccattgcctaataagcctattcccaaga

SEQ ID NO: 14521 - DNA, 969 bp, Solanum tuberosum
  Predicted polypeptide sequence is orthologous to G802
cacaacgttctatccactcccaaggtagttaagaaaccttctaaagaccgtcatactaaggtggacggtcgtgggcggcgcatacgcatgcctgctttatgtgccgctcgggttttccaactcactagagaattgggtcataaatctgacggagaaaccatcgagtggctattgcaacaagctgaaccggcaattatagctaccacaggaaccggtacaattccggctaatttctcaactctcaacgtttctacacgtagcagtggtacaacaatttcagctccgccgtcaaaatctgcacctcttttcatccacggcgcctccgccgccgctgctgccaccgctatgttagggttccaccaccatctatccaccaacaacaccggttttagccaagacccagatgagaattacatgaaaaaacggttcagagaagatactactaccagtggtgccacctccccttcagctgataaaccgggtgaaccgggttcagattcttctaaacccggttcttcacaacctccgagtttaatcccggctcaagccttgtgggcggttgcaccagctggtggtaacgttggtaacgggttctggatgttaccagtaagcggaggcaccggttcaacgacggtttcagttggagcggctcaatcggaccaccaattgtggcagtacaagagttcaagaattggtgggttggagttccccggtggaggacggttcagtccggttcagttaggttcaatggttttgcagcagtcacaggcggttcaacaattggggtcaaatatgggaatgttgtcatcaatgaatgcatataataataataataacagtagggttgatttgggtatgaatttggagcatcatcatctaagacaacagcatcaagatagtgatagtggtgatgaaaatcacaatgattcccaatcatagtttacaaatctcgatgcaataaattgaaaa

SEQ ID NO: 14522 - DNA, 310 bp, Solanum tuberosum
  Predicted polypeptide sequence is orthologous to G802
acacaaatgggatattggatccctcctcagcgttgttacaagaactttgggacacaagacattggacaagatttatagggaatttgacagctacgtgaactctcatgctgcaatgtatgtttgaagcctatgcttgaagattcattggttagaaatggtcctgcaccagacttctgtgttttccacttccaacttgtttatggttttaactataaaaaaatgaacttgtcatttgtgtcaaatgtatacaaagaattaaacgtcattaataagatgttatgtatgagtttttaaaaaaaaaaaaaaaaaa

SEQ ID NO: 14523 - DNA, 855 bp, Solanum tuberosum
  Predicted polypeptide sequence is orthologous to G807
tcaaccttcaatgaccgaggctgcaaaagtgttgcagcagcagattctgaaaataaatgcatctgggaggctggacaaccgattaaacacaaatgactgtttgactaataatcccctcccgcctcaaaattctctagacagtagcggtgcatccagttgtatttccagtgttaccctctcagaagtaatgtcaacttcttcacagcctaatctaatgtcagattcaggatttccattcaactcttgttcatccatcatatctgagacccaatcatccactactgtggttcctggggaggccaacattcccgtattacctgaagctgatgcattgaactctcaggcagtccatgatttgcctgaattttctcatattcttggagtaactgaccttgaccttaatatgtctgagactggaaatgtgccagatattgacacagcgcaaggtattttggatggtttaacaacaattgtctctgatgaattttcagcaaacacagatggtgatgttttgctggatgacatgcctaagcttccagcgattaatgatattttctgggaccagattctctctgcaacccctgcaagccgctctcactggggatacggatgagattggttccctagtcgttggaagaggatttcctagggagttcaggaacagtgattgggataaaactaaaagcatatgcatcaatcttactgaacagatggggctactttcatcagttggccagatttgactgatttccatgtttttttaaaaccgccttgcaatgaattcagcgtgtcctggcagtttaaattgaattaaccacccttgaaaccacacaactgcttgaaaatgtggttgaa

SEQ ID NO: 14524 - DNA, 1007 bp, Solanum tuberosum
  Predicted polypeptide sequence is orthologous to G811
atcaaaaatgaattaaaatacattacaagtagctaatatagaatatagctcacataattataaatcatttattttttttactaaactaaaatccaccaccgaataatgaaaatggataaggcggtggactagcttcctccgtcgccgtattcctcctcctccaccacctccaccgccgccatagtcgtaaccgtaaaagttatccattggtggagccgtgaaaccgccgctctccgacgagccagttgacaatgtactagacatagtaggacaacttccgtaagcttcattagtcatcatcatcggccggccaccgatgacgactttttgccgactcatccacgccgtggacggcgtttccgacgacggcgaggattgatagaacgtatccttatcgaaattcgcgtcaggagatcgaatcgactgtatcgtacctggctcataagttatcattggccgacaacccagccacgccggcggtggcggagttcccgatgacggagaggactgacagatcgcatccttatcgaaattcgcgtcgggtgagtgaaatgacgatgttgcccctactgcatcttcactctttactgaagaccaactcgttgaattcgaaatcataagtctccttttcttctcacgatttgttaaacttagccttttggattctccttctccattaaaattctgggcaaaatctcaggatcatcaaacaacttttacacaaaaaaaagccatcaattgctgttggcctctttctcctgtaggctttctaaatctttcctaagttcatattctctccaactctcatgatctaagaacctttttgttccctgcttttaattcttggaacaatcttctggtaaaaatttctttcgtcttcaactcttcattcctggttcctgagaaccatgcaatttctagctggggcgttttcctccctatttttttccacacaaaatgcgtttttctcccaaaaacatttcttttggcattcccccttttggtca

SEQ ID NO: 14525 - DNA, 786 bp, Solanum tuberosum
  Predicted polypeptide sequence is orthologous to G812, G2467
gctaaaataactcaacttcttaactgcataaactaccttacccaaagagaaactttccatttccaaaatccaaaatccaaacttttttcttcctaaaaatacatatattttcccctgtttcttgatgatgaatcaattgtattctgttaaagaggagttcccggggtcaagttctggtgggggtgagcccccaccgttgacaccacaaccaatggaagggcttcatgacattggtccaccaccattccttacaaagacatatgaaatggtggatgattcaactatagatcatgttgtttcttggaacagaggaggtcaaagcttcgtagtctgggatcctcatgccttttcgactacactacttcccagattcttcaaacacaacaatttctcgagctttgtcagacagctaaatacttatacgaattaagatctggtgatgttcctctgatgaatccttcaagttctggtggttggtataacctattaaaatattcatcgtgctgcggacccaaaaaaaaaaaaaagcactagtgtcaagaattgtttgctaagatggatcttggaaaaatttggaagatgatgatactaagctgcagatgggatttgattgttgcagggatttaaaaagattgatccagagagatgggaaattcgcaaacgaggcatttctaaaggggagttagcatcttctaagaacatcaagaggcgaaaaacgtctaattctcctacagagcaaggtctcggtccttgtgtcgaattgggatttgatggagagttgatcga

SEQ ID NO: 14526 - DNA, 811 bp, Solanum tuberosum
  Predicted polypeptide sequence is orthologous to G831, G1202
gggagttactgcagaggggttctctgaagatacagaattgtggaagaagagagtcgcccactacaaggcattggacagtcaattagcagaacgtggaaggtaccgtaacatacttgacatgaatgcttggctgggaggatttgcagctgcacttgttgatgatccagtttgggtcatgaacatcgtccccactgaggctgaagtcaatactcttggagttatcttcgaacgtggtttaattggaacataccaaagctggtgtgaggcaatgtcaacgtatccaagaacttacgacttcatacatgctgattcgctcttcaccctataccaggacagatgtgaaatggaagatatattattggaaatggatagagtattaaggccacaaggcagtgcaatattccgagacgatgtggatgttttggtaaacgtgaagagcatattagacggactacaatgggaaagcaggatggttgatcacgaaggcggtcctcatgttagagaaaagcttctaattgctactaaactgtattggacagcaccagcacctgatcaagataaacaatgagtattctatactgtggctagggccaattctttacttacttttgttgataagttttttgtttgttctatgatttttcattaacctctctatcttttggattcaaaataaacaagtggatattgaggtttttccctgagaattttaatcttacgtactgtgaaatgcaaaatttggtatagaaaccagaatttagatgatattagtgtttaatgactctagattgtttcttctacagtaatcatt

SEQ ID NO: 14527 - DNA, 990 bp, Solanum tuberosum
  Predicted polypeptide sequence is orthologous to G839, G1196
atcatcaattcaaaagaagtactaatattacaaaagataagccatttctgtacctacttttattcctctttcccctatatagtttacccccacaatcaatccactctctttgtacttttctacaagatgatttgtctcaatgatacttgtccaaaagaaagatgagtactatagtatatatggagctcaaacatgttaagctcatgacaaggttcaaaagtcacacggcccttcaagacagaggcttctgtcatcgttagaatccttagctagggagaggatctacttttttctaaacttgtgactgacattagtctttggagaacatgaagaggaggaagacgtagagaagcccgcccagttcttttcagcttgtctttcttgaatgcctccataacttcatccttgagttcggtgtatcgcatcttctttgatctttgttcctcaggggtgccactttctaacatcaacgaatctagtttgtcatcctccagtaacctatctaaaacttcggagcagtttgggaaaaaacgtcgacctgtgtccactgtcattaaggtagacaaaaaaacacaatattgagaaagactacaacaacaacaaacccaaatgtaatctcacaagtaaggtatggggagggtaggacgtaggcaaaccttaccccacctttaatttgtgggtagagagcttgtttctggtaaacccttggctcaaaacaaatgtaatcaaagcatgatagaaagaaaaaaacaacagcaaaatagcaagataaatagaacaatgaaacagcttgtaatagtgaacattaggagattaagatactacacataaactaacaaatacaacaactttggctacctgttactcttctatccttaccctcgacctccaaatcttcctatctaggtttatgtccttaaatagctagctatcctcataaagctgaagatgtggataaagactattcacgggaaaacgctatcctactta

SEQ ID NO: 14528 - DNA, 886 bp, Solanum tuberosum
  Predicted polypeptide sequence is orthologous to G839, G1196
tttagatggagcctacgctcttcattacgctgttgcatattgtgaccccaaggttgttactgaggttcttggactgggtgttgctaatgtcaaccttcggaatacacgtggttacactgtgcttcacattgctgccatgcgtaaggaaccctcaatcattgtatcacttttgactaagggagctcatgcatcagaaattacattggatgggcagagtgctgttagcatctgtaggaggctgactaggcctaaggagtaccatgcaaaaacagaacaaggccaggaagcaaacaaagatcgggtatgtattgatgttttggagagagagatgcgtcgcaacccaatgaccagagatgcattattttcttcccccatgttggccgatgatctgcccatgaaactgctctacctggaaaacagagtggcatttgcacgattattgttccctcttgaagccaaactagccatggaaattgcaactgctgagacaacagctgaattcgcggatcatttggcatctaaaggttcatctggaaacttgagggaggttgatctgaatgagacacccataatgcagaaagaaagactctcgaagacagttgagctgggcaaacgctactttcctcattgctcccaagttctggataagtttatggaggatgacttacccgactttattttccttgagaagggcactccagaggaacaaaagatcaagaggcgggatttaaggagctcaaagatgatgtcaaagggcatataacaaagacaaggtggacttcattgcctctggttgtctcctcatcatcttccacactttttaaaaccgtgcaagtgtcaaaataagaacttataatataactaggtttatcctacaatttttgaa

SEQ ID NO: 14529 - DNA, 994 bp, Solanum tuberosum
  misc_feature (774)..(774): n is a, c, g, or t
  misc_feature (852)..(852): n is a, c, g, or t
  Predicted polypeptide sequence is orthologous to G839, G1196
ttttgatccaaatatctctacatagtgataaaatacgataaattctccatacacgttaatcatttctacatcattaatatttccacaagcttgttcttatgcaactttatttctactataaacaagcaagcttaacaagatgaactatgaaaatggtcaacgatagagcagccactataatgaaatttttacaagataagtgttttgaagactaattatcttacatacaaaactgagtttaagaacaattcgtagggtaaaacctagttactatcataggttcctagctttgacacttgcaccgtctttaaaagttgtggaagatgatgaggaagacaagccagagcaatgaagtccagccttgtctttgttaaatgccctttgaacatcatctttgagctccttaaatcgccgcctcttgatcttttgttcctctggagtgcccttctcaaggaaaataaagtcgggcaagtcatcctccataaacttatccagaacttgggagcaatgaggaaagtagcgtttgcccagctcaactgtcttcgagagtctttctttctgcattatgggtgtctcattcagatcaacctccctcaagtttccagatgaacctttagatgccaaatgatccgcgaattcagctgttgtctcagcagttgcaatttccatggctagtttggcttcaagagggaacaataatcgtgcaaatgccactctgttttccaggtagagctgtttcatgggggaagaaaataatgcatctccggtcattgngttgcgacgcatctctctctccaaaaacatcaatacattaccgatctttggtttgcttcctggccttgtttctggttnttgccatggtaatcctttaaggcctagttaaggctccttacagatgctaacaggacttttggcattccaagttaattctggaagattaaatccctttatcaaaagtgatacaatgattgagggtgccttagcatggcggcag

SEQ ID NO: 14530 - DNA, 439 bp, Solanum tuberosum
  Predicted polypeptide sequence is orthologous to G846
ggcacaatgtctcttgctgctagagacagagctgtcaaagagttcaacacaaatcctgaggtgactgtcatgttgatgtcactaaaagctggaaatcttggcctaaatatggtggcagcgtctcatgtaattcttctggacctttggtggaatccaaccactgaagatcaggctattgatcgagctcacagaataggacaaactcgtgcagtcaccgtgtctcgtttaactgtcaaagatacagttgaagatcgaataatagctctccaggaggacaagaggaacatggttgcatctgcttttggtgaagatcaaagtggaggcacagctagtcgactaactgtagaagatcttagatatctgtttaacctctaatacagggggcagggcttttttatctgcatttgggctgttatggccagttagcagaatgttcata

SEQ ID NO: 14531 - DNA, 775 bp, Solanum tuberosum
  Predicted polypeptide sequence is orthologous to G849
caacaaaaaaagtaaataaaaagtgttgtaacaaacaagtacaaattcttcttcttcttcctttttagcattttttttcatggcttgaaaattcataattctcatacataatacatagatttcttctcagatcggtgaaattagtgacattggtttattgcatcgggtgatcacttgttggcatgcttctgaagatatggtgtataagaagaagttagattttggtttcaatggctttcaagttccagttatacctaaagctcctagatcagttagaaggagacgttcctgtaaaaaattggatgatgatcaaatttgtgcatttgaattattggcggctgttgccgggaagcttttactggagagcgaaagctctacttccagtaatgcagcagaagggaaaaatgaaattgctgatggcagggatggtattaaaagtgaacaagtggaagaaggtaaagctgtgaaatcagagtgcctcgaccaggggagttgtgtagaaagcgattatatacccgaaactgcagcccaagatcagaatttgaaacatggtttcgataaacctcatcaagcagaaaataattatttcttggagcatacttctactgttataggctctgacgctgacttgaagttggaaaactgcaaggaggtcaatatacctgatggaaaattccacccaaaattgagggtggatcctctagtcttgaagatccatgtgatggtaaaatcaggaccggaattcaaaagcacttagatgatgacacgcagcaga

SEQ ID NO: 14532 - DNA, 683 bp, Solanum tuberosum
  Predicted polypeptide sequence is orthologous to G852, G2633
ggaatggtgcaatagcagatgcatgtagaaatgaaaatcgcattcacattctagacttccagattgcacaagggactcaatggatgactcttcttcaagctctagctgccaggcctagcggtgcaccttatgtacgtattacaggtattgatgatccagtttcaaaatacgcccggggagatggactgacgttagtgggaaaaaagctggcagcaatttctgagaaattcaacattccggttgagtttcatgcagtgccagtttttgctcctgatgtcacctgggatatgcttgatgtgaggcctggtgaggctctggcagtaaacttccctttgtcacttcaccacacacccgatgagagcgttgatgttactaatccaagggatgagcttctaaggatggtgaaatcgttttctcctaaggtagtcactttggtggaacaagaatcaaacacaaacactgccccctttttccctcgatttcaagaagctctagactactattctgcaatgttcgagtccatagatgtaacgttagaaagggacaagaaggagaggatcaacgtggagcagcattgtttggcaagggatatagttaacgtcatagcatgcgaaagccaggaaagagtggaacgccacgagctattagggaaatggaaattgaaggtcacaatggcagggttc

SEQ ID NO: 14533 - DNA, 888 bp, Solanum tuberosum
  Predicted polypeptide sequence is orthologous to G852, G2633
gcggtgaagcagtgtcagatgctgatatctcaactgctgaagctcttatgagagctttggagcaacgggtgtcggtgtctggggaaccgatggaacggttgggtgcatacgtgttggaagggattagagcacgactactatcatcaggaagcatcatatacaaaaaattgaagtgcaaagaactaactggctcggaattattgtcttacatgcaagtcatctttaacatgtgcccatactacaaatttgcttatatgtctgcgaatgtcgtcatcagagaagccatgatgaatgagaacagaatccatatcattgattttcagattgcacagggaagtcagtggatgttcctcctccacgatcttgctcgtagtcctggtggacccccatttgtccgcatcacaggtgttgatgatgacgaatcagcttatgctcggggtggaggtcttcagctagtaggcgaaaggctagcagaagttgccaaatcatgtggagtgccttttgaattccatggtgctgaactatcaggctgtgagatccaactagagaaccttcgggttaaacatggagaagctctggcagtaaacttcccttatatgctgcaccacatgccagacgagagtgtaagcactatcaatcatcgtgaccgcctattaagactagttaagagtttatcccccaaaattgtgaccttagttgaacaagaatcaaacaccaacactgcccctttccttccaaggttccgtgaaactcttgattattatacagcaatgttcgagtcaattgatgcagctcgtcctagggacgacaaggagaggatcagtgcagaggagcattgtgtggcacgagacgttgtgaacataatagcatgtgagggagctgatagag

SEQ ID NO: 14534 - DNA, 955 bp, Solanum tuberosum
  Predicted polypeptide sequence is orthologous to G852, G2633
gatgcagaacaatagaatcccctttggaaaatatcttgaattcatcaaaaagattcaatcttttttataagattttgttggttatgacattcgccgtatctgctgaaagcttctgagactttgtgactacttttaacgaagagactacgatagcttggagcagttgttcagcatcttagcctatttgaagagagtgcgtgactgatcccaagatgcacgcatcccagatacctcaatcatcaggcggagttcacaagttgtgctatcagccaacggcgaactttgagcaatattatagcccttaccatgtagttaacaacaattccagcgatactagcagctcggggacacagctctcttatcagacacagaatgaaaagtttttcactctggactcactgcctgatgctggttatgtcagctatgattcgcctcctgctgttagcgtctcgtccaactggagtccgttctctcctcagtgttctcagtcgtacatctcggatcagcaccattcctcagacaacacttatggttcacctttgagcgggtgctcagtaattaatgatggcaatgaactgaagcatgtgctaagggagatggcgaataatttgctagggcctggttctgatatggatgaagacagcagttgctctttcaatggtgaggtctcaaaaccttcaaagtggaatcgagtattggaaattgcaccgagcttggacatgaaagagctgcttattgcctgtgctgaagcaatatcggatgtcgaagtcacagctagagatgctcagatgaatgtcttagggcaaaaggtatcggatgccgatgtcacagctagagatgctctgataaatgtcttagagcaaaaggtatcggtttccggggaatctatgcaacgattaagcgcatacatgttggaaggactcaaagcaagaatatattctttcgggaagtaaca

SEQ ID NO: 14535 - DNA, 1043 bp, Solanum tuberosum
  Predicted polypeptide sequence is orthologous to G852, G2633
ttagtgaaaatattgggggcacaaacatcaggtcagaggtataaagcgtggaacaaggaagcccaagttgtgcatcaacctcaacaatcactagtttccatccttaatggaattcaaagtgataagcgagacaatgtaatggaggacttacccttgcagggtgttccgtctagcaatctgaagcagctgcttatagcatgcgccagagcccttgctgaaaacaagctagatgattttgaaatactggttgctaaggcaaggagtgttgtgtccgttactggagatcccatccagcgtcttggtgcttacattgtagaaggcctcgtagcaagaaaggagttgtctggaaccaccatatacaggagtttgaagtgtaaggagccagctggtaaggacttgttctcctacatgtatatcctctatgaaatatgtccttacctaaagttcggctacatggctgcaaatggtgcaatagtagaagcatgcagaaatgaagatcgcatccacattatagacttccaaattgcacaggggacccaatggatgactctcttacaagctcttgctgcacgacccggtggtgccccctatgtacgtattacaggaattgatgatccagtttcacagtacgctcggggagatggattggctgcagttgccaaacggctatcagcaatttctgagaaattcaacattgcagttgagtttcatgcagtgccagtttttgctccagaaatcacttgggatatgcttgatgtaaggcctggtgaggctctggcagtaaactttcctttgcaacttcaccacacccctgatgagagcgttgacgtgaataaccctagggatggtctcattaggatgataaagtcgctttgccccaagatagtcactttggtggagcaagaatcaaatacaaacacagctccgtttctccctaggtttgtagaagctctagattactaccatgcaatgtttgagtccatagatgtgaccctactaagggacatgaaggagcggatcaatgtggagcagcactgtttggc

SEQ ID NO: 14536 - DNA, 896 bp, Solanum tuberosum
  Predicted polypeptide sequence is orthologous to G852, G2633
tcaagtttggatatttgtcagcaaatggtgcaattgttgatgccatgaaagatgagaactcgatccatataatcgatttcctgattgctcagggtagccagtggatcaccttaatccatgctctcgcagcccggcctggtggccctccaagaatccgcatcacagggattgatgactctacgtcagcttacgccagaggaggagggattgaaatcgtaggtcgaagattgtcaagcattgctgcatcttgcaatgtacctttcgaatttcatcccgtgtctgtttcttgtccagatattgagattgagcatcttaaggttcgtcccggggaaccattggctgttaactttgcgctcgtcttgcaccatatgcctgatgagagcgttggaactcaaaatcacagagacagacttctgaggatggttaaaagcttatctcccaagattgttaccttagtggagcaagagtccaacactaatacagcccaattcttccccaggtttttggagacactgaattactacctatctgtgtttgaatcaatagacgtggctctacctagaaaccataaggaacgaatcaacgttgagcaacactgcttagcccgtgaaattgtcaacatattagcatgtgaagggacagagagagtggagcgtcatgagcctcttgaaaggtggaggtcacgatttgctatggccgggttcaaaccatatccgttaagctcctcagtaaacgctactatcaagaccctgctggagaattactaccaaagctatacgcttaatgagagaaatggcgcgctctgtcttggctggatgaatcgagatttagttgcttcttgtgcatggaaatagtctgttatcagcctctctaccccacaaaggtagaggtaagat

SEQ ID NO: 14537 - DNA, 948 bp, Solanum tuberosum
  Predicted polypeptide sequence is orthologous to G852, G2633
tatcggactgctacatcctggtcaattatctggacagaaaactaaaatgaagtataagagaatagctagctgaagtagaaactgacaatagaggacgaaaaaaaacagttttatctactagtttcacatcaacctacattagcacaaaagttaatcttatcttgaatggcatcaaagtatacaatgccatgcattctgatcataaacactgaaatattatcacacagtctgttttcgctacaagttgatccaatgcacagcattgtttgtttctgagagagcatatgttgtttctacctccaagctgaagcaacagtcagggtcttgtcctcccacccgaaatagagtgcacctgcctcctcctctgctttgtacctttcgctatattgcttgataagattccggattgagtcatagacatttcggctaattggggatggagtgaaaccagccatcatcatcctagctctccacttccctgcaacctcatagcgctctattcgctccaatccttcacaggcaacaatgttgatgatatcacgtgcaagacattgccgttctacattaaccctctcttggctatcccttgaaagagttgcatcgagagactcgaatacgacacaatagtagttgtagacttctgcaaacctttgtagaaatggggcagtgttagtgttcatgtcttgctcaacaactgttaccagctttggatttaagctcttcaccatccgcagaagctggtctctttggtttaccgttgatacactttcatcaggcatgtgatgaagctggaacgcgaagtttactaaaaacagcttcaaccaggacggcagttcaacattgctggggtgactaatccagtgttggaagacactgtttgggaactccaaagagatcttaaaaatcttgggccagtctgcaaggctgagaacatgacattaagggctc

SEQ ID NO: 14538 - DNA, 952 bp, Solanum tuberosum
  misc_feature (200)..(200): n is a, c, g, or t
  Predicted polypeptide sequence is orthologous to G852, G2633
gggattgaaagggtagaacgacatgaacttcttggtaagtggaagtcgcggtttagaatggctggttttaacccatacccattgagttcattagtgaacgctacgatcaagacattgctagagagctactctgataagtataggcttgaagaaagagatggtgctctttaccttgggttggatgaacagagattttggtntgcttctttggtgcccttggaaaataaacaaaattgggtttctttttccattagaaaacttttttctccttttgggttccccttttttttttttccctcccttaattctttttggttaaaccaaggccttaaaaaggtggccttaaaattaataagttaaagaaaaaaaccaagggtttcctccttgttccaaccacacgacacaaagaacactacaccaaacaagagacatagcaagaaagagaagaagaacttccggaaggggggggggcccctgggttaacccccatattttccggccccttaataagttggaggtctgttaattaacgcggccgctccacttgggcccggtccggtttttaacaaaccggttccggttggacctcggggaaaaaaacccctgggctgttttaccccaaatctttaaattcgggctctttgccaggcaacaatcccccgctttttccggccaagtctgggccggtaatagacggaagagggccccggcacccgaatcggccctttcccaaaccaggtttgccgccaggccttgaaatggacgaattggggaaccgccggccctgttagccgggggcaattaaggcgcggcggggtggtgggtgtgtttaaccgcggcaagcggttgagccggttaacacttgccaggcgcccttagcagcccccgttccttttcgctttttcttttcccttcccttttcttcggccaccgtttcgggccggggcttttc

SEQ ID NO: 14539 - DNA, 1011 bp, Solanum tuberosum
  Predicted polypeptide sequence is orthologous to G861, G1140
cttcagctcacaacttcagatctcttctccatttcttgcaaatttcagggtgaagaaagaaaatggtgagacaaaaaatccagatcaagaagatagacaatttgacagcaagacaagtgacattttcaaagagaagaagagggctttttaagaaagctcaagagctttcaactctttgtgatgctgatattggactcattgttttctctgctactggaaaactttttgagtattcaagctccagtatgatgcaactgattgagaaacacaagatgcagtcagaaagggatagtatggataatccagaacagctgcattcttctaaccttctgagcgagaagaaaacccatgcaatgctaagcagggactttgtggagaagaatcgggagttaaggcaactacatggagaagagctgcaaggacttggcttggatgatttaatgaaattggagaaattagtcgagggaggaataagtcgtgtcctcagaattaagggtgacaagtttatgaaagagatcagttccctcaagaaaaaggaagctcaactccaggaagagaattcacagttgaaacagcaatcacaagcaagattgaatgaagaagggcaaaatgtaattgagcaaggacattcagcagactccatcaccaacaatcgcagcttagtcaatagtcatcaggactacaatgactctgatacaagcctcaagttatgcttggcttttccttaatgagctcgatcaacatgaaaatgggtgatatatagttactgaaacaagggcgagtaatttgctatttatattatgcatcataatatagtgaaatgtataaaattgattagattggttgaccatcgagtttctcgagaaccgaggggtcaacggtctaatcagaaggtcgtgttgatatttagctaggtgctatgtttcagatctatttagagaatccacgtaaatatattaggtagtagttttttagcagtaatttctttgataaaaaaaaaaaaaaaaaaaa

SEQ ID NO: 14540 - DNA, 737 bp, Solanum tuberosum
  Predicted polypeptide sequence is orthologous to G861, G1140
gaaaaaaaaacccctaatggctagagaaaaaattcagatcaagaaaatagataactccacagcaagacaagttacattttcaaagagaagaagaggtttattcaagaaagctgaagaactttctgttctttgtgatgctgatgttgctcttatcattttctcttctactggcaaattatttgactattctagctcaagcatgaaacaaattcttgagaggcgtgatttgcattccaaaaatttggaaaaattggatcaaccatcacttgaacttcagcttgtagagaatagcaattactccagactaagcaaggaaatttccgaaagaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggcatgcaactaatggaagaaaacgaaaaattaaggcaacagctgatggagatatctaataataataataataataatggatacaaagagtcagtagtagtagcatttgaatcagaaaatggatttaatagtaataatgaagaaggccaatcatctgaatcagtcacaaattccatgtaactcaactgggcctcctcctccaggatgatgatagttctgatattctctcatattgggctacttactcagctga

SEQ ID NO: 14541 - DNA, 1162 bp, Solanum tuberosum
  Predicted polypeptide sequence is orthologous to G861, G1140
tctctctctctaggtttcaattgggggagctctccaataatatcttccaacataaaaatttaaaaaattcctcttttttttttctttttctcttcaattccaacaagtgaatagtgcttattccatctccaaaattagtttgtaagatttcttgaaggtctgaagaaagataatagttgtcatctaataacacggcttctcaacagatggcaagggagaagataaaaataaagaagatagataatataacagcaagacaagtgacattttcaaagaggagaagagggctttttaagaaagctgaagagctttctgttctttgtgatgctgatgttgctcttatcattttctctgctactgggaagctatttgattttgctagcaccagcatgaaggatattcttggaaagtataagttgcagtcagctagccttgagaaagttgacgaaccttcccttgatttacagctagagaatagcctcaacatgagattaagcaagcaggtagctgataaaactcgtgagctcaggcagatgagaggtgaggaacttgaaggattgagtttagaagaattacaacaaattgagaaaagacttgaagctggtttcaaccgtgtgcttgagattaagggtacacgaattatggatgaaattaccaaccttcaaagaaagggtgctgagctgatggaagaaaacaaacaattgaaacacaaaatggaaattatgaagaaagggaagttccccttactgactgacatggtgatggaagaaggccaatcatctgagtctataattacaaccaataatcctgatcaagatgactcctcaaatgcatctttgaagttaggcggtactactgcagttgaagatgaatgctcaattacatctttaaagttagggctaccattcagctagcaaactcaaatggtgagcttttgttgaagattgtactaataataatttttggatgaaaacaatgaagtggcataatatagggtgcctttcttttggaaaaatataacgttctactatgtattatatgtatgtgcacaacttggcccagcgcataatgcagatttattaaccatctcattttggctcttgtgaggggatttctataatataatctgtgagtttacgtgaaaaaaaaaaaaaaaaaaaaa

SEQ ID NO: 14542 - DNA, 983 bp, Solanum tuberosum
  Predicted polypeptide sequence is orthologous to G866, G883
gtttcaaaatgactgaaaattttgctgtacaagaagcagcttctgccggtttaaaatctatggagcatttaatccggttggtttctcatgaaccggttcaggttgattgccgtgaaattgctgattttacggtttctaagtttaagaaggtgatttctattttggaccggaccggtcatgctcggttccggcgtggaccggttcaggctccggttccggttcaggttccggtttatcctgattcatttacttcgttgtctcttgctccgtcgttgagctttgctccggcgaaggagacaccggcggtgcagctgcagacggcgttgacgcttgactttacgaagacgagtgttgaacgtccgatcgggaattctagtgcttttactgcttttgctgtgaaatctaaggaggttttaatggcgactccgacgccgacgaactcgtcgtcgtttatgtcgtcgattaccggcgaagcaactgtatcgaatggtaagcaagtttcttcttctatgttgttgcttccggcacaggctgggaatcttccgatcaccggaaaacgttgccgtgagcatgaacaatctgatgatatctccggcagcaaatccaccggctccggcaagtgtcactgcaaaaagaggaaatctcgcgataagaaagtgataagaatcgcggcgataagttcaaggattgctgatataccgggagatgagttttcgtggaggaaatacgggcaaaagccgatcaagggttcagcatacccaaggggttattacaagtgtagcagcttacgtggatgtccagcaaggaaacacgtggagcgtgcgatggatgatccaacgatgctgattgtgacttatgaaggtgaacattgtcataagccagttgctgcgatgcatgggaaacattctcaaatgggtgattttgggtcatggaaaagaagtagggagtgaaatgaagatagaggagagttgtagggtgatttt

SEQ ID NO: 14543 - DNA, 1235 bp, Solanum tuberosum
  Predicted polypeptide sequence is orthologous to G866, G883
caaacaacaaaaatggctgtagatttgttaaattattcgaatataaatgaacaattagctatacaagaagctgcttcagccggtttaaaatcaatggataatttaatccggttcgtttcatttcaacaacagcaaaaccaaacggttcagccggattgtagagagataactgattatactgttaacaattttaggaaggttatttctattttgaatcggaccggtcatgcccggtttagacgtagtccggttcaggttactgatgattcatgtacggctcttactctatctccgttaacaacgccggcggaggaaatactaccggcggtgaaagcaccggtgattgttccggttgagaagtatcaatcaaaggcgttgactctagattttacgaaacggaaagttggtaaatctatgggatgtgaagctgttccggtggcgagttcgacgacatcgtcgtcgtttatgtcgacgattacaggtgaaggaagtgtttcaaacgggaaagtgttttcgtcgatgaacttacctccgcgtccgcctgtatcctccgggaagccaccaatcgccgggaaaaggtgtcgcgatcatgatctgtctgatgaattttccggtagaacctctagctccggcaagtgtcactgcaaaaagaggaatatctcgagtaaaaaaagttatcagagttccggcaatcagttcaaaaaaccgttgatattccggcagatgaatattcatggagaaagtacggtcaaaagccgattcaaaggttcaccattacccaaggggatatttaccgattgcagtattgtacgaggattgtccgggcaagaaaagccacggttagaagaggaagaccaccagaaggattcccaagggaattgcttaattggtggaccttcacccggaaggaaagaaaccattcctccatgttccaaaccccaccgaaatatccccgggcaaacgtcaccagcgccccgggctggaaccgggaaatccggacaaagaaatgatgggttttggagttaccccggcacacacaaatggggaaaccctcacggggtgcaaaaataacgggggtggtcgaagccaaccacagcacgagcggacgacactttcgaacaccttcgatgttaaaacacaccaatcgggggcaccaaggggtgttacaaaagggagagcgacacctctcttacagcccaccgcaagcgtgtgtctccctcaacagaaacaacaaa

SEQ ID NO: 14544 - DNA, 534 bp, Solanum tuberosum
  misc_feature (502)..(502): n is a, c, g, or t
  Predicted polypeptide sequence is orthologous to G869
gggttgtgatatatgtcggcaaatttctgtttggctgtgattagagctccattgaagctctgggtatctgtttcttcagtgatatttggtctttgcatgcaacaaatcctctgctgtgatcatcagcagcagggtactactctgtttttcacgactgtttcgatgcgtttgaggcccaaaaggacttgttctggtgttgtttgctttggtggatttcatataaaccgatttttacatcctattttgctcttgagacggccgattacttcattttttttgctgagtttttcaaattaaattcaaatttgtttctgtttccttttgataaaccaattttctgggcatagtttgaggggttttgaagatttgaagaaatcatgaaaatgtttgagtctcagagacaatttcagaaatcgaaggttagggaagaattagcccgacccatgaggaaaatccggatcgtttgtgacgacccggaagctactgattcttctgatgatgnaagggttgatgtatcgaaacccaaacgatttg

SEQ ID NO: 14545 - DNA, 304 bp, Solanum tuberosum
  misc_feature (147)..(147): n is a, c, g, or t
  Predicted polypeptide sequence is orthologous to G869
ggcttaggaagaaatgctgcgcgtactgcgttaccttcataactagtgtgccgttggcattttgggtatttagaatcccttctttttgacctttttattgtttatatatgaagcacacactggttttagagcttaagttattcaatntggtttaccatttgtttcttccccaaaagtcttactttgtacaaaggttgtgattcttttggcaagaaggtaaaaggattcctaactgaaatttggccaagctggttaagtaaatcccattttggaagaaaattgggtttggctttaaaaaaaaaaa

SEQ ID NO: 14546 - DNA, 936 bp, Solanum tuberosum
  Predicted polypeptide sequence is orthologous to G872
gatcaaatttcatcaatttaacttcaatttcaaaaaaaaaaaaaactttaaaaattgattaaaaatggtgaaacccaattcaaaagatactgaattttcaccttcatcgtcatcgtcatctttgtatcggggagtaaggaagaggaaatgggggaaatgggtatcggaaattagattacctaatagtagagaaagaatttggttgggttcttatgatacgccggaaaaagctgctaaagcattcgacgccgcacttttttgtttgcggggtaaaggggctaatttcaatttcccggaaaatccgccggagattatgaacggaaggtcgatgactccgtcggagattcaatcggcggcggcacagtttgcgaataatacagaacccgagcttatccgggtcggaccgagggagaattcggatctttcttcttcctcatcggaaatattccgggcggaatcgccgtcggtgtcagtttccgatagagtagaaagtgaaaagacggaaataaccttgggtaatgattttatcaatatgtatcgggtggagtctccggtttccgggagggtagaaagtgaaaagacggaaatgtccttggataatggatttatggacatgttttcatcgttggggacggttaatgatatgtccgatttcggaatttttccggggttcgatgatttatccggtgaattttttataccaccaccgtcaccacaaccatcgcaaatgcctaatttggaatcattagaagaagagaattatttgaactacgatggatttcaatcacaagggacttcatttctttggaatttttgaaggatctaaaaattgttacattatattcattaatggttaatattataagtataaaaattagaaatagtactttatttgttgattttgtggacacttctagacattttttttggttgcta

SEQ ID NO: 14547 - DNA, 554 bp, Solanum tuberosum
  Predicted polypeptide sequence is orthologous to G877
gcctatccagtctagcaatggccggatttcatcctaatcaaaacaagccaagggaggttcatatgcatccatatctaggacagccgcgacccatgcatgatatgggatttatgttcccaaaggaagaaccaaaggtggaacctatatcagatcctggattgaacctcgccaatggctcagcagtttatcagcaatttatgaacaggttgccgcttggacctcagatgtaaatttacagtttttgtcttctctaaagaaaagaaagttagagatgctgattttggtacttaatgggcatacctcctacacaaagtcctataatacaactttttgaagctatattttgtctttgttttaacttctaaataccatataagcagccatttatttggtgtctgtgcttcagtttcttgctatactgacaacagtttcaggttgtaacaatggaaaagttccatgtcctatcttacttcatcatattttggaggctaagctttatgtcctccatgtactggttcttttgcttaaaccgcaccatattgccttgctcttat

SEQ ID NO: 14548 - DNA, 787 bp, Solanum tuberosum
  Predicted polypeptide sequence is orthologous to G878, G884
gattaggacatgagttgtcgattgatccaaatgagttttctttgcagataaaggaatgtctgcgaactagtgtggataacaaaccatcagacaatcagggtaagcaatttgaacaaccggaggtttctcaatctgagaacaagacctcctttggtgctctcgataagccagcttgtgatggttataactggagaaaatatggccagaaaaaggttaaagctagtgaatgccctaggagctactataagtgcacacatctcaaatgtctagtgaagaagaaggttgagcggtctgttgatggtcacataactgagatcacatataatggccggcacaaccatgatcaaccaaccaaacaaagaaaaaatggttctgctttggataatacagactgctttggagttcaaccagatattagtacacatgattggacagtaatgaatagctcggatgggtattctctgtctcgttctgaccaggttccaacccaaatggcatctgaacttcttgtcaaaagagaatgtgatgaaaccgaaagctatttgatagacgtagatgatgaagggcatgatgaaccagatgcaaagagaatgaagacagcagttgagcctgtagcttcatcacatgtcacagtagctgaatccaagattgttctgcagacgagaagtgaagttgatttcttagatgacgggtacaaatggcgaaaatatgggcagaaggtggtaaaggggactcagcatcccaaggagtactatcggtgcacatatcctggatgcaatgtccgcaa

SEQ ID NO: 14549 - DNA, 955 bp, Solanum tuberosum
  Predicted polypeptide sequence is orthologous to G878, G884
aatgggggaaaaatcaaagctccatcagtttcggtatcttcactttcaacactaacaatcccacctaaagccccttttgaatcattttttggtgttggaaatataccctattttagtccaggtccaatgacccttgtctccagtttcttctctgaatctgagtacccatctttctcccagcttcttgctggagctatggcttctccactagcaaaaccgcctacccttttgcctgaaaattcatctggagaagaagagaattgtaaacaagggaatttagggtataagcagaaccgacccatgaatctaatggtggctcaatctcctttcttcacgattccaaccgcttttagtccttctggattgcttaattcacctggatttctttccccacttcagagtccttttggaatgtcacaccagcaggccctagcacatgttacagcacaggcagcgttatcccagtcttacttacaaactcaagctgaatgccatttctcctcgcaaagtacatcagcacaggtattaggggcatctgacccagaggaatcttctttacaacctcaattagatactatgtcgtcagaccagaagattaagaaatttgaactgccacagctttctcaatctgaggacaagccatcctttaattcagtcgatagaccagcttctgatggttacaattggaggaagtatggccagaagatggttaaagcaagtgaatgccctcgcagctactataaatgcacacatgctcaaatgtcctgtcaagaaggaaggttgagcgatccattgatggtttacataactgagaataacgtataaagggccatcacaaccatgaaacttctcaaccttacaacgcagaagagacgttgtgctcaggatggttctgaacggtccaacatttaacccttgaaattggcaacccatactggagaatagaaatcacacg

SEQ ID NO: 14550 - DNA, 450 bp, Solanum tuberosum
  Predicted polypeptide sequence is orthologous to G878, G884
ctctaattcatactcattgataccatcaccaagaaaattaccttcttgagtggctaaatcttcatcttcagcatcaaatatagcaagtttagaagaaatctcatgagattcaaacacattgatattgttcgacaacgttggatcggaggcatcagacaggacaggtgcagagggtattctttctagtcctgcaacatctctattgtactcaaattgttgatcatttctccataatgatgatccattttcttgggcaacaacatatatatcatctgtagtttttcgtcgaagatgttgaggttttggatgattatgagcaccattgtagacaatttctataacttgtccatttggtgcacactcaacttttttcctcacaagacaattttgttgagtacatttatagtaacttcttggaaaattactccctttaaaaaaaaaaaaaaaaaa

SEQ ID NO: 14551 - DNA, 761 bp, Solanum tuberosum
  Predicted polypeptide sequence is orthologous to G878, G884
gctgcaggaggaaattgaggacgctgcaacagcagcaggcaaggaacatgatgatgaaccaaatgtgaagagaatgaagacaacagttgagactcctattctttcatcatcacataaagcagaatcagaatccaagattgttgtgcagacaaggagtgaagtagacattttggatgacgggttcaagtggcgtaaatatgggcagaaagtggtgaaagggaatcatcatccgagtcagagttggatttgcaggagttattatcgttgcacataccctggatgcaatgttcgcaaacatgttgagagagcttcagcagatccaaaagctgtcataacaacgtatgagggcaagcacaatcatgatattcccattgctagaaacagaagccatagcacagcccaaaatagtagtcgtcagctgaacgagcaagagattgcaacttgtaggccttcacttctcgaaaaagttgctcttcataccaatgaaataccagtgtgtaggcagctgaaagaggaacatattgcagcataatttgcattactaaaagggaaaagggtgaatatttatcttttgtctatctgtacacaagtctcagaaaagttctttgttgaaaacttcatgctagtgaaatgtatctgtacacaagtttcagaaattgttcgcaagtctggctacttgctaatgatgtatctgtacacaagtctatctatatatcgtcagtaaaaggtgttgtaataaacacaaaaagcaaaaaaaaaaa

SEQ ID NO: 14552 - DNA, 920 bp, Solanum tuberosum
  Predicted polypeptide sequence is orthologous to G878, G884
tttttttttttttttttctttttttttaattttttttttttttcagatgaaaggcctaattataaaacaattccaagaataaaataccaaaacatgttgggaattatagaaacatttacagaaaagaatgcatatagaaataccatagctaacaactctatgcccctttttgagaaacatttacaaacaattttatattcaaaccactccttcctgacctattatttcgggtcaacgcaaattctgtaccattttcgtttcatgattgttgggagagaccatcatcaactttgcaaacgcgagaactagaaccattaagtaataagttacagccatctactggctgccatgttgattaccttgctggaatgaagattggataaatcatgtacttggtccttcttggaaacgtaaaagcgctataggttgtagtccattggtctgaaagtccggtcttcgcattgcagctggtttatcaactacagggttgtgtggcctcaattgtgacatagaattatgggctgaattgtggctactattcctggctgcaggcacatcatgattatgtttaccttcatatgtggtaactgactgggttaagggtcccttgcaagcccgttcaacattgcgtttctagacgtgtacgtccctgggctggtacattggggaataagcttcttggggataaagggtttaccatttaacgcctcggggccggaaattcctgggaaacccggggggaatccactgagttcctaagagcggggcggcaaccaggggggggagagctccaggtttgttgtgacgcctttataaagccaaggggagggcatcaaatatagggggggcgcacaccttgtgggggggcagtaacaatcaccagtgggggcgggcacaaaaagagcagggggggtacacac

SEQ ID NO: 14553 - DNA, 717 bp, Solanum tuberosum
  Predicted polypeptide sequence is orthologous to G881
gtgacaagagataacccttctccaagagcctattttaagtgttcatttgcacctacatgcccagtcaagaaaaaggtacaaagaagtgttaaagatgcatcaattttagtagctacatatgaaggggagcacaaccatcctcaaccatctcaagctgaagtgtcattagtcaatacaacagatccaacatttttgaacaaatttatggaaaacatcaacacaaattcactgcaacaacaatatttagtcgaacaaatggcgtcttcgttgtccaagaatcctagttttgcagctacagttgctacagccatctcaggattacttttttgaatatgatgatttacctttcaaataacacaaaattattgtttgttgagaggataaaatggtccttatgtagcttttagttagttgctcatgagatttagttagataatgtattggtgtagcgaaacaccaagcggtatatattttctatttgctctctcaatctttaaaaaaaaaaaaaaaaaactcagactagttctctcaaaccttgggcgtgagcctgggcggagcggccgtcggtgcagatcttggtggtagtagcaaatattcaaatgagaactttgaaggccgaagagggctctcctctcctcttttttcaaatctcgatcgattgaattcaagatcaatgtatataagttaaactctgacatattcacgtaccttatttta

SEQ ID NO: 14554 - DNA, 777 bp, Solanum tuberosum
  Predicted polypeptide sequence is orthologous to G881
gattttgaggagaaaaaaaagtgtttgtttcttaactcaacacacctgaagaaagactacaactttgctgattcttggaattttcatacatcaaagaagaaattaatatctatggaatttaccagtttggttgatacttcattggatttgagctttaggcttcgtcctgttcttgaaaaagttccgaaacaagaagtgcagagtgatttcactggattgagcagagacatagaaagagagaatatgggggtgaaaaatgaggcaggggatttgttagaggaactaaacagagtgagcagtgaaaacaagaagttaacagagatgcttactgtagtttgtgaaaattacaatgctttaagaaaccaaatgatggagtatatgagcacacaaaatggtgtagcagaagatagtagtgcagggtcaaggaaaagaaaagctgaaagtatctccaatatctctaatcctgtaaacaacaacaacaataataataacaatatggatgttgttcatggacgttcatcagaaagcagctcaagtgatgaagagtcttgttgcaagaaactcagagaggagcacattaaagcgaaagttacaattgtttctatgaagactgatgcatctgatacctctcttattgtaaaggatggttatcagtggaggaagtatggtcagaaagtaaccagagacaatccttgtccaagagcttacttcagatgctcatttgcacctggttgcccctgtcagaagaaggttcagagaagcatagaagatcagtct

SEQ ID NO: 14555 - DNA, 936 bp, Solanum tuberosum
  Predicted polypeptide sequence is orthologous to G896
gattatagttcatctcttccttcttcctttaaaccttcatccacttcatttcaataaacttcctctaatttctttgttggaacataatccagatctgagagttattactctttttttacctcataaaattagttttttctcttgatgaaacctgctttcaatattaactatcatctcttttgctcctttttatgattgggtcacaaaattgaagatactaaacaggtttaacagaagacaaaaccacaagctggtttcattgatggctcgcatgcgaggcggcgcagccgggggtgatgcacccgggcctgcagacagagccccagcttggggtagacgccgaccccgagatcgaggtagggccgcagcaccggtccgagatagggaggaggagtcccaggcagcatatgtacctccacagccagtggggccaggatcagcccagccactacccgcactagctgcagctcctgaccttcataccctgctgactcagatattagatgttattggtgagatgcgtcaggcaccagcaccagttccaactcctgctccagcgccgcagggtcagcttgtcgtagcggcaccagaggttcagccgccaccagttcatgtgaccgccctgccagacttaaaggacagggagatgccactgcacgagcaaaagatgctcgaggtattccagaggttggaacagccgatattctcaggggcgattggggaagatgcctacgagttccagctcacttgccaggagcagttacagtcattaggcctcttggagtcgagaggagccgacttcaccgctcatcagttccgtgggctagccaggcagtggtggcacacgtatcgagagtccaggtcagttggatcgcctcctatatcttggagtgagttctcagaggctttcttggcccggttcatgccacggagcgt

SEQ ID NO: 14556 - DNA, 1031 bp, Solanum tuberosum
  Predicted polypeptide sequence is orthologous to G896
ctccctttaacctaaaccccattctccatattcctcaattccaaaaaattctttgtacccttaccccaattttcttgagccatagatcaaccatgatgatgctggtaaactgttccaattgtcataccccattacagctaccaccaggtgcaagatccattcgttgtgcgatttgtcaggcagtaacacagttggctgacccgcgtgctgttcctccaccaccacataatcaataccagcacccaccaccgtcttcctctgccgccgccgcacctccgtccccttacaaccacgcacctcctggcccaccacccaatgctcatggaagaaagaaagctgtgattgttggtgtatcgtataagtattctaggcatgaactgaaaggatgccttaatgatgctaaatgtatgaaatatctcttgatcaacaagtttcattttccagaggcgtctattcttatgcttactgaagaggaaaccgatccatatagaactccgactaaacagaacatgcgcatggcattgtattggcttgtacagggatgccaatcgggagactcgctactctttcattattctggtcatggctcaagacaaaggaattacaatggagatgaagtggatggatatgatgaaactttatgtcccctagattttgaaactcagggtatgattgttgatgatgaaatcaatgcaacaattgtcaggcctcttcctcaaggagtaaaacttcatgccataatagatgcttgccacagcggaactgttttagaccttccattcctttgtagaatgagcaggagcggacaatatgtatgggaagaccatcgtccccgttctggtgtctggaaaggaaactaatggtggtgaagttttctcttttagtggttgtgatgatgatcaaacttcagctgatacatctgctctttcaaaaataacttcaactggtgctatgactttctgtttcatttcagctattgagcgtggtcatggtgcacatatggaagtatattgacggcaatgcgaaatgct

SEQ ID NO: 14557 - DNA, 425 bp, Solanum tuberosum
  Predicted polypeptide sequence is orthologous to G896
ctgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgactgcaccccagctcaggcccccactgcaccagcaatgctagaaaaccaagccaataaaagtgatttcttttttcatt

SEQ ID NO: 14558 - DNA, 947 bp, Solanum tuberosum
  Predicted polypeptide sequence is orthologous to G896
caatggacagcaggagatgcaaatgccagtggtgcggcatgaagatagcagctcacattgggagcacaaacaattacctgtccaaggtgccaatctgttacacaactccaacctgcaagaaactatggctttgctaatttccccactgccaataacaatatgagtccgggatttccatcttttccatcgaggccaggaaggatgagtccaaatgctaataattttcagcctcaacaattcaaccctatgtcaccacagattaataatatccgtcctcctgcagtacatggacgaaaacgagcagttctgtgcggaattacttaccgtggccatccaaagagtctgaagggaagcattaatgatgttttatccatgagatattttctggttgagaagttggggttcccaaatgcatcagtggttgtccttactgaggatgagaaagatccatacaaatacccaaccaaggccaatatcagatcagccctacgttggcttgttcaaggctgtcagccaggagattcactagtgttccactactctggccatggcacacgagtacgagaccatgatggtgatgagattgatgggcacgacgaatcactatgccctgttgattttgagacagaagggaggatactagatgatgagatcaataataccattgttaggcccttaccccgtggagccacacttcatggaataattgatacatgcttcagtggaactttcctagatttgccctttttgtgcagaataaacagggcaggatactttatgtgggaggaccatcggatccgctcatacaaaggtactaatggtggaatagcaatctctatcagtgcctgtgacgaccatcaaaactctggagatacaacggctttcacaggctttccaacaggtgccctgacttatagtttcatccaaacattggagcaagagactaa

SEQ ID NO: 14559 - DNA, 484 bp, Solanum tuberosum
  Predicted polypeptide sequence is orthologous to G896
cccacttaaagaacaagtatcaaaaaggttggttgatcaataacctgtttattctgcacaaaaagggcaaatctaaaaagttccactgaagcatgtatcaattattccatgaagtatggctccagggggtaaaggccttacaatggtactattgatctcatcatctagtatccttccttctgtttcataatcaacagggcataatgattcatcatgaccatcaatctcatcaccatcacggtctcgtactcgtgccccatggccagagtagtggaacactagtgaatctcctgaccgacaaccatgaacaagccaacgtaaggctgatctgatgttagccttggttgggtatttgtatggatctttctcatcctctgcaaaaaaaaattgtgtattacatgttagaaatcggactgttagtgctcaaatatataccttgactgttttcattagtgcaagaagattacaataaaaaaaaaaaagt

SEQ ID NO: 14560 - DNA, 904 bp, Solanum tuberosum
  Predicted polypeptide sequence is orthologous to G898
taaaaccctaatttatgtcttttgtgttgttgaaattttttggagttttgaacaagttcaggaatcatactgtcgaagctaaccccttgagatcacgactgagcaaagcatgagttcccaagatagtagctcacaaccaattaggcgtacaaggtcccagtcgagaagaaatactttgctaaatgtggatctaaatgctgcaccgccaactgagaacagagatcgggaaggagatcctattcatgttgtgcctagggatacaccacatggagtaagaggtgcctctttgacagctggagcaattgatattgaggcacttgatgatgatgtgattatatcatcccctagggcgtttgcagcagctaagaacaactccagaaggaatcaaggacgggttattgtgcttgatgtggattctgaggaccgtgcgtctaggggtaacagtcgcaacaggcgtagaagagtctctacaaatcaagcaacaaacaatggtgatattcacatagacctagaaggacatagctgcccaaagagagttgatctaagaagtgcaataccagcaccaccaaaagagcctacattcagctgtccagtgtgcatgggcccattagttgacgagatgtcaacgaaatgtggtcacattttctgcaaggcgtgcataaaagcatccatttgcttgctcaggggaaaatgtcctacgtgtaaggaggaaactgggcatgaaagacaccataagagtttatctttcccaccacaaatttaagtcccaaggattttgggctatcaatttaccatgaacttctgggattgaagtgtatgaactaatggtgacgtgggaacggaaaaggaataacttggaaatacttttattccagttgaagctttaacgtcagaaatcacttga

SEQ ID NO: 14561 - DNA, 738 bp, Solanum tuberosum
  Predicted polypeptide sequence is orthologous to G903
ggtggcactattttctcaggagagatagctttggactatagggcgttttgcgatgcattagctgaggagacggctagagttactgcagcatctaatatgcacaacccattggccatggaaaacaacatcaactaccatttcatcggcgcgccattagggccaaacatggcacaacatttctcttctctcttcaaaccagtttcaaacaacaatgagaactcggatccattgagaagagatcaactctcgctttggaataatataggcgtggctcaagagcaagaccaaataggtatcaatatcaataatctccgcgaaatccatcagattagtccccttcttcatcacacttcaccagcactagcaccaacaacagtttatgatgcaaatgcccttcttgcatcacgtaattcaaatgctccaccagttagttataataacaacccatatcaactgggatcagttcatcgggaccaaaatctctccaattaacaatgctgaacaattatcaaacacctcatctgcaaacatttagccgttccgtcattatttcagttctcaacaacaaattgcactttcttcctctactacaaatatgtctgcaacagctttactccaaaaagcactcagatcggagcaataacaacaacaactgcaactgatccatcgatattcctcggaaatttaccatgaataattgcaccaacacaagaacatgacatagcaacaagttttgtg

SEQ ID NO: 14562 - DNA, 691 bp, Solanum tuberosum
  Predicted polypeptide sequence is orthologous to G903
cttctttagggaacacaacaattcccaaaaatagtgtagaatttttcctagctttgggaagcgtttattgaatttctggtgtaaactgagaagggtactttcaaatccatttttacaagtaagctaaaaggggctgaagtggagaaaacaaagtagtaataactgaaaatcatatgtaaaaaattcaagttttattagctaaatatggcagagattgaaaaattagctggttctggttcattagaagaatcgattacacagcaaaattttccagtaaagaggagaaggaatcttcctggaaatcctgatccagaagcagaagtgatagctttatcaccaaaaactctaatggcgacaaaccgatttgtgtgtgagatttgtaacaaaggttttcaaagagatcaaaatttacagcttcatcggagaggtcacaacttgccatggaaactccggcaacgaacgagcaatgaggtgaaaaaacgtgtttacgtttgtccagaatcttcatgcgttcatcatgatccttctagagctttaggcgatctcactggaattaagaagcatttctgcagaaaacatggcgagaagaagtttaaatgtgaacgttgcaccaagaaatacgctgttcattccgattggaaagcacatatgaaaacttgtggtactagagagtatcgctgtgattgtggaa

SEQ ID NO: 14563 - DNA, 816 bp, Solanum tuberosum
  Predicted polypeptide sequence is orthologous to G912, G2107, G2513
gaaaataaattccacaaactctttatattgactatgtcctccccacttattcaatatgaaaatggtgaaaaaataagaatatattagttatagtttattaattctaaatctagaaagacagaaaatatattgaacattctgagtatagatgatataggtgctggtaattagatgaacttgttcacttgtttcattcaaataattactacacatgtatacatttgtaccatcgtaggaaactaataaaatctcctaaatatatccttatttatatagaataattccataaagacatataagtgtgcacatcagctaattccacataatgatctccgatctctaaacattggggaggaggtagcatgagtccttctgccatgttcgcaattaatcctggcatgtaaaagagcgcttcctcatccatgaacaaactactctcctccttcataaaaaacgtgttttctagcgtttcaggagtagtgctacattctcctgaaacttcttccgactctggtcggaagatttctgcagcctcagcggctgccttttgaatatccttggagttagaggaagccggaataggcaacctccaagccgaatcagcgaaattcaagcaagcagaacggcctcttaatgctaaagctgccacgtcatgagctatagctgccatttctactgtgggggaagtaccaagccaaatccttgatttcttatttggttctctaacttcacaaacccattttccagaattccctcatctgactcccctgtatactggatgtcgagtttctcgaaacttcttccctgcagctggct

SEQ ID NO: 14564 - DNA, 909 bp, Solanum tuberosum
  Predicted polypeptide sequence is orthologous to G913, G976, G1753, G2514
cttcaacatacatgtataaaccatgcctctctcaatgtacgtggtgggatctcaattgagttataagaaagaaattaaattccatggattcatttgttttaatagctccatagattttctgcatcagaatgtcccggtgaatcatcggaccgcggcaagctcattcttggagggctcaccatcattgcctccgccatgtcaactagcaaattaggcatatcaaataatgcttcttcatcaatgtattcatgatccctagtttccatcatatgcacactccccgacgattgatgatcatccgtacctgatacagagaagagacagattcaaaatttaaactgtactgttgaattttcatgattcttcaatactacaattattctacttttgaaatactgaattcagtatcagagacgaattcagaatttaaattttactattagagtttttaagaatcatttatataaggttatctttatatatatccttttcgaattcatattgatagtgtaaaaattgtttacattgtcaatatatataaatttaagtctatatgcatttttgtatcgaaaatactgaattcagatgattgtatcacaaaaaaggtgaatatatttacctggttgagttcccgaggtggtttctccggtttcaatcttcatcagggcggcggcggtggcggcagcttttcgtatatccgcggcggcgggtgaaggaggaagtgaaggatacgaattaatattaccaggaaagttaattacggcgtcgtctccttttaaagccattgcagcgacgtcgtatgcagcagcagccatttcgggtgtagggtaagtacctaaccatattctcgtagtcttacgtggctctcgaatttcggacacccatttcccactcctacatcgtattccg

SEQ ID NO: 14565 - DNA, 430 bp, Solanum tuberosum
  Predicted polypeptide sequence is orthologous to G917
gattgattgatagagagagcagtagaagaaaattggtgtgttgatcaaagagatttaagcatgtcgttgatgaagggagagccattggtgaggaagattgcgctgatagctaagtacgcagtgtttccgggagctatggctgctgccgtgatctattctcctccgacttatgcttcttattataagccccaatcttcttcttcaaaatgatctggggatacccttttgttttcttcatgggattctttttgacttgctgaatgcttctggttgcaatagtttactgaaatgctctatttgtaatagacgtggtatgtagtaataatccaatggcagtttgtttctgtactcaaactatcgacttttgaaaatcggaatagacttgctcctttctattttactttgttatcataaaaaaaaaaaaaaaaaa

SEQ ID NO: 14566 - DNA, 784 bp, Solanum tuberosum
  Predicted polypeptide sequence is orthologous to G921
tcaggatcagaacagcgatggatcgaagaaaagaaaagttgaaaacaataataatgaaattgtgaaatcgtcagttcaagtgttgaattcagagagcagttcaagtgatgaagattcatctccaaagaaaccaagagaagaacacattaaaactaagacttctagagtttatatgagaactgaaccatctgatacttctcttatagtgaaagatggatatcaatggaggaaatatggacagaaagtaacaagagacaacccatctccaagagcttatttcaagtgctcttttgctcctacctgccccgttaaaaaaaaggttcaaagaagcgtggaagaccaatcgattctagtagcaacatatgaaggagaacacaaccattctaaagtggatactgttacaacaacttccccttctagccgtttcaacccgaaaaacaatgtttcgggtaattatactgcttcagtaatgccaagttccactactaatatcatcaacacatcaggaccaaaaccaatgttaactcttgatttggctgaaccaaaaacattacaaaatgatgtcaaaaaagtgaacagcaatacaagtacaagtggtcacaagcgtacatcaccaggaaatgatcatcaacaacaccaaaatagaccagagtttccacatttcttgatagaacaaatggcttcatcattgactaaagatccaagttttcaagcagccttagccgccgccatatcggggaaattcttaccaaataataaatacactaggggataatggatggga

SEQ ID NO: 14567 - DNA, 969 bp, Solanum tuberosum
  Predicted polypeptide sequence is orthologous to G922
tttttttataagagaaacatcatctttattgatccatatcaaaatggaaatctaaaaactagagagagactgatcacatgagatcaaaaaagatgacaaaatgtctcaaacatgtccaatagccaggttcactaaactggaagttctacaccattatatgtttacaaacaaacaaaaagggaaagaagaataaactcttaaaaaacattaaccacattgaaaaacctaaagtttaagttctccacctttcctaacattcgccaaagaacgacacttgagaaaagtgctcgaatctggccagcatatcacccaacgcaaacccattctcttctttgatcttgtatccttcacaactgtaactctgcaacaaccttcttgcctgcaacatagcataataactcaaaggcacattcccaaaaccagatgtgtcgaatctttggaaccacttttcgagcttttcatgcctctcctttcgctcgatcccttcacatgctataatgtttctaatctcctcacctaataacatcttttccacctttaatctttctaatgatgttcttggcaatgtcgattcaagacaatcgaataatgcagcataaaaatgtaacgactccgatagcctctccataagagttgtcccattatggttagaatcttgttctgttaccaccatgacttttggtgataaaccccacaaagcattgaggaaactatctatctttgttgaaccagttgaacatagcggggacgaagaagcggtgtcattgcttggactgcaaccattagccatatctttttcagaaattcccctaaagtattttggttgacctagtgccctgtgccaagttcacaccatttgcaatgcttttagaaggcaagggcagacttcttttccatttatcgactgggggctaaacaacggggtgtgcacattggccttaagctgaacctaatcggaaagaacctccc

SEQ ID NO: 14568 - DNA, 800 bp, Solanum tuberosum
  Predicted polypeptide sequence is orthologous to G926, G2632
ggttcactctactctctcttctgcctcttcccttctaactgaacattgtacgaagaactaaacttactagaactagagaagcatgcaatcagagtccaaaagtgcaaattgtgaggaagctagaacatataatgttccgaattccaccctagaaccttggtggaatactgctggcaataatcctgtttctcttggattgatgcggggaagtgcatcagattcaccaccacccgaacaagctgtggatggccgatcacaatctgatggtggatccaacgaggaagatgatgatgctcctgaaaaatcacaaaggaccatacctatgcattcagatgggagttatgctcaagtagatcagaatttacagccaattgcgtcaaccattcctccaaaggatgatgggagcataacacaacccccacagcttgaacttgttgcacactccatggcatgtgctccaaatctgtatgttgacccatactatggtggaatactggcaccttttggtcagcctatggtcccttctcatgtacttgatatgcatcatccgaggatgcctttgcctcatgaaatggctcaagagcctgtttatgtcaatgccaagcagtatcatggtattctgcggcgaagagagtcacgtgcgaaagcagaacttgaaaagaagctgataaaagggagaaagccatatcttcacgagtcgagacatcagcatgccttgaaaagggcagagcttctggagggcgttttgcgaaaaagtcagatgctggtacttcgaggggagagggtctgggtctgctgtt

SEQ ID NO: 14569 - DNA, 920 bp, Solanum tuberosum
  Predicted polypeptide sequence is orthologous to G926, G2632
agcttaagcatatgtatgtaataaatacaagctaaatttgtgagtttttcttgaaagggggttttctttaactgctgtcatccccagaaaaagaaagctggagactgggctacgaattacctcacaatcaactacccaaatgcagccatggtggcagggttatggtgataatactatgcctttggcaagtgagaatgccgttgcacaggggaagtctgaaggtggcaatgaggaaaaagaaacaaaggcgctagccctggaatctggatcagatggaaataatgagcaattcaagcagcacctcaagcattttgctcccacaactgctgccatcctggctgagcagcagaaggaactcacaggtcattcagctatgttggcgtcatatccatatccagatatgcagtatggcggaatgatgacttatggggcacctgtacatcctcacttatttgaaattcatcatgcccgaatgcctttgcctcttgatatggaagaggaacctgtctatgtgaacgcgaaacagtaccatggaatattaaggcgaagacaaataagagctaaagcagagcttgaaaggaaagctattaaagcgagaaagccatatttgcatgaatctcggcatcagcacgctatgagaagggcaaggggatctggaggccgctttctgaatactaaaaagggcaatgacatggactgtacaccagaggagaccaaaaattatggggcaaccattccaactcactctggcaactcgtcaggttccgggagttctgatcaagggggaaaggaaggatctacagttcaagacatgcacaaaggacacagccacagtttcgcaactggcaatggccatggttcatctgtgtattttgcccagagcactggaagtgagcaagggaatggccactacggtcgcg

SEQ ID NO: 14570 - DNA, 769 bp, Solanum tuberosum
  Predicted polypeptide sequence is orthologous to G926, G2632
aatgcatcagattcatcatcattggaacaatctgtggatggccaatcacagtctgatggtggaatcaagtgaggaagatgatgatgctcctgaaaaatcgcaaagtatcgtacctttgcatgcagatgggagttatgggaaagcggatcagaattttcagccagctgctccagccatacctccaagaacttgatggaagcctagcacaagccccagcagctggaacttgtggggcactctattgcttgtgctccaaacccatatgttgatccatactatggcgggatgatgacagcctttggccagcctttggttcctcctcatgtacttgatatgcactatgcaaggatgcccttgccacaagaaatggctcaagaacccagtttatgtaaatgctaagcagtatcgaacgatcctgcagcgaagacagtcacgtgctaaagcagaacttgaaaagaagcagataaagggtagaaagccatatcttcacgagtctcgacatcagcatgcactgaggagggtaagggcctcggaggacgttttgccaaaaagacagaatgcttctaagggtactggttctgtgagttcatcgggttctgaacctttgcagttcaatgctgctgatattcaaaagaggcatgaacatggaacgttggcccgagcttcagcagtctttattccacatggttagccagttatgcgcaatcaaaagtagcttttcaggaatcgaaagatgagtaccagtctgctgaacgcacggaacgagttt

SEQ ID NO: 14571 - DNA, 845 bp, Solanum tuberosum
  misc_feature (593)..(593): n is a, c, g, or t
  Predicted polypeptide sequence is orthologous to G928, G931
gttccatcttgttgcacaaagcctgagttaaacatattaacaatgagacaatacatagcacagtaaaatgaaaaccacaaatgcaaatgacagtaacaagtacagatttagaagtgcaagatgatacatacacgctcgaccaagaaaaggagaatacagccttaatctccactgtttctgattaagaacaatatattttctcttttccttgcccttgttgatgatgtacagcaccaacctgcgctctttttctcattaaccatgaaccataaaccataccacactacgaccaaagctttaggaaaaagtgttaatgatttcaattcaggaaaaggaagagtaacatagccaaggatgaactgccgattatccatttgtgtgcaccaataagaatgcatttgtaatgcagcctgtattggcacagccaccatggataacacaagtgtgctgtcaggttccaacatgcatgaagtcttcagcttcctgcatgtgaaaagggaagccagagactctaaactctggttgctggaacatgttgtcgccactgaagatacttgtcacatcagaaccagattgggtggaagtcccccaantaccactctctgagtgctgaaccatggaactagataagttgccacctgcctgtcgcttaaagatatttctatcgtgcttcggagatgaaggcttggattgctgcatattctttgtgttcaaaaagcgccctccagaaccccttactctcttcaattgcgtgacgatgtcgagaatcgtgaagatatggctttctgtctttgacaagcttattttgagcctctagcttggcacggaccctgtcggctttgggt

SEQ ID NO: 14572 - DNA, 530 bp, Solanum tuberosum
  Predicted polypeptide sequence is orthologous to G928, G931
tatctccatgagtcccggcatcgtcatgcattgaatagggctaggggacccggtgggcgctttgtcaatatgaagaagcctcgagagtccaaatcccctgatttgatcaatggtcaagacaatcaggtatctgatgagctgcaactcaacagaaaaatgttggagcccaatattcatcaatccagaagctactccacaccagtatactctggaatcactagtggctcgaacggtgatgctatttaccatcaccaatcatttaagtactccgccttctcagcgcgtaacagagggacctcacagctggacaaagagaagaaagataacacgagcaatccatgtttatcatctttttgatgcaagtgttgctattaaaagtgggaagtcatccttggctatgttagtattgtagtacattattctgaaaactttatagttagtccataacctggcatggttgttttctatttaatgctttaaatacctcaatccaaagagtaatttttagtttaaaaaaaaaaaaaaaaaaa

SEQ ID NO: 14573 - DNA, 751 bp, Solanum tuberosum
  Predicted polypeptide sequence is orthologous to G929, G2344
ggaaggaaattcaacagaaaacaccagaaattaaagctgcttattggttttctatacacgaagctcttcccgaaaggtttgttactttggagattctgtggcaagcagcgtcatgacgtcctcgcttcattatcattcagatggtagtgagaatgaacagtcagaaaatcaatcagaggctcacagcgagtcttcatcccctgcagctggaatgtctgtccctggcactgtaacaccaaatatgcactatgttatgcccaatctacttggcaatggaaattctatgatacaggctcaaacagcttatccatatccagacccatactataggagcatcttcgcaccgtacgatgcacagccttatcctccacaaccttatccagcacaaccaatggttcacgttcagctaatgggaattcaacaagcgggtgttcctttgccatcagatgcgatagacgaacctgtttttgttaatgcaaaacagtatcatggcatcttgaggcgtcgacaatctcgcgcgaaagctgattcagaaaagaaacttctgaaagctagaaagccttacttgcatgaatcacgccatttgcatgcattgaaaagagctagaggatgtggggggtcgtttcctgacagcgaaggaaactgataatcagcagaaacaggatgaatctggtgataaatcacacgtcaacattaatctcgagtctggaaaagacaaggttgcttcttcagagatgcctcttgattatgc

SEQ ID NO: 14574 - DNA, 917 bp, Solanum tuberosum
  Predicted polypeptide sequence is orthologous to G929, G2344
aatcaataatatctcataaatcggagctggttcttgtggcgaagtggaaagtccaatgtttcaaaaatcggatggtgattccaagagagaaggcaaacatgtagaatttatgcctccaagcatgggtgaaaatttaagagcagcaaatcaatttgaactaatggcaccctcctcaattgcatttaaatcatacccctattcagaagtaccacaatattctggtggcaatgttactattgcttgtggtgaacctatggtaaatcaaaatatggagagatcatcagcagttcatcataatggaagaatgattttgccagttgaagtgaaagaggagccaatgtatgtaaatgcaaaacaataccatggaattcttagacgaaggcaacttcgtgctaaggctgtgttgcaacaaaaagtggtcaaatctcgaaagctgtatctccatatgcatgtacatatatagtttgagtcaaaagtaatgggaccggttgaacgcgcagagacgacagccttatcttcacgaatcgcgtcaccgacacgcgatgaggagagctagagatggtggaggtagatttctcaacacaaagaagaagacccaatctactactacaactaataacaacactactccaagtagtaaaggcaaaagttcaatggattctgattcttctccaaattacctactcaattatgaacatgaaattggatcatccaatcatagtaattctgttgaaggatttcagttccaatctggaatacatgatactacagaaaatcttcaattgggttgtcattatcagtggaacctcaatgacaacaaccattgcaattgcatgcactcggaacatttctgaagagagtcgctctgcaagacgtctagtagtcttctgagtcactctgcaagatgtctagtagtc

SEQ ID NO: 14575 - DNA, 1025 bp, Solanum tuberosum
  misc_feature (948)..(948): n is a, c, g, or t
  Predicted polypeptide sequence is orthologous to G929, G2344
ttttttttttttttaaataggggacactcctttattaccaagatactaataaagagaagagaatgtaattgacctgcactgctgctaacttattatcttcctaataactatgaagaaaaaaacacttttacatgctacacctaatgaccattaccttcagtgtctattaaagtctcagcgaaagaaacagctaaaagtaattacaatcggaaaacgataaatctaaaaaaccaaactcagaaagaagactgagaacagcatcttggaattacacatccagctgctagctttgcaacaccataattcaagaagcattttctgaagaagtaacctcaattttgttggagtcagtattggcgtttgccttcgacttatcatcagattcatccttttcctttgcagtcataaatcgaccaccacaccctctagctcttctcagggcatgcaaatgccgagattcatgcaagtagggcttcctagcttttagaagtttattttctgattcagcttttgcacgagattgtcggcgcctcaagatgccatgatactgttttgcattaacgaaaacaggttcttccgcaaacatctgatggtaagaggaacaccagcttgttgaattcccatcaactgaagtcgaaccattgactgtgctggataaggttgtgcgtcatagggtgcaaaaatgctcctgttagttaaggatctggataagggtaagctgttttgcgccattgcatctggcatttctaagttgaagaaccgtatcacagtacttgcatgttcttggtgggcacagtcccaggaacagacattcagttgccaggggattgaagatcgggtttgccttctctgactgctttgtggttgttcattctcgcaatttatctgacaggatcatgtcatggagggacgttctgatgcttgctttgttcacaaactccccaaatncgagaaggacttgattatgcaattgccactttccttgaaagccttagtgtacacacaatggatacggggctctgtgg

SEQ ID NO: 14576 - DNA, 829 bp, Solanum tuberosum
  misc_feature (21)..(22): n is a, c, g, or t
  Predicted polypeptide sequence is orthologous to G937
ggccccccccaatggttgaanntttttccatacgtagttaggcactgctctttcatttctcaagtgttgggacgtaaattcaagttccttatactgaaacaacaaataactagaacacggttcgaaatgcacagacaaaaaaagaaaaggagatctaatcctgcaaaatttcacatctctctcaagatttatatataagtataatatagggtatcgatttatggtaattaatttctccaatgtatcttatctgcaaaatccatggtggagatctatacatcaatctttccagaggtgagaacatggtttttccagctgtgattctcggattttacatcatcttcttcttccatgctatcacccacagtcgtggaagtacctccgcaactaccagccaagtgtagaggaccctgaggggaaccagattgtgaactgctctgctttgaggattccccatattggccttgggacatccataaatttcctagagccacaccagactgatttgctggttgagtctgtgaatttggaactcttcgtgtatgaagcctgtatttctgcaaatgactctttacttcatcattggttaggccatccacttgcataaggtctctaatctgcttaggagttgcaacttgtgaacccccaagttgttgtagtgcatcaacaaatcgcctatgcaattctggtgaccagcatcttctttgctttcctggaagactgctgctgaccagtgatccatcccttatatttgattggcaacctgctacaactagaataatccacctcttgctaccattgtgtttcgaattcaaaccactattcacag

SEQ ID NO: 14577 - DNA, 935 bp, Solanum tuberosum
  Predicted polypeptide sequence is orthologous to G938
gatctgataaccagattcccgggagggttgaggaatcgagtgtgatagtttccactccccacactttacaggagctgcaggatacaactctaggatcccttttgtctgctttgatgcagcactgtgatcctccacagaggcggtttccgttggagaaaggggtatctccaccctggtggccctgtggtaaagaggactggtggggtcagttgggtctgccaaatgatcaagttcaacctccatacaagaagcctcatgatctgaagaaggcctggaaggttggtgttctaacggcggtaatcaaacacatctctcccgacattgctaagattcgcaagcttgttcgtcagtcaaagtgcttgcaggataagatgacagctaaggagagtgcaacttggcttgctattatcaatcaagaagaggctttggctcgtaagctgtatcctgatagctatccacatggatctttagctattggtaatggttcctttttcatcagcgatgctagcgattacgatgtggaaggagtggatgacgagagaaacaatgaagtggaatgtaaaccccatgacatcaatctccaaactggaattatgttacctaaagataggatcttgatgccaggtttagctccagtgaaaggagaaattatcgatttaacttgtgattttatccaaaagaggaagcaaccatgttttgaggagtctgttgatcaaaagatatatacttgtgagtaccttcactgcccatacagcaattatcaagctggattccttgacaggacttcaagaaataaccacccaatgagttgtccattccggttcaattctgctcaaacacttagtacacctaagtatcagatcaactatgagcacaacacagttttttcctgcacaaactgctccttctaagccagcggtctcgtcagtcactgc

SEQ ID NO: 14578 - DNA, 898 bp, Solanum tuberosum
  Predicted polypeptide sequence is orthologous to G938
attattctctaagctgagttccagttgaaacacaagttttgcaacaacaacaaaaaaagtgatctttttcaggctcatgtaatctgatcaacttcaattagattctgatctgaatattggattttgggtattagctgcttaatcctgcttggatcctgtggaagttgcaagtaacttcacttttttcatcttgttaagatgatgatgtttgaggaaatggggttctgtggggatcttgatttctttcctgctccgctgaaggaagtggaagtggaagtggctgctccacagagtcagactgagccggattctgtggttgatgatgattatagtgatgaggaggagattgatgtggatgagctggagaggaggatgtggagggacaagatgaagttgaaaaggctgaaagaaatgagtaaaagtaaggaaggtgtcgatcctgcaaaacaacgtcagtcgcaggagcaggcgaggaggaagaagatgtcaagggcacaggatgggatcttgaagtacatgttgaaaatgatggaagtatgtaaagctcagggttttgtttatgggatcattcccgaaaaaggcaagccggttagtggggcatctgataatcttagggagtggtggaaggataaagtgaggtttgatcgaaatggtcctgcagcaatagccaaataccaagctgatcatgccatctctggcatgaacgaggggtctaatccagttggtccaacccctcacaccttgcaggagctgcaagataccacccttggttcgttattatcagctttgatgcagcactgtgatcctcctcagagaagatttccattgggagaaaggtgttccaccaccatggtggcccacaggacaggaggattggtggcctcaattgggtttgcag

SEQ ID NO: 14579 - DNA, 730 bp, Solanum tuberosum
  Predicted polypeptide sequence is orthologous to G938
gaagcagaagaacaagcaaaccactgatcaagctcggcggaaaaagatgtcaagtgctcaggatgggattttgaagtacatgttgaaactcatggaggtctgcaaggctcgaggatttgtttatggcattatacctgagaagggtaaaccagtgagtggttcatctgataacataagagcttggtggaaggagaaggtgaaatttgataagaatggtcctgctgcaatagccaagtatgaagcagaatgtcatgcaaaaggagagggaatcggcaaccaaaatgggaacccacaaagtgttctgcaggacttgcaagatgcaaccttgaggtcccttttgtcttctttaatgcaacattgtgatccacctcagcggaagtacccattggagaaaggtgtctcaccaccctggtggccatcagggaatgacgaatggtgggtgaaaatgggtctgcctaagggtcagaaaccaccgtataagaagccacatgatgtacagaaaatgtttaaagttggtgttctaactgctgttataaagcatatgtcacctgatattgcaagatcacgagattagtgcggcagtccaagtgtttacaggataagatgactggcaagggagagctcaatatggttagctgttttaagcagagagggatccactatcccggctacaaaccagtgacaatgggtcatctagcatacgtgaggcacctattagaggtcatggtga

SEQ ID NO: 14580 - DNA, 1083 bp, Solanum tuberosum
  Predicted polypeptide sequence is orthologous to G938
ctcacactctgcaggagcttcaagataccacccttggctctttactgtcagctttaatgcaacattgtgatcctcctcagaggcgatttccattggaaaaaggtgtttcacctccatggtggccaaatggacaggaggattggtggcctcaattgggactgccaaatgatcaaggtcctccaccttataagaagcctcatgatctgaagaaggcttggaaggttggtgtcctcacagcggtgatcaagcacatctcccctgatattgctaagattcgcaagctggtaaggcaatcgaagtgcttgcaggacaagatgacagcgaaggaaagtgcaacttggcttgccatcatcaatcaggaggaagttttggctcgtgaactttatcctgatcgctgtccacctttgtcctcaggtggtggtagtggaaccttcactatgaatgacagcagtgagtatgatgttgaaggtgctattgatgaccctatctttgatattcaagagcaaaagccaaaccatctcagtttgctgaatgtcagtgttgagatgttcaaggagaagctgcctctgctacaacagtctcaggccaatgaagggtgacatttttgccaacttagatttcactcgcaagaggaagccggctgatgacttgacttttctggatggatccgaagatatatactttgtgagtgtcttccaatgtcctcatagttagcttcgcaatggttttccagacagatccagcagagaccaatcatcatttaacttgccttttcagaatacctcccaatttggagttccaaactttcccgttgaagaacttcaacccatctgtctttccctcaacagttattctccagccaaagcaagctcgcttcccgttcaaaccagttcaaccctcctttgatacatcctgaacctgcgggttcccgccagatagccacaggtaaccaatgacctatttccttcctatgaacgtatgttcccggaaccaaactccaatgcgggaagttttgattccaaagagtctcttacaaactcttttacacaaaatcttttttttccaaaccccttcaaactctct

SEQ ID NO: 14581 - DNA, 846 bp, Solanum tuberosum
  Predicted polypeptide sequence is orthologous to G938
gatcgctgtccacctttgtcgtcagctggtggtagtggaactttcactgtgaatgacagcagtgagtatgatgttgatggtgctcaagatgagtgtaactttgatgttcaagagcaaaaaccacaccatctcaatttgttgaatgccactgttgagagattcaacgagaggctgcctctgcaacaacagtctcatccaatcaaggatgaaatgattaccaacttagatttcacccggaagaggaagcaatccaatgaacagactgttaccatggctcagatttatacgtgtgagattcttcaatgtccttacagtgaacttcgccacggttttcaggacagatctgcgagagacaatcatcaactggcttgccctttcagaaatacttctcaatttggagtttcaaagtttcccatgaacgaagtcaagccagttgtcttccctcaacaatatgtcccgtcaagttcagttgctctgcctgttaatccaagtccacctccctttggtctatttggagtaggagttcctgaagatgggcaaaggatgattgatgaccttatgtcattctatgactgtaatatacaaggaaacaaaagccaaaatacggagaatgttgcaggtgaccaaagagcagcagtttcatcaacaaacctcggtgttggaccaggtcaaatttaccttacaacagtcgagggatgatggaggcggaaatatctttcacaacgatattcactgtttcccgcaagtcaaagttctatggcacccgacaaaagcaatccctgttgatcaattgcaaggatcccttaattccacgtgacatttgcatttcttggtttggggcctccg

SEQ ID NO: 14582 - DNA, 633 bp, Solanum tuberosum
  Predicted polypeptide sequence is orthologous to G963
ctcactttccactttctcctcttccttacttcttcttctctgcacgctgcttgagaatgttctccatggtgttcttcaatgctgactttttgttccttcttctttgggtattcaacatccttcacgaattggtgatgaagagtgctgagatctttagctctcaaaggtgtaattttcggtatgatttcttgtcgagctcaatagagagcgtgagccttgcattcagctttgaatttccgtttgcagccgaataggagtgactcaaggaactcccgtgcttcttcacctcgatttctctgttggatgctcgttttggattcagatacaactcctagactctcaccttttgctagtccatgtaccactgtttgctggctgaaatagcttaggattagttcctttacagcttttttgttccagaagtagatagcatctaaattgtacatatcatagctgtggaaccctgtaacttctatgttgtatctaagcatgatgaccattgttgttgctgtaaattctccttgtttttatcctgactgaagggacctgatgtttatcaatgttaagaatatgtttaccttgccttggtaaaaaaaaaaaaaaaaaaaaaaaaagaaaaaaaaaaaaaaaaaa

SEQ ID NO: 14583 - DNA, 738 bp, Solanum tuberosum
  Predicted polypeptide sequence is orthologous to G987
ctattctaccactacttactacttcaacagcattttcttctatataatcaggtaccattctcagttcctattttttgtttcagtttcttttcttctttttttttgttagaatttctgtgattcttgatttcttcaatcaaacatctcagaatttagtagctcaaaccaatttccatggaagccctttttcaagaacagctttttccttgtgctgattctttcatttttaggcacccttcaattccaatggatccaagaaaagatgttgtacaaaatggtgtcaataatcatcctagttttgttcaagattacctttcaaatcatgttgttggaaagggagattcttcttctcctaaagaggaaggggaaagggactattctgatgcaatgtacaaattcttaagtcagatgcttatggaagaagatgatttggagaataagccatgtatgtttcatgattgcatggctctccaagctaaagagaaatacttatctgatgtacttcatggatccgaaaacagctattccccacaatctgtcattatcaatccacgcgattcctctagttctctcagcaactattcacctgattctattgagtcgcctcaatgggatcttaatttcgaatcccctgtttccgtgtcgactttatctaatcatgactctttcttcacttccttcggaaatggccattttgaaaggagagctgttaatgtgttccgaagtggcagcagcagc

SEQ ID NO: 14584 - DNA, 908 bp, Solanum tuberosum
  Predicted polypeptide sequence is orthologous to G987
gttggctcattatcttgccaatgcccttgaagcacgcctgtccggcacaggaacagctttgtatacagcgtacgcacccagtaggatatcagctgctaacattttgaaagcttacaaggcatttatcacagcatgtccattcaagttgctgtcaaacatgttcgcaaacaagtatatcagaaaggtcattgctggagcaccaaagatccacataattgattttgggattttgtatggtttccaatggccctgtctcatacaaggtctatccatgagggctgggggacctccagagcttcgcattactggaattgatcttccccagtcaggtttcaagccagcagggagggttgaggagacagggcgtcgcctggagaagtactgcaagcgatttaatgtccctttcgtattcaaagccatcgcgaagaagtgggaaagcatcacgcttgaagatcttgagattcaaagggatgaagtgttggtagttaacagtttgtataggctaggaaacatacctgatgagacagtagtaccaaacagtccaagggatgctgtcctgaatttaatcaggagaatccgtcctgatttgttcatccatggtgcgttgaacggtactttcaacactccatttttcgtcacacgattcagggaggcgctttttcacttctcctcactgttcgatatgtttgaggctactatgccccacgaggatgaggacagaaagctattcgaggaagaggtttatgcaagagatgctatgaacgtgatagcttgtgaagggacagagagagttgagagacctgaaacatacaagcaatgggcacttagatgcgttagagctgggattcaacaggtgccacttgaccaggagattgtgaggatagtgaggaataaagtgaggtcggagt

SEQ ID NO: 14585 - DNA, 537 bp, Solanum tuberosum
  misc_feature (379)..(379): n is a, c, g, or t
  Predicted polypeptide sequence is orthologous to G987
ttttttttttttttttttgtaatatcaaagattagcaagactaatcccctttctagggccagcgttatgtacatataatagttagagaacacatcgttttttgctaacataacagcatccctatgaactaaaagtttgaccaacaaacatgtttctgatacttctatgctggcacccaacatgagctagcgcatactacccggcctttccaaccctgtaacatccatttaccatcctcattaaacacaaaatcgcggtggtaaccagcctttaccttgcaccttaacttctgcacgagttgttggttcaacggaagaatcttgaatccagccctcatattgcggacctgccattgcttgtacgtctcaggcctctcaantctctcggaaccctcacaagcaatgacattcattgcctcacgtctgtaaaattcttgttcaaaatgcgaactctggtgatcatcacggggtaaggtagcattcaaaacatgtccaaagacgagtttgaagtaaatggcgaagaaggggccttcccctg

SEQ ID NO: 14586 - DNA, 870 bp, Solanum tuberosum
  Predicted polypeptide sequence is orthologous to G987
tttttttttttccctgtggtaatttaaatcaatgtactattacttgcagttaaattacacatcctaaaaaaaattatatttacactgtcacagtatataacttaacttcaaatagggctccaagtatattgaacaaactgacataaactgcaaattcacaaaattccagaatacatatctgatgcacaatgttgcagcaatgtcttgtcagctatagctcttcagcgaatgattttatggtctcggtcattcttctatggaatatcgattcaatcaactcaactcctatgttgtgtatgctgatgatcatcaccaagaacatgcaccgaagcctcgtcttgtctgattatcagatggttattgaagtgtacacctgcagtattatagccccgtccatattaggaaactcgacgagttttagcaaccaaatgatcttgttcgttacagtctttattactgtatcaagacactgagaaggccagttacaccaggtttccaacaagataaggcgtaaattgttcttcctttccacccaagcaacaaccactggttatcttcatcgataacaaagtctctatgatatcctaacccttcactttctctattgccttatccacaaattcctcccggtccaaaaggtatctgcgtaaaccttgcccccataatacgagcttgcactgcttgtatgtctctggtcgttcaactctttcccaccccctaaaaagcttatgacattcaacgccttccctcccaaatatctctctctcaaataaatcgtctttctggaatctcacggggaaacaatagttcaacgcatatcaaaatttgccgaacaatggataaggctcagaaaccgtgtgacaaacatgg

SEQ ID NO: 14587 - DNA, 658 bp, Solanum tuberosum
  Predicted polypeptide sequence is orthologous to G1017, G2567
gctcaatatggtttatcattatcagatctccatttcaataagttgcattctagtttgtttccggttggttttccaccacttgatcaggctgcagcagcatctcgtagacccctgaatattccaatgatcagcaagccatgcaacaatgagaatatatcttgcttgctaaccatgggaaattctgctcactctacgaagaaatctgatattgggaaagcaccacaactcgtgcttttcggtcaacctatacttactgagcagcagatctctcttagctgctcgggagatactgtttctactgttcgtacagggaatagttcctctgatggaaatgctgataaaatcgggaacgtgtccgatggttcaggttctgcactcaatcaacgtggattaacagaacgctcaccatgcgacacatttcaatctgaacctaataccgagattggacactgaaattggcaaatatgttcggtattgacaactcggagatgcttaatcacgtactttaccgggataccactggctcggtcaagcaacttggtgatgaaccatatagcgacttcatgaaaacagcgcgaaggttaacaattctaactgattcaagcagtgacaatgtaggaatcagggaatagagagaacaagttaatctccactttcc

SEQ ID NO: 14588 - DNA, 725 bp, Solanum tuberosum
  Predicted polypeptide sequence is orthologous to G1017, G2567
gcaatttggagtacctttattagatctccaccgtagcgaaaagttgcagttaggtgtgctacaaccacccgcttcccaacaagttgatgctgattctgaaattcctattggcacaagtaaggtccaaaaagagagcaatgaaaatgtatcttgcttgcttaccatgggtacctctagtcagatggaggaagctgataatgtgaagacacctcggtttttactctttggccaaccaattctcactgagcagcaaatgtcaagtgtcctctctactcatgctcctccacaagtccaagcagaaagagactccgattgggcacaattgaaaactgaaagaatttctcaaggctggaaatgcctttcagaaagtctatcaagcactacatttctttggaataaaggttatcacgcagctgaacttggtgcgagtactgatcactgcaaagtattcctagattcagaggacgtaggacttactcttgatctctcagttctaggatcatatgcagagctgtataaaagacttgcagacatgtttgagatggaaagattagatatggtgacccgtgtgctctatctagatgcaacaggtgcatctaaacaaattggagatgaaccattcagtgacttcatcaagactgcaaaaagactgacaattttgaagaaatctggcaacagtgctacaaggaaatggctcactgacctgccaatcctcaacgttgtct

SEQ ID NO: 14589 - DNA, 818 bp, Solanum tuberosum
  Predicted polypeptide sequence is orthologous to G1017, G2567
aaaacccaattcgtttgccaagacattgactcaatcggatgcaaataatgggggtggattctctgtgccaagatactgtgcagagacgatatttcctagggttggattacacggctgacccacctgtgcagaccgtgacagccaaagatgttcatggtgaaacttggaagtttaggcacatttataggggtactcccaggaggcatttgttaacgactggttggagtagttttgtgaatcagaagaaacttgttgctggagattccattgtgtttttgagggcagaaaatggtgaactttatgtgggaattcgtagggcaaaacgaggtggtattggcgggcctgaagccccttctggatggaactctggtgcaggaaattatggtggattttctgcgtttttgagggaagagatgagcaagaatggaaatttgagttctcctacggggagcttaaggggaaaggtaagggtgaggcctgaatcagttgtggaagctgcatatcttgctgctagtgggcagccttttgaagttgtttattatccctgtgcaaacacaccagaattttgtgttagggcgtcttcagtgaatactgcaatgaggactcaatggtgctcaggcatgaggttcaaaatggcttttgaaaccgaggattcttctcgaatcagttggttcatgggaactatatcctccattcagcttgctgatcccatccgctggcccaattcggcatggcggcttcttcaggtggcatgggatgaacctgatttctggcagaacgtttaaccatgtcaagccatggcttgtcgaattggtctc

SEQ ID NO: 14590 - DNA, 999 bp, Solanum tuberosum
  Predicted polypeptide sequence is orthologous to G1020
gatcacaaacaaaaatatggctgtgaaagataaagctgtgaaaggaggtaatgtgaaggtgagtaatggagttaaggaggttcattacagaggtgtaaggaagaggccatggggtcgttacgctgctgagattcgtgacccgggtaagaagagtcgggtctggttgggtacttttgatacggcggaggaagcggcgaaggcttacgataccgccgctagagagtttcgtggacctaaagctaagacgaatttcccctttccggcggagattaataataataatagtaataatcagagcccttgtggaagcagcaccgtcgagtcatctagcggagaaactgttgctcacgcgcctcatacgccacacgcgcctctagagttggatctcacgcgccgtcttggcgccgttgctgaaggtggacgtggaggtgtcggctacccgattttccatcagcagccgacggtggcggtactgccgaacggtcagccggttttgttgtttgattctatgtggagaccgggagttgttagtaggccgtaccaggttgtgccggcgccgatggagttcgccggtgtcggtgccggagttgtttctactgtgtcggattcgtcttccgttgtggaagagaatcgttacaggaaaaaaggacttgatcttgatcttaaccttgcgccacccatggaagtttaatttgatgacgacgataacctaattttgtgaaagagagattaagagtgacagaactaatggctgatttttgtatataagtttaaaagaactgttccttttttttggcagttgaaacgtgttgttatgaggtttctgttgctttttctaccaattgtaactcttaaatccttttgattaatgagaaaatctatgttttctccttcctctattcgtgctggtcgcttgaatctataggctaacttctcttatccgctttgttcatcttttaagtttatttttctctttagatcctgcgacgtattgttacg

SEQ ID NO: 14591 - DNA, 993 bp, Solanum tuberosum
  Predicted polypeptide sequence is orthologous to G1020
gatctaattctctaatgacttgttcaaattctatacgtatatatatataattgtccatttccggtaagcggcgaactgaaaatggcgcccaagcaaaaatgtacgacggcggcgacggcagtgacagcggcggcggtgaaggaggtgcattacagaggtgtaaggaaaaggccgtggggaagatatgcggcggagataagagatccggggaaaaaatgccgtgtttggttaggtacgtttgataccgctgaggaagcagcgagagcgtatgataaagctgcgagagagtttcgaggtgtgaaagcgaaaactaattttcagattgtgatgcagccggaggatgtgaatcggagtccgagtcagactagtaccgttgagtcatcgtctgcggcggttgcggttgcggttgcggcggcggcggcggtgacggtgactgcgacggcggcggcaatggtggaatcggttccgttggatctaagcttaggaagctcatcatccgttggtatttttagcaacggtgtaggtaagtttttgttccagaattctcctaccggaggaatcgctccgccgatgtactatttacaaggagctggagtgattcgtaacggcggcggcggaggtagtggagatggaggtgctgctgccggcggccagagtgggatgatgaagagtgaatccgattcatcaactgtgatagattttatgggtaacgatctcaagccaaaagctaatttcgaccttaatcttcttccggcaccggaagacacgtgaaaattcttctgtatggatcggaaagttgccggagttgatgatcggagattctgcatgctttttgaactttggctttatttaattagttgtaagcttgtttaattagcgttaattccccttttaatcaccagtaattaaggaaaaaaaagataagggaaactatagtatatatagggggaaaacgatgacgttctgttcatcgagttactaaatgtgatatcg

SEQ ID NO: 14592 - DNA, 1009 bp, Solanum tuberosum
  Predicted polypeptide sequence is orthologous to G1020
attttgaataaatttaattagtctttagtatggcgcccaaagaaaaaattggtgcagtgacggcggcggcagcggcagcggtgatggcggtggggaaattgaatggaatttcgaaagaggtgcattatagaggtgtaaggaagaggccgtgggggagatacgcggcggagataagagatcccggtaaaaaaagccgggtttggcttggtacttttgatactgcggaggaagcggcgaaagcttatgataacgctgctagggaattccgtggagctaaagcgaaaactaattttcctccattacaaaaggaggaagatctgaaattccctgttaaaaatgaaatcaatcggagtccgagtcagactagtactgttgaatcgtcgagtccggttatggttgattcatcatcgccgttagatctaagactttgtggatcaatcggcgggtttaaccataatactgttagatttccgatctctggtggaggttttaccggtgctgtaccggcggtgaatcatatgtactatttagaagcacttgcacgcgccggagttataaatttagaaacaaatcggaagaagacggtggatttcctcggtggtggtgactccgatacatcaacggtgattgattttatgcgtgttgacgtgaaaccaaccatcgccggtctaaatctggacctcaactttcctccaccggaaaatatgtgacatcaccggagacgacgatcggagatattttgtgaaacatttttatttattgcaatttcctttttaatgtttttatttaaacagaaaaggaaaaaaaaagaaatagtatatagaattagattagatggtagaaaactgaagagccatcgccgttgctgctgccgtcgccgccagcgacaatttatcaccgccgatgtccatatcaaccaggctgatctacttttaccttttttttgcacagaagaaacaaatctattgattttgcaaagctgtttgtttcattagatcatcctataata

SEQ ID NO: 14593 - DNA, 876 bp, Solanum tuberosum
  Predicted polypeptide sequence is orthologous to G1023
gccaagatatcatatataaagtttcataacatagctcatcacaaagcagtaaacagtcctgagtaccaaaccgaaaatcgagcattcaataggccttctggacggcgtctagcagcagcagaaaaagacccaaagggactagtttgactcaattttcttcaaagataagaagacatacctcaaaagctctcttaaaacataattgtaacagactactcaggaaatcagcttgaaaggcggaagaccacggtctcggagaagctaagtttaatgattcttgagacatgaagaaactctctatggattactaataaataaactaatagagaacactaataaatattgaaactcctatagctgcaaaacttatgggcataatgcaatattcgaggggtgtagtagttagttccattcatcaatggagcagctgctgcatcatccatccaagcacaagcatcattgtatccatgcgaaatcaaagtcgaaatcgtaatcaggtaaatcatcaggcaactgaccatcaagtccacatatcggaagatcctcgaaatcattgacagcaaagtcatcaagattctgggcaaaattatcatgcccagcaaagaacatgtccatctccgtatcgaaatccattcgttgcaccgatgtcagcgagcgataaagtatcctccatcaatccaggttatcatcatccagtagctgctcgaaaagtttgtcgttgttgttaacctcagacactggatgagaaaccatgaagtcacatgaatccattttcaaaaacgtgatgcctgggagcatgctatgtggaacgtaatgtggacacgcaaaacttcttggaagcaggattcatccttcggaataagggcaacccaataa

SEQ ID NO: 14594 - DNA, 844 bp, Solanum tuberosum
  misc_feature (106)..(106): n is a, c, g, or t
  Predicted polypeptide sequence is orthologous to G1033
ggctgcagaatcggcaacgatggcgaagagcccttggtattctctctctccttcatatagagcctttcccactcacaactcaacacacacaaagcaacgcaccaanatccacacaaacgaataatatctctctgtttctacgctctctaaggtttcatcatgaaaggagctaaatcaaaggctaaagctgatacaagcttggtgtaaggaagaagctactgagagtaagaaagcgaagaacgcttgctaaggatccaaacaagcctaagaggcctccaagtgccttttcttcgcttttcatggaggagttcaggaagacctacaaggagaagcacccaaacaacaaatctgttgctgttgttggcaaagctggtggagacaagtggaaacagttgtcagatgaagagaaagcaccttaccaagccaaggctgagaagaggaaggctgagtaccaaaagaacatggatgcatataacaaaaaactggctgctggtgattgctggatggattgagggaatctgacaagtccaagtctgaggtacatgatgatgatgaggacgatgatggaagtgaagaggaggatgatgattaaacaatcaggtaaggcttgtttgaaaattcacgaaaattggtgggagaaaggttcattgtaggaaattgggtattcaagaccttacctttttataaatagatgcctcttttttacatattttgttaagattgtacacatgggggtaagtgtgggcccgaaaagtgaattcagattacttggctttgaaagctcaagtaggttatgtaattccccataatgtgggggtgatgaagaatcagttggggaaaaaaa

SEQ ID NO: 14595 - DNA, 804 bp, Solanum tuberosum
  Predicted polypeptide sequence is orthologous to G1033
tttttttttttttttcgcaacaataagctacacaattatagaaatagactaatcaaaagagaccaattgcctaaaaagttgcattatcattaagcaacaccagcatcagaataaaaagtacataagccactgagctttaaagatagctctgatctaattcatctttttcccatacctaagaaaccccaaaataaacccaaaaaagagcaagtatttaacggggaaaagtaaggagtcatcatatagagaaatatctaaggtattacacagcttccccaccaatttactcctccattagcacttcagtcatcatcctcttcttcctcatcgcttccatcttcctcatcaacctcagactttgacttgtcagattcctcatcttcctcagcctcaccagcctgttttctgttgtaagcatccataagcttctcgtaatcagcctttcgtttctcagccttagcaatgtaaggagctttctcagcatcagtcaagtgtttccacttgtcaccaccggccttgccaacagcagcaacggatttgttgcctggatgcttttccttgtactgcttcctgaagtcctccatgaaaacgaagaaggcacttgctggcctcttaggcttgtttggatccttggcagcattcttctcctttttagtctgggcagcgctcttcttcacaccgagcttgttatcagctttccccttggatttacctcctttcatgataaaaaacttctagggttgagagagaaaaaacaaagcgatattttttgccctttgagatgaaatgtgtatcgtgtgtgtg

SEQ ID NO: 14596 - DNA, 665 bp, Solanum tuberosum
  Predicted polypeptide sequence is orthologous to G1038
cccaccgccaccgtacgactggatttatcaacccaatctccgagcagcaaatatggatttttcatcaatatggcttcactaatggtgtaattttggtttgttatcgatcatctagctatgtattactcatttgatatgattctagcagctttgcagaagcagagtttcattatgttccattgctttccgagtttggtcctgactctcgaaattcgaacggtgccacaaaattaaaaagagttcatggcagacatcgggcacacgtttgatgatgatgatctcaagcaaccttattacaacatgttttctctgatggggactgggttctttggttctgttggttgcattataaacttcggttaaatctttgccgcagattcaaaccttgcttaccaatggaagttgagacacatatgtctttcagaactgctgaaaaaatcagcattttggtggtggatgatgatgccacgtatcttccggttgttgctgggctactcaagaaatgcaactaccaagttgtgactgtcaaatatccagtagatgctgtgtctaaacttaagatcaaaggcgactcttttgatctcgttgtcactgatgtgcacaagtctgatatgaatggctttgaacttcaacaagtgatagcccaagcatttgaaatacctgtt

SEQ ID NO: 14597 - DNA, 419 bp, Solanum tuberosum
  Predicted polypeptide sequence is orthologous to G1043
ggaatttctgtggtgaaaacccacataaaagattgataaaagaacttgttgaaggaaaaatattcgcagtccaacttcaaagtctacttaaacaacctaatgaatcagtcttagctgatgaatttattcgaaaaatctggggatcttttactcaggctattactgtgttgaatagtttgggcaattccgataatagtttaacccagagccagatcgaggaagttgatcaacccaattcgggttctggattgaagaagaagaagaaggagaagcaggaccggagaggttgctacaagagaagaaaaacttcaggttcatggatgagagaatctgaaacaatgaatgatggttgtgcatggagaaaatatgggcagaagataatactcaattcaaaacatcctaggtgctactataggtgc

SEQ ID NO: 14598 - DNA, 904 bp, Solanum tuberosum
  Predicted polypeptide sequence is orthologous to G1043
gatcaattataaaatacacatatggataactcatcgactgatctaaacagagcaatcgaagggttaattcgtggtcgagaatttactcgacgactaaaagagattatcaagaaacctcttgttggtggtggtgaagttgcaaacattatggctgaggaattagttgccaaaattatggaatcattttctgagactctctccgttataaacaattccgatgtcatcatcactacgccggttgaggtcaagtcgccggaagattattctagtggaagttgcaagagttcagatcgaagaggatgctacaagagaaggaaaacttcagaatcaaacataaaggaatcctcagatttggtggatgatggtcatgcttggagaaaatatggacaaaaacagatccttaattccacttatccaaggcactactttaggtgcacacataaatatgatcagaaatgtcaagcaagcaaacaagtacaaaaaatccaagacaatccacaacgatttagaacaacatactatggacatcacacttgcaaagcttttcctagagtttcacaaataatattggattctccaatggatggaaattctaattatattagttttgatcaaaatcatacatttccatcaataaaacaggaaaccaaagaggaagtagttttcggcttctatcctaaaattgaagatcaaattcaatcatcaagttctgattattttcttcccaatgatcatgatcatctcactccggcaacatttgaagcctccggtagccgtatgacgtcgcccgatgttatgtcatctggggtttactcttcttgtactactactagcaatgataatcttgagatagatatagattttgaggagggtctttggaatttttgatcagtgtagctatagc

SEQ ID NO: 14599 - DNA, 878 bp, Solanum tuberosum
  Predicted polypeptide sequence is orthologous to G1047, G1808
cacccccctttagaagcgattttccggccatgttgtccacttttccggccactactctgtccactgatggcctttttccctatttatttccggcttttgatggcgggttcactccttgggaatgtatagaaccggcttttctattcccacaagaaatggaagaagaagaaccggttgtttcacccaaggaatccccacctcctgaaccggttattttaaactccgattcaggttctgatgactccaaaccgaattctgttcactctagttccggttcagatgacccgaaccggaataataacacgaaccgctgtcctgacgagaggaagcggcagcgcacgacatcgaaccgtgacatagatgagaggaagcgtcgacgtatggtatcgaaccgggaatcagcgaggcggtcccgcatgcgaaagcaaaagcatctggagaacctgcggaaccaagcgaaccggcttaaagtagggaaccgggaaataatgaaccggttacggttaattacttaccagtgccaagtggtccagtgtgagaacgagcgggtcaggaccgaatcggctatccttcggcaaagacttgagggtatacgtcaaatattgatcacccggcaacttgagcagcaatttaattcttattctgcatgggcatgcaataatatggaacaaagacctcattaattaatcacttggacctataataaatcatcattaaacgtgcttcttcctctaattagcaccactatataactatcagatgaaatgaagtcacaagaggattttctctctctcactctctatttcttgtaaattaaattaaaaggtgcgtataatagtggtaaagagatatagtaatatgtattgtagctactagct

SEQ ID NO: 14600 - DNA, 951 bp, Solanum tuberosum
  Predicted polypeptide sequence is orthologous to G1048
caatagtaagtcgggccctagtttcttcacccccacaatctccgtcgaactggcgatggtcgataacttcgatgatatcatcaactgggacgatgtagatcacatcttccacaacgttctagacaatccccacgatgatgatcaattcactcttcatgattcctccccacagacattccagcagatcgagcagcttcttatgaacgatgacgatgtcggtcttgtctcttttgaagacgctgatcctcaatttgctgccgactttctctctaacgtcctcgtcgattcccctcttcactccgatcattctcactctcctgctgaacaagccattggattcaccgattccaaggtttctagtggatccgacgccgatcaggacaaactcaagtcaccttctgatggggacgacgaactaaacaaccatgaccccgtcgataagaagcgcaagaggcaattgaggaacagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttctctttgcagaatagcagtgctaatggtgtttctatgaccaagcaggagtctgccgtgctcttgttggaatccctgctgttgggttccctgctttggttcctgggcatcacaagcctgctcattctacccagccacacctggtcagttccagaagaaaatcagggaagcagaaaccacgggcttctccttccaataaaggaaggaaaaaagactagtcggattttgttgttcctgtccttcatgatgggcaaaagatgcaaagcttcaagatcgaggatgaagttcacccccattccttgggaggtgtgatgtgactcgttgtgatcaaatccattccctta

SEQ ID NO: 14601 - DNA, 882 bp, Solanum tuberosum
  Predicted polypeptide sequence is orthologous to G1050
ggacaacattgatgcatttaactcttcgggaactgatgagaagctgggtattgagaaccgtgaagatttagatagtagagcgagtggtacaaagacgaatggtggtgatagcagtgataatgaagctacaagcagtgtcaatgacagcagcagcggcagtatgcagaagagggaaggggtcaaaaggagtgctgtggcagatatcgctccgacaactagacactacaggagtgtttcgatggatagttttatggggaagttaaacttcattgatgattcaccaaagttgcctccatctcctggaccacgcccaggccaactctcaccaaccaattcacttgatggaaattcaaacagtttcagtttggaatttggaaatggtgaatttagtggagctgaattgaagaaaattatggcaaatgaaaaacttgcagagatagctttagcagatccaaaacgagccaaaaggattttagccaaccgtcaatctgctgctcgttctaaagaaagaaagatgagatacattgcagagttagaacacaaggttcagacattgcagactgaagccaccacattatctgctcaattgaccctcttgcagagagatgcgactgggctaacaagccaaaatagtgaactgaagtttcgtttgcaagccatggaacagcaagctcaacttcgtgatggtattaatcttgcttctgtgatctatgaccatgtatttgtcagctcatgtttcatctatgactccctatgttgctaattatcatttttttttcttcttagaaatcgagtcacttactcttgggttttaagaatgagatatcgcctttaaaagtttattcacaaaagaatgagatatcacctgaagagggaagttga

SEQ ID NO: 14602 - DNA, 803 bp, Solanum tuberosum
  Predicted polypeptide sequence is orthologous to G1050
ctgaagttctttgattattacgaagaaatagcatttggggtgtcggaaaaattgaatctttttgcgggtttatttgttgatttttgatggctcagtctaattctaagccacctatgagtggtcataattttggtgttggagctgcttctcatgtgaggtctttatctcaatcgagtattttctcgaatagttgtttgcccccattgagtccttttcctcctagtgagccggggatggtgtcgggtcattctagcttgaaggatatatctatggaggaagtagatgtgaattctcaaggtctaggagttgtgtcttcgtttacgagggatggtcttcctcctcggaaggggcatcgtcgatctaatagtgatgttccattgggattctcggctatgattcagtcttcacctctgttgatgcctataagtggtcagaagatttttgggagagcagtgagtcttggggatagcaatggaaagattgatgagaggaaaccaaagggagaggttacagatgagttgttgttttcctacatgaatttggaaaatatagagacattgaacggttctggcacggaggatagagataaggacagcattgtcagtgggacaaagctaagcggttgtgagagcagcaataatgaagcagaaagtgttatgaaagggaatactgttagtatccaaccaacaagtttaagggaaggaaccaagaggagcgctgatgcgaatattgctccagctgccacgtccaccttttaggagtcttttccatggatagtgctaattggaattttcactatgggg

SEQ ID NO: 14603 - DNA, 651 bp, Solanum tuberosum
  misc_feature (487)..(487): n is a, c, g, or t
  Predicted polypeptide sequence is orthologous to G1050
ggcaccacaaaacttgacgtctaatttattgatacagttatttccaaagaacaaaataatgattcactacatatggtataaattgtagccagacacacataagaaacttatataaatactaatatctgagagcttagtttctcagtgtttgtgcgtagcatgtgagaccgataattgataataaactttttggcttcacgtagagattatcttcacctcctcaaggctttatgttcacccactaggcagatgcaggtgttgctgaagccgcaggtgttttaccaacagataattgttgcatttgactcggctgttgacgctgcatctggaacatattatgctttactggcgtctgttgtgtcatgttattaggcaaccgtccttcctccctatgttccccagctgcaagttttagacgttggacttctgcagttaatgcctcatgcagagctgcagcggaaagcttaggttatgaatatccatcttnatgggtaggtgtatcagatgtccatagagtatcagcatatctatacgtcttgaatgtcaggtataaaatgcgcttgggaccttgtcccttggttcatccaagcaggcttgactagaccagtataacctggtcctgccttcaagattactataacagtatcctaa

SEQ ID NO: 14604 - DNA, 838 bp, Solanum tuberosum
  misc_feature (783)..(783): n is a, c, g, or t
  Predicted polypeptide sequence is orthologous to G1053
ctccttttcccatttgcttactctgtttttgagtttttctccttctgttgttctgtttcttgtttttctcctcttttttagcccttttgatttctgggttcttagtctttgtggctaaaatccattaaagatccaatcttttttcaccaattctgctccttttaacctctgatttctgggtttttgctgaaacccattatagatccaacctttcctgttctgggtttttaatctttcttgttgaaacccattaaagatctaaccttttctgttctgggttttcaatctttgtggctaaaatccattaaagatccaatcttttctccattttctgctccttttaagctctgttttctgtgtttttactctttcttgctgaaacccattaaagatctgtgaaaaagaaaaaagctaatgctaaatagaaacatttattgatgtaccagattcatgtctccagttcttagtgaaatccttcgttctggttatataatcagttcatcacttagacgcagaactcatcttgttcaatctttctctgtttctttcctctactggttttatactttctcagaataataataataataatcttcatccatagtttttcaaattttgctagcttaccttaaaacttaaaattagtacttttttcaccttgtgtacataacaaaatggctacttctagtggtaattcatctcagattccgaacaattcaggttgtgatgaagttttaatggtggttgatgacaaggaacaagaaagagaatgcaatcgaatcnggaatcagcaagcagatcaagacttgagaaaacagaaacatttggatgatttgga

SEQ ID NO: 14605 - DNA, 950 bp, Solanum tuberosum
  Predicted polypeptide sequence is orthologous to G1062
ggcagaattccatcaatggagagggtgaaaggaagagaaagtggggtaatggggaagaagttgatgatgtgagctttgatgggtgcacattgagttatgattcagatgatcttactgaaaatgttactaataaggtggatgatagtgttaagaatggtggaaattgctcgaatgcaactagcaccgtcaccggtgggaatcagaaaggaaagaaaaagggactgccggctaagaatttgatggcagaacgacgacgtaggaagaagctaaacgataggctttacatgttgaggtctgttgtaccaaggattagcaagatggacagggcttcaatcttaggggatgcaattgagtacttaaaggagctcctacagaaaatcaatgacctgcataatgaactggagtccacgccgcctagctcctcattgacccaaacaacaagcttctatcctctaacaccaactggaccagctctgccaggccgcatcaaggaagaactctatccgagttcatttgcaagcccactgtctagcccgactggacaacctgcaagggtaaaaaatctttaaccaacagtaatgtttcatccagaagaaacttatcataatacaaacatatgtttctagttagatgtgtatacatatacattgattgcattgagcactattacggtgttcttcatggtggtaaagtctaaaagtcatcatgttattggtttgagatgatgtaatgcagattttgttttacttttaggttgaagtaaaggcaagagatggaagagctgtgaatatccatatgttttgcagccgcagaccaggcctcttactctcaacaatgagggcactcgacaacctcgaactggacatccaaacagctgttatcagctgctttcatgggtttgccttagatatctttagagctgagcaatgcaaagaaggtcaagactttca

SEQ ID NO: 14606 - DNA, 812 bp, Solanum tuberosum
  Predicted polypeptide sequence is orthologous to G1064
ggaaaaacaattcagagaaattttgacaaaatcactcatcaaatactccttcgtttgttaaaactgtgccctcttcaaactcgtaaggcaaattaatcacacgataaaaaaggtgaagaaagaaaaaagaatgttcagaacaaatttaacaacaaaaaagaaaaatataaggaactttaaacatccaaacttacaaaacacaagttgggaaagaatggatgaatttgatgatcaatcaatcagcagtctatagctatgaatgatggctcgttgtatcatgccgatcatccgtgccaccgccgtgatgcgaatgggacccactcgcctgagattccgatacaccgccaccacctctatacggatttagtccggcaaacatacctaattgaccttctcccaatccattattaccgccgccaccgctactgccgccgcctagttgctgactaggcaaaagcgcaactggagtgggaaaattcataaattgcaatccacttggcattgtgcctctatacaaagcagctgctgcaccagaattgcttactgattgaaacggccaaatcggatcgcctcccatcacttggttactaggaatcggattcgtcaccatccaaaaattagccggaattgaagaatggcttgttggcatcgtaccagtactcgactgtagcaaatagcttcccatttgctgttgttgttgatgctgctgctgctccaaatctaaatctgaccttcgtttcctacttaaattatcctccgccggactcgactccgttaaatcgattgaattgtcacgcaattcaggctttgtt

SEQ ID NO: 14607 - DNA, 847 bp, Solanum tuberosum
  Predicted polypeptide sequence is orthologous to G1069, G2153
gatattttcctacaaaacacaaacattataaactctatgtataaaatcaaacattgatagaaattaaattaccttagtacatatgatctcttgatcctaatatacccttcttttattcatcaaatttcaccttcttctttttttttgaaaaatctcaataaggtggtctaggatttgcccaagcatatgcatcatgattcaattgtccaccatttggtaataaatttggtgtaaaattataaataggtaatgatgatggatcaggcaattcatgttgttgttgatgttgttgttgtggccttccatcacttgaacctaaggttggaggcgaattttcagccggtacttgtgattggctggggcgatcgcctccaacctcttcctcttcttctagtggtaacctttcataggttgcattagaaaaagtggcagctataatcattactgggcccgcagcaattaacggcccaacaatactaccaccaaccacttgtccttggccaccggccaaatagacagttaacccggtcgagccaggaggggctggaccgggtaaaaatgctccggtcaatgataaaatctcgaatcttccttgtagaacaatagcacctggagatgatggttgtcttagggttacatttgcaaccgatccattcccactaagtacacaaacgccacgttggcgcctcctcgcaaattgtgcaatacaatcagcaacatctgtccctcctgccacctccatgacgtggctcctgagggcattagggctatcccgggtcacaaatattggtggtttgggcttgttcttggatcctggtggacgacctctaggtcttctatttacaac

SEQ ID NO: 14608 - DNA, 946 bp, Solanum tuberosum
  Predicted polypeptide sequence is orthologous to G1069, G2153
agacctcaaataacttctttaaatattttttttttaccatacaacataatcaaaaggaaaaaactaacctctaaatcctctcaaactttttttttttcatttcttgaattattattattatttttgtcataattaaattacctctaaattaaaaaggagggcgtccatgtgcccaaccaaatgcttcatggttcatttgtccaccatttggtagcaaatttggtggcaaattatatactggcatatttgatgatggaatatcacccataccaccaccaccttgttgttgttgtcctccaccaccaccaccacttcctcccattcccggtggcgatccaccaccaccaagttgtccttgggccaccgttccaccgccttcttcctcctcctccaaaggtagcctctcatatgttgcattaaaaaaagttgatgcaattaccataactggtccggaagccactaaagaccctactacacttcctcccacaacttgtccttgtcctcctgctaggtatatagtcaaccctgttgatccaggaggggcgggtccaggtaagaaagctccggtcaacgataagatctcgaaccggccgtgtaatgccatgacagctccaggagcagatggttgtcttagggttacattagtaacagttccagtagcactcaaaacacaaacacctctttgtcttttcctagcaaattgagctatactttccgccacatcagctccattagcaacttccattacgtggcttctaagtgcgttagggctatcccttgtaacaaatattggtggtttaggtttgttctttgagccagctggtcgacctctgggtcgacgagtggctacttcgactgcaccctctttagggtcgtcgctatggtccctatcttcatcatgactaccactaccacccactatatcgttcattgatacgcctagatc

SEQ ID NO: 14609 - DNA, 714 bp, Solanum tuberosum
  Predicted polypeptide sequence is orthologous to G1075, G1076
aaagaaagttctccataaagaacattaattaagatgacaaatttcagaattcatagagttacaagaccccaaaataacatacaagacaaaagaaaaaaaaaaactcaaaatctctagaacaaagatggtacactaattttgctgacctttttgattcaagaatccccatatttcatcattgatccaaattagcttccatttcatatcatcagtatgaacaagctcgaattctatttcccttttcaagatttgcactaaactccaaaaggtgggcgaagacctgaattccccacccacccatcaacagaagcagatccaggatttaaatagttaggcatatttaacggtagattaaaaaatggaagcccaggattagacgggtccggaaaagggttattattaacaaccccatcaccaccaccaccaccatcggagccttgtgtattaccatcttcctctaaaggcaatctttcataagcaacattagtaaaagatgaagctataacaataactggtccagcagccatcaactcacctaccacacttcctccaacaacttgtccttgtccaccagccaaaaatatagtcaaacttgttgcccctggtggtgctggtggtggtaaaaacgaaccactaagtgacaaaatctcgaatcgaccatttaatgtaacgaccgatgaagaactaatattaccagtattattattattacca

SEQ ID NO: 14610 - DNA, 1040 bp, Solanum tuberosum
  Predicted polypeptide sequence is orthologous to G1075, G1076
cttctctgtatactccactcagttctctctttacttttctattcgttcctagggtttgaaatttcttgtgttcattttgcttttccataaaatatattttcacgttcaagaattatatatatacatattttctactcatggtcattaattaatttcccgttattattaatcatatcatacttgattatagcttagttttctgttcactacttttgttaattgtatatatgtcatcgttatcgtctatggctggtttgagacttagagttccgcttctcatcatcgttttctccctcatacatctccacatatcctcaagatgacgaaatcaagccggaacaacactcaattttccgatgatgatgacaacgaacaacaacaacaacgattataataacaatagccccggggtagcacgtagaccaagaggtcgtcccgcagggtccaaaaacaagcctaagcctcccgtgataataacacgggagagcgctaacgcgctccgtgcgcatattttagaagtgagtagcggacatgacgtttgcgaatccgttgcgacttatgggagaaaaaggcaaagaggaattggtatactaagtgggagcggtacggtgaataacgtcaccatacgtgcagccacaggctgccggtactgtggtgacgttacatggaagatttgagatattatctttagtctggatctttcttaccacgaccgttccccccggggtcaccaggttaacgattatttagctggttggtcaacgtccagtcgtaggaggaaacgttgtgggtgcgctaattgcatcggggcccgggtcactgtaactagcattcttccatttactaattgttgtttatgaagatttgcctttggatgacacatgagtcattccaaatgacgcagaccaagacaaagtggtcactttggggaacccctatattggatacacttttttaattgcgcttaaacatggcaactgcggtccactcacactggcaacaggggtcagaactgatggaaatccacaaaaggacccaat

SEQ ID NO: 14611 - DNA, 635 bp, Solanum tuberosum
  Predicted polypeptide sequence is orthologous to G1078
aaggcttcgagtgttaggagcattgaaaggaagtattacaattcttactccatggttggcattggacttcctgatgtgggacctgataatggtaatgttttagatgcacgggaccctcttgctgagaaaaaggctgagcttgcagctagccaacggcgtgtggaagatgagatggtgaagcattctaaagcagtggaggtaaccagagcaatgactctgaacaacattcagacagggcttccgggagttttccaagctatgaccagcttttcttccttaatgacagaggcccttgaggctgtatgcacccgttcttattctattaagtaggaaacaacttacagataactgaatactagtacttattttctttttttttctttggctattcttactttcgttctgggcaaggatgaaagagaaagggcgcatttttggtcataggctcctttcagctagttggcttttccccttgattttttgctatgttgtagatatgtggaattttttcagttttgtacttttatctagtggtgggaagaggaatattttctgtatgtatagcaaattatttgcattattgcattgaggtcaacattctcagcagatgaataaatgtattccccttctaagtg

SEQ ID NO: 14612 - DNA, 900 bp, Solanum tuberosum
  Predicted polypeptide sequence is orthologous to G1079
gattaaaatttacgttcacttccgatcagttcatgtcgtcgcctccgccacaatcatcgtcgccgccgcctccactgccacaatcgcctctgccgcggcattacagaggatcctcaagcgaatcggattgtccgtcgtcgttgaagaaacaaaaagtggatgaggaagatggagtttccagcgattgcgaaagtgagcaacctttatcccctctttcagatataagccttcccgactgggatatcgaagaattaatggaagatttattttgccctatcgatcccaatgataaaaaggtggataaatctgtttggtataggtacttgcagcagatctgtgagagtgaggtatcttttctctccatccataactatttgctctatatctctacttgttgttgttgttgcttctttttgttgaatgttcagctcagagtttgttgcctttttactgattgctgattcttattattaagatgaaacactttgttgggaaaaaatacctttttttttatgacaaggaaatccgcagctgctatcctttgggtgtgcacaaggtaaaattttcatttctatgcaataactcgcaaaccacataggagaggttactcgcactaggtaagcctgatgcgacgagctcaactcagaaggcaaaccccttgctttcggcaaggggttttgaacttgagacctccaacatggattaaaaaaaaaataccatttttttttcagaacttacttttagaacaaacatatttatttttaattgattgagtttttttttttactgtgatagggatttgatattaaagattatcccggttcgggtcctcttactaccatttaccccatgactaaatacttagaatatcctgctgaggttgaaaagttgaaggtttat

SEQ ID NO: 14613 - DNA, 363 bp, Solanum tuberosum
  Predicted polypeptide sequence is orthologous to G1079
tgtgcctcagtaacccgttgaagttgatgtttgatgtatgaagtcatgttgtaatgatgtagaagaaatgctttggaatgatatttctcaaccacctttaccgcctcccaccctccctccctccctccccatcttatgagaagatctggcaagtttatgtttgtgttttctaggctcagagatttacttttatcgcaatatgagctactgcactgttagcgttatttagatcttaagcataccaacatatacaaacaggctgtatgtttgtgtctgctatgtgtaactatgttctcaagtatttatgtttataatcgattttcgttaggaaatatatctctaaaaaaaaaaaaaaaaaaaaaa

SEQ ID NO: 14614 - DNA, 726 bp, Solanum tuberosum
  Predicted polypeptide sequence is orthologous to G1084
tttttttttttttttgaaactaatatatatatatatatagatatatcaaggcacctctatatagctttctattccttctgtgttctgcataatcagtagcccagattggttaaggcacctctatggctcaagttactcaacatataatttacattgcattccttcctacctaacctaatatttttaatgtaaattacactgcattttgtggctgtttgatattctcacaattctttaccaaatcagtatatccatcagctgaagctatggcaaactctgtcagtgagctcagagcaactgacattcctgcacatagcactctaatggcaacctcagccatcttttctgctgtcattatgtcctcatcaagctgtccaacttccacgatattcatgttcccatcagattctccgccgagactctttgacccaccagaagtccggcgggaatcttcctttagttgttgtgcatagagtgagcctactcctgctgcaaaaaaatctagtccttcaagcactggtgtctcctggatggagtctaataacctggaccactggatgcaaatgctgaatattggtggagctcccgtggaacaacgaggagagaagggaaatttcgatgtgtcagaatctgaacgagcacagggcaaaagacagtttgctaaaagcatgccaggtatgatcgttgaaaaacgatccaggactcgaaacagggtctccaatttcc

SEQ ID NO: 14615 - DNA, 634 bp, Solanum tuberosum
  Predicted polypeptide sequence is orthologous to G1095
gttatatcttcctcatcacttttgccattttacttgttccatttatcatcattttgaagaaaaaattcgtttgctgcgccgatgaatcgaataatcccgccgatggaaccaccacatgtccgccggaaaatagagccggtgaagtagcgattggtatttgcgatgaagtagtgaaaaacagtgattgttcgatttgtattgcggaaattaaaataggggaaatttgtgcgattcttcatccttgttgccatggatttcatgttggttgtgttcgtccttggttagaagataacgagacgtgccctttgtgccggactactgttaatactaacttgtcacgtataatacggtatcgaggaaatctcgcaccatgactctatttcagattaatggctagttagtggttccaattgaatctcgtgtaaataaggtaaaaaaacattcttttgtatatatatatacattgaaaattttgctaaacttattatcagtacattgatgtagtagaattgttgcatccaacttgcgtttggccatatattttgaaattgttgcatccaatttgcgtttggccatagattttgaagttgaaatttgaaaatttgagtttttaaaaaaaaaaaaaaaaaaaaag

SEQ ID NO: 14616 - DNA, 963 bp, Solanum tuberosum
  Predicted polypeptide sequence is orthologous to G1108, G2394
atctgattcttcagctacagtggaaaaactgcttagacttctcctataaagctgctgcagtccctgaattaactgggtgattgtgaagagcagaagaatttttcattctggtgaactcatacttgcactgcttaagacttttgcatcccatgtttcctatacttatctctcagtcagtggacttagatggccatttcctcattggggctacaccggaaaagccaaactaaccagtttcaattattaatggagcaagcagataaccgtagcaacaatgagcatgttattgacataactactagcaacgatgcatcctcatctagcaacccccatgatagaccagttaataatgtgcttcatgtccaagctgaacatcccccatcaacaagcacaacagtgcccgtctcccaacatgcattttcttctgctaatagatccaacttgaggaactcatcatttgctcgaagaggaaatgggcgccgccatcggagtcctctgaattccgtgctctggatatccattgaactagtcttgacaatgagccaaataattgcagcaatcgcggtgttggccatatcaagggatgagcacccacgagctcctctatcccaatggatagttggttatgcatctgggtgtgtagcaatcctccctcttctctactggcgttttcttcatagaaaccaaaattcagatcaggattcatctcagcagccacagatttcttcccaggttgaactcccggccagaccttcctcaagtacaaggagttcagaaggagaaggtcgtcagacaactgctacagcttctacaggtggtcaaagtaatgaattactgagcagaagggtaaaggcatttgttgagtacttcaaaatggcattagattgtttttttgcagtgtggtttgtggtttggcatgtatggatatttggtggacactcctcttcctctgaggctccaact

SEQ ID NO: 14617 - DNA, 824 bp, Solanum tuberosum
  Predicted polypeptide sequence is orthologous to G1108, G2394
caagacgccacagatagctcgttttctactaactgactgagcaatcttaccacctcacatgttttgcaacagaaattgtatataaatctagtaaagctaacaacatttagcccaaaagaaatcagaagagtgatggaagaaaatgaaatatatatatgaaggtaactactattcctttaaaaagcatctctatactagcatgtgggcagagtggcaacttaaaacgcggaactctgacgcaaacttgcagttgcttcggtaagagagctcaaaagggtctcacccacctcagctttgcaaaggggacatgagttgttgattttcagccacttatccacacagtccttgtggaagaaatgagaacagggtaactccctcagctcatcattgttcacatactttgccaagcaaatgcaacatgccgcatcttctcctgaaatcacacgctccttgtctgttcctgcagccacaaccccaccttcagcagcctctttgttgccacttttgtttttctttaccttaaatttataggtcggaagagcattaattgattctggtgtggcgcctttgttttgagtcagatcttctcggaagcccatgactgaaataatgcaggggaggcagcagcagattgttgcacatagaataaatggcatggcatacccgatacagctaaaggtcagaaatactatacacaacctgtacaagttgggagcctcaaagcgaagcaggagtgtccaccaaaatatccatacattggcaaccaaaaaccacactgcaaaaaaacaatctaatgccattttgaagtactcaacaaatgcctt

SEQ ID NO: 14618 - DNA, 907 bp, Solanum tuberosum
  misc_feature (720)..(720): n is a, c, g, or t
  Predicted polypeptide sequence is orthologous to G1108, G2394
ttttttttttttataacaaagtagaaactaaaatttgtgataacaagcatctctagtgtaatctcaaaagcaacatctgaggagaatggtgtgtacggagccttacccttaaatgtatttatacagagagagagggagagaagtaattggtgtgctatgtctgcttagatgatggacacttcaaaaatatcgcccggtttagatcttccaaaagctatgcattttttgaagatccaacacgagtgcaactaacatttttttggaagttctaagtaacatagctggtgaggcatgaaatgagagtatcaacaatggaattacctcttctttcaagcttgttatggattcttggtatgaactacaactatacaaactgaaattcatgtggtaaaaacagcagtagcagtagcagtagcagaagaagtaacagtcagttgggatatactctccgtggctccccatgcaacaagctagccgcgatgatctctgtttcgaccataagaaggtggtttctgcatcaccttaggattgttggagggattcctcttctacagaaggtagatctctgttcttggcatcaatttcagatttgcagagggggcaagtcgcattaatcttcagccatttatctacacattgtgtatggaagaaatgcgagcaaggcaattccctcagttggtcattgtcctcatattttgttaagcaaatacaacataccgnatcttcgcctgatatggcacgttccttctctgtgccctgcagctacacaaccaccttcctccctctcctagatttttactttcatttactgcgcagttcccatcttgtctttgaagcgctgctactttgaagtgtctgggaaagagccgttgatgggactccttgctgtgggatccttcttcactcc

SEQ ID NO: 14619 - DNA, 852 bp, Solanum tuberosum
  misc_feature (575)..(575): n is a, c, g, or t
  Predicted polypeptide sequence is orthologous to G1128, G1399
gttctggggttatagttaaaagtaatgaattttctgaaaattatagaatgaccccaattaatgaaaatgtgaatgggtttaatggagcaatggctgcagttatacctgcaacttcaatgagtgtggcagcaccgtctacggaagggaagaagaagaggggaaggcctaaaaaatatagaccagatggttctttaaatactgcattatcaccaatgccaatatcagcttcaattccactttcaggagatttttcaggttggaaaaacagtggaagccgccccgttgaatcctttaagaagaagcagcaaaaaattgagcttggaataccaggggaaagggtggcgtattctgctggtgcaaatatatcaccacatgtagcatactccgttggtggaaaactttacaccgcatgtgtttactgttaatgctggcgaggatgttgcaatgaaaattatttcatttgctcaacaaaggatctagagctatttgtgtgctgactgccaatggtgcaatttcaaatgttacacttagtcagcttaattcttctggtggaactttgacctatgagggttgtnttgaaattctctctctgacaggatcgtatatgtctgagtgataccggagtaacaaaaagcagatctggtgggatgagtgtgtgtctctcaggtcctgatggtcgagttttggaggtggccttgcaggtgtgtttatggcagctggttcctgttcaggttgtcgttggaagctttatttcctgggctcacccagcaaagaagcgaaatcccaagaaagccaaaagtatagaagcaatgccagtctaacttttttcaacctgcttaatcccacgaatca

SEQ ID NO: 14620 - DNA, 968 bp, Solanum tuberosum
  Predicted polypeptide sequence is orthologous to G1133, G1137
agaactgaatgccctactctactctgatgatgataatgattattccgaggatgatgaagaaacaagcactggtcactcgcctagtactatgaccactcatgatctgcgagagtggtttgacggaaggggtgaagaagttgctagttctgctgggccgattaaaaggcataaactactagatggtagcttcaatgcaccagagctcagggatactgcaacctctgcaaaagcctatacatgctccgacttagaggatgatgcacaatccagttgtggcaatggtttcgaacaagattcaggagcaccagattctccatctggaaaaaagaggcaaagacaagacaaaatccgcgaggacaattaagcattttgcaggaaataaattcccccgggagggggaaaagggaaaagactccgatgggttggtttatttgattgaaagcaatcccaattaactttgagatcccctggaagatgaaaaggccaagtccccttaaggaactttgattcttcttttgagctttcagcttgcccacttggtcatcatattattgaggttactaaatgggtatttctttcttgtaagctttctcgccttgggtcgagaaggtacgtatatagagggttttaaaattaaataaagcctgaattagagtttaaatggtggtatggcaaatgttgtgggctgatcagaatacaccataaaacaaaccagattggagaatcctttttagagtctttattccatcatttcttgtttggggaaccttggctatggctttgaaaatccagtggtcatgtcttctctttagattacggagggaacacttcttgtcactacttccataaagggttggtacattcatgagtttatatcttgacccccaagagaaaaaaagttgattctggccttgggaaatgtttttagctttgcccacataatggttcgtcgttggttgaacgacata

SEQ ID NO: 14621 - DNA, 963 bp, Solanum tuberosum
  Predicted polypeptide sequence is orthologous to G1134, G2555
tagaaaaaaaaaaagttaacttttgctagaaaaaattcaccgatgcaacgtggaactgccggtgccggaggaggtggactttcccgtttccgttcagctccggcgacatggttagaagcactacttgagtccgacactgagaacgaagttattcttaacccttcttctcccattttacacactcccaaaaaaccaccacctcacccatcaactccgaagcttccggagcttaaactggaaactggcggagctactaggttcactggcgatccgggtctgtttgaatccggtggtagtagcaattttctcaggcagaacagttctccggcggagtttctttcacatataagctctgatggttacttctcaaactatggaattccgtccagtttggactatctttctccatccgttgatgtttcgcagtccgctaagcgaacccgagacggtgattccgaaagttcgcccagaaaattagcatcccagttgaagggagagtcaagtgggaagttacatggttctggtggatcgctggatgctgaaatggagaatctcatggatgatttggtgccttgtaaggttcgagcaaagcgtggctgtgctacccatcctcgcagcatagcggagcgggttcgtcgaacgcgtataagtgacagaattaggaagcttcaggaactggtgccaaatatggacaaacaaaccaacacagccgacatgttggaagaagcagtcgaatacgtgaagtttctgcagaggcagattcaggaacttacggagcatcagaagaaatgcacgtgctcaatgaaagatcaataatgagaagaagagagctccactagagtatataggcaatagttttgttagttgcatgcagtttagaaatggtaattcactcctctatatcctattcttcttcatgtgtagatattaatggaaattttgcagagctttgctactttagaa

SEQ ID NO: 14622 - DNA, 779 bp, Solanum tuberosum
  Predicted polypeptide sequence is orthologous to G1145
gcagatttattcagacttctggagggaatatcgatgatacttccactgcaacttcttttcagcatcaggctagcataactctggcaagggtgattagtagtaatacagttgataaagtgtggggagagacatacaacaaggccagaaggtgataaatcttgaggagatgaacaatcaggagagagagctaactcttggtgagacaactttggaggactacttggtgaaagctgggcttttcgttgctgatgcttctttaggacatacaatgtcattggataatcctacggcaatgcaaaattttatgcctccaataggcttgtccccatctccttcgctgtctgatacaccagtttctgatcggaagaggggtgcttcggacatcgataagactattgataggagactaaggagaaagatcaagaatagagagtcagctgcacgctcccgagccagaaaacaggcttaccacaatgagctggtgaacaaggtgtcacatctggaagaggaaaacatgaaacttaagaaagagaaggagctggagaacttgttatccgagttgtcgtctgaaccaagatatcagctaagacgaacgacttcattctgatcgagtcctttctctagttcttttgctagtctttatagatataggattgtgtatcctctatgaaacatctaattagggagttgggagatagatattatagcttgtttgatctttgtttttatctggatatgtttagatgcacatgaaaaactgaagaatgaatggaactctt

SEQ ID NO: 14623 - DNA, 964 bp, Solanum tuberosum
  Predicted polypeptide sequence is orthologous to G1145
atagtattggtgcagctcaagctcaagctcaagctcatgcccaagacccaaagacaaatgctttggctaggcaaggatcattgtatagcctaactcttgatgaggttcagaatcaattgggggatttggggaaaccattgaatagtatgaatcttgatgagcttcttaagactgtatggactgtggaggctagtcaaggaatggggggaacggattacggggtgttgcagcatggtcaggatgcttcggggagttctttgaatcgacaatcgagtattacactgactagtgatctgagcaagaagactgttgatcaggtgtggcaggatattcagcaggggcataaaagggatagtatcgataggacagctcaggagaggcagcctactcttggtgagatgacactggaggattttttggttaaggctggagtggttgctgagtcgactccagggaagaaaagttcggggtcagttttaggggttgattcaatggcattgcctcaacagcaagctcaatggtcgcaatatcagatgcatgcaatgcatcagctaccgccacagcaacaacaacagaacacgctaccagtttttatgcccagccattcgattcaacaacctctgactattgtttccaacccaacaatagatgcagcttatcctgaatctcagatgacaatgtccccaaccgctctgttgggcacattatcggacacacaaacacttggaagaaaaagagttgcaccagatgatgtggttgagaagactgttgaaaggaggcaaaagaggatgattaagaacagggaatctgcagcgaggtcacgagcaaggaagcaggcttacacccatgaactggagaacaggtttcacgccctcgagaagagaatgaaaggctcaagagacagaaggagatagagcaggtgttaccgagtgttccacttccagagcctaagtatcagctgcgc

SEQ ID NO: 14624 - DNA, 800 bp, Solanum tuberosum
  Predicted polypeptide sequence is orthologous to G1146
gccacaacagggaggatatggtggccgtggtagtggaggagctccaccacgtggaatggcccctcagcagtcatatggtggacagcctgaatactatcagcaaggcagagggactcagcagcatcaacaacgaggtggaggaccaccccagcaacatggtggcataggtggccgtggagcaccttctggtgggccttctaggccaccaattcccgagctgcaccaagcaaccacacagactcaacatcaagctgtaatgactactcagcccataccttatggaagaccagctgacacatccatggaagtgggttcctcatctgagccccctgagatgtcaactctgcaagtgacacaacagttccagcaactggcggtgcagccagaagcagctgcaacccaaacaattccacctgtgtctagcaaatcactaaggtttccgctgcgtccagggaagggaaagtttggtcagagttgcatagtgaaagccaatcacttctttgcggagctacctgacaaagacttgcaccagtatgatgtcaccattactcctgaagtatcttcacgcggtgtcaaccgtgctgtcatggcacagctggtgcttctttaccaagaatctcatcttggaaagagacttccagcttatgatggaaggaaaagtctatacactgcagggccccttccatttgttcaaaagagttcaaaatcactcttactgatgatgatgatgggcctggtggtgccaggagggaaagggaatttccaagtgtgatcaaatttgcttcccgtgctgatctcat

SEQ ID NO: 14625 - DNA, 540 bp, Solanum tuberosum
  Predicted polypeptide sequence is orthologous to G1146
ggagggacaacgatacaccaaaaggttgagtgagaagcaaattacttctcttttgaaggtcacatgccaaagaccaagagatcgtgagaactcaattttgcagactgttcaacacaatgattataatgaagacccatatgcaaaggagtttggaatcaaaatcagtgaaaaacaagcatctgtggaagcccgtgtgttgcctgctccttggctaaaatatcatgagacggggaaggagaaggattgtctgcctcaagttgggcagtggaatatgatgaataagaaaatgataaatgggatgaccgttagccgttgggcatgcatcaacttttcacgaagtgtccaagagagtgttgctcgtggcttttgtaacgaactggctcagatgtgtcaagtatctggaatggagttcaatccggaaccaataattccaatatacatggccaggccagatcaagtagagaaagccttgaagcatgtatatcattcatgcgtaaacaagctaaaaggaaaagaacttgagcttctattggtcattct

SEQ ID NO: 14626 - DNA, 964 bp, Solanum tuberosum
  Predicted polypeptide sequence is orthologous to G1146
caatgtgtggaatatctggaatgaacttcaatccgaatcctgttctgcctcctacaagtgcacgccctgatcaggttgagagagtcttgaaaactcgatttcatgatgccatgacaaagctgcagccgctatcgaaggagctcgatctcctggtcgttatcttgccagacaataatggatctctttatggtgacctgaaacgaatttgtgagactgagcttggagttgtctcacagtgctgtttgacaaaacatgtatttaagatgagcaaacagtatctagccaatgtagcactgaaaattaatgtgaaggtgggaggaagaaacactgtgctagttgatgcaatatctaggcgaattcccctagtcagcgaccgtcctacaatcatttttggtgcagatgtcacccatccccaccctggagaggactcgagcccatccattgctgcggtggttgcttctcaagattggcctgagattacaaagtatgctggtctagtttctgctcaagcccatcggcaagagcttattcaggatctgtacacgactaggcaagatcctgttaaagggactgtgtctggcggcatgattaaggacttacttatctccttccgaagagctactgggcaaaaacctcagagaatcattttctacagggatggtgttagtgaagggcaattttatcaagttcttctttatgaacttgatgcgatccgcaaggcatgtgcatcattggagccaaattatcagcctccagttacatttgttgtggttcagaaacgacatcataccagactttttgccaataaccaccgtgacagaaatgcagttgaccggagcgggaacattatacctggtactgttgttgactcgaagatttgccacccaacagagtttgatttctatctttgtagtcatgctggcatacagggtacgagtcgtccagctcattaccatgttctatg

SEQ ID NO: 14627 - DNA, 968 bp, Solanum tuberosum
  Predicted polypeptide sequence is orthologous to G1146
gtgaaactgatcttggcattgtctcgcaatgctgcttgacaaaacatgtgtttaagatgagcaagcagtatttagccaatgtgtcccttaagattaatgtgaaagttggaggaagaaacaccgtgcttgttgatgcgatctctaggcgaattccccttgtcagcgaccgcccaactattatttttggtgcagatgtcacccatccccaccctggggaggattctagtccgtccattgctgcggtggttgcttctcaagattggcctgagattactaagtatgctggtctggtttctgctcaagctcataggcaggagcttatacaagatctgtacaagacttggcaagatccaactagaggaactgtgactggtggcatgataaaggaattgcttatttctttccgtcgagcgactggacagaagcctcagagaataatattctaccgagatggtgttagtgagggacagttttatcaagtgcttctttttgaacttgatgcaatccgcaaggcctgtgcatctttagaacccaactatcagcccccagttacgtttgtcgtggttcaaaagcgtcaccacacaaggttgtttgccaacaaccaccgtgatagaaatgctgttgatcggagtgggaacattttgcctggtactgtggttgattcaaagatctgccaccctactgagtttgatttctatctctgtagccatgccggcatacagggtactagccggccagcacattatcatgtcttgtgggatgagaacaatttctctgctgacgggctgcagtctttgaccaacaacctttgttatacatatgctaggtgtactcgttccgtctccattgttcctccagcctattatgcacatttggcagctttccgtgctcgtttttacatggaaccagagacatctgatagtgaatctgtcacaagtggagctgctccgtacaagaggtggtgtagg

SEQ ID NO: 14628 - DNA, 723 bp, Solanum tuberosum
  misc_feature (702)..(702): n is a, c, g, or t
  Predicted polypeptide sequence is orthologous to G1146
cgtactatcacagggcagaggacccagcagtatcacgagggggaggagatcccagcgtcgtggtggtatagggggccgtggggcaccttctggtggctcttctaggccaccagttcccgagctgcaccaagcaactgagactccacatcagcccgtaccatatggaagaccagcagaaacatactcagaggctggctcctcatctcagccacctgaaccaatgacacatcaagttactcagcagttccagcaacttgcatgtgcaaccagaagcaggtgcaccccaagcaataccacctgtatctagcaagtcaatgaggtttccacttcggcctggaaagggtagtaatggcactagatgcattgttaaagccaatcacttctttgccgagttacctgacaaagacttgcaccagtatgatgtttcaattaccccagaagtagcttcccgaggtgtcaaccgcgctgtcatggagcagctggtaaagctttacagagagtcccatcttgggaagaggcttccagcctatgacggaagaaaaagtctgtacaccgcagggcccctcccttttgttcaaaaagattttaaaatcacacttcttgatgatgatgatggacctggtggtgctaggcgagaaagggagtttaaagttgtgatcaaactggctgctcgtgctgatcttcatcacttagggatgttcnacaagggaggcaggctgatgc

SEQ ID NO: 14629 - DNA, 847 bp, Solanum tuberosum
  Predicted polypeptide sequence is orthologous to G1146
caagatttgtacaagacatggcatgatcctgcacgtggaacagttagtggtggcatgataagggatctccttatatccttcagaaaggccacaggccaaaagccacaaaggataatcttttatcgggatggagtgagtgaagggcaattttaccaagtactgcttttcgagttagatgcaattaggaaggcttgtgcatctctagagccaaattaccaaccgccagtaacttttatcgtggtacagaaacggcatcacacccgactatttgctaataatcacaaggacaggagcagcattgataggagtggaaacatattgcctggtactgtggttgatacaaaaatctgtcatccaacagaattcgacttctatctttgtagccacgctggcattcagggtacaagccggcctgcacattaccatgttctgtgggatgaaaacaatttcacagcagacggaatccagtccttgaccaacaatctctgctatacatacgcaaggtgcacgcgttctgtctctgtggttcctccagcatattatgcacatttagctgcatttcgagccagattctacatggaaccagacatgccggaaaataattcaggcagccctcatcaaggcagcagcaaggctatacgagagatgggtgttcgaccgttgcccgcgcttaaagaaaatgtgaagagagtaatgttcattgttaggaagaagaataaacaagggagtagcaaatgtaacaaataggtaggggttcagaccacatgcatctttctttgtatatgtatgtatgtgatcatcctaggttaatttcatgttagtttaaatgatggtaaagcggctttgt

SEQ ID NO: 14630 - DNA, 838 bp, Solanum tuberosum
  Predicted polypeptide sequence is orthologous to G1146
cttcttcttattactctttttctctctctcgttaacaatgtcggaacgtggacgaggacgtcgcggtggttctccttatggtggtggcagaggcggtggaagaacacctccttatggtggcggtaaagcgacggtcgaacacctccttatggtggcggcagaggcggtggtcgaacacctccttccgatggtcgtggcagaggatatccgtctcccggtggtcgtggtcgaggaacttattccagtggcggatcatcgagttacagtgcttctcctagttacaatgctcctccgagttacaatcctcctccgatatatcatcatcaacaaccgtcaatggcggtttcatcgatgactcgggaggttgaacaaaagctttcgcttcaaccttccacatctgcaaatcctcctgctgggcctcagcctgtgcaacagtcgtcaccgcctgttgctaccatccctgcgcatctagcgggaccgtcgacttcgacgcagccgccaaggccgccaccggtatcatctaaaaacatgcggcctcctcctagaccggattacggaaccatcgggcgaaggtgcctagttaaggcgaatcactttctcgttcaggttgctgatcgagatgtacatcactatgatgttacaatcactcctgaggttctgtcaaagaaagtgtgccgactgataatcaaacagctggttgagagctataaactttcacacttgggtggacggcgtttggcatatgatggtcgaaagagtgcttacactgctggtgcgctcccattcgctcccaagaatttgttatcctgtttgctgatgataattggtggagcaagga

SEQ ID NO: 14631 - DNA, 913 bp, Solanum tuberosum
  Predicted polypeptide sequence is orthologous to G1146
tgtgtattttcctgcttatatattaaaggcacatatataggcatataagccaccaacagaaaaaaaggtcaaaggaaataagtaaaatataattgaacatttactgtctgttgtgaccataacttcgacacacaacatgcagttgcaaaaagcatgaccatgatccacagatcaatttaaaaaataaatagattgatagtttaatttataacttaatttaaaagaagatttctactgaattcagtgatcgatgatcagtgaatttttcagcagtaaaacatgacctccgacacattttcatgaatgttaggaagtggcctgaattgtgcagctgcttgctccctggttgctgctcctccctcaccaccttcattagctgctcttacatccacgtcattctccatgtaatagcgtgcacgaaaggcagctagatgtgcatagtaggcaggtggcactaaggaaactgatcgtgtacaccttacgtatgtgtagcacaggtggttcgttacattctgaatggcatctgcggtgaaattgttctcatcatacagtacatggtaatgtacaggacgactggtacccttgatcccagcgtggctacataagtaaaaatcaaactcaggtgggtggcatatcctggtgtctaccacagtacctggcaaaatgtttccactcctgtctatcaaactacgatcatcgtgattggaagggaatagacgtgtatgatgtcgcttctgcactaccacaaaggtaactggtggcatataattattttccagggcaacacatgccttgcggattgcatccatttcttccaattaaaacctggattgaatttgtcctttcgctgactccatctctatagaaggattattctataagcgctttcgtttagtcactttgtaaaacggct

SEQ ID NO: 14632 - DNA, 885 bp, Solanum tuberosum
  Predicted polypeptide sequence is orthologous to G1181, G1850
ccagttttgttcggcagcttaatacttacggattcagaaaagttgtacctgatcgatgggaattcgcaaatgactgtttccgtaggggtgagaaaggactacttcgtgacattcaacgccggaaaatctcatcggcatgtaccgtcgtgagtgcggttgttgcaccagcagtagcggtgaatgcagcacaagcggtgacggtagcggtagcaccggctgtgaggatggtttcttcgtcgaattccggtgatgaacaggtgttatcatccaactcatcaccggcagctacggcagcggcgatgttaaggaccaccacgtgtacgacgacgcaggaacttatagaggagaacgagcggttgagaaaggagaacgcgcaactgaatcaggaattgaatcggttgagaagtttatgcaataacgtatacaatctgatgtccaattactcggtgaatccggcggatataccggcaagaataccggaaggacgagctctggaattgcttgacagcggcggtgcagccttcacagcggcggaggaagatataagcccacggttgtttggtgtatcaattggggtaaagcgcgtgaagagaagcaacgaagaagaatctgatacagttgaggatcaggatcaagtacaaccgcatggatcagacatggaatcagagccgttggattcaggaagcgctcatcatgatgatcaaccatggatctatcgattagatttagggtgatgatttgtcactcagaacaagtcagtcccttgtaggtggggtccacagaagcacttgggtgttgatgaacaacacgtgtacaatggaagattgttggttgtttctggtggtttctagaagaagtgagaaattgagtccaatggtttttaga

SEQ ID NO: 14633 - DNA, 1142 bp, Solanum tuberosum
  misc_feature (610)..(610): n is a, c, g, or t
  Predicted polypeptide sequence is orthologous to G1181, G1850
tcgaattttccaattatcttcccatctctccttgttcctacccaccccacacccacgcacctctatgtggcgccggaaacttctagaatcaccgaaaattccgacggtcgtctttctcggaactctgtagttttggctccagatctgcgagaatagaatcatcgatcttcactcaagtgataagaagatatgactccacagccaatagaccggaacggaggagagacgacggccggtgaaacgcagaggtccgtgccgacaccgtttttaacaaagacctaccagctcatcgaggatcaatctattgacgacgtgatctcttggaatgaagacggatctactttcatcgtgtggaatccggcggagtttgctaaagatttgcttcctaaatattttaaacataataatttttctagcttcgttaggcagctcaacacctatggatttcggaaagtcgtacctgatcgatgggaattcgcaaacgacagcttccggagaggtgaaagaagtcacttaattgatatccagcgtcgaaaggttgtgacagcgattgctactccttccgctgctgcaacagcggtggcgattgtggctgcgccaccacctccgnctgctcaacctccggtgacggtatctacctcggattcctgtgaagagcaagttatatcatcaaactcatctgcagggagcacagcggagcttttaggagaaaacgaaacgggtaagattggagaatttacaggtcaacaaagagttgaacagtatgaagaagcctctgcggcaatatatacggtatgatgtctaattacgcacaagctttcagcagggtaatcaacgccggggaagtattccgccgggtttaacccctgtcgcggtccgacggacgtccttgtaatcacagggtaggcggaaaagaacggaaagcctgtgaaccggggaaaatttcgctttcgaaggataacgcttagaagggaaaaaagacgactttcgttattttcgttcgcacgcagtgacaaatttttatacaccgcttcttcaaaacaggtatataaacacctgtgttcgggggaacacacgcttattttgtgtaacccactatataaatattcccacgactggggggaacaacactcctttaaaaa

SEQ ID NO: 14634 - DNA, 791 bp, Solanum tuberosum
  Predicted polypeptide sequence is orthologous to G1190
gattgagtcttgaaaacagattctggcccagaaagtgaggggaaattttgggtctttcaagatttttcttgaacatacaaggtagctgataaggaggatcaggaaacatgaagcacaaagatggaaaacctcatcaatcggataaaagttcgtggaaagtcccagtggcattaacagttgtggtgctgtgtgggctttctttctaccttggaggtattttttgctctgaaagggagagatatgtagctgaggctgttaacaaggctgttgacactcccacgggaactgctactgtacctgtccagatcaaagccgtttcgtttcctgaatgcagtgctgagtatcaggactatactccatgcacagatccaaagagatggcacaagtatggtcgccatcgtcttgctttcttggaacggcattgccctcctagttttgaaagacaggaatgcttggtacccccaccagatggctataaatcgcctattagatggccaaagagcaaaaatgagtgttggtacaggaatgttccatatgattggattaacaaacaaaagtccaatcaacattggcttaaaaaagaaggggagaagtttctctttcctggtggtggtacaatgtttcctaatggaagtggtgcctatgttgatttgatgcaagatttgattccgcaatgaaagatgggacaatccgaactgccattgatactggatgtggggtagcaagctggggaaggtgatttactgggatcgtggaattttgacggtctcttcttgccccaggggacatca

SEQ ID NO: 14635 - DNA, 922 bp, Solanum tuberosum
  Predicted polypeptide sequence is orthologous to G1190
ccccaaaaaaataaaaatagaatacaactaaagagtacaacgctccgttttttataatcgagaaatctccgagggccagctggtgcacaaagtaaaagctttgggccttgcaaagaataaattgcatgaacaagccatcataatattagcatatggttaatttttggctattgattcttcaattcaaaatctcaatttccaatgatttgttgaacaaaatatataatataatatatgagctgcgtggacttacttatctcctatgatgccaatcttaaatatataactttttctctccattatcagcaattgtgttttatggtatgatgttcaaagttcttcatgaattttgctttgaataccataacttcttctggcaaatcaatatcttctccttctctacgccgtattccgtttcttccttacgacagctccatctcattcccttagccatagtagctatagcgtctacgaaatagctggattctcggattatagcatatccattgggccgtaaaatacgatccatttccagcagaacatatttcatttcacatctatgactttcggcagagaagaggccatcaagatgcagaagatcgtatgtccgaggatatgtagagaaagcctcgcaccagtcatgaattgttccaataagacccctatcgtagaccacagaaagtgtattcggtgcataagatgaaaccacattcatgacccacaacggatcatcgaccacagcagcagcgaaacctccatacaaggtgttcatgtccattacatttctgatcttgtcagtcccaagtgcagggagcaaacttcttgtagtgtttcgcccgagccttccatttaccatcatcatgcttgaaggaaccagcattacctccacgacatcagaaacgcgtcaggagcagcgtgcaat

SEQ ID NO: 14636 - DNA, 310 bp, Solanum tuberosum
  Predicted polypeptide sequence is orthologous to G1190
tttttttttttttttttttttaataatataattttattaattaataatataatatgatataataattaaagttaataaaaaaataaaaaaaaattaccggtacacaatgatccggtaagaaccggttccggtccggtccaaaccggttccaatccggtaactaagggaccggacggaacctttggaaatatccggtaaaatcggttccggtaagacccggttccggtaaggaaatccggtaacgaggaccggtttcggtaaaaccggtcctgttgatccggtcttgtccctttgccagccttagttccag

SEQ ID NO: 14637 - DNA, 952 bp, Solanum tuberosum
  misc_feature (615)..(615): n is a, c, g, or t
  misc_feature (782)..(782): n is a, c, g, or t
  misc_feature (933)..(933): n is a, c, g, or t
  Predicted polypeptide sequence is orthologous to G1225
tttttttttttttttttcctttgtgtaattttttttgtactcaaataagccacacatttataacaaaaaatatcacagctcatgtgtacgtacgtacaaggacgacaagaaagaactctacatatactaattaatatgaacattgaacaagtttttttttttctagtggattcaaactaagaaaaattaaaaaaacatgataaataaaagataataggggggatctgttccctaggcttagcaagaaagtgtagctgcttcctcctcaattattcttagcatgtggtggactgcacctgctatgtcatctgctgagtttagttggcaaccttcctccaccttagcacttattgaataaagaaccaatggatctaaagtggtgacattgaggtgaaggacagaaatgtacaatgactgaaacgcagcgaccaatttagatagttgacgaaatcttcttcttgataatattctaacgtttgcatgtgtttcaattaaagttacttcaatatctgctatagctgccttgctctttgatgtgtatttgttgggcaattcacaacatgtatattgtggatatgagaaaaattgagcaaatggggtcccaacatactccgngctcgaaacttctgtctttccactatcacaaccatcaccagtattactagtagtaccgccttgttgttgtaataatacgaatttttgagcttcgagagattgtagaatgtgttccaattcctttacgaattcaatttgcaccaacaaaggattgaagctttggtcancccttttgaacataagatccgcgcatgagtgaacgttaaaaccgaaagattttcattcattttgtttcctttctatttctcttaaacagcaattgtgagtcattccttgattttcaagttcctcctttattttcacaagtttggggactcntccccctttgctttctcct

SEQ ID NO: 14638 - DNA, 508 bp, Solanum tuberosum
  Predicted polypeptide sequence is orthologous to G1242
gcaagaacttgccagaagatgtgatacacttattcgtttggtggagagggaaaaccaagaatttgatgagagggagagacaggcacgcaaagaaaagaagcttgcaaagaacgcgacaccatcaaagcgcgctgtggcaagacaggcagccaaaagccctcccacctcaaagaagcggaagcagtcatcaatggatgattatgtgagctcgggcaagagaagaagtgatggtacaacttagacagacttttctttttgtggtttaggtcccttttttaagtttaaccaggtttgtcatccaagacactaactatgcaatgtgttgggcattgcaattctgtcaagtgctacagaggaaaaccctaccagtgtattcagatatgatgtgtaggttcattgtacataatcacaatagaattctatttaggctagtcttatcaatgtggcgtggcactaatatgtaacttagatcaacttgccaattttatgattttgccagctcgctact

SEQ ID NO: 14639 - DNA, 997 bp, Solanum tuberosum
  Predicted polypeptide sequence is orthologous to G1242
agggaaaacagaggaggaggttgaaagatatgcacatgttttcaaagaaagatacaaagaactaaatgattatgatcggattattaagaacattgaaagaggagagtctagaatttcgcggagagatgagattatgaaagcaattggtaagaagctggatcggtataaaaatccatggttggaattgaagatccagtatggtcagaacaaaggaaagctgtataacgaggagtgtgatcgtttcatgatatgtatggttcacaagcttggccatggaaattgggatgagctgaaggctgcatttcgccaatcaaccttgttcaaatttgattggtttgtgaagtctcgtaccactcaagaacttgccagaagatgcgatgcacttattcggttgattgagagggaaaatcaagaatatgatgagagggagaggcaggcacgcaaagaaaagaagcttgcgaagaacacgaccccatcaaagcgcactttggcaagacaggcagccgaaagcccctctgctctgaagaagcggaagcaattgtcaatggatgactatgtcagctcaggaaagaggagaaaatgagagtcgaaatggagtaaaaagatgaggttagctggctggccggccgggacctcaaattggaaggaaattttattcatttactgatctaatcatctggtattttatccagaacgtcatttgatactgtcttttgccctgccaatcatgactcatgggcattgagattctgtccaggatgctatctgactggcggaaaaaggaaagatatttagtttataatttgttagtccgatgcaaattaaaaatgcaggtcattatttttctcaaacttctgaagctgtactggcatatttctaacggagacttcttagcaatttgtttgttataatccatgttggagttaatgggagcactacatagatagtcatggcctcaggggtacacttgttgtttttagtttagttttggggatgt

SEQ ID NO: 14640 - DNA, 692 bp, Solanum tuberosum
  misc_feature (41)..(41): n is a, c, g, or t
  Predicted polypeptide sequence is orthologous to G1242
acgcggtccggcgtctaactagtggatccccggcctggcangttattcggcaacgaggggtcagaacaaaggaaaattgtataatgaggagtgtgatcgtttcatgatatgtatggttcacaagcttggctatggaaactgggatgagctgaaggctgctttccgaacggcacctttgtttcggtttgatttggtttgtgaagtctcggacgactcaagaacttgccagaagatgtgatacacttattcgtttggtggagagggaaaaccaagaatttgatgagagggagagacaggcacgcaaagaaaagaagcttgcaaagaatgcgacaccatcaaagcgcgctgtggcaagacaggcagccaaaagccctcccacctcaaagaagcggaagcagtcatcaatggatgattatgtgagctcgggcaagagaagaagtgatggtacaacttagacagacttttcttctttgtggtttaggtcccttttttaagtttaaccaggtttgtcatccaagacactaactatgcaattctgtgcaagtgctacagaggaaaaccctaccagtgtaggttcattgtacataatcacaatagaattctatttaggctagtcttatcaatgtggcgtgacactaatatgtaacttagatcaactttgccaattttatgattttgccagctcgctaaga

SEQ ID NO: 14641 - DNA, 1112 bp, Solanum tuberosum
  misc_feature (549)..(549): n is a, c, g, or t
  Predicted polypeptide sequence is orthologous to G1242
agtcctttctcaagcaaaacttcgaatggtattttttaacccaaagagtcgaccatctacttgccatgtcaattccggacaaagtctgtccatcaaggcttcagctttttcatctccagtttacacaggttccacttccggagtgtcaagttcttgcaggcttgattgacggggttccatctggttggggactacccatcataccaccagttcaaaatctcaggtttttccatgcctttatgatcccattcaacttgtcaaacaaccagtagcattgtgcattgcaacttaacagagtttaaaccaacgcgggaatttccaccagaaaatggtgtgtttggaggcaccaaatgatttacctcgtgattccccgttgccaaacgggcagaaagctgtccctttcaaaaaccaatcttggttgagggcaggaatcaagctttgttgccaaacttgttccagaaggggagaaaggtataaaccacaagagggaccttttaacagcactttccagtaatggcataaatttgtcaaacaatatttaaccattantattccaaactgcttcataccacgttgaacagcatgacatattccaaccaaggttgttgttccacaaatattgacatgtcctgggtcacaagtacttccaaaaatgggtaaccacagaaaattggaacaactgcccttcgtttgaacgctggaggcctaacatcaagttgcgaacctgggttcaacgccttgtccaaggggttccctctttctttattctagtcaccatggacagttgggaccaggtttttacgggggttagctgaacattggtttgggaccaggtttgaacttttcaaaccaatgaaacaccatggggactttttttggcgccagactgtggcattaacggttggcaggttgggggtttcatttcccccaactttggaagttggggcacatttaagttttcaacaccggacatgttctccttaaattaccaacaaagattcccaagcgccacatttcattccctgggaacaaaaccacattgatatcattagacacctttgttaaacccttattagccaggaaggattacctcccaggaagcaaatggggca

SEQ ID NO: 14642 - DNA, 701 bp, Solanum tuberosum
  Predicted polypeptide sequence is orthologous to G1246
ttcgctataaatagcaaattgttaatccatttgaaagaggtttgctagacacatttagaacaattctagctccatcaaaccttccatgattagcaaaaaccaaattcaagattcttgattttggtaacaaagaattcacaacaaaaaccaaatttcaagattcttgattttccaatgatttccatttatgagctagtgcatcaacaacaccattaaagctaccaaaattggaacttaccacatcaatgccaacacccaaactctcagcaccagcagctgtaacagggccatgagcagccaccaccattcttggacatctcctcctcaccattgaccaatccaatccaaattcctccaaactcttcaacaaaccctccacttctccagtactagtaaacacaattgcatcaaatccacactcttcttcactctttgtcaccacatccaccgcacatttcgcccctgcccatcgcgtctcatacgcgtctaatctcactggaatccacccccttttcgataaatcctcaaggaatttcggcacaacaggtggttcattcaacccaatcactaaaggaactgggcacaacacttttcttccttgacccaatcctaatgcctccactaacccagatggggtttgcattgaaggaaccaaactcgaattctttcagggtttcacacatttttcgaatgattctcga

SEQ ID NO: 14643 - DNA, 726 bp, Solanum tuberosum
  Predicted polypeptide sequence is orthologous to G1255
accaaagctgaattaattattttattgattgaataaaaacaatataggttatgataaaaagaacctaagtcattccagattgctagtgtaagcaaaatggtgatgttgtaatacaaactctatcaactacaagatcaaatcatcatccatcatcgtttattcatcatgtaaggaaaaccaggcactgaaaaggaggacgatgagttccttttaatgaatcgtcctttcagccgaggccttttttctgcattcaatttcctaacttcatatcgaattttcttggaaaacaatctggtccttctcttctctctgtaccgcaataccctcgcttctcttcctccatcgccacttcttacatgtcccccataatatcctaaattacctccacatgtttccgagaaatcgggccagtagtcatcaggattgaaatggggtcggattccattagtccatggcgaagattgatttggccaagcactaataaccgcctcatgattaagcctgagaaacagtctgtttttttcatcagatttagtactgctaccactgtactctgcactagcgacaaattctgttactgctgccattactttctgctcaactctttcttcataatattcatcaaagttccaattcagtccttccctttccatgtccaattcaggatccaaatgacaagcaacaacagctctcatttcttcgtcttcaactcaattttaatcgcct

SEQ ID NO: 14644 - DNA, 844 bp, Solanum tuberosum
  Predicted polypeptide sequence is orthologous to G1266
aatcccttctaattatagctatggttccaactcctcaaagtgatctacctcttaatgagaatgactcacaagagatggtattatatgaagttcttaatgaagctaatgctctaaacatcccttatttaccccaaagaaatcaattacttccaagaaatactaataatcttcgtccgtcacagtgcataggcaagaaatacagaggcgtacgacgtcgtccgtggggaaaatacgctgccgaaattcgcgattcggctagacacggtgcgagagtatggctaggtacgtttgaaactgctgaagaagctgcgttagcttatgatagggcggcttttagaatgcgaggtgctaaggcactacttaattttccatctgaaatagtgactgcctctgtttcagtagaaaaattaagtttgtgctcaaatagttacactaccaataataattcaaattcaagttcgaatgaagtttcaagtggaacgagtgatgcatttgaatcaaaaatttccaaggagttttctcaagatgttaaaacagagctgtgcatggagaatttcttggtgctctaagcgaataatgtgttggcaagtagggaatatctctatctatgtattcaggtgtacgaatcaattgaactactaaaatttcgctgttgtacttatattatgggcttctctattctcttatttccttttttgaattgtttgcagcgatgcacgctataatcttgtgtaaaaagattgcttaggatacttagtatgtttataagttgtaatagacacattctattttctagttttttttcttctcaaaattcaaaatcaacggaatattatatgtaaaa

SEQ ID NO: 14645 - DNA, 922 bp, Solanum tuberosum
  Predicted polypeptide sequence is orthologous to G1267
ctctttcttagcaaacttatttattttctctctttttctcttctaatttctaaatgataaaaatttagttaaattaagctcaaaaagttttcttttttctaagttatataagttatttttgtttgttttttttggtcatggaagatagtctatacaaaaatccattttttcataaacaagaagattccaccggaactccaccggataatgctgctgattcttgtttttccggtgatgaagcggcggaagttagcatgccatcaccaagaaaaagtaggagaggagcaaaaaagaaagtaatttcagtgccaataattgaaggtgatggatcaagaagtaaaggggaagtttatccaccacaagattcttggtcttggagaaaatatggacaaaaaccaattaaaggatcaccttatcccaggggatattatcgatgcagtagctccaaaggctgtcccgccagaaaacaagtcgagcgtagccgcctggaccccaccatgcttctcattacctattgctccgaacacaaccaccaaatcccggccgccgccgccgccaaacaccaccacaccaaccaccctactaccaccaccagttcacccactacctctaccggcaccgccggagacaacaatgcaacggcggctgtagccacggactctaccgtactagacaaatcatctccggaagaaccagatctatttgcttatcaacacgataatggattttcagagctcgccggtgagttaggttggttttccgatatgggaacaactactacattgatggagagcacgtcgtcgtcaatggtgggatccacgtggaacgatagtgacgtggcgttaatgttgccgattcgggaggaggatcagtcgttgttcggtgatctcggtgaattgccggaatgttcagtcgttttccg

SEQ ID NO: 14646 - DNA, 798 bp, Solanum tuberosum
  Predicted polypeptide sequence is orthologous to G1272
gtttctttctcttttgtcgtacattagggtttcacctcttgactctgtttcttcatccgccatttttgagctttagattgtggtaatggctgaagaagagaatggtggatccacagaggctctgccccctcctccccctgttccacttgatttctctccagcacaagctgaaccagagccggtgaagaaaaaggttttacgtgttcccatggcgagacgtggccttggaagcaagggacaaaagatcccgatccttaccaatcactttaaagtgaacgtgtctaatgttgatggacacttctttcattacagtgttgccctattttatgaggatggtcgacctgtcgagggaaaaggaattggcagaaaagttttggatagagtgcatgaaacatatgatacagaattggccgggaaggattttgcatatgatggggagaagagtttgttcaccattggttcactacctagaaataaattagagttcacggttgtactagatgacataacatctaatcggaacaacgggaccaatggcaactccagccctggcagacatggaagccctcctaatgaaactgataggaaaagattaaggcggccgtaccaatctaaaacttataaggtggagattagcttcgctgccaagattccaatgcaggcgattgcaaatgctttgcgaggtcaagagtctgagaactctcaagaagccttgcgagttttggatataattttaaagcagcatgctgcaaaacaggggttgtttacttgtttcggcatccttttttcatatgaccc

SEQ ID NO: 14647 - DNA, 950 bp, Solanum tuberosum
  Predicted polypeptide sequence is orthologous to G1272
agacgagccccactaatcaagagtacaagattactggattgagtgaccgaccttgtcgtgaacaactatttaccctgaagcagaaaggaaaagatgcagatggtgaggtccaaacaactgaagttactgtgtttgattactttgtcaaccaccgcaacatagagttgcgttattctgctgatttaccctgcataaatgttgggaaaccaaaacgtcccacctatttcccgattgagctctgttctttggtgtcgttgcaaagatacacaaaatccttgtccacattccagaggtcttcactagtggagaaatcaaggcaaaagcctcaggagaggatgcaagtcttaagcaatgctctcaaaatcaaccaatatgatgctgagccccttcttcgttcctgtggaatatcgattagcaataacttcactcagattgaaggacgtgttcttcctcccccaaagctgaagacaggtggtgatgactttgtccctcgtaatggcagatggaatttcaataataagagactagttgatcccacgaagatagaacgctgggccgttgtcaatttttctgcacgctgtaacatacaagggctagtcagtgatctgatcaaatgtggaaaacagaaaggaattgtggtggaagacccatttgatgtttttgaggaatctccacaagtcaggagggctcccccactcgttagagtcgagaagatgtttgagcaggtccaatccaagcttcccggggcacctaaattcctgctatgtctgcttcctgagaggaaaaactgtgatgtatacggaccatggaagcgaaagaatcttgctgagtatggcattgttacccagtgtatagctcccacaagagtcaatgatcaatatatcaccaatgtgctcctgaaaataaacgcaaagcttggaggtttaattctatgttaactgttgaacatt

SEQ ID NO: 14648 - DNA, 964 bp, Solanum tuberosum
  misc_feature (707)..(707): n is a, c, g, or t
  Predicted polypeptide sequence is orthologous to G1272
ttagaagattgtggtaatggctgaagagagaatggtggatcacagaggctctgcccctcttcccctgttcatttgattctctcagacagttgaacaaagcgtgagaaaaggttaacgttgtccaatggaagaattggcctaggaggcaaggaacaaagaatcccgattcttaacaattaacttaaggttgacggttgttctattgtggattgaccccctccttcacataccagtgtttggcctatatataatagaggatgtctcaacccgtgtcaagggaaaaggaatcggcgcaaaagttcctgaatagaagttgcttgaaccattatgattcccagaatttggccgggaaggattttggcttatgatgggaaggagcaagttggtccaccatatggttcattacctaagaattacattaaaacttccacggttgtcttagaatgacttaccttctaatcggaacaaccggaaccattggcaacttccagccctggcaggacatgaaaggccctcttaattgaaacttgataaggacaaaagataagggcggccgaaccattctaaaatttacaatggtggagataagcttcgttgccaagattccaatgcaggcgattgcaaatgcttaacgaggtcaagagtctgagaactctcaagaagcctgcgagtttttggcatatacttttaaggcagcatgcttgcanaacagggttgttacttgttcggcaatccttattccataatgacgcaagaactttgcctgatgtttggacgtggtgttacttggttgcccagggtacatttcgagtttcgaacacccaggaggggattggtccttgagctttgacgttttctaccagatgataattcacgcctgggctgggtggacctctgatacgagcacaattggagagatccctctcacttgatgggggacgaggagctttttgaaaactgagat

SEQ ID NO: 14649 - DNA, 560 bp, Solanum tuberosum
  Predicted polypeptide sequence is orthologous to G1304
acgacttcgggtcttggtgcctgtgatcaacagaagcgcgctacgtgcagtgcacgccacgttcacctgcaagttgcagtggaaggccctgaatccatgcccgggtcggcacggtactgcatcgatcgatcggtacacgtattaaattttgttcgactcgagagactttggccgaacgttgtgcataccggtaacgcccccgtcttcggtctgtgagaagatggatcagtctcgccttgttggagagggtaatgcggagccacagagcccagcgcacgtggtcaccacttggctccgaggagagcgttgacattgcactatccatcgactccgaccttacccgatagcagtggtgccggagtattaaataaggtagggccacattccagcgcaaatcgagttggtgacctgcggtgctgtcatgtagaggctcgggcggcgcgccatcaagcattctgtcatctgtagaatttaggtgatcgctgatgagcgaccaatcaatcacatgagttaattgcgaaagaagtgtattaaacagccttaaaaaaaaaaaaaaaaaa

SEQ ID NO: 14650 - DNA, 615 bp, Solanum tuberosum
  Predicted polypeptide sequence is orthologous to G1305
aggctcattgtccgtccaaaagtattgtagggtttcatcgtccccttcacagacctcaaacttccttcattacttctacacgcgatgcctttcctacccagttcaatttcagattcaacaatgttttgagtgtacatctaaggcagagactactacctatatcaaaatcaagcaccaatccttcaggaggaccagagaaaagcaaggatgcatcaagcccaccattagccaccattttggctggtgtcttagtcttttgtgtcgtctgttggatcgtaggatctattgtaatctggctcataagtctcataactaatgtcccgccatcaaaataaaaccagagtgtgcattgtagtttgtttgcgctttgatcactagctagacaaagccatcttttgattgcagcctaaatagtgatgctttcctttatgttaccaagtgtgagattaatactgagttgctaattatttctaacaatgctgaaacatttgtggagtttctggttagctcaaatggcatgatacttcagttagagcataccaggaagtatcactcattctgttttcatcgtaaatttcaaggttttttcgttgttgttaagtttctgaataagag

SEQ ID NO: 14651 - DNA, 610 bp, Solanum tuberosum
  Predicted polypeptide sequence is orthologous to G1314
tttaaactcttctgcaatgttttccttcccctctttcttcattttcattcgtcgagcattaaaaattttcaggtttggttcaatagcctcccattttacaggaagaaaagatgatgacacagagaagtcttggaactcagatatgaggaaactggttcttaaatattagtctcagccctcgggatcagtgattgagccaggattgtcataccaggaatttaagcatgtgatctcgcgtcaaggggattcaacaactttatatatgtcaaaagactatttttttatcctatttgtacagtatatggatttaattgaagccccttcctccaagctagctcaggatagtcagcaagttttcgtatacatgaagtcttagttggatcaatgatgatcattggaaaaattgccccgagtttgcaaggatcaaggacattactatgcccagaatattgaacatagttgtatagagttttaaactatcaagttaatttgaactatatcttataagtcgcaaagtaaattgctttgaagctatgctaagctatccaaagattctctttttatctctttatatgattgatactaacttgcttcttttcttaatccacta

SEQ ID NO: 14652 - DNA, 859 bp, Solanum tuberosum
  misc_feature (572)..(572): n is a, c, g, or t
  Predicted polypeptide sequence is orthologous to G1324, G2893
tattagtagtagctaagaaaaaaaaaaatggtgcaagaagaaataatgagaagaggtccatggacagaagaagaagatgtgcagcttttattttatgttaaattatttggagatcgacgatgggattttcttgctaaagtttcaggtttgaaactaaggtgattggcgggagacaaattataaaacaaaaaatacatcatagtatatatgcataatattagtacaaacaaatagtcttctcttttatcccaaataacagttaagtttctaatctcttctttaattacttttaattttactctattttaattttttatatatatagttgtctgtgatgtatttatgtttatatctgtttagggttgaccagaacaggtaagagttgtaggttacgttgggtcaattctttgaatcctgatctcaaacatggcaagatgactccgtcaagaagaacgtcttgttcttgaacttcagtccaaatggggaaactaccatggtcccgaatttgcccgaaaaataccatggcgtactgatacacgccacttccgcacttcctggacaacccatatgangcacgcaagtccacgacccgacgcacaaagtctcctaatttctaccatactttcatcatcttcttacttccttcaagtcactccccgaagaacactcgcacgaaacttctaacgatcaccggtggcatccaggtccttgccagttgcaggtgcacaacaattcacgtgatcaaaaccaccttggcacccaggttccgaccagtttaactccaccatggcttcaacacccgcgcaccccactcacgggcctttccatttgcacgcaacacatctggagtcacaaccca

SEQ ID NO: 14653 - DNA, 317 bp, Solanum tuberosum
  Predicted polypeptide sequence is orthologous to G1324
gtttatttgattaatttggttttaatttcttcaaaatttcttctttttttcgggtttatggattccgagcagaaaaagtggaatccatggttgaggagaagtgaaatgatggggaagaaggctagctgagaaggggaaagggtaaaattggaattacagcgcccattgtatagggatagtcaagcttggcaaggagttggaattacttcatcttaattactacttcattatcaatcaagtgtaaacatcttaataaaaataaacatatttgtatttaattcagacttcaaaaaaaaaaaaaaaaaaaaaaaaaaaaa

SEQ ID NO: 14654 - DNA, 1157 bp, Solanum tuberosum
  Predicted polypeptide sequence is orthologous to G1327
tttttttttttttccttttttgtatttttttttttttttaagaagcaaaattcataggaaagcaaattgctaaacggacaacaaaacaaatttcttgttcttcatccaaacgaatggactatcactctctcgctcatggatcaatgaggttcaaaaattgcagttctcaaatcacgacaggaagtccatctatgtgatttcctaattaatcacatacaccgagaagttttggctgcattgtctgttaatttacactcagagtaagtatgaccagagcttagtgaatatccatgtgttaataacagcaaaggtagccaccaagcccggaattggtcactggcccaggaaattgcaatctcctcttactgtcttctgctcttaacaccttgttaaaatcctcaaaacggaaaacaaactccccattgaacttgcttccccaaacaaagggttattgtttttccccttgaagaattgggttaaaggccccaagtctttgggaattgccggcaaccaaaaatacccaaccaaggaatggcggggcttagcaaaaacctccaagggcttggccaaaaattcccccccttggggttgggggttggtttaaaattctccttgtgtaatccttctccgtttttccccaaattaaaggttttgcaaaattccgaccttcctttgttaaaagcccccccaagcaatttttggttttaatggccctcgttggcccaaccaaaatcttccccaaagaagccctttctcccgcatatggcctatagaaaccaactctatttttcggaacattaaacccaaattattcgggggcttggccaccttgtaggccccccaaccctctgtgtaaaccgaaaactggggacatcaacattcgcgttggaaagggccgccaaaattggcgcccctcttaatttgcggcgacttttggcgggaagcaacctattcccatttgtccccaacccaattggaagccaaaaattagaacgcatttggaaacacgacaaggagctttgagattaaacagcaacttctgctctattggttaaggcccaaaaaaaaaaaccacgcccatatgaaaaaccttaaatttttccaacggctctggttgtgtacccccttttaagggacccctggcacaatttaattct

SEQ ID NO: 14655 - DNA, 573 bp, Solanum tuberosum
  Predicted polypeptide sequence is orthologous to G1328
caaaaagatgcatcaacatagtgaaaagtgcaacaattacacagtgaatcttgaaacaaagagttaacacaagtacacaatcccctaacaacttataaccacatctactagaactaataggggcattaagcaagaaaacaaaactaataaaaaagaccagtgcactaagctaacactatgtgcggggttcagaaaagaactggaccacaacaattagtctattgcacactgtaaaccatgacctcctagtcccatcacaattagtctattctacgcagtcttagctttgaaaccatgaccccctagtcacactagggcaactcaaactgaaactattacataagataatactactaatacctaaaaaaaggggggaaacaagacaactaagtcattagagtcatcaccatcagcaagagtccaataacaagccttaaagttttcagctttcctcaacatcatcatcatcatcatgagcaggctgtggcctaactttcctaggcctacccctaggcctcccagtagtagaaccaagatctgttgaattgggacctccaggaacaggtgctggct

SEQ ID NO: 14656 - DNA, 667 bp, Solanum tuberosum
  Predicted polypeptide sequence is orthologous to G1330, G2423
gctaaagcgaacggggaaaagttgtagactaagatggttgaattatctccggcccgatgtacgacgtggaaatataactcttgaagaacaacttttgattctggaactacattctcgttggggcaatcggtggtcaaaaattgctcaacatttgccaggaagaactgacaacgagataaaaaattactggagaacgcgagtacaaaaacatgccaaacagcttaaatgtgacgtgaacagcaaacaattcaaagatacgatgcgttatctatggatgcctaggttagtagagagaattcaagcagcagcagcaggggcatctacctccaaagtgattgatcctcagacaattaatccaaacatggttcaaattgatcacaataataacaacacaaattcaagcacggcaacagcttcatcagaaaactcattcgtttcagacctcactgattgttgctacaattatccccaacaacaacaagattattttcaagttaatcaaagtataagtagtcaacttattggagaatctttaatcagccccacaggttactttcaccatgctttagaattccaaggcgctgctgctgcagatatggatcatcaacaaaacaccactcaatggatggacggtgcaaatttctctgacaatttgtgggatattgaa

SEQ ID NO: 14657 - DNA, 1039 bp, Solanum tuberosum
  Predicted polypeptide sequence is orthologous to G1332
aagagaaaaagtgcaatgaaggataaagaagttaaaacaagaatgaagagaggattttggaaacctgaggaggacttgatattgaagaattgcgtcgagactcatggagagggaaactgggctaccatttctgagaagtcaggcttaatgaggagtggtaagagctgcagactaaggtggaaaaattacctcaggccaaacatcaagcgaggaatgatgtcagaagatgaaaaagacctcatcatcagactccacaagcttcttggcaaccgatggtcactaattgctggtaggctacctggaagaacagacaatgaagttaagaacttctggaacacacatttgaacaacaagagatcatgtagaggcaaaaagaagcatgtcaagtccaaggaggcgaatactcaaagcacacaaggcaaaatgcaagagtaccctgctgagacagtaagcaaccaagaagtggcaaccaaaacagttttagattcatggatagaagaaatgcaggacttcaactgcagcttactatcacctctgacaatgaataacatgccatttctcgaagatgagccttttattcccatattggacgacattgtcttgcttgaagcattcacaagcactggcaaagaagcgtggaatgagattcagccattcctttagaaatttgtcgcagtatttctctattgcatccttcacataagagcacaatttccactagtgccatgacaagttaacaactcccatgctagcggtttcggatttgagcttgtgcttcatctgcctgaaagcttatttgcgaaaccaatttatgcatgtatcaagaggtcagaaatgaatagatctccctttttctaagtatcagcttcctcctctactgccaattccaactaagtgaagaaaagtaatgaactagatatcggctattcctgttacaaaagctagctatctggtttacaattcttattcgcattggtgtagcaacaaaacttcgaaaacagaattttttttaaaaaaaaaaaaaaaaaaaaaaaaaaaa

SEQ ID NO: 14658 - DNA, 530 bp, Solanum tuberosum
  Predicted polypeptide sequence is orthologous to G1335
tgctcttcttatggaccaagagtatcaaagaagtctagtgaattctagttcaattaacttaggacctaggcaattgaaggcacagtcatgtacagtaataggaattcaaactctcacactggttcaagcacattcaaaggaggaggttctggtaatatctcaggtgcaagtggaagttacaacagtagtggtgcaagctcatctggtagttacaagaataagaggtgtttgttgcaatgtgatcattgtggttgcaagggtcactctaaggaacaatgctacaaaattgttggatatccaactgattttaaggcaaagaggaaaggccagaccactggagcttatgctaatcaggttgatacacctctctgttgacactcaattttggccctccacgatatgaattaatcatcgagtttcttaaattccaaacgatttgaaataattagttcttataaagttcaaagtattttttttaagttactttaaattaattttatcatttttataatttttaagtaaaaaaaaaa

SEQ ID NO: 14659 - DNA, 303 bp, Solanum tuberosum
  Predicted polypeptide sequence is orthologous to G1341
aaaattgatttttttttttattttactaaaaaataaacataaagagggtgaatagaacaaaccctttgaccagatcaacaagctgtggatagagctctgactcccttaatttgatgatttcagctgatgtagtttcaatagcttgggcagcaaccatcatttgtgattccaacttttctacttctttcttggctttctctgttttcacataatcagccctcttcatctctagtttcctagcatgacctccccttttctcatgctccaactttaatgcctcagcatgcttgacctcaagataga

SEQ ID NO: 14660 - DNA, 488 bp, Solanum tuberosum
  Predicted polypeptide sequence is orthologous to G1341
aaaagaggtcagatcaaagctcaaatttttgagagcttagtcgaaaccgtaacctctttgttttcccctaaaatactattaggggaaacttccggcggcggtggagatgaatctgacggtaattctaccgtcaccacttcggtgggctccatcagtcctccaccgccgccgccgccgccaacggcatgaataagttcagacgaacttattcatggcttgaagtttgttcaaatttgtgtgaatttgtgatcgccttttttaatcagatgtaagataaaagaagaaaaaaagaggcaattagtgtttgcttgatttttaatttggagttgtgagattctgtaatttttaaagtcagatctgaacttctgtataattattgttatgtgtggatttactctttttgagttgtaattctctctaattatgtaataatctcctacgttttagatggagaaaacaaaaaaaaaacaaacaaaaaaaaaaaaaaa

SEQ ID NO: 14661 - DNA, 929 bp, Solanum tuberosum
  misc_feature (834)..(834): n is a, c, g, or t
  Predicted polypeptide sequence is orthologous to G1361
ctttttcttcctcttctcttttcttttctctctttgtactggtttcaacacagcagcacaaaaacagtactccattttcatctaaacagaagagaattagaaactacaaaaaaaaaaaatcaatcaaattaaattagggatcgatgttagtagaaatatggcatggtgcagtcaatcaacagttctcccaataatatcatcatcagatcaggaaaataatgttattatgatcaattcaaaaactagattcataacttgtccttcatgtggacacaacatacagcttcaacatcagaggggaatactacatgatttgcctagtctaccagctggagtgaagtttgatccatcagatggagagatacttgaacatttagaagcaaaagtcctttcagatacccataaaattcatccccttattgatgatttcattttgaccattgatggacaaaatggtatttgctacactcatccacagaaattaccaggagtgagcaaggatggtcaagtgcgtcatttctttcatcgtccatcaaaagcatacacgacggggactagaaaacgtcgaaaggtacacactgaaattgatggtggtgaaacaagatggcacaagacaggtaaaacaaggccagtttacataagtggagttctcaaaggttacaacgaaaattttggtactttatacaaattatggtaggcaaagaaagcctgagaaaacaaattgcgtaatgcaccaatatcacttaggtgaaaatgaacgaagaaaaagatggagattagttgtttcaaaagtttctaccaaaaaaacctagacttgtggatcattacacatanaaaaaccacttggatcacagcaacaatattattattaaccctgttctttaaaacaacgaatttcggcgaatattataatcctgaatctttcaatt

SEQ ID NO: 14662 - DNA, 776 bp, Solanum tuberosum
  Predicted polypeptide sequence is orthologous to G1363, G1782
ttccagtccacgaaacatagtagcattacatgaacctcttgaatcactcaatacacaaccagcaaccattttgtttcattttcttttcagttaatcattaacaacttcactgcataaccattccatgctaggtgcagacatgcagcaaaacggataactaatacagaacgaaagacgttcttttcttcaatctaggattaataacgaccaaattcaccattagaacagtagaaacaagttgacacttgcaaaaaccagagacgtaatggaaaaagggtaaaagccaaggatgaattgcctgccggtgactgtcttagccagttaagaacttataatcaccggacaactggagcacgttgctgactcccattgccttgcatggtaataaccatatgagaggatacactgaaggtcatgtgatcaggctgctgctggaagttgatgccattgtggacaacatcttgtcggacacttgagaaagcagaagttgaaccttcatgctcaactgagtctagagaagaagttgagttagtagggtagctatttggatcagattgatgaactttctttgagctgaggaaacgtccaccggaccctctaactctgttcactgcatgaagatgccgtgactcatgaagatatggctttctatttttgacaagtttgttctgaggcctcaagctttgcacgtatctgcctccggcttaggatcccatggtactgttttgcattaacatagattggtccatcctctggcatatcaacgggggagtggg

SEQ ID NO: 14663 - DNA, 1018 bp, Solanum tuberosum
  Predicted polypeptide sequence is orthologous to G1380
aaaatagcaaaaaaaaaatcaggcctggggatgaatccccctttctccattgccaatttgctctgaccaacaaacagtcatctcccaaaaaaggcaaaatcatcttccatttcatggaaaatcggcaaaaaaattgaaaaaatacccataaaaatccaatcttgattctcaattcaccggccatgcgccaccggaagtcgtcggagctaaaaagaccaggatctgacgccgacccacctcgttatcgaggtgttcgtaaacggccatggggtcgattcgcagcagagattagagatccgatcaaaaagactcgagtttggctgggtacctttgacaccgctgaagacgccgcacgcgcttacgacgatgctgcacgcgctctccgtggacctaaggccaaaactaatttcaatatgttacctctaacagaggattcttatgatgaggcgaatcagtttgagcttttccccaattcgagaccggcttctagcagtatgagcagtacgttggaatcatctagtgggcctcttggcggatcgagttgtaaggtgacccggatgaagattcctcgcccggttcttcctctggaggactgccggagtgattgcgattcgtcgtcgtctgtggtggatgatcggtgtgatgttgatcaaacgtcgtcgtttttggccaaacaacctctgccgttcgatctgaatctgccgcctccgtcggataacgatggagttgatgttgatgatttgcacgtcaccgctttatgcctctaattacccttctgttacggtgatgtttgttgttaattaatttgatgatgaagaaaaaagaaaaaaaaataggtttttttagttttctttgtcaaatcttcttacttttttttttcaaattttcctcggaaaaatgatgtactcaaatgtcggatgatgagaaacaaaatgggtttttagattatgtgtagattagtgtaatgagtcatgatgcgatctgtataaagaagattgtatctgtatttgtgtctgta

SEQ ID NO: 14664 - DNA, 1025 bp, Solanum tuberosum
  Predicted polypeptide sequence is orthologous to G1380
gatcttcccaagaaaatcaaaattcacaaaaccctagaaataataaaaggaaaaaagaaaaaaaaaacaaagaaggagagagagtctctctctttctttctctctattttttctttcaaccaaacagaccacaaacagtagagagagaaactgagatttctagagagagaaagtgtgaagcttttgcagataagaatcctcatctgttcttccatggctttaacgtttcatatttttccctaattctctcttcagatctcaaaaaaaaagaagcaaaaacaaaaaaaaaacttttttttgaatcatcgatcatgcggagaggtagagcagccgcggtggcgagacaagttccggcgacggaagttccggtaccggcaccggtggccggagagctcaacggatctggaggatctaaggagataaggttccgtggagttcgaaagagaccatggggaagatttgcagcagagattagagatccatggaagaaaactagggtttggttgggtacttttgattctgctgaagacgctgctcgtgcttatgatacagcagctcgtacacttcgtggacctaaagctaaaactaacttccctttaccttctcatcatctacctccttatcctcaccatcatcagttcaatcaaagcatcaaccctaacgatccctttgttgattcccgattatactctcaggaccacccgatagtttctcagagacctacttctagcagcatgagtagtacggtggagtccttcagtggaccacggccgccgccgcggcagcagacggcagcttccgtaccttccagaaagtatccccggtcgccgcctgttgtcccggacgattgccatagcgactgtgactcgtcgtcttctgtcgttgaagacggtgaatgtgataaacgacacatcgctttctcctctttcagaaagccgttgcctttcgatctaaacttacgggcgccgatggatgacttcggcgccgacgcatatgctgatgatcttcactgcacagcactatgt

SEQ ID NO: 14665 - DNA, 1114 bp, Solanum tuberosum
  Predicted polypeptide sequence is orthologous to G1380
ctctaaaattctcagccaaaacccaccacacatacagtagagagagaaaatcaaatcgaacattttagagagggatattgagtttcttcggagacgaagggaagcttaatcctccatttggtgtcaaaagggagctgtgatttttgattttaaaaataataatttttggacatgaggagaggcagagcaactccggcggcggcggcggcggcggcgccggtgaagccagatggatctggtggattgaacgagattaggtttcgtggagttaggaagcggccatgggggagatttgctgcagagattagagatccatggaagaaaactagggtttggttaggtacttttgattcagctgaagatgctgctaaagcttatgatactgcagctcgaactcttcgtggacctaaagctaaaactaatttccctttacctctgtattctcagcatcatcagttcaatcaaagtttaaaccgtaatgatcggttagttgacccgagattgtactcacaagaagctccgattgtttgtcaaagacctacatcgagcggtatgagtagtactgtggaatcattcagcggaccgaggccgccacgtcagcaaacggcggttttgcctttgagaaaacatcctagatcgccgccggttgagccggatgactgcaggagtgattgtgactcatcgtcttctgttgttgaagatggtgattgtgaaggtggaaatgacaaacatccgtttcatcatctttcagaaatccactgcctttcgatcttaactttcctccgccgaatggatgatgtttatggctaaattcaaaattgaatcttttactgcaacaggcactaatgtctttgaaggaaaatgggttcaaagtttcggatctttcaatcaattcgaaaggccgaaaaaaaatcccagatttaagcattgctatgactctgtctgtgggagagatttactcttccattaactatcccaattaaggccgaattcctgaagaaggataggggctcgaaatggaccgatatttcctcaactaaatagagtgggaaatggatattttgtgcggggacacatttttcctactgtaatgaggacgtcaaaaaaaaaaaga

SEQ ID NO: 14666 - DNA, 851 bp, Solanum tuberosum
  Predicted polypeptide sequence is orthologous to G1382
aaacaacacattcaggatgtatatcaattgaaaattacagaaaatacattagccaagtgcactcatcataattacagaaaatatgatacattgaaaagttcatcataattcctagaaaatgtcattgatctgtattcatgggagaaagatattggaggtcgacatttgctccgtcatccatttcctaatatactctaggtatatgtacacaaagaacactaggtgaagatgttttatacagcataacgcgacgagtcctagaagtatttatacttcaactagagatatctttgtaatccaccaagatgcaggaaaaaatatagatggtggcttcttattgttacgctcttatacttgatggtagagactattcaagggccaagaagtatctttccatagttttggagagactgagtagaaggttgtaaaggcaaagtttcgaaactaggtccctgaacacgattatctatagctccaaatcggctcatgccactatgtacaataccatagcgcgctgcaactgcagctggctgtactagcatcataccagaacgtgaaacttgaacttggtgatggagggtgtgaagttgcccgttgttcccattatccagacgatatccagtaccaacgcctagatccagactaagtgagttggtctctcctgccctgatccttgaactgccggttacaggtgaggatcccgtcatttcatggttattattttttgcagcaggtacatcgtggttatgttttccttcatatgtggtgataacagctttgggatcatgagaagccctctccacgtgtttcctgacagggcatccagcactggtgcacttgtaatagctcct

SEQ ID NO: 14667 - DNA, 836 bp, Solanum tuberosum
  Predicted polypeptide sequence is orthologous to G1382
ctgaatcgtcaatggaagactctcactctcagcagcagcagctgcactctacttccgagcaacaactcagagatggaacaacctcctccggcggtttccgtcacaacgccgccggatcgaacggcggtgctaagtacaagctcatgactcctgctatgcttccgatctctaggtccgcctgtatcaccatacctcccggtctcagtccttcctccttcctcgaatctcctgttctcctttctaacatcaaagctgagccatctccgactacaggttccttctccaaatttcaaacagtgcaaggctctggtggggctgctgcattcttattgacaagaggttatgctagtggcaatacatacattgaaagaaaagcaagctgctttgagtacaaatatgccggtggatctagttctgcatcaggatcattagcaactgaacatgtgatttctacaggtctcaaccaacaacaaaatgagccactgaaagaagttcaagatcaaagtcatcctcaattgttagtaccttcatctctagctaaacacgagatggaaacatcaaaagaactgagtttatctgcacctattaatgttgatgcttcaacaaaagaagagagtctatatgaacctattaacgttgatgccatgaatccgagagatcaatctagtgcaagcatgcaaagtatcacatgctgatcataaagatgcgtcatcagtaacatctgatagatcatcagatgatgggtataactgggcgaaagtatggccagaaacttgttaaagaagtgaatattcgagaagctattacaattgtcctttcccaactgtgaatgaaaa

SEQ ID NO: 14668 - DNA, 985 bp, Solanum tuberosum
  Predicted polypeptide sequence is orthologous to G1435, G2741
attcgccggatatcttctggtgaccggaataaaatttagtagttacaaaatattgttaccatgggtgaagaagtgaacctaaccgactatgaatacagcggtggtaacgatgacagacttctctgggaggttggacttcccgacgtcgatgatctcacgccgttgactctgcagttgattccctcggaactcgctgctgcgttcagaatatcgccggaattgtcaaagacgatgaccgatgtaaatcgtgcttcgcagaatacgttttcttctctccagagatggcactcacaggatatggcttcgatgaataactcatatttcaagccgtttagctatgagaggactagagaagagactgttactgaaagagatgaaacggatctgataagagagggatccgacccgaggaagctccgacgggttgaatccggaggcactgaggaggctgattcatctctgtgtaacgagaattttgcggatgattcgtctgctaagactccgaagcgacccagacttgtttggacgccgcagttacacaagcgttttattgaagtggtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgtttacttccacaccggcggcagagagtatgcgtgagtccagtgagggtggtcacctgcgcaatactaatggccacatggcagcgccaactctgatgccgtaccaaccacaaatggtgccgatgccaatgatgggaatgccaaatggaggacatgtagttatgcctgttggttacgggggtggaccgccacttgggtttcatcatcactataatatggtgcagcagcgggactggtctggaaataattttggttactgtcatcctg

SEQ ID NO: 14669 - DNA, 945 bp, Solanum tuberosum
  Predicted polypeptide sequence is orthologous to G1435, G2741
atgggtgaagaagtgaacctaaccgactatgaatacagcggtggtaacgatgacagacttctctgggaggttggacttcccgacgtcgatgatctcacgccgttgactctgcagttgattccctcggaactcgctgctgcgttcagaatatcgccggaattgtcaaagacgatgaccgatgtaaatcgtgcttcgcagaatacgttttcttctctccagagatggcactcacaggatatggcttcgatgaataactcatatttcaagccgtttagctatgagaggactagagaagagactgttactgaaagagatgaaacggatctgataagagagggatccgacccgaggaagctccgacgggttgaatccggaggcactgaggaggctgattcatctctgtgtaacgagaattttgcggatgattcgtctgctaagactccgaagcgacccagacttgtttggacgccgcagttacacaagcgttttattgaagtggtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgtttacttccacaccggcggcagagagtatgcgtgagtccagtgagggtggtcacctgcgcaatactaatggccacatggcagcgccaactctgatgccgtaccaaccacaaatggtgccgatgccaatgatgggaatgccaaatggaggacatgtagttatgcctgttggttacgggggtggaccgccacttgggtttcatcatcactataatatggtgcagcagcgggactggtctggaaataattttggttactatcatcctgttgcttctaatgataagtag

SEQ ID NO: 14670 - DNA, 902 bp, Solanum tuberosum
  Predicted polypeptide sequence is orthologous to G1444
caattaaagaaacatattatatgagcaaactgtcttagctacatcttggaccaaaaaaaaaaactaattccaactagctatgttactcgaattcttcaataataatataaatgtcacatgcactcatgcatgttgaacccttaacatatgcaaactctctccttggaggagcacgggtttagtcaagtagaaccgggttgcgctgcttgatgctccgatcgaaaacaaatcagtggggccatgccggtacgactgaatatgcgttagaaaggtcaatccctcccctacgacaccaaaaaaaccgggccgaacttctaaaccgcctgcttccatagaacaatatcgtggcaataataatataaatgtcacatgcactcatgcatgttgaacccttaacatatataattgcataagcataacattttgaaagatctgacacgaacggtagccataacatctataaagtacatgaaataatatccgatctacatcttcataatttgttactcatttttattatcattatcaactatcatcattgcaactgcattgtccgtttgaccgagtagactactcaaagatctagctttcaccattccaagcttcttcatcttcttgttcttcgtctttttcttgtcatcttcatcatcattattatcatcatcaatatcataatattcatgatcatttatcaacgcgtacgattccttatccttttcttctactttcttcttctttttcttattattcatcgagtttcgaactgtagtactattcatgcttctaagtcttcctttacccaaatgatgttcacacaatgaatatcccacaagggtttgttgacaacatctccatcctctcccataaacacgactacaccttgatccctctaatataacact

SEQ ID NO: 14671 - DNA, 629 bp, Solanum tuberosum
  Predicted polypeptide sequence is orthologous to G1446
agcagtgtgatactttgaatttgattcaaagctcgtttttcgatcgatcggttatataattaaggatgccttttccatggaagaaggtgaagaaaacaagcatttcacaattggtgaaggaccatgtaaattctcaaagtggatctcctcttatggtggaaaccggttttccaacttctcttgtcgatcttgttgtcaagaatcgccgaagattcaagaaatcctccaagaaaaaaatggccgacgacccttttgttcgatacatccccttcccctccccatcccccttcgtctgtaactttaccttccacttctcaattcatgattgatgataatgaagttcctcctctgatccgtgtagctgaagtggaaggtgacaaacctgaatcttgcaagatgaacaacgagaaagagtggggtaatggttgtctcagtatgaatcaggggttggtggccgttttgaagatgtttctcgtggcgggtttggttttagggatgaataatcttgtcatgggggtaaccatgtcagccttcttgttgtgtttattggaatatttaggagaacgtttgtatggcttcttttcttgactacagaggagggttagggttgatgatacaaggggataggg

SEQ ID NO: 14672 - DNA, 697 bp, Solanum tuberosum
  Predicted polypeptide sequence is orthologous to G1446
gcctaattgaaacatctccttaaattctcctctctccttctctgtttcttccaaaataaatttttattttcaaatagatacgcgtgaccagacataaatcttcatttccatctatattattgtccaagatcatgccatgtttcaacagtccaacactataatgtgttgacccttgttatattcttgcttcttgtctcagatactaaatatttagagggaatttttattgagtctgaatttggattatcttcaaacatgtcttttccatggaagaagttgaagaagacaagtatatctcaattggtgaaggaccatattcattctcaatctcctttcatggtggagactggtttcccctcttcccttgtggatctttttgtcaagaatcgtcgaaagttcatgaaatcttccaagaaaaagagggctcctccagtggtggctgaaccccctttaagctctctttcgaatccaccttcctcggtatgttgcataactgagaggtctgagttaaggggtgtcaggaaaaagatgaaagatttgatcttgatgaagctgttgataaaatatggtgtttatagcgcttctgaaggtctttctggtgggtggtttttggttttaggaacaaagaagcttgttatgggaataacaatgtcagctttcttggtgtacttcttttgagatttcgggtaaacgcgta

SEQ ID NO: 14673 - DNA, 705 bp, Solanum tuberosum
  Predicted polypeptide sequence is orthologous to G1451
ggagttgtgtattttcctcaagggcatagtgagcaggttgctgcctcaaccaacaaggaagtagatgctcatatccctaattatcctggtttaccgcctcaactaatttgtcagcttcacaacctgacaatgcatgcagatgttgagactgatgaagtatatgctcaaatgacattgcagccactaagtccacaagagcaaaaggacgtgtgcctgctaccagcagaacttggcatcccgagtaaacaaccaaccaactatttctgcaaaactttgacggcaagtgacaccagtactcatggtggattctctgtccctcgccgagcagcagaaaaagttttccctcctcttgattactctcagcagccaccctgtcaagagttgatagcaaaagatctccatgggaatgaatggaaattccggcatatttttcgcggacaaccgaagaggcatctattgacaaccggatggagtgtgtttgtgagtgcaaagagacttgttgcaggcgatgcagtcatctttatctggaacgaaaacaatcaattgcttttggggattcgacgtgctaatcgtcctcaaactgtcatgccttcttcagtcttgtcaagtgatagcatgcacattgggtctcctagctgcagcggctcatgcagctgcaactaatagccgctttacaatattttataatccagggcccagccatca

SEQ ID NO: 14674 - DNA, 756 bp, Solanum tuberosum
  Predicted polypeptide sequence is orthologous to G1451
actcacaaaagtttaactgcattaacaagtttacaactcaagattcttagtctaaatcacatatgtcctgagcctcagtacagtgattaagattataactaatacaaatagcattgtaatacaaatgacagatggggattaagtctttactttactacataaagaacagtgtcttagaaacgagaccggattaactaggccgagctcttggtaagcagagaattggtgaaccacacttggtttatcaaacgatgacaacaatcagtactcgagtgatcctatagatgaaagtccggacatgaaatcttgaccatcagcactattattactgctcatcctttcaggtggaccgcgatttagggatccaacctcctcccccagtttctgcacatcctcgggtgaaagaattttgatataccaaacattattgacaaattcctcccatggatcatctccaaggagaaggacatcattctccctgtcaacaaatacaagctgccagcctgatctttgagggtcttcaagaaacccttcgatcccgaacatctgtcccagttcctgtcgtagctcatgatagctattgaatcgagtgatatccaatgacctcccaagggacgctgatttgtaaaccttgacaaatgtacgggggcgcagtttgtgcatcaacttgccctacattatgcaacatgtcagaaagatcttgcacataaccatacaaagaattcggaaaatcagaagtccctagtggcttagagg

SEQ ID NO: 14675 - DNA, 804 bp, Solanum tuberosum
  Predicted polypeptide sequence is orthologous to G1451
tctattcttaattacaacaggtcgaaaaaacattgcttcagctagtaacactatttgtacagatgtctcttgaggtagttccacagaaataacaacaataaacattaaataatttacattgaaaactatctggtttacaaggttcaaatgagacttgaccccattactttataggtagaagagatacatgacaaaataacattgatagaacaaggtacaaagaattgctgatattagcagctacatggtacatttaccttagggatcacttagttgttcttgttcattagtagtttatgttgctcaaactcgtcaaaattgccaacgagtgtgtcgtatcctcctccaaaagtagtgcattttcagaggatccaacacaggtgcaataacattttgagtgtgtccaagcaacataaattagtagtcaagtgaccccaaggggattccgttcataatattacacgagtggttccggttcatgaaatcatcgcagccattgccattgctagtgatcctctgcgttttgccagcacttggtaagtcgaggccctctttgcccatctgctgcacttcaagtggagagagtatcttgatgtaccaaacactgttcacaaactcactgcagcaagacagattagttaaaaatgtgataactaaaaggtttaacaaatacgcaatagcattgacagagtaacggttcaaaaaaaatctacattggtgtgtatacagtaaaataagcatacttgaaaatgtgtaagtgggaaatatgatgatataaaacgatagagttgatatctttaagta

SEQ ID NO: 14676 - DNA, 914 bp, Solanum tuberosum
  Predicted polypeptide sequence is orthologous to G1451
ggcttttcagaaaaccacttaatatctcaggcgcagatgcttcagcagcaattgcagcgccgtcaaaattttaatgatcaacagcaattgctgcagccacagcttcagcagcaccaagaagtgaactcgcagtttcaacatcaacagcaaactaagaccatttccggtctctctcagatggcttcagccacgcatccccatctttctcatttgcaagtcctaagttcaactggttccccgcaaaccttttctgatatactgggtaaccatgtcaatgcatctagtaattctaatatgcaaagtctgttgagttcattttcccgtgatggagcatctactgtcctgaacatgcatgaaactcaccctctagtgtcttcgtcctcatcatcaaagcgaattgctctagaatctcagctcccttctcgggttactccatttgtggtgtcccagcctgaggatgtgatagcgcacaatactaaggtctcagatctttcctctttgctgccaccttttcctggcagagaatcgttttctgattatagaggagtagaagatagccaaagcaatgcactctatggatttacagactctttgaacatactgcagaccggtatgtccaacatgaagggtagtagtggtgataatggatctttatctattccttatgctacctctaccttcacaagtactgtgggcaatgagtatccccttaactcagacatgactgcttcaagttgtgtagatgaatcaggtttcttgcagtcctccgaaaatggggaccaagcaaacccaactaatagaatctttgtgaagggtcaaaaatcagggtcctttggacggtcactcgatatctccaaatttagcagctatcacgaacttcgaagtgagcttgctcgcatgtttgggctagaagg

SEQ ID NO: 14677 - DNA, 965 bp, Solanum tuberosum
  Predicted polypeptide sequence is orthologous to G1451
gctgaaacagcaagtaatgcagtttcagcagcctgtccaatatctccaacatgcaagtactgataattccattctgcaacagcaggaaacaatgcagcaagcagttcatcagcatatgctgcctgctcaaacccaaatgctgtcagagaacctgcaaaggcaatcacagcagcaatccaataatcagtcggaggaacaggctcatcaacacgtttaccaagaagcatttcaaatcccacacgatcagctccagcagaggcaaccatcaagtgtttcctctccatttttgaaagtagattttacagatttgaactcaaagttttcagcatctgttactcctttgggcgtgcaaaatatgctaggttcgttgtgttctgaaggaagtggtaattcattgaatatcaacagaactggtcagtctgtaatcgttgagcagccaccccaacagtcctggatgtcaaaatttacgcagtcacaactaaatacgtgctccaactcttcaccactcccaacatatgggaaagatagatccaattctcgggaaaattgtaacttggattcccagaatcaagtgctttttggtgctaatgttgattcttcagggcatctccttccgaccacagtgtctaatgttactactacatgtgctgatatgtccacaatgccacttggggcttcgggatatcagaattctttatatggttatgtgcaagactcttctgagttgttgcacaatgcaggacaaattgatccaccaaatgcaacccatacatttgtcaaggtttacaaatcggggtgtgttgggaggtcactggatatcgcccagttccacagctatcatgagctgcgacgggaattggggcagatgttcggtattgaggggttccttgaagaccctcaaagatcaggctggcagcttgtatttgttgacagggagaatgatatccttctccttggagacgacc

SEQ ID NO: 14678 - DNA, 625 bp, Solanum tuberosum
  Predicted polypeptide sequence is orthologous to G1451
ctatcatctgtttatgttttctcactttgcctgcaggacattctaagcggcatcttcttactactggctggagtgtgtttgttagtgccaaaaggcttgttgctggagattctgttcttttcatttggtactgtttagccaggctctattgacactactgtacatcagtcacatattattgcatgacagtttcctccaggtttttcctgatatagtcggttctgtgcaggaatgagaaaaatcagctccttctgggaattcggcgtgcaattcgaccccagactgtgatgccatcatcagttctatctagtgatagcatgcacatcggattacttgctgctgctgctcatgctgctgctactaatagctgtttcactgtcttttttaacccaaggtagtacggaacagtactccccccttgtgttttcatttatagctattaccttttttgctgttttcttctcacgtgcttcttgcgttagggctagcccatctgagtttgttataccactttcaaaatacatcaaagctgtatatcacacatgcatttctgttggaatgcgctttcggatgctatttgaaactgaagaatcaagtgttcgaagatacatgggaacaatttact

SEQ ID NO: 14679 - DNA, 1088 bp, Solanum tuberosum
  Predicted polypeptide sequence is orthologous to G1451
gcaaggaccacatctactgaatcttcagtcttttggtggcatgctcccctggatgcaacaaagagttgatccaacaatgctccgaaatgatcttaaccagcagtatcaagctatgctggctagcggtttgcaaaattttgggagcggagatctgatgaaacagcaactgatgcagtttccgcagcccgtccaatatgttcagcatgcaggcagtcttaatcctctcctgcagcagcagcaacaacaacaagcaatgcagcagacaattcatcagcatatgttgcctgcacaaactcaagataaccttcaaaggcaacaacagcaacacgttagcaatcagacagaggagcaatctcatcatcattcttaccaggaagaataccaaataccaaacagccagctccagcagaagcaaccatcaaatgttccttctccatcattctcaaagccagatatagcagatccaagctccaagttctcggcatccattgctccatcaggcatgccaacagcgctgggttctttatgttcggaaggaactagtaactttttgaatttcaatatacttggtcagcagcctgtgatcatggagcagcagcagcagcagaaatcttggatggcaaaatttgcgcattcacaattgaacacgggctccaattcaccctcactctctggatatgggaaagatacttccaattcacaggaaacatgtagtctaggatgcccagaatcagtctctttttggtgctatgttgattcttcagggcttctcctcccgacaactgtgtctaaacgtcggctactacatcaatttgatgtctgatatatccttctatggccaactagggaaacttcctgggatttcccgatattcctttggtaatgggttaatgtgccagaaattcctttcttgacatgttggaaacaatggtaggggcaaggttggatgcacaaaactggcgccccggtaacatttggttaagggtttaaaaatttcacggtcccttgggaggtcaatgggatatcacacgcaataaataatttagagatcacggaacgtggacaacatttctggatctaaggggttt

SEQ ID NO: 14680 - DNA, 907 bp, Solanum tuberosum
  Predicted polypeptide sequence is orthologous to G1451
atcaggtcgaccttggtcgggtggggtataaagagaccaaccagcacaccttctctctcttcaaaagccttatcactgatagtgatatcatgaagttgagctcagcttagattctgtcaacttattgaattgaaggaaaagggaatcatcacaatttaatggaagtattggagaaagagaaaagtagctgaaaggttttttataggattttttggttaatgcatgtggagattgtgagggagcatattcataatgtggaagaggtggtatatcttgaggataagagtgatgaattggtggaattgcttagggtttcacttggttttgagagttataattgagggctttgtgtaattgagtggataattacagggaagggtgttgttatagtactataattttcttcagatttttaagagaagtggctttaaatatatatatatgaagctttcaacttcaggaatgggtcagcaagctcatgaaggagtagagaaaaagtgtttgaactcagagctatggcatgcgtgtgctggtcctctggtgtgcctaccaacagtcggatgtcgtgttgtttactttcctcagggtcatagtgaacaggtagctgcaacaactaataaagaagttgatgcacatatacccaattacccaaatttgtcgccacagttgatctgtcaactccacaatgtcacaatgcatgcagatgttgaaacagacgaagtatatgcacaaatgactttgcagcccttgacgcagaaagaaacaaaaaggatacataatcttcctgtggagtttggatccctaacagcaggttataactaattttgtaagaaggctgacttgggagtgatactagcccggcatggggggttctctgtgcctccgcgtgggtctgcgagaaaaagtt

SEQ ID NO: 14681 - DNA, 693 bp, Solanum tuberosum
  Predicted polypeptide sequence is orthologous to G1451
tttttttgtatacttgtcaaaagtagaagtgcaataactaaattttaacacttccgagattcttagtttaaatcacgtctcatcttgtgccgtacagtgaattatactaacttgaacaacaggattacaatgaaaactacaccatacaaatgggagacgccttaagtccctattactgctagatccaaacgcaaaatacagcatacaattgggagatggaccaattagacgaaagctaaagaagccagattacgaggcatgtaatttgaatttctgaccctcgagaagattgagaatcagaattagtcctcttctttaaaacattacaacaatcagtactctagcgatcctagagatggcattccagaaataagatcttgatcatcagcactagtgctactcatcctttcaaccgctccatggttcagggattcagcctcttcctttcccagcttctgcacatcttcgggtgaaaggatttttatataccagacattattgacgaacacctcccatgggtcgtctccaaggagaaggatatcattctccctgtcaacaaatacaagctgccagcctgatctttgagggtctttaaggaacccctcaataccgaacatctgccccaattcccgtcgcagttcatgatagctgtgaaaactgagtgatatccagtgaccttcaacacaccctgat

SEQ ID NO: 14682 - DNA, 552 bp, Solanum tuberosum
  Predicted polypeptide sequence is orthologous to G1478, G1929
caaaaaattaaagatgtgtagtggaagaagagagggtgaagaagaaactacctcaatttcgtattgcaaagggccattgaaagagggagaatccataattaggtctacaatttcttgtgcgctctgtagttcagaggcctctgtttattgtgaagctgataatgcttttctttgccggaaatgcgatagatcggttcacggagctaatttcttggctcagagacatataaggtgccttctttgcagcgtttgccggaaaacaacgtggcggtttctgatcggaacttcgtcggagctgattttgccgacgattgccggtttggaacagagaaacagaaggagaagtgcagattctgagacgatggactacagaacgacgccgcaagagcttttcctgtttatttgatatttaattatgtttagatttttttttgtttaattccattattggatgatgcatttaatttaaattaattaagtgtacatactttgtatgtattacgttaattaataataaaaatatagtactaaaataaaaaaaaaaaaaaaaaa

SEQ ID NO: 14683 - DNA, 1029 bp, Solanum tuberosum
  Predicted polypeptide sequence is orthologous to G1480
gatcattattgcaattttagagagatactacgcattagagagagaaactaacaaaagtttaacaaaaaaaaacaacaattcacaataatggtggcggagagctggagcacgacggcgaaacgctgcgatgcctgcaaagcgacgccgtccacggtgttctgcaaggcggacatggcttttctctgcttaacttgcgactccaaaatccacgcagcgaacaagctcgcgtctaggcacgcgcgcgtttgggtctgcgaagtgtgcgagcacgcgccggcgagcgtcacgtgtaaagccgacgccgccgcactctgcgtcacctgcgaccaggacatccacgccgccaatcccttagctcgacgccacgagcggatccccgtagttccattctacgactccgcctccgccagatctcctcgtggtgctggtgcggatgaaaatgatccacaccagcacgaggacgagactgaggaagaagaagcggaagcggagtcatggctgctccaaacgccgaacagtaatactcaaggaattgagtataaatcggcggaatatttgtttagcgatgtggatccgtatgtggaaatggatgtaattgcagatcagaaaacatgtacgactactatggatattgctcataatcaagaggagtataaagaagattgtgttgtacctcatgtacaaaacaataagaatgagatccaattacaaggcccagttgttgatggatacccaacttatgaaatggatttttctggtggatctaaacctttcatgtacaacttcacaactcaatccattagccaaagtgtctcttcatcatctatggaagttggagttgtgcctgaccataacacaacgacagatgtatcaaacacatttgttagaaactccgccattgacggactacctaacccggtttcgagtttggacagagaaagcagagtattaaggtatagagagaagagaaagaatcgaaaattcgagaagactatacgatatgctttctagaaaagctatgctgagact

SEQ ID NO: 14684 - DNA, 400 bp, Solanum tuberosum
  Predicted polypeptide sequence is orthologous to G1480
cctcgtgccggttttgcgatacagagagaagaaaaaaaacagaaaattcgagaaaactattcgttatgcttcaagaaaagcttatgctgaaacaaggccaagaattaaaggtcgatttgctaaaagaacagacggcggcgccggcgccggcgagtttgatgacgttgacgggattttctccggcgccgaattcattgcggctgactcacgatacggcgtcgttccttcgtttttaacttaatttaattattattaaaaaggacatatagttttatttctatttttagtttataagttgtatttccaaaaattccaattacccgaaaatatccaaatgggtattgggttttttatgtactaatggaagggtactttggtaactaaaaaaaaaaaaaaaaaa

SEQ ID NO: 14685 - DNA, 1009 bp, Solanum tuberosum
  Predicted polypeptide sequence is orthologous to G1480
gattctctcacttaaaaacagagaaaactaaccgaaacaatgggaacggagaattggagtttgacggcgaagctatgtgactcatgcaaaacgacgccggcgacggtgttctgccgggcagattcagcgtttctctgcttaggatgcgactgcaaaatccacgcagcgaacaagctagcgtctaggcacgcgcgtgtctgggtttgtgaagtgtgtgagcaagccccggcgagtttcacgtgtaaggcggacgctgctgctctctgcgttacgtgtgaccgtgatattcattctgcaaatccgttagctcgtcggcatgagcggtttccggtagttcctttctatgactccgccgtcgcgaaatctgacggcggtggtgatgccgatgctgatgctgctgatgatgagaagtactttgatagtactagtgaaaatccttctcaaccggaggaagaagctgaagcagcgtcgtggatacttccgataccgaaagaaggaactgatcagtataaatctgctgattacttgtttaatgatatggattcgtatttagatatagatctaatgtcatgtgagcaaaaaccgcatattattcatcatcaacagcatcaacacggccattacagctccgacggagtttttgccggtacagaacaacaacaacgaaacgagtactcatttaccagcgtccagtcgttgattggatttcctaccttacgaaatccaattttactggaatctaaaccttttacatgtacaatttcaccctcttcaatccattaaccaaaagtgtttcattccatcattctccttggacttccgaatttgtacccgaaccacagtgccattaacggaatgtatcaaaaccacctttgttgtattaaactcattctgcccggacaccgcacccggcacccgaaactgtaccaaaatgcattcccggttaaaaccggaaaaccaggttactgaatatacgaacaaaaggacaattcaaagtttcaaaaaacat

SEQ ID NO: 14686 - DNA, 912 bp, Solanum tuberosum
  Predicted polypeptide sequence is orthologous to G1481
ccattttctctgttttgcgttgaagttgttgctgtggtttaatttgttttgtctttttggaaaaatatagagaaactatgaagaattgtgaactttgtaagggattggctaggatgtattgtgaatcggataacgctagtttgtgttgggattgtgatgcgaaggttcactcggcgaattttttggcggcgaggcattctaggtctttgctatgtcaggtgtgtcaatcgccgacggcttggtcggctgccggtgcgaagctggggaagacggtttctgtatgtgagaagtgtgtggatggatactaccatagggatgaagtggatgagagtgagagcgcgaatgatgaagggagtggtacggaggacgaggaaactgattatgaagaggatgaagaagatgaggacgaaattgattcggagggtattcaggttgttccgtggtcaaatacgacgcctccaccgccggctagttcatctagcagtgaagattcatcaaatggctgtagaaatgtctctttaaagcgaatgcgtgaagctgatccagatcttcattcagatgacgacagcggaagttcgtcatgtcaccggaaagttcatacatcgccggcgatggatgcagacggcggagacgaggcagcagctattgttgactcatactcatcaaaaatgagaacgccggctaagatccagagaacagatcgtctcacggctcctagatgcacgtcggtaatagagtttatcaggagaaataaccggcagaggatgagctccggtgcggcgatcgccgagctttgtagactcaataatgactccaggaccatagatctggaaagctcagagacatcgtagccgtctgattgaccattcgtttccatcacattacgtggattctactttacttaccctttac

SEQ ID NO: 14687 - DNA, 855 bp, Solanum tuberosum
  Predicted polypeptide sequence is orthologous to G1481
ttttttagtatgtctcttggtagtcaaaatgatcgatcggagagaaacaagattttgcataataaagacaactcctacctactcgtttcagacctcacttatgaaattacactatatacgtagttgtgactaatcacacaactcatttgttcgaaccaccttcattggtctcaagaaccctatggatgaagatgttcccttgttctcttccaacaacaaactcgacgaacatgcttcttcatcctcaaaatgtaggcaatcactttcccttactcgcttccacggagatgaattaacagtcaccgtagcgccgccgccgccataatctccggcagctgataaatctccataagtgccggaagaactcaccgaacgcaccggcgacggcggagagaaattactcgacggagaagaagataaaggaacaacttgattcccatcctcctcatcttcatcgtcgtcatcgatttcactgtcattactcccgtattcatcctcatcttcgtcattatccgtttccgtttgataattttcttctcctctttccccaatttcttcaattggatcccgtaatcgaacggcggtggtgtagggttttcgaggcaggaattgcagacagagaaagtaggagaaagctttggaccagaagcagtccatggagttgaattttcgacatgaatgacaacggagatttctcgaatgtttagctacgagaaaatttgcgaaatgactttcgaatcgcaatcccaacaaaagactagcttgatctgattcacaatacatcattgatttgttctttatcacataacttcacaattcatcttgttctatcatgaaaattgagaatttgtgatt

SEQ ID NO: 14688 - DNA, 912 bp, Solanum tuberosum
  Predicted polypeptide sequence is orthologous to G1481
ctccattcaaaaaattccaaaccccattctaacattccttcaaaaaaaccccaaaatcattgaaatcacaaaatttcttcaatatgaacaagatgaattgtgagttgtgtgataagaacaaatcaatgatgtattgtgaatcagatcaagcgaggctttgttgggattgcgattcgaaagttcattctgctaattttctcgtagctaaacactcgagaaatctcctttgtcattcatgtcaaaattcaactccatggattgcttctggtccaaagctttctcctaccttctctgtctgcaattcctgcctcgaaaaccctaacaccgccgccgttcgattacaagatccaattgaagaaattggggaaagaattgaagaaaattatcaaacggaaactgataatgacgaagatgaggatgaatacgggagtactgacagtgaaattgatgacgacgatgaagatgaagatcaagaggatgggaatcaagttgttcctttatcttcttctccgttgagtaatttctctccaccgtcgccggtgcgttcggtgagttcttccggcagttatggagatttatcagctgccggagattctggtggcggcggcggcgctacggcggctgttaattcatctccgtggaagcgagtaagggaaagtgattgcctacattttgaggatgaagagtcatgttcgtcgagtttgttgaagagaacaagggaacatcttcatccatagggttcttgagaccaatgaaggtggctttgaaccaaatgagttgtgtgattagtcacaactacgtatttagtgttaatttccagaagttgaacgttggcattgagtacgtaggaattggctttattatgcaaaatcttgttcctatacgatcgttcattcggactaccagagactt

SEQ ID NO: 14689 - DNA, 695 bp, Solanum tuberosum
  Predicted polypeptide sequence is orthologous to G1482, G1888
gaagatccagtgtgatgtgtgtaacaataatgaagcctctgttttttgtgttgctgatgaagctgctctttgtgattcttgtgatcatcgtgttcatcatgctaataaacttgctagcaaacatcaacgtttctctcttattcaaccttcacctaaacaaatacctatttgcgatatctgtcaggaaagaagggcttttttgttttgtcaacaagacagagcaattctatgcagagagtgtgatgtttcaatacacaaagctaatgaacatacacagaaacataatagatttctattaactggtgtcaaaatttcagcgaattcttcgctttatacttcatcagaatcagcaccagcaacttcatgtagtacgaatcaagattctgttacgaatttcaataagtctcaaatttgcacaaaaaagactttgcctgtttctggttctgttcctcaacaagtgtcagtggcagctaatattggggaaaatagttacacaagtagtatatcagagtacttagagatgttacctggatggcatgttgaagaattgctgaattcctctacaattcctactaatggtttctgtaagattggtgataatgatgtgtttccgatttgggatactgagattgagagcacaatgaattcattctcaccagaaaatttaagtatttgggtgcctcaagcacctccac

SEQ ID NO: 14690 - DNA, 872 bp, Solanum tuberosum
  Predicted polypeptide sequence is orthologous to G1482, G1888
atcccccggctgcaggtttcctctcacttatagcaacaatcttgatccatcaaaataaaagagaggctataatttaaatttaaatttgaattcaaatgaagattcaatgtgatgtttgtaacaagaaggaagccgttgttttttgtacagcggatgaggctgctctttgtgatgattgtgatcatcgtgtccatcatgttaacaaacttgctagcaaacatcaacgtttttctcttcttcaaccttctcctaaacaagctcctatgtgtgacatatgtcaggaaaggaggggtttcttgttttgtcaacaagacagggctattatgtgtagagagtgtgatattccaatacacaaagcaaatgaacacactcaaaaacacaatagataccttcttactggtatcaaactctcaggcaaactctgatctctactctggctccatcacaattacaatcacaatcaggcaatttcctccggcggatttgtgtgtttcaaatttaaagtctcagaaccccattagtaagcctgttgctgtgtctgtttctgtttcctccacgaatactagcaacactaagggaggagcagtatcatccggttgtgagaatccaggtgacaggttgttcaaacgagcaaagttgggtggatgttaataattaattgtgcaaattctggtgaatgggaggggggaaataacttaaacaaggtagtattatcccgatctttagcagaatgtttgcctggtttggcgcacgttaagaatttcctggaattgttcaactccctaactgtttaatccagcactattgggtgatgacgcaaagtgtcaattgggaaacgaactttaaaatcaattaattctttccaccccaaa

SEQ ID NO: 14691 - DNA, 914 bp, Solanum tuberosum
  Predicted polypeptide sequence is orthologous to G1482
caaagattactatacactttcttagatctcaccagcaatcccctgaatcccaagaactcccaaatctcagtctcagatctcaatcatttaccatcaaagctgttaaatgcagtaatttaggcaaattttcttgaattccttgaattgggggtgtcttgcttggttggtggcccaatcggttaactttacaacattcacagaattaattcaggaattgttgtacaattcaaaccttttaattgcccaaggaaaccaaacctggccctttaaaggttcgcaagacattgtgattttgggcaatcctccaaagttccacgttgccgccaattgcaatttggcaaagggcggatcctccttgttgttaatttaacgccccgaagaatatgctaacattggttccaaaacgcacggatattgcattttaaaacgcgttatgaattgtcacatgcattggaaagaaattcactttgaatcttagattatttgacacagacgaatttccggtggactgaacaatcggcctccaagggggttccaattcctaaattgtttgttataccacctttccaacgccgccattacccattctctggaattaatggcggctccggtaccacacaaggaaagccttctaccttatgtacattggcaaactatttggtgaaaccaaattcctttgggttaaatggtccctttgaagaaacccggaagggaagccttggggctttactcttttgcagaggagacaaccaagtggtccctctttaataattcccggggtattgtttgttggcacacagccgggttcccttttggctaattgcaagctttgtccgaattcccccgaaccgccattaggctccaccaggaagaatttacacagggcgctgagaaaccccttttatgtttagggg

SEQ ID NO: 14692 - DNA, 810 bp, Solanum tuberosum
  Predicted polypeptide sequence is orthologous to G1482
ttttttatttttttttttttccaatacctaatcttaagtttccattcataggattcataaaaaaaaaagatatttacatcaacaaaaagatccttgcactaagctagtacgaggtacaacaaacttgagattttaagaactacaacaaagccaattgtagcaaaaagataagggccatcatcatttttttgaggttcaaactcaaccaaaaaaaaagacgaaagtgatgaacaagttagagaaaaagattatagaagccttctcgatttgttgcttgtcatccttgcatagaaacatcagtataaaattggaacgatacagagaagatcatcgttcaaattttctaccaaagagttcttgatctcttgaaagaagtggaaggtggcttcatttgtgggacagcaaatgagttctcatctgtccactttctactggacttgatgttagtaacttctcttgattcttttaggccaattttcccaccaaagttcaaattttgtgaaggaaaaaaattggatctgagtctcttgctttgactctggaagaggaggggcttgagggacccaaataccaacattttgtggtggaaaagaactcaattgactctcaagatcagtatcccaaaatgacaacatatcctcatcaccaaatattcttggagtaaacattaggagttgaacaatcaagaaaatcttcaaccgtgccaacccaggcaacatctctaaaatactctgatatactacttgttcaagttattccccccttccattccaccaatttgccacattatttattacttccaccaaattt

SEQ ID NO: 14693 - DNA, 866 bp, Solanum tuberosum
  Predicted polypeptide sequence is orthologous to G1483
gtcaatattaaccatagatcttcttgctaaagtttgctgaagaagtgatgaagattcagtgtaacgtttgtgaggttgcggaggcgaacgttttgtgctgcgccgatgaggcggcgctgtgttggtcgtgtgatgagaaggttcatgctgctaataagcttgctagtaaacatcagagagttcctctgtctggttcttcttcatctatgcctatgtgtgacatctgccaggaaacagttggctatttcttttgtcttgaggatcgggcattactttgccgaaaatgtgatattgctattcacacagctaatcctcatgttgcagctcaccaaagatttttgctgactggagtgaaagtaggacttgaacctgttgatcctggtggtatttcatcctcagggacgtcacagtccattcagaaggtttctgagccagagtctgctccactttctaaacgaaatgccccagtatcatcggatgctcaatttaacaaagtattacctacccaggctagtggggttggtgattttgctcctactaagtctccgtttgctggaggttctgcagctggaagtatgccgcaatggcagttcgatgaatttattggtctgagtgatttcaatcaaaattatggatacatggatgatggatcatataaggcggataatggcaaacttggtggagagtcagactcttcatcaatcttaagaattgaagatgaagaactagatggtgatgagtgcttgggtcaggtgccagacacatcttgggcagtgccactagttccttccccacctacggcctctggactttactggcccaaaacttaccagaatccattcgactctgcagtgtttgtgcctgac

SEQ ID NO: 14694 - DNA, 702 bp, Solanum tuberosum
  Predicted polypeptide sequence is orthologous to G1488
gggcaaagctcgcagcaagcgctcacgcgccgctccctgtgactggtcctcacgcctccagctgctcttatcccctgccacatcatcatcagagagcaacaacatctcgcctccatctgctaacaacactactttcgccacggccaaagccaccaaagcgccgtcgaagaagcgagagagtgtggaaacgccgggacggaaatgcctgcactgtgcttctgataagacaccacagtggcgcacagggccattaggtccaaaaactctgtgcaatgcatgtggagttaggtacaagtcaggtaggcttgtgccggagtatcgaccggcgtctagcccgacttttatctcagcgaggcactcgaattctcatcggaaagttctggagctccggaggcaaaaggatctccagagacaccaagcacatcaccagcatcaattgcttagtcaacccacaattttcggtgtatcaaatggtggtgatgaattcctgcttcatcatcaccaaaattgtggtccaaatttcaggcacctcatctagtatcagtcacctagtgtaggggataactactttgcacttttctcgttttaaaaaagtttgaattaacaatcccattttcctaattccatctagttttagaaagttgaaaatatcaggatatcaagatataggagcaaaaaataaaatgttcctagcaatcctag

SEQ ID NO: 14695 - DNA, 611 bp, Solanum tuberosum
  Predicted polypeptide sequence is orthologous to G1488
cttttctcagcttccgattctccttataaagaattagtctcaaacctaccgttactttgcgttttacactccaccattcttacactacacaccaacaacttcttcttcttttttctaacaatggaagcatcggatttattccttagcggctttttctcacatgccggagacgaacaaattccgaataacatcaacaacaacatcaattataataactgtaacaatttttctgtggatgatcttttggttatccctaaggaagatgaagttatggccgacgcatttttcaacagtattacaggaaattctgctgattcttccaccgttaccgtcgttgacagctgtaattcctctgtttctggtggagatggacaatttaacggcaacctcagcggccgcagcttcaccgatgctcccttccctaacagcgaactctgcgttccgtttgatgacttggctgagcttgaatggctctcaaattttgtggaggaatcattctcaagtgacgacgttcaaaacctgcagttcatccctgtagcaaacattaattcctccaccatctccaccgacagttcctcctccgcaaccacattttccacaggacctaactc

SEQ ID NO: 14696 - DNA, 945 bp, Solanum tuberosum
  Predicted polypeptide sequence is orthologous to G1493
gatggagtgctaaaaccacagaagaagaaaagagaagccaaagaagaagacgacactgaaatggaaaatgatgacccaagtacttcaaaaaagccacgtgtagtctggtcagtggagcttcatcagcaatttgttagtgcagtcaaccaacttggcattgataaggctgtacctaagagaatccttgaactgatgaatgttcctggtttgacaagagaaaatgtggcaagccatctgcaggaaaatcagaaatttaggctatacttgaagaggttaagtggagtagttcaacagcagggtggcctccccagtaccttctgtgggccaatagaacagaattcagaacttggttcactagggagatttgacattcaagcactggcagcctctggccaaattcctcctgaaactttgacagctcttcatgccgaacttttaggtagatcgacaagtaacttggttttaccagcagtagagatacagaatctcctacaagcttccctgcagcaagcaaagtgcatacctgttgaccaagttatggcttatggtcagcctctgctgaaatgccctcccagcatttctaattctaaacatctttctcaatctatattgtctgctgaagatgttcattccggatttggatcccagcgagcaaaaaatatatgtctggtccctagcagcaatcccattgggctagctgctccgaacagcaacatgttaatggcaatgatgcaacagcagcaatggcaaaagcagcagcagatggaactgcaacatagacagtctggacctcctgaggtcaaccactcaattaatgtgcaaccttcttgccttgtattgccctctcagttaccaggtaatttccaagtgggagatagtcctgcttccatcagccgcgccagcagtctgagtaaatcttcggtgaatgattatggagttctctcg

SEQ ID NO: 14697 - DNA, 896 bp, Solanum tuberosum
  Predicted polypeptide sequence is orthologous to G1493
caatcacaagcgtggaagatggagatcaacagcagaaacctccagaagatgttgattattcatcttcagctaatgaagggaactggaaaagctcaaagagaagaaaggaggaggaagatgaaactgaagaaagggatgatttatctacatcaaagaagccacgcgtggtttggtcggtggagcttcatcaacagtttgtacaagctgtcaaccaacttggaattgacaaggctgttcccaagaaaattcttgagctgatgaatgttcctgggctaaccagagaaaatgttgctagccacctacagaaatatcggctgtacctaaggaggttgagtggtgtatcacagcatcagaatggactgaataactcattcatgggacacccggaagcaacatatggttcgatgacttctttcaatgggctagagcttcaagctttagctgccaccggtcaactacccgcacaaagtcttgctaccctccaggcggctgcactaggtaggtctgcgacaaaatctgcaatatctatgcctctagtagatcaaagaaaccttttcagctttgaaaatcccaagttgagattttccgagggacaacaacaattaaataatagcaataagcaaattaacttgcttcatgggatcccaacaaccatggaaccgaagcagctggctgatttgcaccagtcctcacagtcctttgtggctatgaatatgcaagggaatgctagaatgcaacaaaacaacgctctactaatgcatatgtctcaacaacaacaacaatcgtctagggctcacatgctaaatgaaaccaataatggtcaagtttcacggccgccattgtccatgtcacaacctgctgcagtcttatcacgaaatagcattgttgacaacgta

SEQ ID NO: 14698 - DNA, 786 bp, Solanum tuberosum
  Predicted polypeptide sequence is orthologous to G1496
gcctttgttactttccgcaaagtaaaacaaaggacaagtagcagctttttcttctcttaactctttctgaaaaaaggatctctattattgatgaatattgcattaccagaaatgctacataacaacaccaccagcaatggaggaaatggaagcagcgtgcttgaacgacaacgagctagaatgaaatggcatcaagaacaggtgcagcaacaagagatgagttattttaatggacaaaatgatcaactgatgagttcttttcatcaaacgtctgaagctcaacaatttcatgggttgatcaatgtaaatgatcagagtcttaatgagcttgtgactcgggcaattaagccagacccctgtatggagaacaattggggtgattttgggaccactgataataatggttttggttatgttccagttggagttggacacggaggaatgtcacacccaactgaaatgaattatgctatttcaagaactacaagttgcccgcctaccatggcggacaatgctgtttctgctgttaaacccaaagagactatgctgcgttctaacagaggcagtgagaacttcaagaaaaggaaagcagataagaatcaacatctcaaggaggttgaagaagaggaaaccaaagacaagaaattgaaagaatgcatcgaagaaggggatgattcttccaaggtaacaacagagaaaaaaagcaacaaaaggagcgccaataacagtagcaacagtaaggaaaattctgatacttcaaaggagaagtccaaaattaccgatgat

SEQ ID NO: 14699 - DNA, 948 bp, Solanum tuberosum
  Predicted polypeptide sequence is orthologous to G1506
gatgcgcaatccaatatatggggattcaacggtgccttcaaggaagagaacctgtttcaatcgtccaaagccatcttcagtagaaaagctcactaaagacctatataccatcttacatgaacaacaaagttcatacttgtctgcatcctctgaggaggagttgctttttgagagtgacaagtctatggtttctgttgagataggacatggaagtgtactaatgcggcatcctagtacaataggtagagaagaagaatcggaagccagctctctttccgttgacaacaagcaccgttctgtcagtgatgcttattcacgattgactacccctcctgtaaatattagtaagggtgtcaattcaccaaatatggataccgagagaatcaagaaacctactggtccggctatagaacaagaccagattaaaagaaacaaggatcaccttgataaactacaaattcttggacatcataattcaccccttcgctatatagacctgaaggatgtacttaattatgaagaattcacaagtcatttgtcaagtgatgaacagcagcaactactgaagtacttaccacctgttgattcttttgcgcctccagatagtcttagaagcgtgttcgagagctctcaattcgaggagaacctgtgttccttccagaaacttctcgcagaaggtgtttttgataactcattttcaggagtgacattagaagattgtagaaacttgaagagatttatattgtgctatttaacaaagtcaaagtggatgcaacaatataatttactcaaggacaaaaaatgtaagaatagtagcagtggctctgaagttgcccgagagccaaatgttgttggcacatgtcattcagctaatgtgaagaaaccacgggaggggcatatctcaagtgttcaggtgcaaagacgacaatgaagagccccaaaaggggt

SEQ ID NO: 14700 - DNA, 642 bp, Solanum tuberosum
  Predicted polypeptide sequence is orthologous to G1506
aggaggggcaccatccaaagtatgcaggtgcaaagaaagcaatgaagagccccaagagggtggtgatgaaaagtagctatgagcagaaggaattagtagacaacaatagctcttgcttcagtccgaaatgcctatttcccttgccttctaatagttctcctgagctggattctttccatgttgcaaatgaccaggacgtgctactggatgtgccatccaacagctcctttgcgcaggcagaactcctccgaccaacatctaattttgctgcacaagcaagcaccagtagcagctctgtgtatccacatcttgtacgtccctagtggtagtatcatagtttgcattttcatagggcatctagaagctacttcagccaaaccagatgattgtgtctgcatgttcctcaccaatcatgtggtgatttgctgaaagagttggatgttgtgctgtttatgtttcccctttgagctatactaacaaaattttggatttagctgatggatatggttgtttaccctctttttttctttctgtaacgatagacaaacattgtataatatagctggaaatgtggggaagatggtaatgtccagcacttgtatgcagtaaagtttttcaacttaaattggggacagctttcta

SEQ ID NO: 14701 - DNA, 853 bp, Solanum tuberosum
  Predicted polypeptide sequence is orthologous to G1506
agaagtggtgtcttcaatttaagttaaaaacttcagtgcatacaaaaatctctagacatcaccacctctgcattttcagctatattgtacaatttgtcaacctatacaaaaggatgaaaaacaagcataatatccatccgctaaatccaaaatttcgtttaatattaggttacctgcaaaaaggcaaaaggcaaccatctgaatcccttcgcggaactttctatatttggtatgtgatatgcagagacagtaatgtggtttggcccaataaggttgtaaatacgctacagacagaaagccaagtgtgatagtgttgtgtttctaggggtggatgaggtgtgggtatatggagctactgcttgtgcttgcttgagctgcaaaacttgctgttggtaggaggagttctgcctgagggaaggagctgttggatggcacatccagcagcaagtcctgatcagaactttcatttgtaaaacggaaggaattttcagatggcaatgcgaaaaggctttttggactgaagcaagagctatcattctccaggatttccttctgttcgtagctgtttttcatcgccaccctcttggggctcttcattgttgtgtttacccctaaatattttggatgttgcccatcgcgtggtctcttcatgttcactgaatgacctgtgccaaaaacattgcgccctccagcaaacttcagaactactgctactatttttacattttcatgtccttaaagaagattaacttgtttccacccacttttgacttcattaaaatagcacaaacataaacctcttcaggtttcctacattcttctactgtcacccaaataatgagttatcaaaaac

SEQ ID NO: 14702 - DNA, 870 bp, Solanum tuberosum
  Predicted polypeptide sequence is orthologous to G1512
tgcaggttcttgtttacctctttaaagaaacctattttcttctctttttcctctgtttaatcacatgggattctccgatttgaagcttgaaagtctgaaactttgattgtttttctcaacccttttcttgattgatttgaaaagacccttgggttgaacaagtgctcagaaacaaatctcatggccttcgagcagtattattcaaacgagtggaaatcgatccctactccagaatcatcagactcagagaagacttctgcctgctttgattgcaacatctgcttggactttgcccgtgatccggttgttacactttgtggccatctctattgttggccctgcatttacaagtggtttcacttccagagtgactctctgtcttcggatgaacgccctcagtgtccagtttgcaaggctgaaatctcccaaacagatttagtccctctttatgggcgtggggtagcactgcctgaatctgagcctgaaaacaagctcactttaaaagtgcctcccaggccatctgctttcggtccattatccttgtcaaattcctttaatccttctcagcaaccaccacatcctaatgcctatgatccctatgccagttacctcaacagttcatcgccgccttcattcaatcatggaaacaatacatcagtgggagtctttcatccagttgttggaatgttaggagagatggtttacgctagggtatttggaaactcagagagtttatacacatatcctaaatcctaccatctagtggcaaattgtagtccaagattgagaacaagggaattgcaggctgacaagtctctaaaccagaatttcccttttcctcttctgctgttcgtcttctttgcctattgt

SEQ ID NO: 14703 - DNA, 1007 bp, Solanum tuberosum
  Predicted polypeptide sequence is orthologous to G1512
cttttttgttgcttctaaaacacaaagtattctttgctttctccttataaagactcaatcttttgcttctgtattagttcagaaacgttcttgatacaaatttactatttgggcattagaagccaactttgttacatcaacaagcaggatatggccttagaacaactggacactacctttaacaaacacgatactccattagggaaatggaagacgatgaatgatgaagttgaagagaatatttccggtggttttgagtgtaacatatgcctggatctcgtgcacgatcctgtggtaactttatgtggtcacctctattgttgggcttgcatctacaaatggattcatttccagagtgtttcttcagaaaatttggatcagcagcaaccacagtgccctgtatgcaaggctgaagtttcacaaaaaaccttgattccactctatggacgcggtggccaatctacaaaaccatccgaaggaaaggctccgaatcttggcatagtgatcccacaaagacctcctagtccaagatgcggtggtcacttgctgatacccacctaccgattcaaatccatcccagctctttcaaccgacaaagtcatcaacaacagtctcaaacacgtcaatcgccttatcaacaaagcgcctcaccaggcaccacagttaatatgttacaaccctccatgattggagaagtgtgctatgcaagaatttttggtaactcatcaacaactctgtacacaaactcttacaatctacaatcagcagtagtccaagaatgagagggcaatattagaggctgattaatcacttcggaaatatgttttccctttttgttgcttgtaactgtctatcctgtttgaaccacttggtctgtgctctacgtcgtaaccaacaaattcggttgtcataattaaaaattcagcctcgtatattttaccaatcctaacttgcttcttatttggtcaaccttgcttcatcgttctaatgtacctttctaaaaaaaa

SEQ ID NO: 14704 - DNA, 1011 bp, Solanum tuberosum
  misc_feature (843)..(843): n is a, c, g, or t
  Predicted polypeptide sequence is orthologous to G1512
ttttttttttttaatcataagtagttatatgatatatatgatgaagataaacattatatgaacctcaaaacaggagtaggcacaagataaagcagcagaaaagaaagatggacaatctgttgagagatttgtccgcctgcatttcttcccttctcattctaagaccactgcttcctcggatgaaataagatctaggatgaggataagcaattccaaacattcttgaagaaaacatttctccaaacacaccaaccactgggctgaacaaactggtcattgctgtgctcccaaagctagatggagccatagctgcatagctaccaaaggcttgggggaagtattgccggtgatgttgaaatgtggagggtcgtggagggtggagagaagtttgacgaagtctctgatgtaagcgaggaattggagacactgaattacgcagtgtcattgtcctaattgctcgaggtctatgaggtatgtctacatctgcctgagccttcttgggttcagactccaatgatgatatcccacgaccatagagaggcactagcgaggagtttgaaatgtgagctttacagactggacatttagagttttctactgatcctggtccagagctctcaacctggagccacttgtaaatgcaaggccagcagtagaggtgaccacagagggtgactacaggatcatgtgctgagtcaaggcaaatgttgcagtcaaaacaggaagtttcattttcagaggctgctgttggaaagggaactgagttttctcttatcaacggaaaatatcttcatcagacccaacgcgggtgataactcatgaaaatcgacagtatgaaaaccnccaaaggagaattggaagaaaccgtagaagaggaaaaaagaataaggaaaacgagttagtacccaaaaattactctggaagtagggctgtgaaattcctcgtctggccgaatttcctgcacagccccgggggggtatccacttaagtttctaagaacggccgccacac

SEQ ID NO: 14705 - DNA, 1016 bp, Solanum tuberosum
  Predicted polypeptide sequence is orthologous to G1519
ctccttcctcttttgtctctgtgttctactcgatgcttttggttcttcgttaaatcttgcctgaactgaatttggggatttttgcttctttcgaggatttgtaattttgagagccctattttttttggcctaaagccactgctttagggttgagcaccgatttgcatatctgaattctgaaccatgggattgggagaagcttctagaacttcaatcaatgtcggaaacagtgacggcggtggcgcctccacttccggcagcagcgtcaagaggtttccgctggcggcgcagccggagattatgagggctgctgagaaagatgatcagtatgcctccttcgtctatgaagcttgccgtgatgcttttcgtcacctcttcggtacaagagtcgctgtaacttaccagaatgaggcaaaactcttagggcagatgctctattatatgctgacaaccggtgcagggaagcaaacattaggagaagaatactgtgatatcactcaggttgcaggaccatatggactttccccaacacctgcaagacgtgctctttttattttctatcagtcagctgttccatatattgcagaaagagtcagttctagagcagcttcccatggcatcaccctggctgattcaatggcggactatgcatttggggatgatcctacttcaagcaacgaagctgaggcgtcacctacttttgagatacactcatcttcaacatccgctccatcaatttcagctctttcaagattgaaagccaagataagggatttctggttgtatacagttcgaaggtggccttcgatgcttccccttgctcgtgagatcttgcaattggttatccggaccaatctcatgttcttttattttgaaggactttattatcatatatcaaaacgtgctgcgggcatacactatgtgttcattggaaaacctatgaaccagcgacctagatatcaaatactagggggtcttccttctaattcaattatgtattcttgctgctgaaggtc

SEQ ID NO: 14706 - DNA, 735 bp, Solanum tuberosum
  Predicted polypeptide sequence is orthologous to G1535
gacctttcccttatttcaagagaagaccttctggatgcatcattcaagacatgcccaatggatactccagggttacatgggttgaacatgctgaggtggaggaaaatccagtgaatcaaatattcaatcactttgtaactagtggagtggcatttggagcacaaagatggttatcaatcttgcaaagacaatgtgaaaggcttgctagtcttatggctagaaatatatctgaccttggagtgataccatctccagaagcacgaaagagcttgatgaatttggcacaaaggatgatcaagacattttgtatgaacattagtacttgttgtggtcaatcatggacagctctttctgattctcctgatgatactgttagaatcactactagaaaagttacggaaccaggacaacctaatggactaattcttagcgcggtttcaacttcttggcttccatataatcatttccaggtctttgatctcttgagagatgaacgtcgaagagctcagttggatgtactttcaaatgggaactcattacatgaagtggctcatattgcaaatggttcacatccagggaattgcatctctcttcttcgaattaatgtggctagcaattcatcccaaagtgtagagctaatgctacaagagagttgcacggatgattcaggcagcctggtggtctacactactgtagacgtggatgcgatccagctagccatgaaacgggaggacc

SEQ ID NO: 14707 - DNA, 829 bp, Solanum tuberosum
  Predicted polypeptide sequence is orthologous to G1538, G1545
atcttgctacttgctagctagatagtcaaatactagtaaccctaattaccacactagtctagaaaaaagcaaggaaaaaaagatatatttacatacattagtacgttatatatagtggggttacttatctacaaatagaattatgggatcctaaaattagaaattaatcacatgataattttataattatatcaaatatataggttcacccaatctaatccttgaacataattattctcttgtgcatagaacacattatccaatgcctccattccaaattcccctagaaatggtgcttccattgagaaagatgaagcacttggacttgtgtaattactcgataccccatcacatcgctctaataatagcctttttatctccttctctgattcattcaattgttccttcaacttcaatacctcagtttcaagacgacacttctcaacaacattgttgtcatgttgagatttcaacttggaatattcctcctctagcttcttgctcttccaacgagccctcctgttctggaaccacaccgcaacttgtctagggtcgagccctagctccgcggctagcttgtcctttctctctgactcaagtttgtgctcgtcctcaaaacttttgctcagaaattaacttgttcttcactcaacttcctcttcctcatcatcatcatctgatcactcccactcccttctcctaattggttttcttacgtcttcttctccgcggctttgactctccttgttgtggtacaaggtggggtgtaatatcaggatagtactgggaaatgagtatcatattgtcatcttctataatctgatggtta

SEQ ID NO: 14708 - DNA, 869 bp, Solanum tuberosum
  Predicted polypeptide sequence is orthologous to G1538, G1545
aaacaccttattctctacatccctctagcttttataataactaaaactaaaagtcctcactgctgtactctttctcacatttatccactttcatttttgcatcagaaagcaaaaaagtaacatgaataatgatgatcaaatgttacacatttctcagtactattctggtatctatactcaacagttaactcaacaaggagagggtaaaccgaagaggagaagaaagaagaacaaaggagatgatttaaacggggcgatgatgatgatgatgaggaagaggaaactaagtgacgaacaagtgaatttgctcgaacaaagttttggacatgaacacaaattggagtcggagaggaaagacaaacttgcctcggagctaggtctagacccgaggcaagtaactgtgtggttccaaaacagaagggctcgatggaagagcaagaagttagaggaagaatactctaagttgaagaatgaacatgagactaatattgttgacaaatgtcgtcttgaaaatgaggtattgaagctaaaggaacagatgtgtgaagcggagaaggagatacaatggctattgacagagcgatccgaaggcgtttcgatcaatagcccaacaacttcatcactctcaatggaagcagcatggatcctccttttctaggggaagttagggtttgatagtagttttaatgggccctatgtccatgaagggattcggacatggggttaaataaaccttgtaccaataattgacattatcatattgtgaacctaaatcactagcttaagtaggtaactcatccacggtgtggtataccttaaactgatcctttctccctttgacttattaaagctgtacttactaatactcg

SEQ ID NO: 14709 - DNA, 846 bp, Solanum tuberosum
  Predicted polypeptide sequence is orthologous to G1538, G1545
ttcattttctacatcaagaagcaaaagcaataacaagagagatctaggagggaagggattatgtcaagtagcaaggttgatgatcaaatggaactcatctctcacttctatcctcatatttacgcccaattagcacaagaacaagtctctttaggagagaagatggaaccgcgaaggagaaggaagaagaacaaagttgaagggagaaacaacactagtgaagttgtgatgaggaagaggaagttgcttagtgaagaccaagttaatcttcttgaacgaagttttggggacgagcaaaaactaggagatggagaggaaggccaagcttgcttctgagcttggccttgatcctcatcaagtcgcggtgtggttccaaaacaggagggctagatggaagaacaagaaaatcgaggaggaatactccaagctaaagactcaacatgagactaccatcattgagaaatatcgtcttgaaactgaggtgttgaagatgaaagagcaattgtgtgaagcagaaatggagatacaaaagcttttattggaacgtaaaagtgatatttcaagcaataataacccaatttcatcaatattctcaatggagcagcaacattttgatcttggggagtttggaatggaggggcaattaatggatgataatatgttctttgttgctgataaatcaaagtacttatataactctttgggataattagaatgggtttaaaatttataatcctatatgtatgatattcatgatcatccatatgtataaagttttaaatgtagaaatatgtacatttctttctttttgtaacttgctttgtggttaaaaaaaaaaaaaaaaaa

SEQ ID NO: 14710 - DNA, 607 bp, Solanum tuberosum
  Predicted polypeptide sequence is orthologous to G1556
gaaaagttctgtaagaatcatccagaaaatatactttaaatacatatttttcttctcggtcttcgtgggttgtggaggaattggccggattcctcggagttccagtttgtggttttaagctcgctcgtttggtcccagtcgttgcccaaaaaacggtgatatttcccatttttctattttgcttcaatgtgttattcatagttaagatgctttggatatcatttgttttcgatctcacactttgtgtaattttctacaaattgattgaatatagtctctgatagttgcttataatcattagttgactcgttcgaggttctaaatgcgtagaatattgtgtatctcggcttgtgtttaaatctttgctttttgtcatcatcttagattggttcttggctcgctttgtctgaaatataatctgcttatggcttagattctagtcacaaatcataatatatctctaattcatgcatgttaagttttacacttgtttgagcttcaatctatctgtttgtttgctctgtttccctccttatttatattactatatctattccatttgcaattcattctgaagcatgatttcgtgtaattgttccttacttga

SEQ ID NO: 14711 - DNA, 913 bp, Solanum tuberosum
  misc_feature (639)..(639): n is a, c, g, or t
  Predicted polypeptide sequence is orthologous to G1560
tattactttgtcctacttctttctccctcttacccatactccaaattaatattaaccctatcttttctcatatattcacaaactcttttattaccttgccaatttcctctatcttcttaactttgacattgactcaaaataatatactatctttataagcatatttgttgaagaatcaaagcatggatgattttggaaatttaataaaagaagagtttgatggatcatttttgattcctcaaccaaaggagtgtcttcatgagaatggacctccaccatttcttacaaaaacatatgaacttgtggatgatccaagtagcaacgacgtcgtttcttggagtagaggtaacaatagtttcatagtatgggatccccagaacttggccattaattttcttccaaggtatttcaagcataacaatttctcaagctttgtcaggcagctcaatacttatggatttaggaaagtaaatccagaccattgggaatttgctaatggaggttttttgagaggggaaaagcatctcttgagaacaattaggagaagaaaaacaagtaatttcatcaagtcgtcgtcgtcaattaaccaaggtatggattcttcaacatcatcatcatcatcatcatcatcatgtgtgngagttgggaagctttggatcattcgatggagaaattgatgaattaaggcgcgacagcaggttctcatgattgaacttgttaaaactttaaacagcgtccaaaaggcttacaaaaatccaccaacttcaaggttatggaaacaaaaagcttccaaggggacacgaaatcacaccagggacgaaaataactgagtttcttgggcaaaagcattacaaaattccaaaacttttgttggacgcaaataatggcaccaaacagggataagcaaggaaac

SEQ ID NO: 14712 - DNA, 943 bp, Solanum tuberosum
  Predicted polypeptide sequence is orthologous to G1634, G2701
gatctcctatacatctagaaagattggaaaattaaacagatagaactttctttttatgatgatgattttaggtcagatcattttggagagtttatcggaaataatctttctgtcttgactcttgagggataaggtcttcgtaaacactatcatcatcagactcgacttatatgttattattgtattcagtcatctatatggtcttaattcattcaatcattgtctattgttcagttaaggtttatagaattgatcaagaaatactcctcgcgattctgatccagagtatgttcctatccaccgagaagattatagtcttttaagtttcaagaaaattgaggattcttgatttggatatggaaactttatatccaacttcttttgtaccaaattcaaattggattatgcaacagagtaagagtaatacagaatggactaaagaagagaacaagagatttgaaagtgctcttgcaatatacgacgagactacaccaaatcgatggtctaaagtagcagaaatcatccctgggaaatcagttcttgatgtgataatgcagtataaagaattagttgcagatgttagtgacatagaagctggattacccccaaatacgaggcgtgatttcacgtcttcttttgcgttggaatttgttgatcattgtaagattcaaacgtttagtaagagaggcaagtcttatgatcacaaaagaaagaaaggtgtaccatggacagaggaagaacacaggcgatttttaatggggttagagaagtatggtaaaggagattggagaaacatatcgaggaatttcgtgatctctaaaactccaacacaagtggctagtcatgctcagaagtactacttgaggcaactttccagggagaaagagaggaagagacctagcatccacgacatcaccaccgtccatctaacaaacgatgagtt

SEQ ID NO: 14713 - DNA, 880 bp, Solanum tuberosum
  Predicted polypeptide sequence is orthologous to G1635
atttcttggaatattggagcttaatacggattgaatttgaaggtgactgttgatatttctgggttttgggaactgaagagaattgattgggtaaaaactggtttcttctattttaggggaaagtaaaaactttggcagcagttgttagtgattttggctcaaggagtactgatttgattcagcagaaatgactataggggatcaaagtgagtcggacacgatacttccaagtaggaatagaatgtcagttgatgtgggagctccttctccaaggagcatccagatggaagagcaagttattccaggagaagaatatgctcctaagataagaaaaccatacaccatttcaaagcaaagagagaggtggtcagaggaagagcacaaaaagttccttgaagcattaaagcttcatggtagggcatggcgacgtatagaagagcatgtgggaaccaaaactgcagttcagattagaagccatgctcagaagttcttttcaaaggttgttcgtgaatcgagtaatggtgatgcaagctctgtgaaatccattgagatcccacctcctcggcctaaaagaaagccaatgcacccttatccacggaaaatggtaactccacttaaaagtggaaccctggcttcagagaaattgaataggtctggttcacctgatctctatctctccgagccagagaatcagtctcctacctctgtgttgtctgcctttggttcagatgcatttggcacggtggattcaactagcccagtgagcagtcatcacctgttcatcagctgtcgctgagaattctgggtgatcttggttactttccttgaaaccattcccgcttttcatctgtacaaggaagagcaaatctttcaccctggc

SEQ ID NO: 14714 - DNA, 737 bp, Solanum tuberosum
  Predicted polypeptide sequence is orthologous to G1641
tattaggcagcttcccggtggaaaagataaaaggagatcaagcatacatgatatcacagttgtcaatcttatggaatccaagtctacttcccctgagggatcataaatctgcccctttctcaacaaacacaacagcattcaaaaatgaatggcatggtaaaaacactatgtgagtataattcaccaaatcaagaatcagacataacattcaactcatcaagtggtggtctgatgaccatgcctttccgaggggctccatcatatggacctcgagcatggaatgcataacattgctctacaaggtctccagtttggtaactacaatactatgtgttgagtcagggaagattcaaagctcagttcttgtgggtcaagagcagtgaggatccatatagccgtctccaactttgcttggaattgacgcgcagtgtagtgtcgtttgtcaagaccacgagcggaaaacaatcacttattagaaagagatttggcgtacagtaaggtccatatggcaaacaaaagtgggattgctcattatttaggaaaactttgagctatttccttgcactagattgtctacttgtgttctttcaaagttgtgaatgaggttgatttaacagatttgtgactaagattactcaacacaatcaagctaattatgaagcttgccaagtgacttaagggcaccaaactagtcattagtgaaaacatctagtatgctaggtggttcaataactctc

SEQ ID NO: 14715 - DNA, 1044 bp, Solanum tuberosum
  Predicted polypeptide sequence is orthologous to G1641
gtcttttcaagattcctctctatggttaaaagggtattctgattccttttatagatgctgacttcttgatttaacactgatatttttttcttcccattgtaaaaaccccacatctctgcatttcccatcttgggtttttcccccaaatcttccctctgtttcatcaaaagttccaaatcttttttcataaaaaaattgccgttctttgaaactaattcttttctttggtaaacttttttttcctttcttacttggttgaaaattttttggaacccttttttttttgaagttcctttgggggggtttaattgggaaaatttcctaattccaacccaaggcttccctttaattcttttccaaaattcccaaagcctttgggttttcttttgaatggaaggggttaaagaaggcaaccaaaaaattggaacctcccaaggcttgaaaaacaaaagctttttggaaagattgcactttgccctttggttttgataaaagataacacccagatagatggcaatagagttgcagaaatggttccagggaaatcagttgttgaatgtgatgaggcaatataaagaaattagaagatgatgtgagcagaatagaagctggattaggttactattcctggctatagtacttcaccttttacattagaatgggggaataggtcataggttttgatggatacaaacaatcttatgttgttggaggcaaaaggcctttgtctaataggccaccagaacaagagaagaagaagggtattccaatggaccagaagaagaaacataagttgtttctaatggggcttaaaaaagtatggaaaaggggggattgggaggaaacatttcggcgtaacttttgtttgttaactagaaactccactcaagttggctaattcattgcctcagaagtactttattagaacaaacttttctggttggaacagatcaacagaacgggcgaatttttcttgaccttttacaagcaataaatctccagcgataattcaaacgcttttacccagaatttaccagaaaacaa

SEQ ID NO: 14716 - DNA, 946 bp, Solanum tuberosum
  Predicted polypeptide sequence is orthologous to G1655
atctctctctacataatccttctctcctccgccacctaccgctgccgtctccgccgccaaactcacaactcaggtattgttttatgtgctttagtttctgtttctcgtttgtgagctgattttcaatttattttttttgtttttttgaacggagattcctgagaatcaaaatattagagtttcaattcaaggaggagtatcatgttactactgccttatgtgtataggtttattttgcatctatttacagaagagaagcaaacgtaccattcgcgagaatcattccgaattttgcatcagaaaattgttccttctgatggcgtcatctcaaaccgtctcgaatcccgatgttaactccagtcactcgcgagaatccaagcgcaaaaagagaagaaaaattgtagatgctggggaaattgagcaacaaacaagccttgatcaatccaggtggagaactgataccgagcaacagatctactcttcaaagcttctccaggctctccgtcacgtccgccggagtaatgataatccgtctccggttaatgccggacgcgccgtcagggagaccgccgacagagtccttgccgtcacagctaagggaaggagtcgttggagtagagcgattctcagtggccgtctcagcctcaggcttagccaaatcaataaaaagcataagaaagctaagctgaacagcggcaatataaaatcgaaaaaaccagcggcgaagaagcgattgccggctttgcagcggaaagttcgtgttctcggccgtttagttcccggttgtcagaaactcccgtttacgaaccttctagaagaaactaacgactacatatcagctctacagatgcaaatcaaagccatgacttttctgaccggtctgctctccgccggtggagcaggatcagttgccgctcaccccgatcggctcggctaagtggctcgt

SEQ ID NO: 14717 - DNA, 691 bp, Solanum tuberosum
  Predicted polypeptide sequence is orthologous to G1660
ggctgcttaggtctcacttttaatatagtatagatagtttttttcccattattaactaatataatcatactttaagtgctagctttgtaaagaaagaaaataactctgagcatgtatctcattttgttacatgacaaaaaagtaatcttgcattacaaatatatatcgtatttgaatctacttcctaactgaattattgttcaactttgcaggttcaggagatgtcaaatgattttacattcacgaatgaagtcatgcaactagcttgattgtttatcaatttgaaattatattttttcctttcagattttcaattgctcattctacacatatttgaatagagtattatatactccattttaggaagtctattaattcacatgagacacacgtgcaacacatgtgtccagaaactagtatttactatatgcatggaacttaagctttatggtgcctttacgtgcttgattcatgatcgtccacagtaaattgttgaaatatgatgaatttttggatgcaagatgataaacgattgtatatttttgcagtaaatctgagccgtcatgattcgtctgtttctatacatagtgcaactgttatcccccaccatcgactgcaaggtcagtctcgatgagagaatgggcatggaaatgactccaattgcaagccaggaaccttccaggacggacac

SEQ ID NO: 14718 - DNA, 976 bp, Solanum tuberosum
  Predicted polypeptide sequence is orthologous to G1660
gtccgggccccccccaatggttgaattggaggaccattcattacccatcaaagtcacaattggccactggagaatggctgaacttctacttccattgatcaacaattacatgtaaagtggccaaccagttgagtttgtacaagagcttcaagcatacacaaaggcagtctccaacttcacaatactagcttagtggaaaagcaaaaaatatacagagcatttgatagtgatttgaagctcttcagaagcaccagcgacagcaggagaatgagcgcggtaaacggccagttttacgaatgtattctgcttgcttctctatttttacagcatgtttgtttctcctggcttctgctgctgccagcttctcttcggctttgtatctcaccgcagctagcttgttcattagcttgtcttgtgttcgtgccttcatcttttccacctccacctcagttttcctcatctcagcttctgtctttgcttgttgatgattttcccatgcttgtatcttgatttcttctcgtttaaacctggctaagtactttgctttctctgcatcctcccaagcagctgcacgtgtctcagtgacagtggtatttgggttggtcttgcttatcagttttcagcaagctggatgcatttctatcctcgccatctttgctagcccaggcagcaatattcattttaccaagtttagttccaagtgccatgatttctcttcgagttttcatctgtaattcctggtcagacaacttcattttgcatgagcattccaaattatcatttggaaggacgaaaaaggagaggaaggctggtgcagctcccgggagttgatggccgagaagaagttggggctgcgagtaaggtgtagttgctctcacaaggtggtccaagttcctggaaaagttccctggctcagcaattggagtcaattcccgctgcaccattatctcttcagtgagaacgaacttgccaagtt

SEQ ID NO: 14719 - DNA, 557 bp, Solanum tuberosum
  Predicted polypeptide sequence is orthologous to G1662
gatcaagttgaagagtaaacatgttggtggagctttttctaagaataacaaatgtaagctctcccctatattatcattgttttcaattttttcatttcccttgatagatttgttcaataagcgatgtacttcattcagaggcgaatccagaattttaacttgatgagttcaacatttaagacacttagtgacttttcacatacattcaaccctctctataacgtcattagtccagatattttttaactgctatagcgagatgctattttacagaatatataatataacataataagaaagtcggttgccaagaaaacttggccgttatagtaaaatgaacaagatgattgttatagagaagtctggctatatgtatttatgctcccctatctacaaaaatattgggttcagttgaactcttgtagcatccgcctctaacgtcattcattatgcaacaggtgttgtatatgaagtatgtgatgaaagtgaaccatggctattcaacaaagagattgaaagcctagatttgtaccttagagtaaagacagctcatggtc

SEQ ID NO: 14720 - DNA, 784 bp, Solanum tuberosum
  Predicted polypeptide sequence is orthologous to G1662
actgaagattttagtctctccaattattaagtacaacttacatctgaagtatcataaaacagacaaaccaagaactatctcaaacatttttatacataaaataacacaaaaaatgaaaaactaagttagtctaaaagctcttgttgattttcaacattgtcattgagccctcagtatcttcatataaactggttttatcaagaagcttctgaattccatcaacccatttttgtttatggcttttgttcttgcacttgaactctagaagaccctgagctgtctttactctaaggtacaaatctaggctttcaatctctttgttgaatagccatggttcactttcatcacatacttcatatacaacacatttgttattcttagaaaaagctccaccaacatgtttactcttcaacttgatcacaacctgagatttcttgtttatataaacagaaacgcgcttccatcgttgcagaccttttcttgtgagatgcagcaattcacccgcaaacagagaatcgtgttcatccatctcattagggaaaacagcagcaaaactttgagcttccaccatgcttctgtcacaaggacttattgatgcattcctctttgcttcttttggtaatcttgacttaagagttgcttctcctctcaaagctgtggcagctgcagctgttagtgtgacaagatcactagcactatgtatgtctacagctgatctaacaactgaagctacacgatcatgatccgccccagctgattcagccatttcaaggcatgtgaggcc

SEQ ID NO: 14721 - DNA, 841 bp, Solanum tuberosum
  Predicted polypeptide sequence is orthologous to G1667
atcaaatagtgcaagtaaaacaaatggcttcatgtgtaaccaaagagaccataagccaaaatcaacaaattgacacaattggtaacaacaatcttggaggtggtacaagtggcttaatgttggctgcaaaagtacgcgatggggactccgtgagacgcccacgtggcaggccagctgggtcgaagaacaagccgaaaccaccaatcataatcacaagggacagtgctaacgccctgagagcacacgcgatggaggtaaattcagggtgtgatgtgaacgaaagcctagtgaatttcgcgaggaggaagcaacgagggatatgcgtgctgagcgccacagggtgcgtgacaaacgtgacattgcgtcaaccagctacatcaggatccattgtgacattacatggacgatttgaaatcctctccatactcgggtcagtcctaccaccacctgctccaccaggggtaacagggctcacaatttacttagctggggctcagggccaggtaattggtgggggtgtggtgggtgcactcatcgcctcaggtccagttgtcatcatggctgcaacgttcatgaatgcaacgtttgatcgtttgccattagacgatgatgatctcgttccttccactgctgctcaaaatcaacattaccagaagactcaccaacgtcatcaggtcgatgtccccgattatctatgcgttaccacaaagtgtaattactaatggggctgaggttaattcatgggcacctggaagaactctatcaaagtcctagattttagttaagagcttgaagttgaaaaattatactaataagcttgaatatttataagtactagtac

SEQ ID NO: 14722 - DNA, 640 bp, Solanum tuberosum
  Predicted polypeptide sequence is orthologous to G1743
aaatgttctaaaaaagaagaaacttctttttctttctatacacaataatggctgccctttctcagctgctagctcatatctacaccatgactctagtcttcttcaccattctaatcctcgaactcgtaatctttgtacgctccataaccgacacaatctccgattccggccgcggccgccccatcaccaccaagcaatacctcaaactcatcgatgaaaaaaacccggtcagccggttcaaaaccgcatcaatcaacccggacggtttttccgatacctgtgcggtttgtttatcggcatttgaagacggcgaacaagtacggaagttgaaatgcaagcatatatttcataaggattgtttggacacgtggctccaacaggattctgccacgtgtccactctgccggaataaggtgctgccggaggaaattgtggttaaattccggcagcaccgcaaccaccacacggagtatgaagggagtgatgaggagctcatttttttgttatctgcattacatggtaattatattcgtagatttttgtaaattattaggaaatttttgtattttttttttgtatataaaaatatttagaatattaaaaaaagaaaataattagtacaaacaaaaaaaaaaaaaaa

SEQ ID NO: 14723 - DNA, 954 bp, Solanum tuberosum
  Predicted polypeptide sequence is orthologous to G1767
ctccacttgagttgatccttttgctttgaacccatccaacaaaatcactaaaggtactactagtcttgtacatttattctttttaactttgatgtggcaagagagatacgtaccccccctttttgttaaatggatactttgtttagattagttacccttcaacaacaacaacaacaacaacaatctgatcaatactcttttaactccagcagaacttcaagcagctctagatcttctaacaaacaaaatactacttataattatcatccacatcataataatcaagacgaagaatgcttcaactttttcatggatgaagatgatttctcttcttcttcttctaaacacaacacgaactatcctcctcctcattacaatcaatatcaacaaatttccaacactcccacaccgacaactacaagcagtaccccgacacatcaatctcaatctcatcatcactatgatcatcagttctccccagcacgtgacttaaatctcgaattcgcttcctcattttctggaaaatgggcgacggacattcttctagaaacttctcgtgccatagccgataagaacagtacacgtgtccaacaactcatgtggatgttgaatgagctgagttcgccatatggagataccgaacaaaaattggcttcttattttcttcaagcattatttagccgtatgacggattctggcgaacgatgttatcgtacgttgttatccgcttcggataaaacatgttcgttcgagtcaacgaggaaattagttttgaaatttcaggaagttagcccttggacgacttttggtcacgttgcatccaatggtgcaattatggaagcgttagaaggtgagtcaaagttgcatataattgatattagcaacacttattgtactcaatggcctactttactagaagcactagcaacccgcaccgacgaaacaccgcatctc

SEQ ID NO: 14724 - DNA, 426 bp, Solanum tuberosum
  Predicted polypeptide sequence is orthologous to G1781
ctggaggtgaacaatgaagaagaaacaaaggaggtaattttagagctctctatgcgtgtggtgttattgaatcaggtaattgtggctgaattgagttgggggaaaaaggcaaaggaaaaggttgatttgttggaacaaatgaagtttggggaagaaggcctgtaggagaatatacactgttgtatgaaaaatttggcttctgatcatgttgttgtgattggttctgctttggaacatttagcttttcaccttctaattctctatatttgttaagatattgtttaagagggagaacgtaatcttcaaacccgagaattgtgatggcccatataatgtcatcaccattgattgtctttctcttctcacgctggcatttatcagatgcttctccagtaacaaagcttataaattctgatacacaaaaag

SEQ ID NO: 14725 - DNA, 289 bp, Solanum tuberosum
  Predicted polypeptide sequence is orthologous to G1785
gttctgtcacaattttttagtatgtgattgtaagataatctatagggtttttatgaagttgagtctatgttgggaatgaaattgggtcaattggcgttctcaatgtatcgtaacttccctccacttcctctactactcaaccagtgaccagtgtggtggtgctttcaccttatatatgaatcaattattgtctgaatgaattccctcctttaaggcttcttctgtatctttatttgtacatatataattattcttttagacatagaaaaaaaaaaaaaaaaaaaaaaaa

SEQ ID NO: 14726 - DNA, 586 bp, Solanum tuberosum
  Predicted polypeptide sequence is orthologous to G1789, G1911
atgtctcccccttcttgttcttcttgttcaattcattactaaaatggccacaaattgttacaacaaaacaaaacaagaagtttgaagaggcaattgttatgtatgacaaagacaataatggtgaaaaatggcataatatagctagatatgttggtggaaaatctgttgaagaagttagaaggcattatgatcttttgataaaagatattactcaaattgaaaatgatcaagtccctttgcctaattataggactacttctgatcaaaccaatgctagaggttatgctaatgaacaaaggcttctgaagaatttaaaactacagtgagcagaaatttggactcataagtcaacaacagtcaaagacatatttatccaaatgtgtcagtttataaaattccaaaaatttggaatctttaattaattgtaaattcatgtttaattaagtgtttcttatcttatgtattaattaaattattgttgcccaattaagagataagaaaaatgtgtacgtaactaaatgtttttcagctttaaatgtacctttatttctgcataagttatcatcctataatatataaatttgag

SEQ ID NO: 14727 - DNA, 491 bp, Solanum tuberosum
  Predicted polypeptide sequence is orthologous to G1789, G1911
ttcacgtttcatacttataaaaaaaaaatgacatcaaattcactcactgcttggactccaatagaaaacaagaaattcgagcaggcactcgcggtctacgacaaggacacatctgatcgctggcaaaacattgctagatacgttggtgggaaatcagttgaagaagttaaacatcactatgctatccttgtagaggatcttaagcacattgaatctggtgacgttccattcccaaaatacaagtcaggtcgttagtctattacaggcgtacgaggtataataccagtcaaagtcaaagatatgtggacgaattacatacgtggaaagacatatttttctctcaagattatgaatacactaagctattattttcttcttagatctagtgagatgtgttagtgttatcattgtataaccctgattattatcgtttcgaattaacgagcataatataattttatggacgctacgtaaaaaaaaaaaaaaaaaaa

SEQ ID NO: 14728 - DNA, 962 bp, Solanum tuberosum
  Predicted polypeptide sequence is orthologous to G1794
gatcccccatctctcctttccgtctttcttttccaactaggtggccaccggcgaagacccagcgtcgtcctctcttctcctccctttcccgtcgcctctttctctcttctcctccggtgagaaagaacatccagcagctccagcgagccggctccggccagcagcgagggacgaagaccagcagcagctgtgatggcgggcaacgagtgtgcgccgctcgtccctctcttcctcctgctccggcgaagctaattagcagcagccgccagcggaaaccacagcaacgaggcagcagctccggcgaaatcttctccatctccgactaagaagcaacatcaacgaggcaacagcctcacgagaccctgccgatccctccacgcactactactccgatcagtggcgatacggcgacaacacaacagtgtttggacgggatttggccggcacaaggctgtgagattttggattgtttaaaacggatcttaacagatccgttcaggaaattggttcggaagcggattaacagaaaaatgtattgaagtgatagcaacaacaaccaacgatgccatcgacgaaacgtaggtccaacgacggcccgtaggtgctgcagtagaagtggagttcaaggaattctgaccaagtgtggaaccacgagagtcacctacgaactgtaggtcgagtgacgaaccatcttgtacacctgtcgatgcgatcagcaagtatcaagttccagtacctgaaccacggaggcaacccacggaccgtaggtcaatcaacgttctgtaggtcaggccatcagtcaagtatgagtccggcccaattttattttgttttcctagttggtttaagactttagtactataaatataagttgttatttccgtttttgagagttagacaccattgtaaggttttagttttgttcttttgggattagtttgcaaactcttagcaatttattt

SEQ ID NO: 14729 - DNA, 913 bp, Solanum tuberosum
  Predicted polypeptide sequence is orthologous to G1794
gcacatagagatgcatgtaactaatcaacagtgtgaacatattatcttcagtcggcacctgatctaatcttgtttttttttttcttcttattatataattttttttgttctgatttctactttgtgcatgtgctcaaagagaaaaacaaatcatatacgatttgagctaaataaaaattgatttttttttgtcagagtttgatgtgttgtttttagggaaaaagggtatttataattaacaaaaataacatctgggttgttgtttttgaagttggtgagagtatatgtgcttttcaaaggtggcgaatccaagaaaatcaagtgaatatgtcagatttacagatacagaggatacacaaaccaccgccgtaaccgccgccgccggcagcgtcggcggtggtcagtttgatcagttcttggaagaagatgattattcgatgtatacagagtattctgattctcagacgagagatatgtcggagatggtgacggcgttgacacatgtggtatcgggtcaggattatcgacccgataccagtggtgttggtgttggcgttggtggtggtgagagatattattcgttgaattcaccgtcttcagcttattcttcgtccagctcgggttctagagctggactgaagagaagccgtgatcaagaagaatttagaagtgggttgtcatcttcatcctctgttaaaattgaaggaactacaagtatggttgcaccatcaaacacaacaatttccaccatcacaacaattcccgctttcacaaccacaaccacgaccacgaccacaacaggtgagggttcgagcgaagaaacaggaggaggagatagaaggaggaaatacagaggagtaagacaaagaccatggggaaaatgggcagcagaaataagagatccacataaagc

SEQ ID NO: 14730 - DNA, 817 bp, Solanum tuberosum
  Predicted polypeptide sequence is orthologous to G1794
ctcttctcctagcagcaccgctgctctttctcgtcgagttccggcgacagtcaccggaggagccgccctctcctctctctggccttctttttcccctctcctcctccacttgtattcctcatctgccagcgaccagcagccggcgcagcaactagcagcagcgaggaggacgaagtcagcaaccagcagcagcagcgaacaactcctccaccggcgaccatagtcagacgtggcaaacagtagctccggtgaagccagcatccgctggccgcctctgcttctctcatctctttttctccggtacagcgaggaacaccagaagcaacagcagctccagccggacagaaaccaacaactagtgcctctgcccctctcttctccggcgaagctcaaaggctgtggaagacggatcttcccagatctgtccgggttcgttctcctaattcgaatatatgatttctctatttgattatgaatatatgattttgcatgtttgtgttattgtaaaaatgattaatggctgtgaaatttcatcccaagcatgtaaagttttgatctgacggatttgtttcattagtgtggtaactttttttacagttgattgctaacctgttgcatataagttgtaaactgatggtattgttaaccttcattctattgacgccttattgcttgacttgtcaatcctgctaataatcatttaattttctgctttgaccgactctttaactgcagatttagttatttactcatttagtggtcctctatactgaactaattattttcttgccaatgtgctcattcatcttattacggt

SEQ ID NO: 14731 - DNA, 962 bp, Solanum tuberosum
  Predicted polypeptide sequence is orthologous to G1804
aaatgaaggagaatacatagtatcttctttggttttgttctttgttcttcttcttgcaccaaaagaaaaaaaaaaactttgttttctaattttaagtttggttttttttttggttttgatgacatgttcttgagagacttaaaatcttggtggagctgaaaaaaataatcaagaaaaaggtcccttgttaaagatccgaaccgtagttaggaaaaaagttaataacatgggagtaccagagtcagagatggtgtcacaaagtgaggttcaatcaccattgcaaccagaccaaaaccagaacaagaacaacccgttcccgtccctcggtcgacaagcgtcgatttactccctcacgcttgatgaattccaacacactgtttgcgagagtgggaagaattttgggtcgatgaacatggatgaatttcttaacagcatttggactgctgaagaaaaccaagcccacgcccatgcccatgcccacgtgcacgctcagcctcactgccaggctgcaagtactggggaagcaactagcgcgccacgttttgcattagcacagggcaatgtttcgttggagaaagctattgttgagcagccaagcttgccaagacagggctcacttacgcttcctgcaccattgtgtagtaaaactgtagatgaagtttggtcagaaattcataagacccaacaagagcagcaacagaacaacgggtgcagcatacagaacaccggtaacggaagttccactcaacgacagactacattcggtgagatgacgctcgaggatttcttggttaaagcaggggtcgtgcgcgaacagggcaattcagcccctgcacctcctcagcagcaatcatatatgatgtatccaaacagtgcaaatcccactatggccactatggctcggcctgttatcggcctcggtggagtcacggggcggtgttggcatcggtgtcgccattccc

SEQ ID NO: 14732 - DNA, 821 bp, Solanum tuberosum
  Predicted polypeptide sequence is orthologous to G1835
tgttgagtgggatgttagtgagtcgaagggttttggaccaatcccgaccgatgctctaatggattttccgcctatgcctcaaggcaacattggcaatcgtcgggtgaatgcggtggcaaaatcacatccacatcctccgatcaaatttaccgaggtccaagggactggtacattccagacacagagtccagtttcagttcttgaaggcagcaattcctgctctggtggaaagagtatacccatcaaacatgacattgtcattcccgtacgtcctcgctccaagcgtgcgcgaccttcagctgttaatccatgggttttgatggctccgatatcttctacaagagttgcatccaagaagatttctgacgccagaaagacgaaagagaagaggagaagattgtcactgctatctggtgccaaggagcccatgaaaaactatgttcaacagatcaatgatgcagcgctaccattatcagacgtttacaagaagaagataacctccacacaacagtctagttttttcaaaaaatgcacacattgtgaagtcacaaagacacctcagtggagagaaggaccactggggcctaagacactatgcaatgcttgtggggttcgctatcgttcagggcgtctatttccagagtatcgaccagctgctagtcctacgtttgttccatccgtgcactcaaactctcacaggaaagtcgtagagatgaggaaaaagactctgtatggaacaggtgaagttgaggaacctcctaaggtgatcatgggaagaaagagtgaagctttgccagaaccaactattgttgctgaccctg

SEQ ID NO: 14733 - DNA, 831 bp, Solanum tuberosum
  Predicted polypeptide sequence is orthologous to G1835
tcaacttcttctttactagtttcttcgaggtaaagggttttagagtagaaaaaaaatcaagaaactatggggtcaaatgtggtagatgagatagattgtggcagcttctttgaccacattgatgatttgattgatttccctcttgagaatgagaatgttggccttagttctactgattgcaaagattttccaagcatttggaatgaccccttgccggattccgactcccttttctctggcagccaccggaattctgcctccgacctctcagctgagctctcagttccgtatgaggatattgtccagcttgaatggctttcaacatttgtggaagattctttctctggtgggggattgactcttgggaaagaaaacattcctgttgagaaagagccgttatcccaaggcaagttccagacttcgagtcccgtgtctgtgcttgaaagcagcagcagcagcagctcgtcattttccagctcgggggaaaaaactttaccccttagtccatgccaccgtggtccacaacgtgctcggaccaagcgtcctcgcccaacaacttttaatcccttcccagtatttgttgctccaggagttccaacagaatcagaaaatttcgcggagtctcccatgaagaagaatctgaaaccggctgcaccagaacagaaaaagaaaaagaagatcaaattctctgttcctctagctccggtcgagacaaatcagaatccagtggcacagcaagcagttaggaaatgccagcattgcgagataacaaagactccttcatggagggccggtccaatgggaccaaaaaatctttgcaacgcctgtggt

SEQ ID NO: 14734 - DNA, 826 bp, Solanum tuberosum
  Predicted polypeptide sequence is orthologous to G1835
ataacattactatttgagaattgcctgataacaaataaactgcaaaaagaattcccatcctaaggacaaggataaaagcctaaaacatctaacaagaccaacactgacccaaactaactttttttaactaagaaacttaattaacactagtcttagcccttaatctaatctcctaaaatataatcatctacttttttttttctatttccatattacatccctatacaaaaagaacattgaacaaagcaattgaaaaaaaaacactagccaaataacactaagaactgaaatgacagactctatgactaggaaaaactgtttctctgattcttttcattcacttgtgctcctcctcaaccgaaacgttgttgcttgggttgaactccggttgggtggctattgctggtgacgaggtcctggctatggtgtcgttgtctgggacaatggtggttctcatttcgagaaccttcttgtgagagtttgagtgcaatgctggaacaaatgtaggacttgcagctggccggtattcagggaagagtcgtcctgacttgtaacgaacaccacaggcgttgcagagagtttttggtcccattggaccggccctccattgaggagtcttggtaatctcgcaatgctggcatttcctaactgcttgctgtgccactggattctgatttgtctcgaccggagctagaggaacagagacattgatcttctgttgctgttgctgttctggtgcagccggttcagatcttcttcatggggagactccggaaaatttctgattctggtggaactctgggacaacaatactgggaaggattaa

SEQ ID NO: 14735 - DNA, 912 bp, Solanum tuberosum
  Predicted polypeptide sequence is orthologous to G1852
gttaactgctactgctcaaaatacaacttcaagatccaatcacacatatagatatgtatgattggatcttgaagttgtattgttaactgctactgctcaaaatactgaaaatgggtcacttaaatctaccatcgtcgaagcgaaatgttcgacaatggcgacttcttgatttggtttcagcagctttctttgcagcagtactgattttcttccttcttctctgtactcctttgggtgattctttggctgcttcaggccgccagactcttctccgttctgcctctggggatccgcgccagcgtagtcgcctaattgctcaggtggaatcagggagacacaacacagccattgatgcatgctcagctgactatgtggattatatgccttgtgcagatccgagaatcaatagccaattgagtagagagatgaatttttatagggaaagacattgtccattgcctaaggatacgcctctttgtttgattccaccgacacaaggttaccgcgttcctgttcaatggcctgagagtttgcacaagatttggcatgagaatatgccatataataaaatagctgacaggaaaggacaccaaggatggatgaaaaaggaagggccatattttatatttcctggtggtggaactatgtttcctgacggagctgagcagtatatcgagaaacttaaacagtatattccgatagctggtggagttttgaggaccgcccttgaatatgggatgtggggtggctagttttggtggctatctactttcagaagagatttgacgctctcttttggctccaagaagattcgcctaagtcaccacatacagtttgcccttggaaacgagggaatacttgccaatttgttggccatgcctggggacaacgccaggctttcctttcctggcc

SEQ ID NO: 14736 - DNA, 736 bp, Solanum tuberosum
  Predicted polypeptide sequence is orthologous to G1863, G2334
gaggatgctacacaggtacggaatggctcctgatgcggatgaccacaatttcttgccagtagcttccgcaagtgtgagaggactaggaggtacgggttctaacacagacaacatgtggcgtctgatgccatcacaagttccgtcaaaacccaatctgaaaaatgattcccagctgttgggtagttcacctaatccgtttgagcctgtgatcgaatcaaaacagcaaccccaacattgcttcttcagcagtgacatagattcacctggtacagtaaagcaggagacacagcatccaatgcgttcattctttgacgagtggcctacatccaaagaatcatggtccaatcttgacgagggatctggcaaaaataatttctccaccactcagctgtccatatccattccaaatgctccttctggattctcttcaaggagtgcttcttcccctaaatgatgcttaaggaagctgcggctgcttcaactcttagcagtctctggtgctatgcagaggaatggttgtcctggtgctaaactcccgacatagcagtaaaagcaagacgtgtggatcgactcatcaagttgtaacctctacttgtatgagcttacatgtactttttatattactggtacattcagtccttgcattgtgtttgtagttgtatttcaatttcaatactcttcttaagcaaaaatatatggctttacagacaaatgttgtgcacaagttgccataaaa

SEQ ID NO: 14737 - DNA, 889 bp, Solanum tuberosum
  Predicted polypeptide sequence is orthologous to G1863, G2334
aaaagttcaatcttcacattctgtttgggatgtcgttgaactgaaagctgacttaaacagtacgattataaaaggaaagtgtagttacatccacttgtcatacaaacatagctaatacaatgcaccttcatacatagtatgctttcaatacaaaagatggaaaaaaagtaacacaacaaagagaaaaatcaacagtgccacttgtctaatcaagtgctaacataactagcctctgacgtgctgccacgtggcaagtgatacaaaacgctcgttggcgatgagttggacatcgatgaccttaaagcctcggctagtggtccacccatcgatgccacttggttcgttccccacatggaacgttcaacgttatggactcgagtatcagagttgtgtctgtctcccgtagagagctttaacgagatgtcagacgagggatttccggccatcgaaatggagaggctggtggcagaagccattgaagtagcattttcattttcttcaacttgttgtctaggccaatcatcaaagaaatggcgaaggatttggccattggatttactatcattttgggcttccattggaccttttttctcaattatagattttgaaggcctttgattgagttgaagtagatcaattgaatttgcatgtccagatagagcaaattgaggagtaaccccgccatgacttgccatggcggggttgactttaaggacttcattgccgcccctggctgctcgtggctgcattgcagccacgaggggcggtggttgtggggatttccactggctttcttgaacggttcttaccacgatggacgtggcgttcacagtacttatgtccactcacaacatctctttgacatctccatttcttcccatcagttctt

SEQ ID NO: 14738 - DNA, 833 bp, Solanum tuberosum
  Predicted polypeptide sequence is orthologous to G1863, G2334
aagttacatatttaaccgatcaatcaaaataacagtaaagttcaccaaagtgcacaactttggtatcaactcaaaccaataataaacacaccacacatcccatgcaaatttgtacaggtgatagttagggacatcaataccacaaaagaacaatgaacaacaacacaaccaaggaaaaaaaaaacaataaagtccaaaaaaaaaaacattttttccatgaaagatcaaacaagaacacttgcaaaaatcaagtgctaatatagctggcatcggacgtgctacctcgtgccaattcatgcaacacgctagtaggggacgagttagtcatcgatgaccttaaggcctcggcaagtggcccacccatcgaggccacttggtggtgactcgtcccccatgtagactgttcaacattacttacttgagtccccaaatcatagtcattcccagttgaaagcttcaacgaaaagtcggacaaggggttaccccctcctccaccgggcatcgaaatggacaggctggtggcagcattgtcaccttcttgaagttgttgttgtctaggccaatcatcaaagaaatggcgtaggatttggccactagatgatttaccatcaccaatagatacatctttttggagtacttcttgtggtggacccttaattggcctttgattgagatgaaaaggtgcattagtggaaggtgaatgcccagatagagaaaactgaggagcaccagcagcagcatgtccaagcatttttccaaaggcttgatgatgagaaacagtatggtgggggttttaactggccattgtgtggcaggtgtgggaatttccacag

SEQ ID NO: 14739 - DNA, 740 bp, Solanum tuberosum
  Predicted polypeptide sequence is orthologous to G1868
gcccaaacacatttcatatcatataactaaaacaacaaaagaaagaaaaaaaaaaacatgggtccttcctcctcttccaacaacaaattctgtctctttctttcagtttcttgctattaagtgaccccttcttcataaaagggtaaaactttagtttcttgatttttattttcttgtttgatggattttgggggtttggatagtggggggggtggggtgatttgttcaaacaatactagtagtactatgtttgttgcctcagctgagacaaagcagaaatggtatggatctggtggatttaataaacatgaaaggtcctctgttactgaagatgaatggaataaggagagtaaattagcaaagacaagtgatgatttttcatcttctaaagctactatgatgtttcagcaacttccaatttctcatgagaatcagcaaatgcttagcttttctacacccaactctcaaaatcatgtcacaatgccttattataatcaacacccttcaagtgcttttgctagaaacacttcaggctatggcagtggagctttgagtgctggaaatatgcatgggttaatagcaggggtgaaagggccattcactccatcacaatggatggagctggaacatcaggccttgatctacaagtacatcactgcaaatgttccaatacccccctatctcctccatcctataagaaagctcttgaatctgctggttcaccacttttgcaagcctta

SEQ ID NO: 14740 - DNA, 778 bp, Solanum tuberosum
  Predicted polypeptide sequence is orthologous to G1868
gccagggccgaattcggattagtttgtgcagactctttgatcaatcccttgaataaaaactcttcgctagttaactgccgtggctatgtcaattcagatgtcagagatcaagaaaggaaatcacagcatcatccacttcggcagttcatggacgagttgcccaaaacccaatctgatcaatccaatgtttcatggccagacattgatttgcagtcagatccaactcagctctccatttctatccctttagtcacatcagacttcatgtcttcgacttcctctcctgcgaatgacaagctcacagcctcaccacataggtctcgggagcatgaagcaattcaaatgggactaggcattggtaccatcatcagtgaacataaccaaagacaaggaagttggattcctatatcatgggaatcttccttgggtggacctcttggagaggtcttgcatagcactaatagcagctcaggcgatagcaagaacaagtcagctcttaatctcatgaccgaaggatgggatagaagccctcggatgggatcatcaccaaccggagtcttacaaaagtcctccttcggttccctttccaacagcagtgcagggagcagtcctagagcagaacacagtaagacaacgaacgaaggctccagtctttgtaatggccttcttggaaacactcttatgaatccaccctacccctgcatgtatatgtaaaactaggaatatgctattttgtaaactcagaagtgagccatttcccttttttcccttaatgctc

SEQ ID NO: 14741 - DNA, 697 bp, Solanum tuberosum
  Predicted polypeptide sequence is orthologous to G1880
gtaaatatcttgctacatctgattagtttcaaaaaaatattttattacaagatcaaaactatttttggataaaagttgttttctacgctatcttttactttgggtatttttgaccaagaaaaagagtgttttcaactcatgagatcaccttccaaatttcaaatttaagaaatttacatgtttatattactactcttgtattttcaaaaatctatattttaacacttagcctaattaataaatttaagttcggcaggttaaccatgtttaatggatcttaaaggatgcctaaccccttccctttagattaattgaatccttacctagaatctcatgtttagtagaccttaaaatgaagtttaactttagacaataactttaatcatgtaggtgtcctaattcactgtaataattaggtggcgacttcttaagttagttaataatttagaaatcaccaaaatgttgtacactatttttgacccggttaaaatggggtataacagaaattaatcacaagataaggatcactgtaaattttgaatttgtttatatcaagcagggctaacaattttttttttacttgttaacatgctaagctttcacttaacttcagattagtaatggcttggcaagttagtctcaagtgtattgaaatactcgcatattatattgataagaaagtagaaacttttgactt

SEQ ID NO: 14742 - DNA, 827 bp, Solanum tuberosum
  Predicted polypeptide sequence is orthologous to G1893
gtactttatcatcaaacttgcgtttcccgtatttctgcaacccgtaaatcgtatttccgcttgtattccagtgtatacagcaggtatattggcctgttttcaggcttttcgggatctgaaaaattttgatttccggcctttatcagcttcccagcagtttggacaagatgaggttgacttgaagaaaatcaactcgaggaaatgcacggaatgagtccaaggtggactcgggttcgtatcacatgtaaacaaaataagaggtaaagattaataactcaccagtgccccccacaaatccaaaaatatagaatattaataatagagatttgaaactaaatagtcattaattagaccacaactaaagcatatcacatcaaattgaaggtagaagaaaggtttccacagacattagtcttcttattctaagcgaaacaaaactcaaatcgaaaataataatatgaacagacaatagagagaaatatgatgcctttgggtaatgaaaaaaaaaaaaggagataaaaggaaatcaagcatttaagggaaacaagtaatacggtatgcataatttgggactcttctaattgtaatttatcataatcatgtattcaaaatgagcacatggacttatatttcaaagtaaaggtttaaaaaaatatccacatgatcttaatggtaaagcagtcaattagtttcaactaacattagcacactaatatcattatcctttgatttttattttcttttagaaaaataaaaaatctactatacacatgcttttgtactaaccatactatccatctttcgaccttagacttattttgaagaga

SEQ ID NO: 14743 - DNA, 826 bp, Solanum tuberosum
  Predicted polypeptide sequence is orthologous to G1902
ttcaaatttcaaatctatttataccctgtgtcctcttttttctcgattttctgaaagatttcaactcaatttggtggaaaattggaggtatagatcttcagaaatcttgttttcatatattcaggaaattttaatagcgccttctaaagaagttgttttcgtttgaaaaatatctattcctttttgtcctctttttagtttcacctttgctgtttcgccacttctcagaaacccataaaggccagaaaaatcactctttaacaacaaatttggtttcaattctactatacccttatcatttttaaggtcaaaattcactatactcctttttcatcattgaatcaatatgcaagacccatcaatttattcacaaattaagcctcaattcccagagcaagaacacttgaaatgccccagatgcgattcaccaaacacaaaattctgctactacaacaattacaacctttctcagccacgccactattgcaaaagctgtagaaggtattggactaaaggcggtactcttcgtacatcccagttggtggaggctctcgtaagagcacgaaacgatcttcatcatccagtaaaaaaagttcatcaactacaacctcatcccctgcaactcctccattaacatccccttcttcatccacaaatccaaaaccagagccattcggtatatctgcaattccatcttttgatgtgatgactactgggccattcagctcactgttagcgtcaaccgagcccgcatttgggaatttttctcgagctttgatccccataataacagttgggtaacccaatttcagttcggccttggttc

SEQ ID NO: 14744 - DNA, 779 bp, Solanum tuberosum
  Predicted polypeptide sequence is orthologous to G1927, G2184
tcattgattctggcaagatgccaaatgatagaacatcaacttttctttgctttatttaagagtatatgagtctcctcaagatgtcgacaaatgttcctactaacacacataagattgcacacagtattccaagaaaagaaaaataaaaaagcccattcttagagtggcgcgaacttcttgaagttgctgtattacctgctgccacaacattcatgttcctggagtttattctcatcttactaaagctagacacgcgcttaaaggcactattaaccactggactttcagcagctatagcaggagaagtaggtatagaatccacgaaggcccacaactgagaggtcaaccatgatggtgtaccatcatcttgattgggtagttgattttgatttgcgcccataggatgatttgccaaaatactatcatatacaacacctaaaacattgccaaaactttaaaaaattaggaaaaaaaaaatctaacaccaatatattagcagcagcagagctcttgctggctcaaactcccccatttccacttgggcaatagagttctcgccatgctgaagatgacatggttattcttataccatcatctgaagtagctggaggaacaaccaactgatttgcctcgctggggttaaaagatgtgaacctttgatcgtgtgtccacagttgattgctagtctgttctccctcattcaatacactagctgggtggtcatcattcatgctgaaaatgcttatatacggtgtagaagcagggtttcagaacaatca

SEQ ID NO: 14745 - DNA, 1015 bp, Solanum tuberosum
  Predicted polypeptide sequence is orthologous to G1927, G2184
ctgggttgatgatgagtgcctaaatgccaaagtccctgtacagccggagagcccgagacatcaagagagttctgcaaagaacattaatgtagttcctgctcctgatgatgcaattgaggaattgctgaagcgtccttttactgttgataacaattttgcgttggagcagtttgttcaagaggaagatactgaaagtaccttgctaaatcagtcttcgagggaagttgatttatacaatcattgtgctgtcgctgggccaagctgccagcagtataatgcgagggtaagctttgacctgacagagtcaggcacatcaccattacatttgcacgaggtaccagaggtctcatctgctccggtgaatcctgtaaagcccccatatgtggtggaagaggatttcttggaagattttttggagatggatgacctccttgttgccgaaccaaatgttcaaaactttgatcatgaaacaccaaatggtcaagtctttgacaatcctgctggaaacctggagactctgcagtttgatgactttgatggcttatcagagttcgacctgtatcatgatgcaccttcacgtcttgataatgtggggacaccaacagtggggcaaattgctgaaccatacatgaacaactttgtgaacgggatataccctgattccactacatacatgagcactttccagaatgatatgatgaacaaccagcagatgcgcttgaatcatgaaaatcagataaacaatcaattctggatgcatgatgaaagattcgacgtcttcaaccccattgaaggagatcaatcagttgttgatcaagcatcttcaggtgtggtaaatgataataatatggcaaattatcctatgggcgctaatcaaaatctagccaaaaaggatgatggtacgcagtcgtggttctcctctaatttgtgggctttcgtggattctatacccacaactcctgcttcagctgctgaaagtgctctagtagttaacagggccttttgagcgtatgtc

SEQ ID NO: 14746 - DNA, 842 bp, Solanum tuberosum
  Predicted polypeptide sequence is orthologous to G1927, G2184
ccaattcttagagttgccccttctcaattttgtctgctagggtttcaattttttctataattacagcttcagattcattgattaaggggatattctattgatttttgaagtgggtgttgagattattttgtggttgtgaagaaagatgaagcttttgatggattcatcagcaccatcatcatcatcatcgccatgtaaagagatgaaggtatcggagtgttttggagaaaatagtgttttcccacctgggtttaggtttcatccgacagacgaggagcttgttctgtactacttgaagaggaagatctgtcggcgccggattttgcttgatgcgattgcggagactgatgtgtacaagtgggagccagaggatttgcctgatttgtccaagttaaaaactggggacaggcagtggttcttctttagtcccagagatcgaaaatatcccaatggagcacggtcaaacagggcatcaaagcacgggtattggaaagctactggaaaagatcgtattattacatgcaactctcgtgctgttggagtgaagaagacgctggtcttttataaagggcgagcgccagtaggtgaacggacagattgggtgatgcatgaatacaccatggatgaagaagagctgaagagatgccaaaatgcacaggactactatgcactttacaaggtcttcaagaagagtgggcctggccccaagaatggtgagcaatatggtgcaccttttagagaagaggactgggttgatgatgagtgcctaaatgccaaagtccctgtacagccggagagcccgagacatcaagagagttctgcaaagaacattaatgtagttc

SEQ ID NO: 14747 - DNA, 912 bp, Solanum tuberosum
  misc_feature (123)..(123): n is a, c, g, or t
  Predicted polypeptide sequence is orthologous to G1927, G2184
atctgccggaagaggattctgcttgatgccattgctgtcactgatgtttacaaatgggaaccggaggacttgcctgatctatctaagttgaaaactggggaccggcagtggttcttctttagntcccagagatcgaaagtatcctaatggagcacgggcaaacaggggaacgaagcgtgggcactggaaagttactggaaaggatcgaactattacgtgcaactctcgtgctgttggagttaagaagaccctagtcttttataaaggccgagcaccagtaggtgaacggacagactgggtgatgcatgagtatactatggatgaagaagagctgaaaaaatgtcaaaatgcccaggactactatgcgctttacaaggtatttaagaagagtggctccgggcctaagaatggtgagcagtatggtgcaccttttagagaagaggagtgggctgatgatgaatgtccaagtgccaaaggctttgtccatcaggatgctcctcctgtggatggtggaattgaggagctgttgaaccctgtgcgtatggagccactttctgtagattatgattatgcactggagcagcttgtacatgaggaggatactcgaagtaccttgctagatcatttggcaaaggaagttaattttccccaccacagtgcagtgattgccccagcaaaggaaagctttgacttgacacaagtcaggcacatcacagctacagttacatgagggtaacagaaggtcacatctgctcccggttatttatgagcagcagcacatgtggttggaagaggatttcccgtgaaagaattttctgggagaatgaatgatcttcccttgcgtccggaagccaaagcattcgaacctttgattaccttggagcgggttgtttgaaaacttttgattaaggc

SEQ ID NO: 14748 - DNA, 779 bp, Solanum tuberosum
  Predicted polypeptide sequence is orthologous to G1928
cttcccagttctagctagctatctctttattctgagaaaaaaaaagcatactagtaatacagatctaacaattacagacataattgatcagaaaggggagaaaaagaacctgcattttgcggtaaaattgtacttaactttgccatgttttgtgattttgcgattgattttcgttcggagtgctattagctagaccagctatgttgaaaatgtcgctatgagaaagaggtcttaatcctaagaaatctttggtcatatcatcgttaccaccgccattttcgtttttcggattcaaaatgctaaatggatcgtcgaaattcgatccttcaaatcctgtaggattaacggatgagtacgaattcatcatatcctgaagagaaggagtgggatgaggtgcagttgataatgggattgtaacaggagcaataacagcagagggattagcagctttattcccatatgaagccaagctattgaaaaaaccagtggtgaggtcttcacgtgaagacaaattgagtccaaaatctgttgtgttgctaacagacacagcagcagtagcagtagcagacacgtgaatttggtggggtctcatcagcatggctgggtctgggcctgatgaaactgcagaaacagtactcgctttgttactcatggtcgcacccatctgagctgccttctgcaacaacgcagttgcagaaatatgtggagaggccattgctccagatgtaagtccggatagactaggggtaggggtcataaagccgccttgttgggtgtgg

SEQ ID NO: 14749 - DNA, 1699 bp, Solanum tuberosum
  Predicted polypeptide sequence is orthologous to G1928
ctgatgccatagtcaagaagaaatattgaagctaattttaagaaaagagtcaacaaacataacatgtccattgtaacttgtgaaaaagctgctgcaagtttatcttcttcttccaacatgaataatgatactaatggagccttttgctatacacctcaacatcaattagttactccacaatatcaaaatccacctcaacaaatcaagaaaaagagaaaccaaccaggcaatccagatccagaagcagaagtgatagctttatcacccaagacactagtggcagccaacagattcttttgtgaaatttgtaacaaagggtttcaaagagaccaaaatctacaactccatagaagaggacacaatttgccatggaagttaaagaagagagaaaataaggaagtagtgaggaagaaagtgtatatttgtccagagtcgagctgtgtgcaccatgacccgtctagggcattaggagatcttactggaattaagaagcattttagcagaaaacatggtgagaagaagtggaaatgtgagaaatgttcaaagcgttatgctgttcaatctgattgcaaagctcatttcaagacttgtggtaccagagaatacaaatgtgaatgtggtactattttttcaagacgagatagtttcatcacacacagagccttctgcgagactttagctatggagagtgcaagatcagtaataaatggacgaaatccaacaattttctcacctcaattgaatctccagtttcaacaacctcacttctttaatagccatgaacagattcaagctactacgtttcccatgaaaaaagagcagcaaagtagtgatttcagacatattgagattcctccatggctaattaccactaattcccaaccatttcagcttggagctattaatcatggtccttcaccacgcagtaattttagctcatcgtcgatttttccagctactactaggttagatcaacaatacacacagagcggccacaaagatttaaatcttcatcacccaaaccctaatctcagaggacctacattaggttacgattcaacgggagaatcaggtgcggtctctccagtacacatttctgcaactcgattgctgcagaaagcagcacagtttggtgctacaattagtaacaaagcaagtgctgtcactgctactgctgcttacacaggcacagtaaaaataccccacaatactcacgtgtctgttactagtactgattctgctaccaaacaaactcatcagaaattgtcctcacgtgaagacctgaccagtattactgggcctgcaaatataagtggcatcatgacatctttttctaatggctttgatgggtcaacaatgtttgaagatgcgatattatttggtggattcaacaatttgaattcaaagaaagaggacgaggaggaggatcaacaactctacttcaatggaagtatgaatgaggaggatcatatattgaccaaagatttcttgggtttaaaacctctctctcatactgatgacattttcaacattgcggctcttgttaatactgaacctcatcactttaaaaatcataaaacttggcaaagttaattataatcatctctttttattgtacacctctagctagatatatatagctagaaactgatatatgtattgtacaaaagtgcatgtagaactgggtgaaagttcagat

SEQ ID NO: 14750 - DNA, 791 bp, Solanum tuberosum
  Predicted polypeptide sequence is orthologous to G1928
ggatcaacgaggagcaattcggccctctttggtgctggattcgggctaatgggctcgtctttttctaaaaccaatggacaaggacaatttgctgctcatgatcagaattttaacggcttaatgatgaactctccatcaacagctacgaataatattagtaatcaaggaaataggctgttgttcggggatatgaattcgagttcattagaaggtaatgcaagtggaaagaactcagatccttacaatttgatgccgcgtaacaacaaaggaaaacaagtgaatcttagtggaaatgaagcaattgaaggaggtttaacaagagattttctcggggtaggagggaatgaaagtaggccttttctatcgaaaaatgagctagccaagttcggtaacatttctggttcagccatgggattaagcgactatagtggaagtcattgactctgagtttttcactcaaaatatatacaacacatatgcacaaaaaagttatgtgtgctgcacacacattctaaagtgaattactcaaaaggtccaaacttgtggggatatgttatttcactatagtggaatgatacaatgttcagagtgtggagaaaaatagaagttggaagaaggccaaaagcttcaatgttcatgagagaagagagagaaagcagcagcaattttgagagatcttgtgaattgtcagagaaaaaaagggtggggaccacttgaatgttggcagagacttgttacaagggacttgacaatcacaagtcaagccttttttttgctccaatggttactta

SEQ ID NO: 14751 - DNA, 713 bp, Solanum tuberosum
  Predicted polypeptide sequence is orthologous to G1928
actcccttccaaagcaccttgatgataatgacacaaaacaacaacaaaatataatactaagtatatattgttgtctaaataaaattcagaaatcatagtacaactaattttgccagggtgattgattttgattctgatgatgatgatgttgatcaaatgaagcaagagcatcagaagaagaagaacccatgtaatgaagagcagcaggtgtagtagtagtattgagaaaatccctgtgatgtggaaatgctctaagacccaaaaaatctcttgtcaacccttcattattttctttaccttgtctcatcaaatgtgcgccgcgaccaaatccttcatcaaaactagtacatggcaaagaaggcgcagtagtagccatcatgttttgcatgtcatggacttgttccatgaacccaggggtgacactcgcaccaaaatcatgaaaagacgtactaccagcagtaacaaaatcagtattattattattattatgtggttcaaacggatgatattcacatgacgctatatcaccaccagctcctcttcctgctcctgctcctgctcctgacattgtcatgccagttgttggactgaaaaaagtgtactcgctcatgttattagcagcatgagaagaagaagttactccaatttgtgctgctttttgtagccagtgcagttgcgctcatgtgcaggaggtgcctcggtgcccgaattcc

SEQ ID NO: 14752 - DNA, 850 bp, Solanum tuberosum
  Predicted polypeptide sequence is orthologous to G1932
aacacaacactcatacactttctctctctaaattccccccatttccatggcttcaactcgtgagggtcactacagaggagtgagaaagcgtccctggggccgttacgccgcagagattcgcgacccatggaagaaaacacgtgtttggttaggcactttcgacactcccgaagaagctgcactcgcttacgacggcgccgcccgttcactccgcggcgctaaagccaaaaccaacttccctcctcctcctcctcctccgcctccttcttccgttcctcttccaatcgacctcaaccttccatctgatcaccggtggacttcgccctccggacgtagactcatgattggggagtttctacaagtaggtccgccgccggaactgaacttgccggtcaccagcgccgcgccggcgaaggaaaatgacggtggagctgcggctatgtattttgggatcgtgagacgtgggttgcctattgacttgaacgaaccgccgccgttgtggatgtgaggcggcagcggataattaatgacttggtaaaattacttttttcgttttttacatttttgtcattctctctattttcaagcttttgggagaaaggtaattcctatgactatgaagaatccttgagatattattgttatcaggaggaagcatcattatgtaaataccttttttattttaatgttaatcccaattctctatctttttgcttatcataaaactgaagagagtttgtgtactttatggtatataataatatagtgtaatattttgtgaaaagagttattgaacatccacgatccattctagatccgtacctgagatcattccacgtgtgaaaatata

SEQ ID NO: 14753 - DNA, 928 bp, Solanum tuberosum
  Predicted polypeptide sequence is orthologous to G1938
gatcaagcaacctaacaacaacaatattaagcctactcatgatcagataaaagacttgcagattttgaaaaatgatgaaaccaagaaacagcagcaggtggctgctcctaaaagaaaagataggcataccaaagttgaaggtagagggaggaggatacgtatgcctgctctatgtgcagcaagaatctttcaacttacgcgcgaattgggtcataaatctgatggtgagacaattcagtggctgctgcagcaagccgagccttcgattattgctgctactggcacagggacaattcctgcatcggctttagctgcagcagcatctgtttctcaacaggggatctctgtatcagctggtttaatgattgaatcgggggcgaatatcgcggggtcaggtagcagtagaagtagtaatagtaggaccaattggccaatgatctgtgggaattttggaagaccccatttggctacagtaggaatatggcctgcccctgcccctgttgtcactagttttgggtttcagtcctcatctgctccatcaagcgccagtttagacagtgaaagttcaaactattacttacagaaaattgggtttcctggatttgatctgcctgcagctacaaatatgaatcctatgagttttacttcaattcttggtggaagtaaccagcaactgccaggattggagcttggattatctcaagagggtcatttaggggttttgaaccagatataccagcaggaaagaatgcaacatccgcagcagcaacaacaagatcagcatcagcatcagcatcaacaacaatctccggaggatgattctcaaggatcaggacattaaagcatccttcagataaaagacctgagttaggttattttggtgaatgagttttcatttgttaggaggtgtattgatttatagttaaaa

SEQ ID NO: 14754 - DNA, 936 bp, Solanum tuberosum
  Predicted polypeptide sequence is orthologous to G1946
cttcttccaattttccgtttctaatctccaaaaccctctgtatttgtaaattcatatatgatcagcgttgtgttaagcaattgaaaatttaattacttcgtttagcaatgggttctacttcaatggacgccggaggaagttctccggtaccggaaccaacaccagcgccgatggctagcgcaaatacgctaccaccttttttgatgaagacttatgatatggttgatgacccgagtactgacaagatcgtttcatggagtcctaccgacagtagctttgtgatttgggatccaccggagttcgccaaggagttactgcctaagtatttcaagcacagtaacttctccagcttcgttcgtcagctgaacacttatggctttagaaaggttggttcggaccactggaaattttctaatgatggattcataagaggtcaaaagcatctgcttaaaaatattagcaggcgcaagcctgctcatggacagagtcagcagcagcagccgcagcagccgcagcagcagcaactgcatggtcagagtgcgtcggttggggcttgtgttgaggttggaaattttgggcttgagaaagaggttgagtggctgaagagggacaagaatgtgcttatgcaggagctggttaagctgagacaacatcagcagactaccgataatcagatgcaaaccatggtgcagaaccttcagatgatggagcagcggcagcaacagatgatgtctttcctggcaaaagctgttaacagccctggattcttggcacagtttgtacagcagcaaaatgacaacaataagcgcaagatggaaggaaacaagaaacgcaggattagaccagatattccttcagatgatcattctgttagccctgctgatggacagcttgtgaagtaccaacctataatgaatgaggcagcgaaaggaatgc

SEQ ID NO: 14755 - DNA, 952 bp, Solanum tuberosum
  Predicted polypeptide sequence is orthologous to G1946
cactcacttgcactttctctctctaacaacttagggttttttctcaacctccgtccatggatgacattccaaattcaattgacgcatagcatatatatatgtagtgtatttatcgtcggagtttgatttcattcgacccgacccgacttgttccggtttgaggcagagttatcgtgaatggagccgaattcttctggcagtgggaaggctgctgtcggtgacggaggaggaggaggaggagctccaatgttacagccggcgccggcgccgatgcccagtgcaaatgcgccgccgccgtttctggtgaagacgtatgatatggtggatgatccgagtacggataagatcgtgtcgtggagtcctacgaataatagttttgtggtttgggatcctccggagtttgctaaagacctacttccgaagtactttaagcataataacttctccagctttgttcggcagctgaatacttatggttttagaaaggttgatccagaccgctgggaatttgctaatgagggattcttaagaggtcagaagcacctgcttaaaagtataagtcggcgtaaacctgctcatggacatgctcaacaacagcagcagcaacatggacatgctcaacaacagacgcagccacctggacacagtgcatctgttggggcttgtgtcgaggttggaaaatttgggcttgaagaagaggttgagaggctgaaaagggacaagaacgtgcttatgcaagagctggttaggctcagacaacagcagcaaaccactgacaatcagttgcaagggatggtgcagcgccttcagggtatggagcagcgacaacaacagatgatgtcattcctggccaaagccgttaacagccctggattcttggcacagtttgtacagcagcaaaatgagagtaataagcgaatagctgaaggcagcaagaaacgaaggattaagc

SEQ ID NO: 14756 - DNA, 1200 bp, Solanum tuberosum
  Predicted polypeptide sequence is orthologous to G1946
ttttttttttagatcacgtacagtgttcttttctataaagaaacatagatcaagtacagtgttcttttctatttcaactatgcatactgagttacaatattcacgagtttaaaaatgaaaggaagattcaacaatagatcttcgcaatttgtataagcgggttgggctcccttcagaaatttactatgccccagctgttcagtaagtatatccatattacttaagttgtctgactgagtctccagcaaagccatttccatctttttatcttccagactatgaaatggttcctctgaacctgaaaaagttccagactctattcgctggaatgacaagtcagtctccatgacagcatgggagcaagcttgatttatctatcacttcgccttctttattctctgttattggactggacaaaagcagctgttccaacaagttctcatcatcaggataatatggcaaagtaagagggaccctattttcaaaagcaagcagcttttcatccattaatcctgagaagaaatctattattggaaaacatatcttttaattcattggaagaaaaatcgagctccataggtttctgagaatccaaagcaggttcaggttcagcgcatagggggggctctgcagcttcttcatggagtgggaggatgatacctcacaattgcctcgatcggaatggtgtatctacgcaatcatcttcaactttcactcagttatattattaccattttcactcataacaaccaactgttttccttgggctggaaaaacttggaccaaaaaaacttgcggctttgcatgagacataacattggagggaaagctcttgtgtgattttctccctgtaatttaagttggtcccgtaagaaatatcaacttacatccctggaaattctggctggtggtcccttaaagctggataaatcctgggtgagaacacttctttccatcctttaagatatttactttctttccgcggttcagaatctttactttttcagatttcagagattgactccccccaggggatgttctttgggccacagggctggtctctaacaattatctttagaaagggtttttggctgtaaaaacttacttcaaaaaccctgtctgttgttgtttggaccaacatttgttgtcacacacgcaaattgtgtgttttagaccaaagatagacccttatgtttttat

SEQ ID NO: 14757 - DNA, 1034 bp, Solanum tuberosum
  Predicted polypeptide sequence is orthologous to G1948
gaagtgaatagatacactatcttatcctaaaggcatccttctcataggattatggagatgttcatggccattcaaaagaaagagcgccagaacatctccttcccacttctcccatggatgctctctttgtcaattcatctctctcccgactcaaactcaaattctcttctcaattccctaccttctctcccctgccccatcagtcttatctcccacttaaaaaactgaatagtagtaataatttaccacttgtatttgccacgcttcagaaccagcagcaacaagcagcagcagtagcagaagaaggacgagaagaatttgaagattacgatgccgacgaaacgtatggagaagttaacaaaatcattgggagtcgagcaattgaaggtgggaaaggaatggagtatttgattgagtggaaagatgaacatgcccctacctgggttccctctaatttcatcgctcaagacgttgtcgctgagtacgaaaccccttggtggaacgcggcgaaaaagcccgacgaatcggctcttcggcaacttatcgaagctgaggacggcagggatgtggatgctgttgatgacgatggacgaacggctttgctctttgtatcgggactcgggtcggagccttgcgtcaagctgcttgctgaagccggcgccgacgtcaattaccgcgataggagcggcgggttgacggctctgcatatggctgccggctatgtgaagcctggggtcgctaagctgttaattgagctcggcgcagaccccgaggtgcaggattacagagggcagacgccgctgagcttagcgaggatggtcttgaatcaaacacctaaaggaaacccaatgcaattcgcgaggagattgggattagagaatgttattagggtattggaggatgcaatttttgagtatgcacaagtggaggagatattggagaagagagggaaaggtgaaaatgttgagtatttagtgaaatggaaggatggggaggataattgaatgggtcaaagcatggctgatatctgaagg

SEQ ID NO: 14758 - DNA, 246 bp, Solanum tuberosum
  Predicted polypeptide sequence is orthologous to G1950
gctctctccgtaacgaagatgctcgttctctccttcacgtcgccgtctcttccggacacactgaggtctttcaatctcacctcaatttcagttttttaagggcttccgagccccctttggcgaaaaattatattgtaaatacaacgtcaaaattatttattatgtatatatagtagatattgaatctcgtctgtgtatttagttcttcatgtttttgaacacctttatgcaaatactggttcggct

SEQ ID NO: 14759 - DNA, 653 bp, Solanum tuberosum
  Predicted polypeptide sequence is orthologous to G1950
gttgagagaggatttgttgatattgcatgggcacttgtagatgctgctgctgatccttcaattccggacgaaaactctctcacaccacttcataaagctgttaaactgcgcaatcacgacatggtggataccttactatcggtcaacaccgaaactgaagaatggaccaaagttaacgccaaaacaagcgaaggtgccactccactttattttgcttgccaccttggtgatatccgcttggtgaaatctctggtggagtttggagcaaatgtcaaccttgcttccaatgagggggtgactccactacatcgtgctgttgctggtggtcacttagaggtggtacagtttctcatagagaatagtgcaaatgtgtctgctgaagactctgcccgccgcacttctgttcatcttgctatccaagcaggatccaacgaaattctttctgctttacttaaacacaaacctcgcatcgagggtgattcccctttgatgactggccttctaaaacgcgctaaacagcgtcaatttgccgcaatcgttcagttagttcatgaatactgtggtttagaccaataacacgttcatttcaaaataccgaaacttgtacattatcaacccgagaaatttgtaataaacattgccattttttgtcc

SEQ ID NO: 14760 - DNA, 716 bp, Solanum tuberosum
  Predicted polypeptide sequence is orthologous to G1950
gctactaacactctaccgtccgtacaaatcccggcgaaaatggaatcggaaaaatcctcagctcaaatcaaagacaaagatttgttcaaagctgctgaatctggtgattcatcgctcttcaaatcacttcccgaagaacagctcctcaaatccctctctctccgtaatgaagatgctcgttctctccttcacgtcgccgtctcttctggacacactgaggtggtgaagatacttgcagctgctgatccctcagtgagtggtataaatagtggtgatgaagaaggttgggtgccgttgcactctgcagcaagcagtggtaatgtggaaattgtggagattttgcttagcagaggggctgatgtaaatctgaaaaatgatggtggccgcactgctcttcattatgctgctagcaagggtcgagcgaaaatagctgaacttttgatttcacatggtgctaagatcaatgcaaaagacaaggtaggatgcaccccattgcatcgtgcagctagcactgggaactctcagctgtgcgaactattaattgaggaaggcgctgaagttgatgaagttgacaaggcaggggaaacacctttgatgactgctgttgtatgtggcaataaagaagtagctttgctcctcataagacatggagcagatgttgacgttgaggacaagaagggtacactggtcttggtcgagcttctaatgatctctcg

SEQ ID NO: 14761 - DNA, 951 bp, Solanum tuberosum
  Predicted polypeptide sequence is orthologous to G1958
gtcggtcatttgttttcctcaccatcggagttctcgaccaatcttgacttttcatctgttctgccttatgatgagcatttggcacctacaactttcatttctcagccaacaattaatgaggcatcaattccattagctaattctggagttcttcaaggtgctgcatcaagccagtatgttaatgtaaatagtgaatcctggcgtacagagttattgcctaattaccttgattactcggtaaatgcccctgtccagaacactcagcttgattgtagaaattcaggtgattgtcacatcccacctgaggatcttagtaaacaaagtgattggccggaatgggctgaccttgtaatgaatgatgatgatgctttgacttctaactggatggttgatactagcattgctgatgcagaaccaaagatgcaatatcaggaacaaaatcaaccttcaaatttcccagtacaccaagttcaaccattccagcaaattcctactgcatctgtagaaacatctgctgttgttcctgcatcatccactgggagtggttcttcatcgaaacaacggatgcgttggacaccagaacttcatgaagcctttgtggaagcagtcaacaagcttggtggaagtgaaagagctactcccaagggtgtgcttaagttaatgaaagttgaaagtttgaccatctatcatgtaaaaagtcacttgcagaaatatcgaacagctagatataaaccagaagcatcagagggttcctctgagaagaaagagtcatccattggcgatttgtcagctctggacttaaaaacgggtattgagatcactgaagcgttgcggttacagatgggagttcagaaacagctgcatgaacagcttgagatccaaagaaatttgcagctgcgaatagaagaaacaggacgatgcctccaaatgatgtttgagaagcagtgcaag

SEQ ID NO: 14762 - DNA, 933 bp, Solanum tuberosum
  Predicted polypeptide sequence is orthologous to G1958
gatgcaatatttcttgttgatatcaatcctccagacactaagtttctgggagcatctgaagtccatgctggccagtccgatactcttcctcctcctcttcctgctgctgctgcatcgtgtgggcaaagttgcccagttggtagcccatcgtctaccgcagcactgacgaagcctcgcatgcgatggacacccgagcttcacgaagtctttgtagaagctatcagtaagcttggtgggagcgaaaaagctacaccaaagggagtgttgaagctcatgaatgttgaaggcctaaccatctatcatgtcaaaagccacttacagaaatatagaactgccagatacagaccagaaccctcggaaggaacaccggaaaagaagaccaccagtgtgacagagatgccatctttggacctgaaaacgaccatggggataacagaagcactaagaatgcaaatggaagtccaaaagcagcttcatgaacaacttgagatccagagaaagttgcagttgcggatcgaagaacaaggtaaataccttgaaatgatgtttgagaagacaaaggacatggggaaagatttaaaggtatcatcatcatcaagaacagatgaacatccttcaccatccaacaagacgaagcatacatctcccaacgacagatcagaagcactcgagaaagatcctgtgagtttgaacgatcgttcaagttctggagggaactcaccaaacaagaaagctcgtcaagatcatgaatcagatgatagagacttgtgttgttcacctccatcgaagcgagcaaaaacagaggaaacatcaggtcttcatgaatcttgacactcatttgatatgtgaattgtctttacaaatgctgtttgacttgatgaaagcttttagttaatagttgtgtgattttttcttgtccattctcttttcccc

SEQ ID NO: 14763 - DNA, 953 bp, Solanum tuberosum
  Predicted polypeptide sequence is orthologous to G1958
cagctaattaatgatgatgacactctcggtcttggttcagctggagtgatatcctagtagatgtcaattttcctgatccagaacctaagcaactgggagattctgagatcacttctaaccagctgcaacctcctcctcctacttcatctgggcaaagctgccccattggtagcccatcatctgccacatctaagcctcgaatgcggtggacaccagagcttcatgaagtcttcgtagaagctgtaaataagcttggtggaagcgaaaaagctactccaaagggtgtcttaaagctcatgaatgtgaaaagcttaaccatctatcatgttaaaagccacttgcagaaatataggactgccagatacaaaccagaaccctctgaaggaacttcagaaaagaagccaactatcatcacagagatgccatctctggacttaaaaactactttggaatctgattacaggactacagggataacagaagcactgaaaatgcagatggaagtgcagaaacagcttcatgaacaacttgagatccaaagaaagttacagttgcggattgaagaacaagggaaataccttcaaatgatgtttgagaaaacaaaaaacatgggaaaagaactaaatgtatcatcatcaaaatcagatgaacctgcttcaccatccactgaaataaagcatgcccctcctgatgacaaatcagatgcaccggagcaggatcatgtcagcattgaacttagttcaaatgttgcttcaagctctgcagatgatctcactgagaataaggaacgaaaatcacccgaaaggaaagcttgtgagaatcatgacttagatggtagagacttaagttcccctccagcaaaacgtgcaaaatcggaggaaacatcaccttcgtgaccttgacacactttttgtaacttcgtagaaggaatagtttgcatgtgaaatgtggtg

SEQ ID NO: 14764 - DNA, 798 bp, Solanum tuberosum
  misc_feature (523)..(523): n is a, c, g, or t
  Predicted polypeptide sequence is orthologous to G2011
ttccagaaaaccatacaagaatcaaaaaaaaaaaaaaaaaaattaaaaaaattaaaatggagcttcaagagaaaaactccaccgactttacacagttgttttcaggagatatttcttggtttgtatgtcggcgttacctatataaacctcccttaaacccccttttaccggcttattatcaaacacccttttcgaaattttcaatcttttgatccaaaaaaactataaagtttcaatctttgatccataaaaccacaaatctctttgtatcatatgaacccatttgataaaaaacaagaatctgatactaatacaaaaaccccctttttgactgaaatggactctgaatttgctgcgttttcaccaatttcactcccttttgctgacccatcttctccttttatcaattttggatcttttgccactcctttgagccaacacccagttggagatggagatggagatggagaaggagaaggaggagaaattgaacagccagctgaggaaggattgggtgtgccanaccctatggagtgtttacatgggatacaaattccgccatttttgtcaaagactttcgatttggttgaggaccctttattggattcgattatttcttggggtagaaatggagaaagctttgtagtttgggatccaagtggagttttcaagattggttcttcctaggaatctcaagcacagcaatttctccagcttggtccgacaggttaatacatatgtggggtataaattttagcacacttggcaattttcttcggctactgtgttaaactctct

SEQ ID NO: 14765 - DNA, 820 bp, Solanum tuberosum
  Predicted polypeptide sequence is orthologous to G2011
ttttttttttttcttttcagtcgaaagtaattatcaactaaaatatttataatcactcattcaatattatgtcccatcaactaaatgatggctagtatcccaatggcacactgaaggcccaagggtactctttcctaaaaactatcattcttgggctggttggcatggctttcagactgaccaaaaggagacccatcagctggccacttatcaaccccagaacttccagctgcctgcaagggatctatatcccacaaatctgacaaaccagagctaacaccgaagtctgggacatagctgctaaaactatcccataactcggcgccagcacttggcatgccagcactggcttcaaaacccatactccaaagttcctcgtctttcaccatacttccaatatctggtgaggaaaatcctgaaatgtttttttccttccccatctcctctggaaaagaggcaaagtactcaggcataacttctaattgaggactagctacattcttccctttgaaatgagagccttcggggttaaagaatgaagctcctcctatttcccgatctgaacaattaaaaagttcatgtgctactgtcagtccctcagatgcaacagtaccaccttcaaaaggcatggcttccactcctaaaccagtttctgggagttgttgatccacaactggattgaatctgggttctcaaaccatgctgcaagggtcttgaaagtcagacctgaccttgactatctgccctttccatggaagaacgaccccactccatcccggaccatgtggctgatgttaacaaatttccttcattgttcttg

SEQ ID NO: 14766 - DNA, 654 bp, Solanum tuberosum
  Predicted polypeptide sequence is orthologous to G2041
gggggatttaattaaactaaataaaaattataaagttagagttaaataacaaacaataaataatcacaattaaataattaaaaagtaagagagaaattgaatttgggcctccttttgggccaaattcgctggattttgggacctaggctcaattcccgtttttgtatacactggttgtatatcagtgtatatcggatgaatacggcccattttttttgtgtataagactgtataccaaatgtatacaacctaattcaacttccaaaacacctgtttcaattttttgctttacatttgttgcgttttgatgagtataacatgtatacacaatctgtatatcagcccatatttgtcatttttcgacctgtacacctgcttccttaattcgccacgatgactgactcgaagagaaagaaatccgggcctctatggcccaataggaagatgcgaggatgagaggagcccatgaggactcgaggcgaattttacatgtgacgaaacaaacaaaaaaaaaataaaaatacgtaagtgacaacccacatatccaatataaggagtattgatgtgaatatttataccattgtattagagcctaaacatcaggaagaaaacaaaaatgactcccactaatgtttaatcacaacaggaaactaa

SEQ ID NO: 14767 - DNA, 879 bp, Solanum tuberosum
  Predicted polypeptide sequence is orthologous to G2041
gaaatgcaaccagagagcaagagagaggtggctgtgttatttctcatactccaggagctgggaaaaccttactaattatttccttccttgtaagctatctgaagttatttcctggatcacgaccattggtccttgctcccaagacaacactctacacctggtacaaagaagtactaaagtggaagattcctgtgccagtctaccaaattcatggtggtcaaacctttaagggagaggttctaagggaaaaggtgaaattatgtcctggtcttcctcgcaaccaagatgtcatgcatgtcttggactgccttgagaaaatgcagatgtggctttcgcaacccagtgttctccttatgggttatacctcttttttaacactgacacgggaagattcaccttatgcgcataggaaatatatggcccaggtgttgcggcattgtccaggggctactcatacttgatgaagggcacaaccaaggaagtacaaaaatccaggttaaagaaagggtctactgaacgtcaatacacgggtttagaatatttactttcttggtacattattcagactaaatttgggaggagttatttcaattacaacttttacctttagcaagggcccaacctttggttggatgacggtctttggaaggagcttgggatcccaaagttacagaagaaaaaaccaaggttgattctgcgctcttcattgggaaaaatcgaaacaaaaaaaaatgtttatttgatacaaatttcaaccggtcaattgattcagaacttcccgcaggaaaaaggaaagaaaggcgtaaacttattggaagaacactacgaggtggaattcattagatgtgcctgacagggtggaacatctgataacttctg

SEQ ID NO: 14768 - DNA, 567 bp, Solanum tuberosum
  Predicted polypeptide sequence is orthologous to G2067, G2115, G2294
aaaataaatatttttccaccatttttttattgcactttgagtacacaataaatgatacagcatatgacacttctataaaagaatatatctttaacaagaattttctaggaactcacatgggagagtccagaaaatatgacttctctctctgtattgtccctaattttttttcccctaatagtaataaatataaataaaattagtctatgtaagtgatgctgttcaagaaaaaaattaacttgacatcacatgtaaaaaaaaaaaaaacttttttttttgttttttctttcaaagaataattaaataattgaagtgagatcttgatgattagcaaaaactccataaagggatatctgctgatgattcttcataataaacatcctccattgaaggtggatcaaagaaaactgtaccatgtaacatgtcattatactttggtgaatcaaagttgtaccattgctcaatcattgacatctcttgatcaaaagtataatttggtaataaacaaacatcatttatatcctcagaagaagtagtagtagaagaagaagaaggtggtggagatgg

SEQ ID NO: 14769 - DNA, 753 bp, Solanum tuberosum
  Predicted polypeptide sequence is orthologous to G2071
cacgaggcaactgtggaatttgcatcacccttgcaattaggagggagcccattgacaaggcctcccatgtctaatccgtctgcaaatactagtagtgtcatgcagggtggtgttatgaccatgccagtaaaaggagcatcccctggaaatattgatacatcttctctttcaccttcaccttatgcatgtggtgaaggtggaagaggaaggagatcatgcacctcttttgaaaaagttgttgagagaaggcgtaagaggatgataaagaacagggagtctgcggccagatcaagggatcggaaacaggcatatactttagagttggaagctgaagtggcaaagcttaaagaaattaagcaagagttgcagaagaaacaggctgaatttatcgagaagcagaaaaaacaggtatagacttctttcgtgctgtcaatatcttgtatgaattatgatctacttattcatgggactagatgcagggatattgtaaattaaacaatctaagcaatagaattagcaaatgaaataagggcagaaagtagataatttactaatagcaaaatgattaaagcttcagatggttgttccatcaattgcctaagtgaatggagtagctgtacaacttttctatagaagtcatcagctggtaagacgtgataacttcgcgaaagagactgtctgtgtaagtgatttgttatgcccaagttgttgactataggtcaaatgatgttttcataactaaattttgggggt

SEQ ID NO: 14770 - DNA, 954 bp, Solanum tuberosum
  Predicted polypeptide sequence is orthologous to G2071
gatctaaatcagcgaagaagaaggagacgacacgctgctgctctttccttgctgctcccttccatttcttctgcacatacaaggatattcaaataccctttgagttctagtatcatgggatcttacatgaatttcaagaacgatgctgacacgccacagctggagagcaacggggggaagtcaattggtaatggtgatttccctttggctaggcaatcttcgatatactcgttgacgtttgatgagcttcaaactacatttagtggccttggaaaagattttggatcaataaatatggaggaactgttgaaaagcatttggacagctgaagagtctcaagctgtgacatcttctactggtggagaaggagatgggaatgcacctgtaggaaatctacagaggcaaggttctttgacattacctcggacacttagtcagaaaactgttgatgaagtatggagaaactttcaaaaagaaactacggtatgtaccaaagacggaagtgacactgggaaatcaaactttgggcagaggcagtctaccttgggagaaatgacattggaggagtttctagtgaaagcaggtgtagttagagaagatatgcaatctacttcaaactcaagtggtattacatttaacaatggtttaagtcaacagaacaacaacaatggtttcaacatagcatttcagcaaccaactcaaaacactggactgttaattaatcaaattgcaggcaataaaatgttgaatgtggttggtcccacagcctcacagcaacaacaacctcagaagcaacagcctcttttccccaagcaaacaacagtggcatttgcatctcctatgcagttatcaaacaatggtcacctggttagccctcgaacaagggctcctgctggtggaatgtccagtccttctgtaaatgctaatatgtctcgaggcggagtatggagatga

SEQ ID NO: 14771 - DNA, 1095 bp, Solanum tuberosum
  Predicted polypeptide sequence is orthologous to G2110, G2574
tgcgttgctactttttagctaatggccacaattgttacttcttggttttgtaggttcaaagatgtgccgaagacatgtcaatattgatcaccacatatgaaggaacacacaaccatactcttcctctttcagccaccgcaatggcttcaaccacctcagcggccgctagcatgctgttatccggttcatctagttcatcagacccaaacccacaagtaactgccaccaccaccaccacccctacttccactacttctgccaatatcaacggactcaacttctatctctctgatacctcaaaacataataaatcgccatattactttcctaatacatccatctcaacatccgcacctaattccctccctacaataacactcgatttgacttccacttcgtcctcgtcctccttctccttatctcatctaaacagaatgagtcacaattttccaactagatataattacaataacaataattcctccacaaacctcaattttagctcagtacttgaatccaattcccttcccatttcttggaccaataattatccaaatcaagcctataacaaaaataaccaaaattttggttcacttacattttcatcaagatcaagtcaagataacattttccaatcatatttacaaaaaaatactacacaatcttctttaccaccagagacaattgcagccgcaaccaaagcaatacatcagacccaaatttcactctgcattagctacagtcttacatcaaatctttggaaattctgggaattgaaataaatctagccatgttacggagccattccaattttgtcaggtctccattagctcaaatccgaattaaggttcggctcagttttaattaaccaaccctttttaattcgcgaataatattatagttccagcgccggaatatagcaggcggtttcgggcaattttcttcatgcccattcgaggtataggggaatacctcagggagggccgacacaaattttcgttcgccgagagcattgccgtgggaaacctttggagatttgtcaccccgcgaactcttgtgccgaagtgatcacgtttgggggtgtgaaaaaaaaaa

SEQ ID NO: 14772 - DNA, 835 bp, Solanum tuberosum
  Predicted polypeptide sequence is orthologous to G2124
ctgaaatcaaagagaatttcttctttgcaactgtttgctgaattggaaatcaggaagaaactttagtgtgagtgaaaaattaaacgttagggaaggtgttttttgggtcaattatgagaggcattataagatgattacaagagaagagaaggcaaatgagagcaaggcatcttcgtctacaacatcatggacaaggttaaaggatccaagaattgttcgtgtttcgcgagcatttggaggaaaagacaggcacagcaaagtttgtactgtaagagggctaagagatcgtcgtgtaaggctttcagttcctactgctattcaattatatgatcttcaagacagattagggcttaatcaaccaagtaaagttgttgattggttgcttgatgcagctaaacatgaaatcgacgaattgcctcccttgcaaattcctcctggaagtttgaaccctaatctttatcctatgttaggaattggaggtaattctcatcaaattactagtaataaagagggtcttaataataagagcatcaattgggatgataatgtcgttccattggaaccacctaataataataataataatgctttgggctacaattccaattttttgaaatgggatccttcaaatttatccttagctcattcagaaaattcattatctcatcaacatcaagatattcatcacaacttcaatttaatgtctagtatgccattaggtccaatcatcaagttgtgtttatccaccaggattgcctcaattttccatcaacataatattgttggaccatcgtcatcatcagagtttgatccaaaggaaataaacttccaaatg

SEQ ID NO: 14773 - DNA, 790 bp, Solanum tuberosum
  Predicted polypeptide sequence is orthologous to G2140, G2765
gaaagctttgattgctttgaagaatcatagtgaagctgaaaggaggaggagggagaggattaatggtcatttgggtactcttaggaatcttatacctggcactaataagatggacaaggctgctttacttggcaaagtcatcggccacataaaagaattgagagtgaatgcagcagaagctaccaaaggtgttctagttccaacagacattgatgaagttaaagttgaacaacaagcagagggatctgacggagccacttattctgtcaaggcatctttgtgctgtgactataagcatgaacttatttctgatctgcgacaagctctggatactctccccctaaagactctaagggcagagattgctacgctagggagcagaatggttagcgttttcgtgattactgagggcaatgaagggaatattgaggatactgaaaggtgccagcttcttataacttctgttcgtcaggctttgaggtcagtgcttgataaattttatgcatccgaggaattctcttcgagaagtacactatcaagcaagagacgaagagtttcatttctcaattcttcgagctcatcttctttaggggatttctggtgaataatgagtcttatttactgcatttatttatcaactatataatgtattacggaatgatctcacgggttaatggcatacgtcttagcatgcatatcctctgataaatggatatgcatgctgctacatatgtctgcctttgtaaatggagaacgtggtgcactaagtttgcaccagtaaaatattagc

SEQ ID NO: 14774 - DNA, 785 bp, Solanum tuberosum
  Predicted polypeptide sequence is orthologous to G2142
gtgtatgttttgcaagtgttcttcgataatcggagccttttagcgaaatcattttgaaatggtgaggactgtgaagaataatcatgaagaggacgaagaagacgatgaagagttttcatctagaactcccgatggttcttctcaaaaggggaaattagaagggaagagcaatgatgggaaggtaactgctcatcgttcgaagcattctgagacagaacagcggaggaggatcaagattaatgagagatttcagactctaagagatctcataccacaaaatgatcagaagagagaccgagcgtcattcatgttagaggttatacaatatatccactttttgcaagagaaattacagatatatgagggaaccaaccaaggatggagtgcagaaccctcgaagttgctgccatggagaagcactcctgggcccgtggaaggctctgttgaacattctcaaataatcagaaacggctctactcatgaggatgatattgtcattaacgcaacattgctttcgagtgcccagagctttgtagaaccgaacttgactgctgctgctttatatagagcaacacacgattctcatatggcagcggatgaagcaattgccttttacatgccactgcaacctaatttatttgaaaatgcatctgttgaaccatcttctgatgctgagcacccttcccagccacatcattatgttggcccaggtaacgagatacaattgagtccggaggttctgagctatggcagaaatgatcaggaagaagtgaaatgcgatggtg

SEQ ID NO: 14775 - DNA, 999 bp, Solanum tuberosum
  Predicted polypeptide sequence is orthologous to G2142
aaagcaaacacccgcgttcaaagccattcagcacagagcacggagaagaagcagatcaattgacagattttcagatgttgaggggaatcatccctaacagtgatcagaaaagagataaagcgtctttcttactggaggttattgaatatattcattttctacaagagaaagtgcacaagtatgaggaatcataccaaggctgggacaatgaacctccgaagttgcaattgagcaagtgccataggacgagtcatggtgttagcaatcttcctcaacgcattatcaatggatccgctgctgcactgatgtatgccggaaagtttgatgagagcataatggggatttcttctgctaatcctatcaatgtgcaaaaactggaaccaaacataagcagcccaagtttaaaagataaccgtcagcagcctggtttaacaaataagccgacaacacttcctatgcacccaaacacattttcgttttctgggactagtagcacagcagcgctatattcatcaaagctgacagctgatactgataagttggagtcaaagtctcagtctcaattttcacttagcagatcacatatgactgattatgctattccaaatgctaatccagaaaggcaggagctgcctatagaaagtggtaccatcagcatctctagtgcctattctcaagggctattgaaccaccttggacacaagcgctgcatagttctggagtagatttgacccatgccaatatctctgtgcaaattgatctggggaaagagagcaatggggagagtaaattcatcaggttcaactattaagtgatgatgttacaccaagcacaaccatccaaatttaagttcaccccaagggagaactgatatgccttaaaaggggaaaaagccaagctttgaacaaggttttctcttccgtaaataggtcctgctcctttcccaaggcccgaatccggaacaaccgtttgaaatttgccggggacggtttaaaaaaa

SEQ ID NO: 14776 - DNA, 749 bp, Solanum tuberosum
  Predicted polypeptide sequence is orthologous to G2142
ttttttttttgatagtaaagttcatatattgcaacaaaaactcttaaggtttagtcgttacaacatgagttctacagggtcagcaaacttttagttaagctactctgtgtagtactggagtatccaacaaggtacttgttaaaccacagcaagcaaactaaatcgacctatgaagcagacctaaacacacctaatttcacacattccagaaaatttcaaaatcttgaaaaaataggatgaaatctggaaagggtcatcatgtggaagaagaagaggatgagtatgattttggttctaacagagatgccacaccttcaagtaacagtactaaagtgacagatgggaagaacagtgacaaggcaaatgcaattaggtcgaagcattctgttacagagcagcgtcggaggagcaagatcaatgagagatttcagatgttgagaaatttgataccccatactgatcaaaaacgagataccgcgtcattcttgttcgaggtaattcagtacgtacagtatttacaggatacagtacagaagtatgaaggatcatatcaaccttggagctcggagcctacaaaacttatgccatggagaaacagtcagtggcacgcacagagttttcctgcaaaccctcaagccttgaacaatggtactgacacaggaccaacatattcaggaaggtttgatgagaatctcttaaccgtcacttcgtctatgcaagccaatcaacggaatccacttgaatctcat

SEQ ID NO: 14777 - DNA, 922 bp, Solanum tuberosum
  Predicted polypeptide sequence is orthologous to G2144
tactctttctgctaaactatggctatcagtggcttggcctcgacgcgctcggacatgaacatatggtagcttctcgccgccgtcttctgaggtatcgttagctgattttttccccttttttgtagtttcttttacctgaatttcgcataaattgttcatcaaactgaaattagtatcatttatcggaaaattatactatttatacatggttaacactattctttaggtatatatgatagataaatgaaaattctggctccgacactaaattgggtgttgaaattacctttttctcgcgttcctttctctttgttgatttctgattgactagtggattggaagtcgccggagatgaattgtggttaaattcggaatctatgggttcttgcttgacgaacagtgatttcgacccggaatttgaaagggttgaattggactccggggagttaccggcggcggcgaagacggagaacttagaagctctgtcgatcaaagcgatatctgaaggaaaaatcggaggaggaggataacgatagtgaggttcactgatagcgagcttatctgatgtcattttgtcagcttccggtgactgaaccaaaagctccaccgcttgattcggtggaagcccaagtaaagcagtgaaagaacttccaccttccgacgtaacagacaagatttcctcaccaaattgatgaaacccagttcctatttctcccattctagctccgcaattctcggatctagcttctcctgcttcaattgactctatcagatgatccatttcacagaaaaatcaaacccaactatgatacaacacagctaacccaattccagaatgagactcaacaagacaacctcaagctcaatttctacagtttctcgaatttcgtttatgcggcgaactccaactgaaacttttaaa

SEQ ID NO: 14778 - DNA, 328 bp, Solanum tuberosum
  Predicted polypeptide sequence is orthologous to G2145
cacatgtgatattggcggagtcaatttggattcttctttcacattttcgagtggtcaaacccaatatcttcttcaaatcaattcgttgaaaaggaggcttatatttgtgtccaacacctgcaacagtagcagaaatgagctcaaggagatgccccttcaattcctttccattcagttcatcactttatttgtcaattcgcaattgtcgttaactctttggtattttactaacttacatgaatcctcaatggccaaatgcaggttttcaatgactgtgacttttatataactatatatctaatttactcgaaaaaaaaaaaaaaaaaaa

SEQ ID NO: 14779 - DNA, 814 bp, Solanum tuberosum
  Predicted polypeptide sequence is orthologous to G2147
ttaaattccatcaagaaaacatggtttactcttcttcctatcttccattgctattattcactcttttccaattaattgtaattcaaaaccatttgttttgcaaagctgatcctactgatggtttcactcccatatctattagccaaagcaatttcgaaattcaaaagccttatgatgtgcctgtgaatcaaaggtattccttcattgatggagtacacaaattttgggtttacaagactgacaagcctcacactacatctagccaaacaaaaccccgttgtgaaattcgtataacggggaatgattattcatcaggtattcgacaatttgagggatatttctatgtgccaagtggttcatctggtgtctcaataatgcaagtatttggagcatcaccatcatccacaactttaatgctaagagtttatgatggaactctctattactatagagaaaaagttattgaatcaaatatttataatagatggatcagactaaatgtgattcatgatgttggtgcaagtaaattaaaggtttatattaatggaaatctcaagcatgaaccatccggaagaggtggagaccatcattatttcaaatttggagtttatacacaagataatgagtctgatcgaatggagtctcgttggagagggattaagcttttcaagaaataaacatctatcacttgtagtgtcttaacatgatcgagcggactagctctatatggatcatgaaacttatgtaatttcatttaattagaaatatgatgtattaagacaaaataatcatccctctagggttatgatcatga

SEQ ID NO: 14780 - DNA, 977 bp, Solanum tuberosum
  Predicted polypeptide sequence is orthologous to G2157
cttttagagagagaaaaacagtacattagataacttcttgtgaatttttctctctaggttagtgagaattttaggtgaatagagtgaagaacaagaaaaaaaaaatggctaatcgatggtgggatggaaatacagcaatgaatccaatggtttcatcaagtaacaatccagaagaagaagaaaaatcaaacaaactccgccccggaaaagagcaagagttcatgaatacaatcaccaccaccaccaacagtagtgaaaacccaaatgaaatgagtcaggaaggagaagaaaatatacagagtcctgaaggtctgttctcctctggaccgtccagctctatgcgtagagctggacggcgacccagaggaagacctatgggctcaaaaaacaagcccaaaccaccaatagtggtaactaaagatgccccaaattccctcaaaagtcacgttttggaaattaaatccggaagcgatataatagaaagcatagccgctttcgcgaatcgccgcagctgcggcgtatccgttttgagcggcagcggtattgtaacgaatgttacgttacgccagccggccgcggtgaccgtggccgggggcgtaattacgcttcacgggaggtttgagattttgtctttatccggcgcgtttttacccgcgccgaatagtccagttggagcaactggactaactgtgtacttggctggtagccaaggacaagttgttggtggaaatgttgtgggtgaattaatagcatctggaccagttattgtaattgctgcatcttttacaaatgcaacatttgaaaggttaccaatagtggagaatgatgaagaagaagaggagaataatgtaaatgaagggatgcaaatgcaattacctacagcttcaggggttggtaatgtaaattctgattattttgcagttgatcatccatctccttctacttctatgcctatgtacaatttagccactaatgtt

SEQ ID NO: 14781 - DNA, 775 bp, Solanum tuberosum
  Predicted polypeptide sequence is orthologous to G2192
tttccataagttagtaacatgatgttactaatttgaattattttacaacaacatatatagaatgtttgctataacaacgaataataagtacatgagcacgtaaaagaaaagggcagttcgatgcacgtagagtctagggaagggagtgtaaaattacaattcaagatgatgattgatggctgctggtaaaaccaacatcttaattgtgttgttccctaatgattgagcattattaaaacaatcactcaaatcatcatcacaagcaatccatatccaatcattatcttcatccatataatttattctaaatcttccaattggtaatttcaatcttttagccacttcattatccaaatcatcttttcttgaaaatgtgtacaatttaaacttcatcatatcatctccaaatgttgccttcactgtaaaactgctgctacaactctcatgatctttttgtgttgtagtttctgaagctactgatttgttcttctttgaaagcatagttaatgtctggtgatcggattcactagacttcttacgtttcgataatggccaccttcgaataccatactttctacataatcgcttcagtgtagatcgactaatctgaaggctttcagctgcatcagaaaggtttttgtcaaaatgctgtttgagatcatcatagttgacagagtctttagttctggttctgctttctttttgcaaatgagtaacacttacacattgcttctctgatataacgtgtgaatcgatacttaacacattggattga

SEQ ID NO: 14782 - DNA, 934 bp, Solanum tuberosum
  Predicted polypeptide sequence is orthologous to G2192
attttcttcatgtcggagccggaagaagaaatgaatttcattttccgttcaaagcctaaggagttctcagctccaccgccggcgccggcaacggcgcagcagcagcatgcggcgggggagaatcatagggaatcgttgatgatggatctcgatttggatctcgacgcttcctggtcatttgatcagatcttcgcggcagctgcttctgcttcaaatcctatgtcgccgtttctcgtaccggctgcttctgaacagccttgttctccactttgggctttttctgatgaaaacgaagataagcctaacggaaatgctctctctagcggcagtttacggctctccaactaccctagatttgtcacttatgctaatgaacatgaggctgcacctgaaactgtgtctgtcactgatgataagaaaagaatccctctaccaattaaaggattagcccctttagattatctggatagttcttgcataatcaaggagaggatgacacaggcacttcgatacttcaaggaatcaacgggagaacgtgtgttagctcagatctgggcacctgttaagaatggcggtcgttatgtgcttacaacttcagggcagccctttgttcttgacccagactgtaatgggcttcatcaatatcgaatggtttctttgatgtatatgttttctgtggatggggagactgatggagtgttaggacttccgggccgtgtgtaccggaaaaagttgccagaatggactccaaatgtgcagtattattccagtaaagagttcccccgtcttaatcacgccctgcattacaatgttcgtggaactttggcattgccagtatttgaaccatctggtcagtcttgtgttggtgtactggagctcataatgacctctcagaaaatcaactatgccccctgaagttgataaagtatgcaaa

SEQ ID NO: 14783 - DNA, 974 bp, Solanum tuberosum
  Predicted polypeptide sequence is orthologous to G2192
gtgaccagcaggctttgcttaactcactcttattgacaatgaagcagcacttcaggagtctcagcattgcttccggaggggaacttgagcatgactggagttcagttgagattattcaggcttccatggaagagaaaattgacgcaaagcctgaatctgtaccaacaccaataacttctcctcaactgactagtttaccaaatggatggatgcatcttgatccagtgggagagcagcagtcagcagtaggatccaatgtttctaaaggtgcaaggagcacaagtggtacaggtgaagcccctaaccatgtatctaactccgacaataaaacgtctggaaagaaatcagagagaaaacgtggaaaagctgagaaaacaattagcttagaggttttgcagcagtattttgctggaagtctcaaggatgctgcaaagagtcttggggtttgccctaccacaatgaaacgcatatgtaggcagcatgggatctctagatggccatctcgcaagataaataaggtcaatcgttccctttcaaagctaaagtgtgtaattgaatccgttcaaggagccgaaggtgcatttactctgacttcactggcaccaaattcacttcctgctgctgttagttcaatttcttggcctgctggtgcaaatgtttccaatctaccaagttcaccatcgtctaaaccttcagtatttcctgaggagaagaatgagttctcccaccatggaacaccagaaagtcacatagaagctgaaccctcaaatcaaatgctaggaggcagggtggccaggaaggaagaattcactcctacgcagaacggttttctgcatgcagaaggcacacgtaagtccagaacagggagtttctccagagaagtgagcgcagggacacctacgtcccatggttcatgcccaggaagtccttgtgctggaaatgaattctcccctcagaacgagctgggttattca

SEQ ID NO: 14784 - DNA, 462 bp, Solanum tuberosum
  Predicted polypeptide sequence is orthologous to G2215
aaatcaaaacaatactaggtgacttgggggtttcccagtcgtggagctatggtgagatttttttagtaaacaagataggtgatcgattgaaaaggggaagcaaattatttttcctagtattcctatcttttaagaaacctccacgaaggacatagaaaaagaaaaaaaaataatatgtccggatctgaaaaaatatttgcaattggaagctcgattttcatggtcaagaaacggaagcagtcttcttgtgattcattttggaacggaagaaattctttcactatacgaatcaagcttcgaatttcggaaagttttcttggtggccattgtagaaagctgcttctttgcaattttgctatgaagaagatataattattagagaattttactaattaattagaaattaataagtgtaaaatatagctaacaaaagaaaagttaattaaaaaaaaaaaaaaaaaa

SEQ ID NO: 14785 - DNA, 434 bp, Solanum tuberosum
  Predicted polypeptide sequence is orthologous to G2215
ggagatagagagagaaagtacaaaattgaccttccactctgtggatctagggtttcacaatacacagttgagccaccgcatcgtcatctacaccgccgtactacaactactatctgaaaaatcatctaaaccctacttttaatcttctcttaatcatcatcttctataaagaaaccctaaaattttcattcttttttgggtatttttttgggtaaatctgaatgaaatttgataaacgatgacgtttgattggttgatttgataaagatttgataagatctgacttttttttttctgtttcgattggattttaagcataatttctagatcgatctatattgcgatgagaaactgaaagggaaaaggatagaaattgtttttttttgaattttttgtgattacagagaaaaaacgcaaaaaaaaaaaaaaaaaaa

SEQ ID NO: 14786 - DNA, 734 bp, Solanum tuberosum
  Predicted polypeptide sequence is orthologous to G2226
cactgtcccaatttggatcctatgaatctccttcaacacatcaacccttaaaaaaagaaaaatttctcttccaaaatcttgtaaatcctattttctcttgtcaatattacaaaaaataataattgtaaacaaaaagtttcaagttttcatattattagatccagtatattgagctctttcaaaagtttttgaagatataatcatcatttcaacataaggttccgatccattatgggcctctcacaatatccaactccggcagatgcaggagtacttggtgtgattctagtaaacacagccatatccatctccattatcaaggagatactccgatcgatccttcgtgtgattggcatccgtatcgcatcatgggaagactattctgttgaaggacccttggactcacttgaatgccgtggaagcccaccagagtcatacatggaggagttcagaaaccgaacacctgcatttcgttatgactcgctatgtatctctaaccaccctgaacaagaatgctctgtgtgcctgacaaaattcgagcctgatgcaggggtaaacagtctctcatgcggtcacgttttccataagctgtgtctaagagaagtggctcaagtattggcatgtaacttggtcctcctttgcagaaattacttgatgtctccaacaaagaaagaggacgatacgtgtccgaatgtggagattaaacgtttaacggtgccacttcatcccatttg

SEQ ID NO: 14787 - DNA, 508 bp, Solanum tuberosum
  Predicted polypeptide sequence is orthologous to G2226
tttttttttttttttttttggagaggacgaaaagcattaataagctacaggactacaccatgtactataatgtacaagtttttggtcacacgaaagagacccgtcactctgaagaggacgcaaagttttacaaacacaacaagcgtacaggactaaatcatgtacaacaagggtattaaggttttgtgtggtcacacgaaagagacccggtcactcatggagaggacgcaaagcatcacaaatatgacaagctaacaaactacatcacatcaaagatcaatgcatccacatactcaggctgtacacaactaatgctgtaaagtgataccatcatcaaatggatgaagtggcaccgtaaaacgtttaatctcacatcggacacgtatcggcctcttcttgtagagacatcaggtaatttctgcaaagaggcacaagttacatgccaatacctaggccacttctctagacacaagcttatggaaaacgtgaccgcattgagagactgttt

SEQ ID NO: 14788 - DNA, 923 bp, Solanum tuberosum
  misc_feature (137)..(137): n is a, c, g, or t
  misc_feature (429)..(429): n is a, c, g, or t
  misc_feature (721)..(721): n is a, c, g, or t
  Predicted polypeptide sequence is orthologous to G2226
ggatgaaaagaaaaaaagactatttttttatgcagttcttggatggtccagttcactcagctattccagaagttgttgctagtagaaaatctcttagtttcagcctagattccaatccagtatgggcctctcacagntatccaactccagcagatgcaggagtgctctgtgttattctagtgaacacagccatatccatctccattgtcaaggagatggtccgatcgatccttcatgtgattggcatccatattgcatcatgggacgattattccatcgaaaggtccttggaatcctttgaatgtcgcagaaaaccatctagagatcatatatggaggaattcagaaaacatatacctctggaatcgggatgagtatcacaactcgggtactcttatacactgcgtgagaaacgagagcgccgcgctgnctcgacaggaggatttgagagcccatgtcgtgagataaaacacactctcatgtggggcaccgtgtttcaccaagacactcgtgctgagaacagggggcccctactcgggacgtagacaaagtggcacacctgcgaggagagaacactgatgtgtccccaaaaggcgcgaagaaacatgtgccatcgtcgaggtgggagagaccatcgaccgcgcgtgacactacgatacaaacctctgtcgggaggagacatgcgcgtgcgaagacaccaacaaatgtacgagccacacgcngctacatagcaaaacagcaggggaagcgacactgcccagaaaccggagataacatgcagacagacacggcgccgttaatgcagtggcgggcgctccccacagaaggagggcgctactgtggggcgacaatgacatcacaatccgggcgcctaatataacgcaaggaaagcgcggagggtttctccacacagaaaaaaaaaac

SEQ ID NO: 14789 - DNA, 652 bp, Solanum tuberosum
  Predicted polypeptide sequence is orthologous to G2226
gcatcatgggaagaatattctattgaaggccccttggacccatttgagtgtcgtgggagcccctcgggatcatacatggaggagttccgaagcagaacccctgctgttcgttacgattcattgtgtatatctaatcaccctacacaagaatgcccggtatgtctggcagatttcaaccatgacgcggagataaaccacctctcatgtggccatgtttttcataagctctgtctcgagaaatggctaaagaattggaatgtcacctgccctctctgcaggaattacattatgcctaaagaaggtgaggaagatacttgtccgatgtgaattttgtagtttgtcaggctactccttctgtttgagatgttctgatgtacagcttagttgggtaaaagttttatagatgactgcctgatcgttgagacggcataattctgtaatcttttatgctgtaatactctgcgtcctatcatagtgacgggtctctttgttgcgaccaagaatccatacattgttgtacatatgttatgaaattgccacttcctgatgttttccatctctggcttagctagcaaccttataagggaacattttaatgcttgattgatatggtgaaatgtcacatattcctaaaaaaaaaaaaaacaaacag

SEQ ID NO: 14790 - DNA, 885 bp, Solanum tuberosum
  Predicted polypeptide sequence is orthologous to G2227
ctcttacgagaccttttttttattctccggcgagcctaatcggagcataatttggggttctgagttatcggatctaaccgggtttattgggttaagttttgacggatctccggcggctgcagatgtcttcgtactggtgttaccggtgtacaaggtttgttagaatttcagttgggaacgatgttgtttgtcctcactgtgatagtggatttatagaagttgctgaggcaaatattgggtcgccggaatctcgccggaggtttcccatgtggaacgaacggccagagtcagatcggagtgtgaacatgggttctcgacggagcaggcgtaatcggggtgatagatctccgtttaatccggttattgttcttcgtagtccatctgaagctcctggggaggatgaagctgctgcagctgcagaggagcggagttacgagctttattatgatgatggtgaaggttcaggtctcaggccgttgccgccgacgatgtcggagtttttgatgggatctgggtttgatcggttacttgatcagttagcacagatcgaggtgaacggttttagtcggccggaaaatccaccggcgtcgaaatcagcgattgaatcgatgccgattattcaaatagcttgtactcacgtaaattccgagacccattgcgctgtttgtaaagaagctttcgatttaggatctgaagctcgagaaatgccctgtaaacacatctaccattccgattgtattcttccatggctatctcttcgaaattcgtgccccgtttgccgacacgaattaccggcggaatcaacggaaactacaaactccgacaacattgctagacctagaaacgaagaagaagcaatgggattgacaatatggagacttccag

SEQ ID NO: 14791 - DNA, 628 bp, Solanum tuberosum
  Predicted polypeptide sequence is orthologous to G2239
ggaatagtagatagagagagaaacatgtattttcattttgagccattagccacctttacagctaccgccaccgctattttcttaatttccactatcaaattccgttggttccgtcccgacaattatttgccgccgccgttcaaagtcctcgtcgaggaaatcggttactgttactgtgccgtgtgcctcgacgaggttagcggtggcgacacgtgtcgacaactgcccaagtgcggccacgcattccacgcgatgtgcgtggacgcgtggctagagtgcaattggacgtgcccaatctgcagaaggcaagttactgatgaacttccggagagacaaggtcaaaacaccctgttttcttttgttatttcacgctgtgaagaatttgtggctaagattaatactcgtgctgaagaattcatgatcgttttgttcgagaccgctgttttaggccatctttgaattttattaattgtaattaagtgtgtattcattgatcaaaatttttcatctttgtccttttttttccctttcttaaaggaactttttgatcggaatatgtataattgttagttttagccgcctctctgtacgtattaggtaaggaaatgaagaattatacgtattgctc

SEQ ID NO: 14792 - DNA, 866 bp, Solanum tuberosum
  Predicted polypeptide sequence is orthologous to G2239
cggcggttctcaaactccctgaggtggaaccctcgccggcttcagctccaactctgggtgatttcattgatgagcctcttgaaaagaatggtggtgccatggtgaaaatccaccggtccgatttaggttccggttcagaccactccatccttttgttagatctagaacccctgttgcttccatctccggtgccggttctgtatccttttctggagcttatatctcttggcaaggtgcctccaaagcttttagcccggttcaatagtgcacggttcattacctctttccgaacgccctccggtaatctgagagtgtaccggtctaaattctcaccaggtagtactagtgaatgaccggttgaatgtgatctgaatttgctgaatatccttggcctcatggaaattgatctcggtggttgaatcggcacgttgaaactcaagtttctctttactcctgatttaactgaaccgccttcttcttgcttgggaacccggttcggcacgttgaagctcaaattccgcttcaccgtcgatttaacagaaccttcttcttgttgctgttgctgtacttgttcactttgttcgtcgtcgctcgctatgcgaattgaaacttcatcgttttgctgttgctgttgctgttgctgttcagttcccggttcatctgggatcacctgaggaacttgaaccggcggttcatccggttgagggttgagatcagcacggcaaacagggcaagtatcatgtgattccaaccaagcatcaatacactcgggatgaaaaacgtgatcacactttggaattaaacgcagcgtttcatcatcttcaaattcattcaaacaaacagcacactccaaagctcctttacca

SEQ ID NO: 14793 - DNA, 909 bp, Solanum tuberosum
  Predicted polypeptide sequence is orthologous to G2239
tgagtttcaacgcggcgaaccggccgccgaggtctttttctgtgaagagaccaaagatgttcagcaaattcaggtcacattcgaccggtcactcattagtggtaccaggggagaatttagacaggtacactcttagattgccggagaaggtgaggaaagatgtaatggaccgggctctactaaaccggacaaggagctgcgcagtcacgctaccaagacacggtagcaccacaagagggtacagagccggtccgggagagggaagcaacagaggtacaaggtcattcaagagaattgaccggttcgacccggaagcaaaatcagaccggtggtttctcaagattgcaccaccattctttaccagaggttcatcaatgaagtcaccaaaagtaagagctgataacgaagaagcatccacatcccgtagtaatgtgaaagtagcagtaaaaatgccgtccttcaaatgcctggagccgaaaggtgatgaaccgggtttattggcaaatgactcggctcgatctccggtttaaagaatgtggtaatttctgactcgggtttaattaagcgtggcggaaagggaaaactttttgttcgccggcaaatgtggagaacgcgtggtcgatgctaatgggctgggcccaccaacctttgaaacttccgctattgactttaatgcacatatatataatgtcaaaagttgaattcaaggtttttgatttctagaatattctttaaaatgttgattaacttttattatttaaaaaacaaataattttcaactttgggtttatatggggtgatgagatggtgttcaatagtgtgtgtttatctagatggatgacgtaataccctaaacacaatgtaattatactatgtgtgttactttgttcttgattgatagagatatga

SEQ ID NO: 14794 - DNA, 829 bp, Solanum tuberosum
  misc_feature (406)..(406): n is a, c, g, or t
  Predicted polypeptide sequence is orthologous to G2291
tcaaaaagctgaaccattcttcttctctacacaaaaacctctttattacccaaatgaaccaaatcataatttctccattgacaacactaattattccctcgacccattttgggataattactctgtttctgctaatgaaaatgaaaatgaaaaatcccctgttctagaaggaattgctgctgttgttggagaacatgttcttttcggttataataacaatgaaaacaagaatgatgatccaaattcagcagtttcaattctgaaacgcacgtgtcctgcagaaaagaggaataataataataataatgttccatcagtggagaaaagttacagaggagtgagaaagaggccgtgggggagatggtcagcggaaattcgcgaacgtatagggcggtgcaaacactgngctgggtacattcgacacgccggaggaggcggcgcgtgcgtacgacgcggcggcgaggtggttgagaggttcaaaagctcggaacaaatttccaaattcctccgattgttcctctggctacttcaccaaacatcgaacgtcatccatcttccaattccgcctccgtggaaattggaaccattggaaacatggaaaacaggaaaaaggacccattgttcgcctattaatcaaaagaaaatgctcagtggtaacttcaactgcgcatttatttagctctaatgaatttaacaaaaaagttagtgttactgtggagcttgatctcaagctcggattcgagaggaagtagactcaactgctataacgaaacaactacttcctattattaatgtttagttttgtatcgtaaaaaaaaaaaaaaaaaaa

SEQ ID NO: 14795 - DNA, 999 bp, Solanum tuberosum
  Predicted polypeptide sequence is orthologous to G2311
agcggcagctggtaagagattgagtgtgagggatgggaaatccaaagcagaaatggacatcggaggaagaagaagcgcttcgtgccggcgttgcaaagcacggagctggaaaatggaagaacattcaaagagaccccgaattcaatcacctcctttactctcgctccaatatcgatcttaaggataaatggagaaatttaaatgttagtgccaatggacaaggaccaagagataaatcaaggacaccgaaagtgaagcctaatcctgatgctgcagcagctccattggccatcacatatgcccctctttcttccactctagttccacaagatgcatcagcagacactgttatggaagattcttcaaaatgcgcactagatggaaaaactgcctcaaagtacaatcaaatgatatatgatgcactttcaagtctaaaggagacaaatggatctgacacaagcacacttgttaacttcattgagcaaaggcatgaggtgccccaaaactttagaaggttgctgagttctaggctgaggaggcttgttcaacaagacaaacttgaaaagattgagaattcctacaggattaagaaagaggtcttggaaaaatcaaagactgctgctaccgctaaacaaaaacacgttgggccaaggcagtttccaaataatgcctatcttggtgacactgccgaagaagcagcaatcactgctgcctataaggttgcagaagctgaaaataaatcatttgtagcagctgaagcggccaaggaagctgagagagtctcaaagatggaggaagacagtgataattcactacagatctataaggatctcttcgataaatgttcacatggcgaaattgtgctgctaacggcatgatatggtctttcccctattttgtaaagtcagaaccatctgttcagcgcctctatagtagtaaatgttttactctttgtatcaactagtgatatgctgtttggtggtagtttatgtactaggg

SEQ ID NO: 14796 - DNA, 702 bp, Solanum tuberosum
  Predicted polypeptide sequence is orthologous to G2317
cttccctgcagctacaatttcttggtggtcctggtaccaagatctcatttatcgatctatctcatcgtgtggccaaacagccatggagactgctgctcattatcagagaccaaaagatgaagaatctcaaagagagggatcatcgactggttcaagcattggctcagccagtgaagttgacgatggaaacaggagttctgaaacagttgagtccaaatgtacaaccaagagcaagggatttgtaccatacaaaagatgtttagcagagagggatggcaagtcatcaggagctgttttagaagagagagaatctcaaagggtccgcgtgtgttcatagcacttttttggtacagtttcctcctgaccagccagaagttctggtgttctgcacagcatttctatttattaaccaatggctgtttaggagtcttaggtctgcagataatctaattcaggaggtccgcgacactcttcaactttttagctttgtcaacattcttttggtttcctttcatatttttcagctgcacacgaaactgagtttgcagccaaaaaacacgcagctgcaatttttcctatcaactgatcgtgcagcagttgttctgtatcatactcattgtaactttcttcacagtgtttcaactctctaatgattgcccactttatgctatctaaatacaaccaaatatctcttggttcgtt

SEQ ID NO: 14797 - DNA, 572 bp, Solanum tuberosum
  Predicted polypeptide sequence is orthologous to G2348
ttctacagtcccacttttggatgcagaattgccattgagagtgaaggaagaacaatcagggaagtcctgtggcttcttggttaggaagacagtcttgacgtctcgtactcttgttttgttaatctctggttttgctttgtgtcttggtctatgtgcaacattcctgcaccctagaaaagttggtgacatcgctatgacaatccggaggtgtttgtttgacaaaacttaaaattgcatgtaacttttaccaaaatgatgatctgcagtcacagaatatatgtgtgatctccattgctccggtccctccttggtcgctgatcttgtatgatattcatgtgtttgctacaactgcgtctcaagaaactggacagcattgagtgaagagttgatgattaggtcctgagtcctgaccaaatgcttgctgggagacatgctttgtggcattgttgatgtattatactacctgtgctatgtaaacagaataactgtatcagctatgtagcttcaaatagttgtgtagtttctttgtacaagttcttggatagtcacaccctaaaaacttgttattgctg

SEQ ID NO: 14798 - DNA, 761 bp, Solanum tuberosum
  Predicted polypeptide sequence is orthologous to G2348
gcacagggtgtgcttacgttgtgctaatgcaactgctgtggttctcgatgggcatagtaagagatattgtcagcagtgtggcaagtttcatattttgtcagactttgatgaaggtaagcgtagttgtagaagaaaattagagcgacacaacaacaggcgtaggagaaaagccactgattcgtccaaaacgtctactgaaaaggaatctcagcaggtcacaacggctgatgatgttagtggtgatgacgacatcgtcaaagatagcacatgcatgggcagccagttaggagaaaaggaaatcctattagaatctgaaggacatgtgccaatatgctctactcaaggtatccaaaataatcacagtgatagtttcacagcttctggtgaaacacaggttgatgcagaaaaggagaactacaaaaattcccattctccaacctattatgacaacaagagtgccctttcttcagtgtgccccactggtcggatctcattcaagctttatgattggaaccccgcagagttccctcgaagactccgtcaccaaatcttccagtggttggccagtatgcctgtcgaattggagggctatattcgtccaggttgtacaatcttgacagtttttgttgcaatgccgacatttcaagtggggtaagttactagaagacccagctgcacacctatatgagttaattgcatcacctgaaaacacgcttcgtggaagaggaagctttcttatttatctccacacatggtatttc

SEQ ID NO: 14799 - DNA, 442 bp, Solanum tuberosum
  Predicted polypeptide sequence is orthologous to G2348
ctctcctctttttctctctccatttctccaacagaaaccggcgttgggatctccgccatcgctcgccggaaaacttcacaatttccgatcggggattatgaatgtttagctgtggataaacggagaaaatataaacaatttagcaagaggagagagaaattacaggtggtttaacgtgcaatgtaggaaaaacacatacaacacaggggggagagagagagaaacagcgagacagatagagagagaaaggcatcgaagctttggaggtttctgcacggcacggatacctagatctcttcttcaatttcccttccttaccttgccttgtgccgtaatttattcctaaactattttttcatctctctgttctctcttcctaatctttatagctacctctcataccttccaatttttctatatattcaaaaaaaaaaaaaaaaaa

SEQ ID NO: 14800 - DNA, 913 bp, Solanum tuberosum
  Predicted polypeptide sequence is orthologous to G2348
gttactaagggagccttcatcagaaaatgttcagattctggcgtctgtacagatgcagagatttaattatttgttgaacattttaatggaaagtcggtcaactattattttggaaagagtattgtcttattttgaaaatatggtgaagagaaatatgttagctggcatcactgatgctgacatgagactttttcagaagaatatcctcgagaaaaataatctgctcaaggaaagattgtatctaaaggaatattttgcgggagattcgggacaaattatccaggaggacacagaggtaccacataagcacaacatagaatttggtcctacttattgggagagaacttctacagtcccacttttggatgcagaattgccattgagagtgaaggaagaacaatcagggaagtcctgtggcttcttggttagaaagacagtcttgacatctcgtactcttgttttgttaatctctggttttgctttgtgtcttggtctatgtgcaacattcctgcaccctagaaaagttggtgacatcgctatgacaatccggaggtgtttgtttgacaaaacttaaaattgcatgtaacttttaccaaaatgacgatctacagtcacagaatataggtgtgatctccattgctcgggtcgtcactgatcttgtatgatattcatgtgtttgctacaactgcgctctcaagaaactggacagcattgagtgaaagagttgatgattagtcctgagtcctgaccaaatgcttgctgggaacctgctttgtggcattctgatgtactatactaactgtgcctatgtaaaccagaataactgtatcagtatgtatcttcaaataattgtgttattctttgtacaagttctgggatagtcacctaaaaactcttattggtgaaaaaaaac

SEQ ID NO: 14801 - DNA, 999 bp, Solanum tuberosum
  Predicted polypeptide sequence is orthologous to G2375
gatctcaatggtttggtggaaacaatgaaaatctcggtccatttacccagcgtttgatgcttccgcagcaccccctccacctccttcccggcgccggtggttcttcgggcagcggtttgggcggagacgatgagtttcctaagcgggacgagcgtgttccgccgtggagtaatcaggagactagggatttcatagctattcgaggtgagcttgagatagaattttcttcggcgaagcggagtaatttgaagaatctatgggagattgtagctgctaggattaatgagagaggatacaggagaagtgctgaacaatgtaaaagcaagtggaagactttgatcaatcgttacaagggtaaggaaacatctgatccagataatggcggacaatttccatattttgatgagctgcatgcactcttttcatcaaatatgaataataatgtacagcgagtacagctcgaatcagaggcaaggaagagacctcgcggaacaagtagagaccgatcttcagaggaaatctcagaagatgaaggttatgcttatgagagtgatgaagtaaaattagccagaagcaatgttgctcctcccaaaaagaaaaccgaaaaagaaaagcgtccaagaacaagcaatgcagaaaaagcttcaagacaagccaactttgggagtattaacaacaacactggtagagctgttgataatattcaagaaatgcttaaagaattctttcagcatcagctgaggattgaaatgcaatggagggagacaacagagaagcgtgctcgtgaaagagaagtattcgagcaggaatggcgattgtcaatggagaagcttgaaagagataggatgatgatcgaacagtcttggagggagagggaggagcaaaggagaacgagagaggagacccgagctgaaaagagggatgccctgttgacaacacttctgaacaaactcatcggtgaaaatcatccttgagatgatccgtcgtgtactctgtttt

SEQ ID NO: 14802 - DNA, 1177 bp, Solanum tuberosum
  Predicted polypeptide sequence is orthologous to G2379
cgatgtttctccccttcacctccggtccaccttagcaccctgccttctcttttccgaacttcaaataccaatcacgcctgaatcggagtcggtcgccgattttctctgttgtatggagaaccaaactgctactcagaacacctctaggcctcacgctggaggacgtgaagactgctggagtgaaggtgctactgaaaccctaatcgaagcatggggcgatcgctatctcaggcttaatcgcggcaatctccggcagaaggactggaaggaagtcgcctactccgttaattcacgtcaaaatggagttaagcctcagcgcactgatgtacaatgtaagaaccggatcgatactttgaagaagaagtacaagcttgagaaaaacaagtcaactccctcaaagtggccgttttatagccgtcttgattatctcatcgctaccaataatgtttctgcctcaccctgtaatagaagacccgctgcctcgatatcacttgcccgttaaacgaaaaaaattaggccccgacttcaacacttttggttgcatttgaaattatttcaagggcgggttccatcccagggttgaatttcaagttggttcaaattgacagttcaacaccgaatgattgtggccttgtggggaagtggaagaagaggcaagaattaaggaattcgatgttaccgttatgggttaatcccgaaggataccaaacggtatttttaatcgtatttagccaagcggcaattttgaacggttttgggggaacatatttttgcaaaggatgttgaaactctcaaagcacgcgattattgagtttggggaaaacacaaggattgcggattttcccccagggcctcttgatggttcacccgtcgttacatatgtttccgtgcgaaactcccgtctccgcattgaaacggtctcaattgtctgccacagatatcccctttggtggcggtaaataattcgtatattttttcttgccccttttttgcttttttccccaaaaaaatagtctttttttgtgttgtgaaacacggcgaattccccaagaccgattgaaaatctattaaaaaatcttgtttcaaatgaacacactaaacgggcaactttcttggtggtttatccccacaacccttctttcttttttttttaaaccagcgatttccctagctataa

SEQ ID NO: 14803 - DNA, 733 bp, Solanum tuberosum
  Predicted polypeptide sequence is orthologous to G2383
ttttttttttttcgagcagcacaatatttttgaagagtttaagcaattacatagtagttaataactatatatcttatatacctaaatcccaaataaacaaaaagcaactagtagtacaaacatcaaaattttatttgttctcaacctttctacaatcaagtagcaaagttcaaaaataccaaactttgccatattccataaatcaacaaccaaaaataataaatagaagtcttaacgtccttatggtccggcccttttccaaatctcgcgcttagctaaagcttagggcatcgagctatcctttttagtcttaagacctgaaaatgggatttgaacctcatttgtcattgaacaattttcaagaatccccatattgaagcaattgtcagaaatatctatgtctcctttgattactccattgttgtcaaaatcaaatatagaagttattgaggaataacttgctccacctaagtacctttccatgattccaacattagcaaattgatgttcaagagattttgaatttgaccctaatttatgatcaatagtacttatagggtttgtttcatccaattcttgattacactttttgttgtgacctaatttgatcatcattttctcccttgtcttttctcttattggcttgtcacttgaaccaattttctcaattttctatgatcatcatcattgtttgatcatgactatgatgctcttgggggatgttccttgagag

SEQ ID NO: 14804 - DNA, 743 bp, Solanum tuberosum
  Predicted polypeptide sequence is orthologous to G2404
gctaaatttcattatttctttaacacaatgccaatatcaataattgatcatcaatattcaacattcaaaaatccaaaaaacaaaactcattctacccctaatcatcaattttccaacacaaatgactcaaatgtatctaaaaacaagaagaaatttatgtctatgagctttggagggctaggatgtaagggaaaattaaacttaccggttgcgtcgacgccggaggttattagatcagcagcacaatgggagagtagtagtaagcaaatgaggaataatagaagaaaaaagatgacaacattgtcaacaagtactaggaattcaactaatgttgtttgctgtgctcctcctggtattggttctgcttttgatgttgctcctaggccaaaaataagatcaaataacaaagagaactctcgtatcgcgaggagaacatctacgaatggtgaagcaatttctaggtctcatacgtctaatacaagacatcattgccctcgttttcatcatcgtcctcatattatgatcctcagacacaacttgcaatacgcaagagatatagaaggggatgatcaatatggatcttggagactagatgtagatgatatgtcttatgagcaattggttgaactaagtgataaaattgggtatgtgggaacaggtttagaagaagagaagatagttgaatatataagaaagtttaagctctcacaattgactcatattcaatgctaatatctactgat

SEQ ID NO: 14805 - DNA, 939 bp, Solanum tuberosum
  Predicted polypeptide sequence is orthologous to G2404
gacacccccttattctctccctctcaatttcatcctttttatcttcaatatcttctctttagtgcttctctctctctctacaaaaatcaacatcaattttctttacaaaaccaaatcttgaattctccattgttgtcttcttcacctttactgtgcagagcaactatgcctgtagtgttttcagaaagctccacagtttcagaacagattagatacagaaaacccagaacgcaaaaccaacaagaaacccaagatatggatccaatttcttcttcttcttcttcttcttcttctcgctccactaaacccaccatttcatctctacttctagcaccattttcacctacaagtcctacccatgaaaactcaactacccccagtgcctctacagttttttccactaaaaagaagaactttgctacatttaggggactgggttgtacagcatcaccgcaagtgtcggttcctgctgtgattaggacttcggctgactgggatcccaaaagggtcaagaagaaaaaacagaacagcaacaagaacaaatcccttaattctgctgttaatgttggtggaggagtatccattggctgcagtaactcagtccagaataataacccttcatcgtcgtcgtcttcatcagcaccgttatcgttatcatcgagctgtgtggcggttcctgacgtttggtgtggtcctggaattggattaactactgatgctgcttctgttgattgcgttgtttcaagaagacccgtgtctgggaggggaagaattgaaagtgacaaagctacgcctagagagcgatctgcatgtcctatacgaagaatggtgatcccagaagacaacccttttctggatatagaaagtagccttggtataccacgctcccaaatagagttatttgcatctaggcatcatcgacattctcgccatgggtat

SEQ ID NO: 14806 - DNA, 412 bp, Solanum tuberosum
  Predicted polypeptide sequence is orthologous to G2423
cccttcatttaacttttaacatcaaaattatggttcaaatataaaaggtcacagttttgggatagcaaacaataacgacttctcttgctatgagcttagataaatacttttaactgttgacaacagcagaatacactgttctctttcctattgaacaaaattgccttccatctacaggagaaaaagaggtaaggccacaccatgtatatacatctcaacaagaggctattctttctatgctacaaaggtcctaaataatcagctacaaaactatcgccaatactctcagatttccgagctctgtgcacaactcttaagtagggaaaacatggaatagtcccacgatgagtgtccagtttgtctggtcctgccaagtgctgtatatgtgccctgatatctccgtatttagggc

SEQ ID NO: 14807 - DNA, 560 bp, Solanum tuberosum
  Predicted polypeptide sequence is orthologous to G2453
gcaaatgggctatagtggagttaagccgggatggacaagggtcagcttcccctattacatgtccaaggaagaatttgtgttcattctagcagcaatagaattcatatccatttatggacaaaggttcctccctttgtatcatttcaattggaggagtggtgcgtggactttcaagaaaaaagctttcaattgcaacttttgctgttcagaaatgacgaacatgttgaatataagttgccataacactaaagaaaacaaccatggtggaggtcttgtttacaagtatgtaaagtacattgagacagccaagcgtatcgctaatctccttcccaagttcccacctcaacgaccgatacctgaagaaatagaccccaatcttgtaccctttagagtctgaagagtgaagagcattagcttgctctgatccttaccaatatgatcatacacttagccaatgcctggttggtaaattcaaagttgacatgtaataaactaaaggtagaagaaaaacaatattgaacatgacatacttgtaaagggaaatcaaaatactgggtctc

SEQ ID NO: 14808 - DNA, 736 bp, Solanum tuberosum
  Predicted polypeptide sequence is orthologous to G2455
cccctttactagccttttcttcccccttttttccccatcttttgtagctaggtcttttcaactctcttcctagctactagtatttcataacatgatgaacattacacatatttcttgattttgacttatccttttacttcagagctcgtccttgatccgcctcttaattcttcgatccgtattttctgagttaaaaagaaaaaaaaacttataagaaatgtcacttgacatgacatattcatcttcctcagaacgtgtttgctatgttcattgcaacttctgcagcacaattcttgcggttagcattccatgcaacagtatgatgacaatagtgacagtaaggtgtggacactgcgcaaatttgctttctgttaatattgcaccttcccttcagtctctccccattcaagatttacagagacaaaatgagtcaagtattgaagatgggatgagtagaggttatgggtcatcatcctcttctacaaattcatttcacagattttctcccattcctactgatcatgatcaacctagatcccctcctattcgcccaccggagaaaagacaacgtgtaccttctgcctacaatagatttatcaaggaggagatccaaaggataaaggcaagcaatcctgatattagccacagagaagcttttagcactgctgccaaaaattgggcacatttccctcatatccactttggactcaagctggatggcaacaaacaaaccaat

SEQ ID NO: 14809 - DNA, 751 bp, Solanum tuberosum
  Predicted polypeptide sequence is orthologous to G2456
ggaaagagagaagtagtctagctcaaatcaggaattagaaaggaatcttatcatctcaaaaaaatgtcgtcttcatctgccgcttttgctccggaccaccacctccaccaccatcacctctctcctccttcaggagaacaactctgttatgtccaatgcaacttttgtgacactgttctcgcggtgagtgttccttgctcaagtttcttcaaaaacgtgacagtaagatgtggtcattgcaccaatcttctctctgtcaacattattcttcccactgctgctaatcagcttcatctcccacattctttcttttcacctcacaatcttctggatgagattcggaataatccaccaagtttgttgatgaatcaacaaattaacccaaatgaatcactcatgccagttagaggaggagttgatgatattccaaagccaccagtcgccaacagacctccggagaagcgacagagagtcccatctgcttacaatcgattcatcaaggacgagatccaacgtatcaaagctggaaatcccgatataagtcacagggaggcattcagtgctgctgcaaagaattgggcccattttccacacattcatttcggacttatgcctgatcaacccgtgaagaaccaaatgcatgtaacaggagggggaggatgttctgatgaaggaagggtttcttgctccagcaacatttggtgtatctccttaactaataatgaaagcatgggagtgggtctgttcgaat

SEQ ID NO: 14810 - DNA, 815 bp, Solanum tuberosum
  Predicted polypeptide sequence is orthologous to G2456
aaaaaaggggttttgctctctctgactctatcttctttcctcaaactcatatcatcataaaatacaaggaagtgtcaaaaggcatcaatcaaatcaaatcaaatcaaatcaatcacaaaagcaggaggaaccaatcagtttggaaaagaataagagaaataatataatgtcctcttcaaatagcttgtcattggaccaccttcctcctcctccaccacctccacctccttccgaacagctctgctatgtccattgcaacgtttgtgacaccgtcctcgcggtaagtgtaccgtgcacaagtttgttcaaaactgtgacggttcgatgtggacactgcactaatcttttgcctggatggcttttgccttccactaatcatcatcatcattttggtcacacttacttctctccttcccacagtcttctggaggaaataagcaatgcaaccccaaatttcttgatgaatcagagtaactcagctcatgaatttgtgcagctgcctgctcgacctggatttgatgatcttcctagaccgccgcccgttattaacagacctcctgagaagagacagcgagtcccttctgcttacaaccgattcatcaaggaagaaatccaacgcataaaagcagggaatcctgatattagccacagagaagccttcagtgccgctgcaaaaaattgggcccactttccacatattcaatttggtctcatgcctgatcagactgttaagaggactaatgtgcgtcagcaggatggagaagatgttcttatgaaagatggtttgtttaatacatcagccaatgttagtgtgt

SEQ ID NO: 14811 - DNA, 702 bp, Solanum tuberosum
  Predicted polypeptide sequence is orthologous to G2457
ctcgattttcttctccggcaagcgcagtcggcgaaccactggaggtagccgcctctctctccagtcgtctttccccttcgccttctcttcttcccccccgtctcctctttctcctcgtctgtccagcggccagcgaggacgagcatcccgcagccgcctggacaacaacaacaaagacattgttgttcaggccagtgaccggctaacatcggcgcctccagccggcgaagcccctttgccacttctctattctttccggcgaggatgagcgacaaaacgaggcagcagtagccgccggcaaatgacaccaacagtgctccgataaacagccggtgagaaccagccgattagcgaacctctttctccctctcctccctttcttggggaagtccggcaactggtgaagccaccagcgaaagagcagtagcagccgacgacaaccagcagctctggaccagcgaaaaaagctcctggcagtggctacgaaatcaacaacaacgataagatgctcactacaaggttccgaccaaggaccaaaatggaaaaaaagtgaccgggtgtgtaacattgagttctagtttgaagagttgccagggatggaattccggacgggatttagttctatttacattcgtatttgtcatatttgtataattttattcagtcatgtaatagttgtattagctcttctaactctccata

SEQ ID NO: 14812 - DNA, 864 bp, Solanum tuberosum
  Predicted polypeptide sequence is orthologous to G2457, G2459
taaacatgtcgtcaagctacattgattctactaattctgagcaactttgctatatcccttgcaatttttgcaatattgttcttgtggtgagtgttccatgcagcaacttgcttgatatagtgacagttcgatgtggacattgcacaaatttgtggtccgttaatatggctgctgcatttcactccaattcttggcaaaatcatcatcaatatcttcatcatcagtttagaaaactacactaaattctcctcatgatcaatacaagataaattgtggttcatcatccatcacaaacaattctactcatgagcagaggattgtaaatcgacctccggaaaagggcaacgaggaccttctgcataataaatcagttcataaaagaggagattcagaggatcaaaggtctaataatccagatatcgctcatagggaaagcatttagtactgctgctaaaaaattgggcacacttccctcacattcaatttgggctcaatgtgggagactgacaaatcaagctaaaactttggtgctaggtgagaacaaagaaaaacttataatgcatagagtttgcattgccaaaaataaaagacctttcaccttctaagagtattaattctctacatgttgtatgctgaaattattgaagacaagtgtgattttatttgttctaatttataagtacttataaattgtgtaatatacttggaaattatctgaaagcttccttttgtattggtctaacaagaacaagacaaaacaactcggaggggggggcccgggtaccccaattcgcccttataatgagtccgtattacggcgcgctcaatgggcgtcgttaacaaacgtctgaactgggaaaaacc

SEQ ID NO: 14813 - DNA, 956 bp, Solanum tuberosum
  Predicted polypeptide sequence is orthologous to G2465
cttccatactttccttcttaggtcaattaaatcatctcacaaaagctggaaaatttcaaagaaaacttcctttttctttacaaagaagatgatgagcaacaacaatttttcagagaaaatggagagatgtcaacaatatattgatgctcttgaacaagaaagaacaaaaattcaagttttctctagagaacttccactttgtcttgaacttgttactcaagctattgaaacttacaagcaacaattatctggtacaacaacagaatacaaccttaatgcacaatctactgaatgttctgatgatgaacatacatctagtgatgttcctgttttggaagaatttattccattaaaaagcacattttctcatgaagatgaagatgaagaagaagatgatgaagaaaatcaatctcataaatcaaaatcttttattattaataataataataatactagtaattctactagttctaaggatacaaaaaataaaaaatctgattggcttagatctgttcagctttggaatcaaacttcagatcccaccccaaaagaggaattaacacctaaaaaggtgtcggttgtggaagtgaagaaaaatggaagtggaggagcatttcatcctttcaagaaagagaaaaatgccgttgccgccatagaaacaacgtcaactagtggcgttgttttggcggcgacagggagttccaccgccgaaaatggcggtggaactaagaaagaagataaagatggacaaagaaaacaaagaaggtgttggtctccagagttacatagaagattcttacatgccttacaacaactaggtggctctcatgtggctacaccaaaacaaattaagggagttaatgaaggtggaaggactcactaatgatgaagtaaaagtcatttacagaaatatcgattacacacgagaagacctagtcctttcatcattcacaaac

SEQ ID NO: 14814 - DNA, 787 bp, Solanum tuberosum
  Predicted polypeptide sequence is orthologous to G2492
tttttttggctgccaactcaaagcagtgtacaatgcaatattaaatagtactatatgtttacattgcctttttatgagttaaatctgtcactgggtagatctatgagttgcaccttaatgattctgatatatatatacacaagtaaatctttgccgagtgacaaagatcttaagcaatcagtatccagtcatcccttcccttttggtcgaaaaaaaagaaggttagattcctactccctaagttagttattgttaggcacgaaacctgcaaggtcttgcattcaaatcagtttggacaaagaatgcattcttccaagaggacggttgggtacgcgtgaggtcgcgaatttctgcaattggcattcttcatcccacaaattaacccatttttcttcacccttccagcatttttcccccctggctttgtgggtgctcaggaagtaagacaaatttcatcaggttatgtttgattaccattcagcaacattttcagggcgagaatgaagtgcagaacaaccgtggatgcatgacttaagttgtttgacttgatatggacatccaagcggggatgataaatagcttctccaagatgttgttcacaaagtccaaggttgaacatcgaattcctctttaagccctcaaatttgtggaatgcatcaaaagaagaagctttgatcaagaattgggtgaacaacttgtttggaataaccacgcaatggaggtgaactcgctagaatgcctttgaggtactctagaaagctttgggacatcttgtctgctgaaaacg

SEQ ID NO: 14815 - DNA, 620 bp, Solanum tuberosum
  Predicted polypeptide sequence is orthologous to G2512
gggacgataacaccatcaaatcttatatacttcatgaagtaagactcatttcattgatcagtcaacaacattgtaataccaaattcataacgaaacagattagtcaccataataattataaattataaacaacttgtacttcaggtgatgcacgccgaaatgagtttagcacaatggggattgtgattgttctgctagcatgaccaattcttttcgagggttcaattagcattctctccagcatgggagacttggccaacaaaagcttgataagctgcaactcaggctctgagcctatagtctgtattagcttaacttccctaaggtgaataaatgtcacatctgagaaagcttccaaattaagacattctagttctggaatttcatcatcttcatcaatcacctggatttcaaaatattgcagatgcaggaagcttcttaacaagcaaagaacacacaagacgttatccaatcgcttcagaagaatcgaatctaagcaaagatgtttgacacatttaagattaaaagggagccttgctggtactttttttgctactgcaaccacaaacttaagactaaaccgattcaacttgagatgttcaagagcagagaaagactcc

SEQ ID NO: 14816 - DNA, 882 bp, Solanum tuberosum
  Predicted polypeptide sequence is orthologous to G2520
tgtcctaaagacatacaacaactctgttcctgatcagaaacaagctattatctacctataaatcaaggaactgttatatattttggcagttcctgggggaagcattagcctcctaagaatttattagcctttgatgcctccgattatttactttatgtcgttctttcaaatccaccacctatctgcatgtgcaaccagtctggtgatgttcccccagcatattcccttgtaccttgtgaaccaaatgccatagcgtttgtctcgaatgtttgctgcccaaagtctttagtaggaattccatcgatggttggggttactcttgtattaactgcttcaagcttcattgataggaactcaacctggcgttgtaatgattggacataattgattatctcatcaaggacaagagcttttccaataaccttgttacaaccagggaccaagtcttgtaggattttcatcctgtcactaatcttttctcttctggctctttctgctaggctatgactatcggtagcttgacctctcctcgctcgcacatggatgtagtccttaggtggttcagctggtggctttgcaggttggtctgaagattttcctgaattccctcctcctgaatattccccattctcgtttgatctcgtggccttcagccgcttactatcagattcagtcaaggcatttgcactagttgaaactccaatggcagattcatcatcgtcgcgtcgctttctggcggcgtgatttgttgtgtggtcgagaagatgctgatagggccagatctccgccaaattaggcgcagtttgaaaggcactcattatagtagaatgaggatccattagagaaatgctaataatgcatatataattagcatagtaatgt

SEQ ID NO: 14817 - DNA, 975 bp, Solanum tuberosum
  Predicted polypeptide sequence is orthologous to G2520
ggtcgctattatacgccagtagatacagtacgcaccaacaacttccattttcgtacacgcagagcttctatatatatcttctctcattcacatttcctacgtgaatgcctaatacttcaccattcgcttcggatttggattgggtattgaaatggatccacaagcttccatgatgaaccacgccggaggttttcagtctccgccgtttaatttatctgagatctggcagtttccgatcaatgcaggtgaaggcgagacgccgtatagttttccgtcgtctgcggcggcggcggcgcagaatgtgagtgatgttcggaataatgatcccatggttctagaccatagaacaactaattacagcggcggcggtggtggttcagctaggaagcgaaacgaggatgatgaatcagctaaaggagtttccactagcggcaatggcttgactgaatctgctagtaagcggatgaaggttacaagatcaaatgagaattgcgaatctagaggtgatggggaagggaattcagggaaatctgcagaacaacctgcaaagcttgctgaaccaccaaaagattacattcacgtgcgagcaaggaggggtcaagctactgatagtcacagtctagcagaaagagctagaagagagaagataagtgagaggatgaaagtcctccaagatatagtccctggttgtaataaggttattggcaaagctcttgttcttgatgagataataaattatattcaatcattacaacaccaggttgagttcttatcgatgaagcttgaagcggttaattcaaaaatgccaagcatagaaggatatccatctaaagatttcggacagcagccatttgatacaaatgctatgacatttggttcacaagctactaggggatatgccaggggaacatcaccagattggttgcatatgcagcttggtgggaggatttgaaagaacaacataaatctgcatca

SEQ ID NO: 14818 - DNA, 407 bp, Solanum tuberosum
  Predicted polypeptide sequence is orthologous to G2520
agtgatccccgcgctgagtaaaagatctagcacatcagctttggatacactggaatgattttcggcactcaagcaccgagagaatatgctcaaggggcacaatccgagtggctccatatgcaggttggtaacagctttgacagagcaacatgacagataccctaatgaattggaacatagattattcaggaacatcatgatgtcttttagagaaccttggtattggatccagcagcactatagaagaaccattcttaaatgtgtaatcataatcatttccagtagaattgtctgtattatcgttgtatgatcaatgtcctctaactcaagtgtacttgtaatatgtttgtattgatataagaaatagcctaagcaaactttctcagaaaaaaaaaaaaaaaaaaaaa

SEQ ID NO: 14819 - DNA, 683 bp, Solanum tuberosum
  Predicted polypeptide sequence is orthologous to G2522
gctttctcttcaattcaatcttctgaatctgtttgctcaaacaaattggcatcactcaatttctctctcacataccacacaatgacacaacacatatctattagttctgaaacagaaacaactctctctgccccacatttccattttcatttcagataaggacttgtcacagatttactgggaggctttgttcttgaaggagctttcagttgttattctttgtgctagttaggaagtgaaattcacagctaagtacattcttggattttaaagagatcttgaatgtgcataataaagttcccttgagaatttaaagaagttcagtctttttgtgccattttctaatcaaaggctgcaacttttactggttttgatgttgcgaagaccactttccatgtttaggaataaagagttgtgactttgattccattcccttagagatttaaatcattgttcgaaggggatatattgtttacggagttctgaaaaaagaaataaatgtatggatcgaagggaagctatgatgttacctggatcctctccttactatatgcaaaaagggatgagtgggagtgggagtgggaatgcccctggttacagggatcaccaagcattaatccttcggtaactcctactaatattgcctttcaatctagtggcagtggcgcttcgattccacaaca

SEQ ID NO: 14820 - DNA, 671 bp, Solanum tuberosum
  Predicted polypeptide sequence is orthologous to G2522
agcaaacatatatctatttgaatagttttttttttttttccatggaatggttaaaaaacacatccaggacacttcaagaatagaataattacagaggatcagatttcaaaatcaggcagagataatatgtcatacaccacaagatcaagaaaaaaattagctacattgatggaacagtttgcaactggaagacaaaccacaatatgttacacgcgcagactaaagcctacagcataaattgaactactaccgagtagaaaagcagattcatgttaaagtaaaactgcaaaagaactcctatatcactacaatctaaggtgattgctgatggttgtgagaacatgtcttatgtcaagatggtaggactggagaaatcagaacacaatatatacagtgctcacttgtttacctacatttgacatagtcatcctcgcattaaatcaatgtcaatatggccagtttgtagatccatctgccttgaactaggccatactcccattgaagaggatggtgcaagattctggtttgaaagagcatcagctggattaacggaattgtcagtggtctgaagatctgaagttcctgcactctgtacactttctgcagctcttttctttgcctttgaacttgagcataagaagcttcccactattacctgaattggacttgct

SEQ ID NO: 14821 - DNA, 880 bp, Solanum tuberosum
  Predicted polypeptide sequence is orthologous to G2550
catattctctgcaagcttttattctcatattcaaatacaaaattacaatatatgtatatcaattgaggattctatctctagactaacattcacaatgtcctcactattatacagatggattatccaatagtatatttacataattggtaacccacttctcgttgatacaataagtggaaaaaagtcttataaccaatatatgaaagatatcatttttttacactacaaaatcggatagaagatgaggacctgagaacctttcttgctggtttactggatcgatatagtagtactcacctttaccaatgtccatatgagtagaatccgtcttctcgtcctgtcttaactgtggcctaccagacattggctgctggtccatttgactgttttgcagacgcagagcgagtgatacttgattgcccattatgtcaccaaacatggaaggatggtatgtattgacagcaccaatgatgcttccatcactagtcggtttaggaccaaagccgtgagcaataggaatttgttcgctctgcaacttacttgatccacaatcaatcctctcatgttcataaacaccgtcttggaagctaaatttggttgtaaatgaattgttgtgtacattagtaacattattacgtgactcgtcagatggatcgagatgactgcagttagcagctggagtagtaaagctttccggaatctcttctcctgtgttttcagctattgacttctctttggagtctaccggtactcgttctggtgaaactccggaacctgcttctgccacaccaaactcttccttgtacatatcttcaatcatgggcttccaaagacgcactcgagcatttatgaaccagtttgccacctgacttctggtaaa

SEQ ID NO: 14822 - DNA, 825 bp, Solanum tuberosum
  Predicted polypeptide sequence is orthologous to G2552
aaaactcccgtttagttgggatcatgagtactaaacaacaagttaaatgataaaaacaaattaaatctaagaaatgattagtttaatcatatgcatgtatgtgaacgacaacgcaccattgctagaacacgtggttttaatttaaaagttacaaacgatcatcgatgctcaatgacatttgtcatgctttgataagttcaatattttggaaagttacaatgacgtgacattagaccaaaggagatgtctcgaagtcaaatccttgattaagaaaagcactagctatccatagcttcaaattgccaaagtttatgtccacctcatgacattctctcacattaagagtaaaggtgaaaatgtaatcattggtagaagtagccaagttggaagtttgaacattgaatccagtgagagactcaagagctttgaaaagagaagctgcaatttgtcgccctttgttgcaaattaatctcacgtaaaatcctttttcttctacttgattaatgtccatctttgttatcctcttgattgttggataatagcttgtgaaattcattttcttggcattttgaaatagtccactttgattaattgatgactcaaactctgctatttctacttttagtttcttggctctcgtttgcagtccttgtacgtataatattgcatctcctatgatggaggctttatccatctttgtgatattaggaactaaggatcgcaaagcgtaaagcttttccttcatttctcctctccctttgcgctcggaaatcaaagtctcgacgggtcagtcctcgtgcctttgggtggtggagtcattttggg

SEQ ID NO: 14823 - DNA, 738 bp, Solanum tuberosum
  Predicted polypeptide sequence is orthologous to G2559
gcttctcttcaaccccactctctgatataatcttacaattctgcaattcgattaagatatgggtgaagaagaagccaagaaagtggagactgctgaacatgtcgcagaggagaaagccatcgtcttatcaactgtacctccttttaaagaattggaagacaaacccgatgattccaaagctctcgtcatcgtcgaacccgaaactaaagcgctggtacccgttgagaaaaagggatctattgacagagatgcaactcttgctcggttaacgacagagaagagattgtcgctaatcaaagcatgggaagaaagtgagaaatcaaaagctgaaaacaaagctcagaaaaagcggtctgaaattcttgcatgggagaacagcaagaaagcaagcttggaggctgagctaaaaaggactgaggagcaattgttgaaaaagaaggccgagtacattgagaaactgaaaaacaagattgctctagtccacaagtcagcagaagaaaaaagagcgataactgaagctaaacgtggagaagatcttcttaccgcagaggagatggcagcaaaatgtcgggccactggaagttctccaaagaaaccactccttggatgtttctgaagtggaaaatactagacttgtatcactggttataaaagttgtatagtgaagtttgtggattgagaatttctttgcattagaaacattgtgtgcttatgcccttgtgggatctattgctttcg

SEQ ID NO: 14824 - DNA, 737 bp, Solanum tuberosum
  Predicted polypeptide sequence is orthologous to G2559
cacgaggccaactactaaatatcttcttctttgaagaattctctgttttcttgattctgtttgtagccatggcagaattggaagctaagaaagtagaaattgtggaccctgcaccccctgcgccaggacctgttgaagctcctaaagaagtggtggctgatgagaaagccatagttgcaccagctctgcctcctcctgcagaagaaaaagaaaaacccgatgactcgaaagcattagttgtcgttgaaactaaagcaccagaacctgctgatgagaaaaaagagggatctattgacagagatgctgtgcttgctcgcgttgcaacagagaagagagtatcactcatcaaagcatgggaggaaagtgagaaatcaaaagccgaaaacaaagctcagaagaaggtatctgcaattggtgcatgggagaacagcaagaaagctaacctagaggctgagctcaaaaagatggaggaacagttggagaaaaagaaggccgaatatactgagaaaatgaaaaacaaaattgctctactccacaaggaagcagaagaaaagagagcgatgattgaagctaaacgtggagaagatcttctccaggcagaggagcttgcagcaaaataccgtgccactggaactgctccaaagaaaatccttggaatattttgaagcagcaagcaccaagtctgcatcggtagtgattggggagtacatttttgtaagttgtgcatttggaatttg

SEQ ID NO: 14825 - DNA, 946 bp, Solanum tuberosum
  Predicted polypeptide sequence is orthologous to G2559
ttaccttcctccaactactaaatatcttcttctttgaagaattctctgttttcttgattctgtttgtagccatggcagaattggaagctaagaaagtagaaattgtggaccctgcaccccctgcgccaggacctgttgaagctcctaaagaagtggtggctgatgagaaagccatagttgcaccagctctgcctcctcctgcagaagaaaaagaaaaacccgatgactcgaaagcattagttgtcgttgaaactaaagcaccagaacctgctgatgagaaaaaagagggatctattgacagagatgctgtgcttgctcgcgttgcaacagagaagagagtatcactcatcaaagcatgggaggaaagtgagaaatcaaaagccgaaaacaaagctcagaagaaggtatctgcaattggtgcatgggagaacagcaagaaagctaacctagaggctgagctcaaaaagatggaggaacagttggagaaaaagaaggccgaatatactgagaaaatgaaaaacaaaattgctctactccacaaggaagcagaagaaaagagagcgatgattgaagctaaacgtggagaagatcttctcaaggcagaggagcttgcagcaaaataccgtgccactggaactgctccaaagaaaatccttggaatattttgaagcagcaagcaccaggtctgcatcggtagtgattgggagttacattttgtaaagtttgtgcaattggaattttgtttcttgttagattacatttgtgtgattatgtattttagaaccatttattgtttattgttacgtgtgcatagtgatgtatttccagtgtatatagcacctggacaaattaactttgtgggattgtatgaaaaaaaatgttgaaggaaatcttcatgttagtacacaactcttgcagaaaaaaaaaaaaaaaaaaaaaaaaaaaa

SEQ ID NO: 14826 - DNA, 826 bp, Solanum tuberosum
  Predicted polypeptide sequence is orthologous to G2559
caaaaagttggaatctccagatattagtttccatttcccttttgttgattgattccttcttctttcactatatacatacatttaatttcaattataagaatggcagaagctactgcagttgcagctcaacctcaaccagaattaccacctcctcctgccatggccaaaactgatgactctaaagctcttgctactcttcctccaacaaagcctgactcttctacaaagaaaagttcgaagggatccctcgacagagatgttgctctcgcacaccttgaaacagagaaaaagaattcctatatcaaggcatgggaagaaagtgaaaaaagcaaggtgaataacaaggccgaaaagaagctctcttcagttggaacatgggagaacaccaagaaagcaaatattgaagctaaactgaagaaacttgaggagcaactagagcaaaagaaagcagaatatgcagagaagatcaagaatagagtagctgcagttcacatggaggcagaggaaaagagagctatggttgaagccagacgaggagaagaacttcttaaagcagaggagatggctgccaagtatcgtgctacgggacaagcccctaagaagattggatgccttggatgttaaagccataaaatgtatctttctcttttgtgaattttcatgtttgttgctctttattgggtgtttcaaacatattgagtttcatactttgtgtaagaaaagcactttatgaaagtttttaacttttaaacgtgtccatgaagtttctactgatactttcatactgctattcgagattatgtataacaatgtctgcgaaaactac

SEQ ID NO: 14827 - DNA, 820 bp, Solanum tuberosum
  Predicted polypeptide sequence is orthologous to G2565
aggaaaaaaatcaacgttcatcgttcaaattctttcgatttcgccggcgatgatatgaaatcccccaaaatctgcaaaaacgatttatctgtttatacatacaggattcaatcttggacacgggttactaagaaattagaagatactaattgaggagaatatagtagtgtgctgtactcatccacaaagttcaaatggaagcacgccctgctgtgtctgttcaaagtgtggttgcaagtcaactcagtaattgtggtgcatcaggggcactttcttcttccttctctatgtttccaacagccctaggagaaaagtaccctaagtttccagacttgcagcaggcttcgatggagaaggagctcaagcaacatcctggaactgttgtctcttctttgccttccaacagtggggctgttggtcttatgttctcatcatcatcaggattttccgcagatcttcagttctcatctgtttcaccccaggagaagcattcaggacctgcacctttcatttctcagtcaacatatagtgagacatcgatccaattacctcattcgggagttcttcagtccacagcatcaagccaatatttgaatgaaaaccatgaaccctggtgtatagatccattgcctaatttccttgattattcgatgaacaaccctgtccagaatagtcaggtagcttgtagcaataaacaaagtgattggcaggagtgggccgacctttgtactcatgatgaagatgctttgccttctaatggaacgacatcattgctgataccagtattgggcactcggagctgaagaatgcatttcaggag

SEQ ID NO: 14828 - DNA, 849 bp, Solanum tuberosum
  Predicted polypeptide sequence is orthologous to G2592, G2713
ccggtcgtaagcatgtcgtagcatgtgctgcagtctgtaggtcatggaggagtatgtgcaaagacattgttagaaatccggaattttgtggaaagctaacttttcctgtttccctaaagcagcctgggcctcgtgatggaactattcagtgcttcatcaagcgggataaatctaatttaacttaccatcttttcttgtgtcttagtcctgcattgttggttgagaatggaaagttccttctctctgcaaaaagaactagacgtacgacttgcacagagtatgttatctcaatggatgcagaaaacatctctagatcaagcaacacctatattggaaaattaagatcaaattttctaggtacaaaattcattatatatgacacacagcctcctcacaccggtgcacatgtccctcctccggggcgcacaagccgtagattcacttccaagaaagtctctcctaaagtcccaactggaagctatatcatatcccagatcacttacgagctgaatgtgcttggaacacggggtccgcggagaatgcactgcgtcatgcactcaattcctgactcagcccttgaagccggtggctctgtgcctggtcaaccaaagcttctctcaaggccccttgaggattcattccgcagcatctctttctcaaagtctcttgatcattccacggagttcagtagtgcgcgattttctgatattgctggaggatcaactaatgaggaagatgataacaaggggaaaccactggtcctaaagaacaaggcgccacgatggcatgaacaaactgcagtgctggtgtctgaatttccgaggacgagtgacagttgcatctgtcaag

SEQ ID NO: 14829 - DNA, 861 bp, Solanum tuberosum
  Predicted polypeptide sequence is orthologous to G2592, G2713
ccattttcacctttcatgttaccaccttttttttatccttcataacaatctttatcttcactttctcttttatttatgcttcttgatctcatttgaataatcaacttcttgttatctcagtttggttttaatgcattgggtgttgagtttagacatgaaagaatgttaaagattcaatctttttggtgtttagggggattatggatttcagatctggatttgaggtgcattttgggttgtgggtgtgatttttatgaaattctgtgaggtgggtctgttttggttgagtttataagcattgttttgagaaatcaattttttagcattttttgggttgtgagatgaagtggggttatgggtcaaagtcaaggtgtcgccagagttcagtggtggctgtggcggaggaaacagaggggattgatgaagggcttgtggagagctgttgggctaatttgcctttagagttattgagagaggttcttatgaggattgaagatacagaatctaaatggcctttgaggaaaagtgttgtagcttgttctggagtgtgtaggagctggagggagattatgaaggagttggtgaagactcctgaagtttctggcaagttaactttcccaatttctgtcaagcagcctggtccacgagacacactccttcagtgctttataaagcgaaaccagacaacacagacatatcatctataccttagtttgactcaagcattggctgatgatggcaagtttcttcttgctgctcggaagtacaggaaggccacctgcactgactacacgatatcactagatgcaaatgaaatgtcaaagggaggtggcacttgtatcgggaaattaagatcaaatt

SEQ ID NO: 14830 - DNA, 923 bp, Solanum tuberosum
  Predicted polypeptide sequence is orthologous to G2592, G2713
aagagagcgagaactcatggcctgcccgtaagcatgtcgtagcatgtgcttcagtttgcaggtcatggaggattatgtgccaggaaattgttacaagtcctgaagtttgtggaaagcttacttttccagtatcgttaaagcagcctgggcctcgtgacggaatgattcaatgcttcatcaagagggataaatctaatttgacttaccatcttttcttgtgtctcagtcctgctttactagttgaaaatggaaaattccttctctctgcaaagagaacaaggcggactacttgtacggagtatgttatctcaatggatgcagaaaacatctcaagatcaagcaacacttgcattggaaaattaaggtcaaattttctgggtacaaaattcgttatatatgacacccagcctccatacacctctgcaaacattccgcctccaggccgctcaagccgcagattctattccaagaaagtctctccgaaagttccaactggaagctacagcatagcccagatcaaatacgagctaaatgttcttggaacacggggtccacggaaaatgcactgcgtcatgcactcaattcctgcctcagcagttgatgtgggtggctcagtgcctggccaaccggaacttctcccaaggtcccttgaggattcattccgaagtatctctttctcaaagttgctcgatcattctgctgagttcagtagctcacggttttctgatattgttagagcatcatccagtgcagaagatgatagtaaggtgaaacccttggttctaaagaacaagtcaccgcgttggcatgaacaactgcagtgttggtgcctgaattttagaggacgggtgacagttgcatctgtaaagaattttcagttgatagcggcccaccaaccagctgctgggggaccgacaacgtct

SEQ ID NO: 14831 - DNA, 888 bp, Solanum tuberosum
  Predicted polypeptide sequence is orthologous to G2592, G2713
acacaaatggatgttacaactagaaatcacacatggtacaaagtttatacattgttcctttcaccaagtttagcgaaaattacaacagaaccatcttaaactatatgaatgaagaataaaacgaccaaggacgaagagaaggtaaaaaaagaaagaagagaatagtaactttcaaatgtgcaagagcttcctgcatcttcttgattatgatgaagagtaacacaatgactagtatcaactaaatcttctatttgtcctttctattcacatgccaactttgtgtcaaagctgctcaaacagatggcgaaagcctgaaaggcagataaaggatatcgataatccattgtaaacatatctttgccaaccttaccaaactgcaagataatcttgtcttgatctgatgatgactgagccggttgtgctggtgttggagcaccggctgcacgctgtgtagcagcaatcagctggaaattcttgacagaagcgacagttaccctccctcggaaattcagacaccaacattgcagctgttcatgccacctaggtgccttgtttcgaagaaccaaaagactactcttaccttcttcatctacttcacttggacccccaatatctgaaaaccgagcgctgttgaactctgttgaagcatcaattgattttgaaaaggacatgctcctaaatgagtcttcaagattcggagggagaagttcaggttggcctgggacagtgcccccgggttcaagggacgagacagggattgagtgcatgacacaattcatcctgcgaggccccctggttccaagtacattcagttcgtagctaacctgtgcaatgttgtaggtgcctgtagggactttgggagaaactttcctggagtagaatctccgg

SEQ ID NO: 14832 - DNA, 995 bp, Solanum tuberosum
  Predicted polypeptide sequence is orthologous to G2592, G2713
gtaatgtcgctctactaggtttgttgggatgaaacaagtctctccaagaatacccactggcaactatcctgtagctcacatctcatatgagttgaatgtcctgggggctagggggcccaggaggatgctgtgtatcatggacgcaattccggctgcttctattgaacctgggggtctagcccctacgcaaacagaatttgttccggtgaatgtagattccttcccctccctccacttttttagatcaaaatcaactcgcgtggataacttctcatccgggcctttaccaagtccaaaagatgaagttctaactttgaagaacaaagctcctaggtggcacgagcaactccaatgctggtgtcttaacttcaatggccgggtgacagtcgcttctgtaaaaaactttcagctagttgcttctctcggggatggagctggacaggaaaatgagaatgttattctccaatttgggaaagtgggagaggatttgttcaccatggactatcagtatcctatctctgcatttcaggcattcgctatctgcctcagtagctttgacaccaaaattgcttgcgaatgatgagataacaggttctgcaagaagtactgaggtgtttggattgggagattgcactaaccctatttaacgttggttacctgaacttaaccgctcagttaaatttgcagtaaggtatgtcccgtcgtcgaggattaatcacccgttcttcatgctcttggacctttcgtgtcttggatatttgtagatagacacgatgatgattccacagtttggttcatccaacttacctatttctgtaagcacaatgtttgaacttgtatacatattgcacctatctcctgtgtgagaatggtacttcagtttcctggaatttttgggtgttcctcgcgttccatataagtttcacagaaccgtgtatttacccgcaatttgtggttttgataaaccccaaggaaatttctggaattgacaacac

SEQ ID NO: 14833 - DNA, 933 bp, Solanum tuberosum
  misc_feature (70)..(70): n is a, c, g, or t
  misc_feature (787)..(787): n is a, c, g, or t
  misc_feature (795)..(795): n is a, c, g, or t
  Predicted polypeptide sequence is orthologous to G2604
agtggatccccggcatgcagtgttatacggcacgaggcaaatgtgcagtagatgaaccagtaacaaatcnatgaaacagtaaagatggaagcagctgctctgttagaagtttttgaagcagtaggcttttgagatctcaggagaggactacctctgttagcttcacaatgccagttccgcttgctccatatcctacaccaccaacaccatttacaccacctgctaacggtacgcagagccagcttgtgtgctctggatgcagaaatcttttactctatccagttggagcaacatctgtttgctgtgcagtttgcaatgcagtaacagcagtaccacctccgggcactgagatggctcagttggtttgcggaggctgccacacattactcatgtacattcgtggagcaacaagcgtgcaatgttcgtgctgtcacacagtcaatttagctatggaagcaaatcaggtagcacatgtgaattgtggcaactgccgcatgctgctgatgtaccaatatggagcacgatcagtgaaatgtgcagtgtgcaattttgtgacatcggtaggggtttcaacgagcacagctgagcaaaagtttaacagctaactttaaagcagctgagccagtgctagaaacttctatgtctaaagttgtcgtgttatgtgtcagcggcattgcagctgcatcaaccggaggaaatttctacttgctactagtataggagctattacagagctttttttcccctcgtgcatctgtaatagaataagcagttttgcaggttgagncttacaanaagggtattgtatataatgggtattggcgtttggaaagtctagttgaaaagaatcctggatagcaaagactcttttcagcctaaccatattatgcgttcactcttggggattgccttaatacgacgtttcaaacatgt

SEQ ID NO: 14834 - DNA, 963 bp, Solanum tuberosum
  Predicted polypeptide sequence is orthologous to G2649
gatggcaaagaggccgtgaagaccaccaggcagcggctccagctgctgcccaccggcgtccagtagcacctccgaccgccaagagctcctcagcaaacagtagctccggcgaggccagtgaccagcgcctctgtttctcccctgtcttttctccgatacaatgaacgaaagacaccagcaacagcagcaggcgacgaagacagccagcagcttcagcaagcaggctccaccaacggaaacaacaaactccggcgagcagctccagcgaccaccactggcgaaaatcagcagcagctgccggcggaagcaaccaacagcaacaacgctgctccgagatggtaaaactccagcgaaaaccacctgcaacaacagctccggacagcaacaataactacggctccggtcagcgaactccggtgatgtaaagttctgattaacttgagatttaaagggtgcaaagacagatcattacagatcaatccagagtcatggacactttcaactctccaaacccgcaaatggtcatagaggtaaactacaagctaaggaactggtggatggatatcaacatagaccgtgaaagagagattcggcagttgttgggcggtattacctatctcatctttgtcataccaaaccctcacttgattagggccttgcttgaattttgggaccctgtgaggatgattttcaaatttgtggattttgacttggcaccaacgattgatgagataagtggtttcattgacatgccataccacgagtgtgaaatgatagtaccatataagccatcatcgagggagtttctaaaaagtctaggaatgaagtcaaatccaaccttgccttctctagacccttgggtggattcatttcgactttctttattcacgctttggccgagatgatagttattactcttttattgatgagtttaaatgcttcgttgaggaatgggaacatatc

SEQ ID NO: 14835 - DNA, 938 bp, Solanum tuberosum
  Predicted polypeptide sequence is orthologous to G2655
cgagaattctagtgtttgtgcctttgcttgaaacttccaatctaaagttaggtttctttggaacaaacatatttatttctcttcttcatctcctattgtttgtcctctttttttctttcttagcctttcaaacaacttttcttgtctatatatgttatgaaaataaagtaaaagagaaaaaaagggtatttggggtcaataaaaaaaaaatggcattagaaacagtgatttacaatcaagaaacatttgggtacggttgcaaagagtactacaacaataatttgggtaactttaattataattatgagttggatttattacaaggcgaaggaggaggtggagaaatgagttttacaaatttgttggatcataataatcgggaagaatcttcatcatcgccaccagaactaatgtacaacaacaatgcgagagagtacaacatttgggacccaaattcttcgatagaagatcatcagctgtttatagaagggtcaccggcggctgaaattccggcggcggcggtcagatctgccgccacctccggccgccggaaaagaagacggacgagaagttgtaaaaacaaggaggaattggagaaccaaagaatgactcacattgcggtggaacggaaccggcgtaaacagatgaatgagtatcttgctgttattcgatctctaatgccaccttcgtatgttcaaaggggtgaccaagcatcaataattggaggagccataaactttgtgaaggagctagaacaccatcttcaaaccctagaagcacaaaagagaagccattctcaaaaacaagaacactcagataatcatggctcatcatcaagtccactatttgctgattacttcgcgtttccgcagtactcaactcattccaagagtacatctccggcagcaccagcatctactgctgccggatcatgtgac

SEQ ID NO: 14836 - DNA, 590 bp, Solanum tuberosum
  Predicted polypeptide sequence is orthologous to G2699
tgcccttcaatggccttataaataacactatttgatgcacaaaatccaaatctatgccatgggatgagatccacataccctgctagctcagtcacactcattaatctcctttcaagattactacctccatgaagatttgtggcattaggacaaaccctagaagcccttgaaattaatgccctaaggaaccatgatgtgagtctttgatttggatctccattagaagaagccaaattgttgagcacccacatgacttgttgagccaaagtaacatcattgttctctaaggcacttgcacaatgaagtaatagtttttccaaacatgctccatcaaggttcccaatgcatccttgtagtgctcctgctagagaactttgagagttgttgaaaaaactagggttttggaggggaatggttgtgaagttcattgaaacttgactctactataatgctaaacacaataaaatggaagcaaggaccaacttgaatctgaactacgattgatcagatgaagtcttcaccgaatagaatttcccttttcgtgatgaagtgatgtatgttatatgtgaaggataaataaattttgtaag

SEQ ID NO: 14837 - DNA, 775 bp, Solanum tuberosum
  Predicted polypeptide sequence is orthologous to G2699
gcagaaatctcacctttaattttctctctctctctgcctctgataaagaagatgcagtgctattaatccgttttgtagcctttgtaaagctttttcttatgagaagtccttattcatgccaaccagtctctcttttgcctcaattttgactttaacagctgatcgacgagatatatatatatatattgagattttctccaccagtcattttactctttaaacaaaaaagttgaacagtcaattattgttgattcatttccagaatattgcaaaaagttctctctgcactgctattagccactagcaaaccaataatggatcgcttcccaataatattgttcaggtaccactactactagtctagtctttttctcttgtcttctctacttatttctcaaaaaaaaaaagttcatttggaaatacttttctctaattccttcctctcatgatgcaatttactgagagtttacctccacaagtttcatcattttcaagtttgatgatgaataagaatagtaatactaataataatcagatccaacacgcgcgcccatggcctggttttcacacatcgaagaatttgggaaacattggggatactaattgcatggaacagttgttagtccattgcgccaatgccatcgacagcaatgacgcaactttagcacaacaaatattgtgggtccttaataacattgccccctcctgatggtgactcgaacccacgcctaacttgtggattcctccgaagccctattcttcgtgctgcgaaaat

SEQ ID NO: 14838 - DNA, 994 bp, Solanum tuberosum
  Predicted polypeptide sequence is orthologous to G2717
ctcgtcccttagatttcaatttcaacagttcgccgtggttttgtcaattaacaggataacaatggcgtaaattctgttcgccggcgagttacttttgtcaccgtcacaaactctgcgccggcactttcttccgtgaagacgcttctgtagataggagagctcaacttctgtattcagtgctagaaagttgtcaacctattaatgggtgcaccaaagcagaagtggacatcagaagaagaagctgcccttaaagctggtgtagcgaagtatggggttggcaaatggagcaccattcttaaagatccagagtttgctgctgtgttgcgctctcgctcaaatgtggacttgaaggataaatggaggaatctacatgtcatggcaagtggttggggatctcggcatcgagggaagattgtgtctaaaagtgttcagcctacaccgaagcacgatgacaacaccttggttggctatgtgggtgagaatgatatagaaattcttgatgttaaacctcttgcatcgactgggactggtgatgtactgaaggatgttggctcaaaaaaaccattttcaagattagatgatcttatactggagtcaatagccaaattaaaggaatcacgtggatctagtcggaatgcaatttcttcttacatagaggagcggtatgtggcacctctaaactttgaaagactgttggcagcaaatttgaaggtgttgactgaaaaaggaagactgataaaggtaaagcatcactacaggattgcaccgagtagagcatcatctgatggcaagggaggccctttctcttcgcttatgggcggaaagcttgattccactatggtagaaaagaatgaaactagattactgactaaagcacagattgatgcggacttagagcaaatgaagagcatgagtgcagaggaagctgctgcagccgctgcacaagcagttgcagaggctgaagttgcattgctgatgcagaacgggcagcaag

SEQ ID NO: 14839 - DNA, 937 bp, Solanum tuberosum
  Predicted polypeptide sequence is orthologous to G2717
agtggatctcctcaggcacatggttcaaaacgatctatgataaggttggataatcttataatggaggctataaacaccttgaaggagccaggtggttccaacaagaccacaatagctgaatacatagaggaccagtactgggcacctccaaattttaaaaggctactgtccgggaaactgaagtatttaactgcaactgggaagcttatcaagacgaagcgtaggtatagaatagtacctacgtcaacaccatctgacagtagaagaaacctgtccattacacttttggacagcaggcagaggatcttccccaagattgatcaggatgatatgaacatgcttagtacatctcagatagatttagagctagctaaaatgaggaacatgacacctcaagaggctgcagctgctgctgcactagcggttgctgaagcagaagaagccatagcttaagctgaggaggctggtagggaggctgaggctgctgaagctgatgctgaagctgcacaagccttttcagtagctgcaaagaagacactacatgggagaagcgccccaaggatgatgatacatgcttgattgttcctttggaggtgaggtgggtgtgcgagttagagaattgctagatcccattccagtttgatgttgtatcttcacagcttgtacatatggcgacaagtttcatgctaagtgtaatctactgggttgttagtagtaaaagtgtttttgttgtatcagtgtgtttcctgttcaccagaggactaaaccaaatcagatgtctcctttttaaccgtaaccgtttctgctagctgagttcccgagaacaggaataaccccgggaagggggttgttaatgcatggatgtactggatgctctattgttagtgtacaacgatttattatttatttgaactggatttggaaggagaataaatta

SEQ ID NO: 14840 - DNA, 1018 bp, Solanum tuberosum
  Predicted polypeptide sequence is orthologous to G2719
ataacaataagcagagaagatgaatgaaaagacggagcagaacggttacgccgccgccggcgacggcgatggcggcgacggaggatgtactttggttgatgccggtgatgcgatgttgcacggaggaagaggaagtacagttagtagtggaagagtcaaagagccctggtcgccggaggaagatggaatactgactgaacttgttaataagttcggtgcaaggaattggagtatgatagcgcaagggattgcaggtcgttctgggaaatcgtgccgacttcggtggtgtaatcagcttgatccggtgcttaaacgcaagccttttactgatgaagaagaccacattataattaatgcgcatgccgtccatggaaataaatgggccgcaattgcaaaattgctccctggtagaacagacaatgcaattaagaaccactggaactctacactaaggcgtcgatttgcagggctatggagggttaaaccagtatgcagcatgatgttagatgatagtagcatttacaaagccagggcattatctgaagaaactatgtcacgtgaagatgttaaccaaattaagcccctcgaaatgcaagaagttagtcgtactgagtgcatgaccagccagtctgaagacaaagatcaaatatatgggacgtgtggtattcctgagaaaactccacacttcgcttttgaaagaagtcgtcctacatctatgggaaacagtgatccacctgcttctcatccaactgagaaaattggcgcatttaatgtttataacccttctgtaacttcaagaatagtgccaatgcaggggcctctgatccacacattctcaccagactttgatatatgcaaacttcttgaaggtgtatctggtgaaaccatagttcctcaggggtgtggccatggatgctgtgcagctaccaccaagagcacctccaaaagttcattgttgggtcccgagtttgttgattacgaggaacatcctcctctcctcagccatgagttagcttct

SEQ ID NO: 14841 - DNA, 944 bp, Solanum tuberosum
  Predicted polypeptide sequence is orthologous to G2747
ctagtttatgaggatactctttctttcaccctagctatctagttccagttcctctcacactaataactactggacgcaattacttttttcccatcacatcttctctaattagatctatgctgggtcctagatcatgaatttcttcgatcaaggaggtacacgccaattttctcattcttcttcttccagccagaagattatagttcctgatttctcttatcagcaaagaagcaccactaataatggtgaagatagtactgatctcgtgatgaatatggatcttgaccctgcagatgaagttggtgaaagtaatacgattgagcgagaacacatgttcgataaggtagtcactcccagtgacgtcggcaagctcaatcggttagtcatccccaaacagcacgctgaaaagtattttcctctggattcctctaccaacgagaaaggcctccttctcaatttcgaagacaggaatggaaagccttggcgcttcagatattcctattggaatagcagtcaaagctatgtaatgaccaaaggttggagccgcttcgtcaaggagaagaagctcgatgctggggatattgtctcatttcagcgtggagtaggtgaattgggcaaggatcgtctcttcatcgactggaggcgccgtccagacgcccccgaccatctccactacacccacttcactaatcatcatctccataataacttgtaccgctctaatattcagtacccagctgctgctgcttggaatcgtcctctctttttgcagcctcctcctcctcctgaccattcacatttacaatattccctggaacctgcagctggcagcatgtctcatcatcatcaacaacaatctcacggatccagtcctaattattactacgacactttgtatttcaacaacagccgtacaaccgtggtaaatggaaacccttgtccga

SEQ ID NO: 14842 - DNA, 990 bp, Solanum tuberosum
  Predicted polypeptide sequence is orthologous to G2763
ccctccactcctaaatctctctctctccgattcatcaattctgaagaaataatttctcacttctaatcctcatcttcttcttcatcatcatcatcaggttttcttcttcagacctcaaattggatagtgattcaatcgattcggtcctaaatttgattcgattttaactgaatctgatggaaccaatggttgtagagatgtcttcaacggtgatctcgaatcctgtaatgtcttctgacagagtaatatcaaggagaaaaaagagtaagaaaagtttgagaaatcaaactcaaaacattagcaacaataacagcaacagtgaaactccgagtaatactactgaatggaaaactcaagctcaacagcaagtttactcttcaaagctactcaaagcactccgtgaattgcggatcagttcaccagcggcggcgacgacgacttcatcggtgccggcgccaaaaggcggtcgagccgtacgtgaagttgctgacagagtccttgccgttactgctaaaggacgatccaggtggagccgagctatacttacaaaccggctcaagctcaagttcatgaagaaacacgccaagcggcagaaaatggcggtttcctctaccagccggttacctaggaagccgagagtggggattttgaagctgaaaacgaagaatttgccggcttttcagaaaaaagctcgagttttaggacggcttgttcctggttgccggaaacaaccgctgccggtgattctagatgaagctactgattacatagcagctcttgagatgcaaattcgagcgatgagcgctttagctgacctcctttctggtgcttcctcaagtactactgctcctcttgatcagctcagctcgagtcgacctcctcctatttgatgatttatggttttcttgcttttctattttatctattttcttctctccctttctatgaatattcctctgttacatatatttcttctatcttttcaagtgt

SEQ ID NO: 14843 - DNA, 1021 bp, Solanum tuberosum
  Predicted polypeptide sequence is orthologous to G2766
atcccctcaccccacccacccacctctctctctattaagttctcaacctccaaatcttaacaatccaattcaaaacaattctcaaatgtatccatcatcaacatcttcttcatcacaaggttcaatgagccacaccagcaccaccgctggcggcggcggcggtctcactcgctacggttcagctccgggatcatttttaactacagcagttgaatccatcgttaacgcgaaggaacaatcgaatttacagaggtcaattggtttcaacgacttaacaatcggcggcggcggcggaggtttgccgacgacttcaaccacgccgttggttcgacatagtagctcaccggcgaggtttcttaatcaacttgctactgctgcaggtgatactgtttcaatggggagaggaagctataactcaaaaggcggtggagatagtggccggggaataacaaggctgaactctcagctcagcttcactaggcaagaagctctctctcaaatagcagaggaaaatgaggatattgaagggaccagtatagccaatggccacagaaagtcaacacattcttatgccagtgcaagtggtttcgcaatgggttcttgggaagataacaactctataatgttctctgtcacacctagcaaacgagccaagcagattagcaatgacatggtcaatgggctcgatgatggggaaactcagtttcagtttggcttgtctcagacagcactagaaatggcatctatggatagattgctgcacatccccgaggattctgttccttgcaaaattcgtgccaagcgtggttgtgctactcatcctcgcagcattgcagaaagggaaagaagaaccagaattagtgggaaactaaagaagttacaagatcttgttccaaacatggacaagcaaacgagctacgctgacatgctggatctagcagtgcagcacattcgaaaccctttcagatcaggttcagaatctgaatacagaacttgaaaactgcaaatgtggatgtaagaa

SEQ ID NO: 14844 - DNA, 749 bp, Solanum tuberosum
  Predicted polypeptide sequence is orthologous to G2774
gaaacttggctagtatttgttttggtgattatttaagcaataagccattggtggactttaaaccaagtctcaaaactttgaatttggcacaacataagaagaatattgggctacaacaaccttatataagcaagtctaggggtacaatatcaacatgcaacacattgaagagaagcaatggaagatcacaagaatataatccaagtgctggaaaaaagaggaaattagaagataatttagagactaattcaaaaaggcaaaagaatgaaaattctgcagttacatctaccaagacacaagttcctaaagtgaagcttgcagacaaaattactgctctccaacaaattgtctctccatttggaaagactgataccgcatccgttttgtgggaaacaatcaactatgttagatttcttacaagagcaaatacagctactgagccatgccctaacatgaagaaccaatacatgcaaagaaaaggtaattgggggaggatttgatagaacaaagaagttgattttaagggagcaaaggacttttgttatagttcccattttcatggtacccccttcaatatatcatgagaactaattaattggatcttgattatttaaatcccatcaatatatgaaggatgtttggtatacagatacattaacgtatttaagttatataatattattgtcgtccagtgttacgaaactttttcattcacttcattgaatcccggaccatcatacactagatat

SEQ ID NO: 14845 - DNA, 948 bp, Solanum tuberosum
  Predicted polypeptide sequence is orthologous to G2783
catcatccacatattttcctctagggtttcaacacgatgcaaccggcggcaagttcaatgggttccaccaccaatggcggcgcaaccacagtaccaacagcagtggatggctcagcagccgcagtaccaggttctgccaccgcagtccggttattactaccagcaaccaccaccgcagcagggcggcggagtacccccaccgcagcagcagcaacaacaatctcagtacacggcttcagctcagccgaccagtgctgatgaagtccggacgctttggattggagatctacagttttggatggatgaacagtacctatataattgcttcgcgcaaactggagaggtggtctctgctaaagttatccgcaacaagcaaactcaacaatcagagggttatggctttattgagtttaatagtcatgctgctgcggaaaggaatctacaagcatacaatggcaccttgatgcctaatattgagcaaaattttaggctcaattgggcatcacttggttcgggtgaaaagcgttcagataatactcctgaatatacaatatttgttggagacttggcagctgatgtcacagattacatgcttcaggagacattcagacccaattatccttcaatcaagggtgctaaggttgtaacagatagggcaaccgggcacacaaagggttatgggtttgttagatttggggatgagagtgagcagttacacgctatgactgagatgaatggaaagttttgctccactaggcccatgcgcattggtcctgcagctaacaagaagaatgctggtggtcagatgcaagcttcatatcaaagtactggaactcaaaatgaggatgaccctactaatacgacgattttcgttggaaacttggatgccagtgtaactgatgatcacctcaggcaggtttttgggaactacgggcaattgcttcatgt

SEQ ID NO: 14846 - DNA, 898 bp, Solanum tuberosum
  Predicted polypeptide sequence is orthologous to G2783
gattcacgatgcagccagcgaattccatgggttccaccaccacagtaccagcagacacagcagtggatggctcagcagccgccgcagtatcaggttgcgcctccgcagcaatcgggatattattaccagcaacctccgcaacagggcggagttcctccaccccaacaacaacaacctcagtacaacgcctctggtttggctgctactaccggttctgtccagccgactagtgctgatgagatccgaagcctttggatcggagatctacagttttggatggatgaacaatacattctcaactgtttcgcacaaactggagaggtgacctctgctaaagttatccgtaacaagcaaagtggacagtcagagggttatggctttattgagtttattagtcatgctgctgcagaaaggaatctgcaagcatataatgggaccttgatgcctaatattgagcaaaatttcagactcaactgggcttcactcggttccggtgaaaaacgttctgataatggtcctgaacatacaatatttgttggcgacttggcagctgatgtttctgattatatgcttcaggagacatttagggctaactatccttctgtgaagggtgctaaggttgtaacagataaggccacggggcgcaccaagggttatggttttgttaagtttggggatgaaagtgagcagttacgtgctatgactgagatgaatggacagttttgctccactaggcccatgcggattggtcctgcagctaataagaagagtatgggtggtcaaagtcaagcttcgtatcaaagttcacctggaactcaaaatgaggacgacccttctaataccactatttttgttgggaacttggattccaatataacggatgaacatctaaggcaga

SEQ ID NO: 14847 - DNA, 901 bp, Solanum tuberosum
  Predicted polypeptide sequence is orthologous to G2784
catcaaatagaataattataattgactcaagaaactgatatccaagtgaacaaggtgagaaatgaaaaatcataaaggattgaagcaaacaatacgatcaacaaacatgtaacttattagaaaaacaagaacacgatatgtaactattaacagatctgacaactttgaagttgctaaatactgaaacctatacatgacaaaaaaactcatgtgaaaaatatgctgatgccacaaatctttattaagattagcttttgtaatattggagctcatattttgtaaatgaagtagagagtgtcagcatttggttaatagtcattgaccacattctgtatcgctggtaatcatccatcatgtctagcttgatgactcccctgtttgttgttagcacaataagatagcagctatcagtttccgctccatttgaatccttatacagctcggcatgtaggtctaatacgatactttccatttgacttgagaaggtcttcaacatagttggcttccttgttcttaggataacctgggcttcactatttaagacaatggacaccgaccttagcttggatcttccttctgatttttcaatatagaggtctgcccccttggagagaattgatctgcatttctcgtagttaaagttgtagtcgttgctatcttcaattgggagaactggtgtgcttccatttaaaatattcttgtagccagatcttgctttgagtgtttctgctcctctgagtgaagttgtagctgcagctgtaagtgtcagaatgtcgcttgcacttgtgccggtcatggctgagccgatcacactgctgatttggtcccgttttgcccccatagcttctgcgacttttgcacattgtgctgcaactagtgcagctgcgctggccacagctga

SEQ ID NO: 14848 - DNA, 924 bp, Solanum tuberosum
  Predicted polypeptide sequence is orthologous to G2789
ccaaaccctcaccaaaagagaaggaaagaagatcaacaaacaaattaaaggattgtagtatggttgattcacctatttctcctgaattctttttggtttctcacttcattactttccctttccaactcttttttggtgaaggttagaactaattccatcaatttcatagctagaaagtaaattcaaatacaaggttatattagatggatcaattaacagctcatggccgtcctcttccacctccttttcacacaagagatcttcagttacagaataacaatcctcacctccacggccagttccatcacatacagcagcagcagaaaactgaagacgagcaacaaagcggacacagaaatcagaaacgagatcgcgacgataacttcagtttaaatcctgatcaatccggttcgatggatagcaaaggaaacactataggaggagatggcggtggagaagtcagtagaagaccaagaggaagaccagctggttcaaaaaacaaaccaaaaccaccaatcattatcactcgtgatagcgctaacgctttgagatctcatgttatggaaatcgctagtggttgtgatatacaagaaagtatctcaaacttcgccaccagaagacaacgcggtgtttgcatattaagtgggagcggaactgttacaaacgttacaattagacaacccacgtctccgggtgcggtggtaactctacatggaagatttgaaatcttatctctttccggttcatacttaccaccgccagctccgccagccgcatcagggctgacgatatacttggccggaggacaaggccaagtagttggcggtagcgttgtcgggccgttgaatgcttcagggccggtggtgataatggcggcttcgtttgggaatgcagcatatgaaaggcttccacttgaggacgaaa

SEQ ID NO: 14849 - DNA, 912 bp, Solanum tuberosum
  Predicted polypeptide sequence is orthologous to G2791
tttctaaaaacaagtcatcaatattaatatgactataaataattccataatagtataaaacgagaaatataaaatcaaattgattctaaataaaaacagtgagtcacattgggataggaggactaactcaagtcccgccattgcccatcgtagctgactgaacagtggaagctgacaaggtaggagaagacggtccaccgccggtctcaccaccgccgttgatagcggagcctccgccgagtagtagtgggttgttgggtttcatggagtgacacgtggaggtggaaatagcagtggctaaggaaattggcataaggcataagccttttccttgaagatactgcattgctgatcccatatcttcttccattagcttagctacctggtgctccgtcatcgtcatgctgctgtcattgtttgcagacgacgtcgttccattactgccaccccgacctccatttccttgtacacaatcacctcctccctcagaggatctatcagcaactaggggagcaacagctgcagcaccacccaatctgctcatactcagaactttgacttggagctggaggaacctgacatagtcgatgatctcatctaacattgaagccttgtctgtcttattggcattaggtaccagctcctgcaaagacttcattctctctgcaattctctctctccgtaatctttcagcaatgctgtgaggatcagttgcttgtcctcttcgagccctaactttctgttgctttggctgcgctccaccagctgaaccactcgccgccggcgtttgattcatcgtcaacgacgccgccggagctccgaaactctgcgcctgagaatggtgaaaatgctgagattgatttgaggtttgaccaagagatccagcgaatccattgtaaagagcttgaactg

SEQ ID NO: 14850 - DNA, 967 bp, Solanum tuberosum
  Predicted polypeptide sequence is orthologous to G2791
tttctctcttctccttttagaaccaaactttcacacacaaagctactgaagaaaaaatttctctcggcaaaatctcagagaggaaaaaaaaaatgcaagccatgaattcacttctaagtcaacaacagcagtcacagatgtcactgcaagaccttcaaagtggcggaaatggcggttctaccggtggtgttggtggtttaggtcaacacaatatgggtcactttcactttgatccgacgtcgtctcacgacgattttctcgaacagattctctcttctgttccttcttcttctccttggcctgacctttccaaatcctgggacccacatcaccatctctcatcgccgccgcataaccctagctccggcgaagatcaacctccttctaatccacttcactcacagttccattacgacgaccaggcttcttctctactagcctcaaagctccgtcagcatcagatcactggcggcggcgcggctgcagctgctaaagcacttatgctacaacagcagcttttgctttctagaacactcgccggaaacggactcaggtctcctaatggagcttccggcgataacggcctcctttccctacctctaaacctcagtaataatggtgaccaaaacgacggcgtcgctaacccggctaatgacaattccgttcaagctcttttcaatggattcaccggatctcttggtcaaacctccaatcaacctcaacattttcatcatcctcagggaggatcgatgcaatcgcagagtttcggagctccggcgatgaaccaaacgccggcagcaagtggttcagctggtggtggtggaggttcaacgccggcagcacaaccaaaacaacaacgagttagagctcgtagaggacaagctactgatcctcacagcatcgctgaaagattacgtagggagagaattgcagagagaatgaaggctttacaggagctggtacccaa

SEQ ID NO: 14851 - DNA, 840 bp, Solanum tuberosum
  Predicted polypeptide sequence is orthologous to G2802
tcagttcttctctctttttttttcttccaatgtctacaaactcatcagacaaggtagttcaccttgatgaagtgattgtagccatggtgccatttcctgattttagccatctcaatcagctcttcgttcttgctcgtttcatcgcttcccataatatacgagtacacttcctctgccttgctgatcggaaccaagatttgaaacttctcgtccaaggtggtctatgtgcctcaaacatccattttcatgatcttttagtaccttcttctcttgatgctggcaatggtttgccttcgattgttatatttataagaaagctcatcgagcccattagaagaacgtgtattgatatctctacctatgcgaagagattggttataattcatgattccataatgatggagcatataagggatgttcattcattgatcccgaacgtgaagtcttatatgttccacgccatttcagcttttgcaagatactctatgctccgacaaagtattgatcacttagttgttgatgatgatgatgatgatgatgatcatgaaaaaatgatcaaacaaatgcacgatgagtttccgttgttggagagctattgtgggaccatatgcagcaagcactcattagcaaaagaccatgcaatggaaggctcattcacggagaaatccatgaactcgtgccagagaagtcgaaagtaagtacttggatttacttgcacttacaaaagacaacgcagtaatcggcctgttgggtccacttcctatggttggtaaaaatcacgcggactccttagcaacattggacgaaggcttggattggctcccgaaatttccttagaac

SEQ ID NO: 14852 - DNA, 722 bp, Solanum tuberosum
  Predicted polypeptide sequence is orthologous to G2805
ggttttgactggtgtcctggtgggacaacctgaaattttgcgatttccagccatggctggtgcaaagaactcaatgccaccatataatctgatcctccagtttcagatgcctttgcatcatttctccataaccaatcctttcttttcacctcagaaaacaaataaaacagagcattaactacaccagcagtacttgacctcattctgatttatgagctcagtccaaagcagctccctaaattccttgaaacatatgctatcattttctcaaagaggcagtgattgtatttgcttgtctgggctaaaaaaaaaagggttgtttgggttttagagacgagtagatttgtatctatgcttggtaaacctctgatgatatgtgatttgagacttatctatcacatgcaactggttcttttaaagtcatggcaccatctccttctctttgccccattagtaaccaactctgaacctcaaaattgcaagtagtccttctggacattgtttgacggaaaaatctttcttttgaaagccttgctcataaatgagacatcatcaatgagaaatgtgaaagcttgctggcaaactaacagtgctagctctttcttgcaactctagattcagaaatgcacattattgttgatttgttgctgctattggttctcgccttgccgctttgcattaacacataaacagcgagaatcatgctccaataagaaacagtg

SEQ ID NO: 14853 - DNA, 623 bp, Solanum tuberosum
  Predicted polypeptide sequence is orthologous to G2834
cgaaatctttgtttctatgtaatttacttttctgttggaggttggtctgagggtgggggtaggatgttagatgaagatgctgtcatttagtttatggaaattagcttctagtagagaaattaaatgtaggtttcaatgaacttggttaggaatttctgttagaagataggagacggctttcttgtggtagtaattgcgaacatctctcctcttctcttagtgtgcaaagttgcttccatgccgtcttaggcacatctctctatcttagtttctttaaatttcaaagcacttaaaagtgtataaatatcttgatttgggattatgaatagaatagagagtttaactaattttctcaaataactaactaactacactcatttccggatcaccagactaggattgagcaacaaatttcgaaatctaaaacgcatctagcatggaacaacaggctaatgaaagcagtgaaaatcatgaatgggatccaagagccatgcttaaaagtatgtcttttcttgaacaaaagattcatcaactccaagaattggtgcgtataattgttgaccacagaagtctagctgggattcagggaagtgaccttttcattcagcagccacagctaatat

SEQ ID NO: 14854 - DNA, 939 bp, Solanum tuberosum
  Predicted polypeptide sequence is orthologous to G2834
cagctggcgagggaccaccggaacaaccagcagccggcgagatcccaggcgaccagcaatagccagtgacgagcaacagcaaccagcgacatcggcaaaaaccagcaactccagcagcagccaggcaagccagcgcagtcagcagctccggcgaaatctgcccctctccacgagtatgactggcgaaggcagcaaccagaaaaatctcggccatgagttacgacgagcgtcgttcggataatgtttgagtttccggtttgctaaagacggatctttacgggtttgttctcttgtttgatttgttacttaatttattttagtttgatatttgaacttgtgattttgtgcaatatgctcatgtgaaaatcaatgtcatatgtatctcatactaggcatgtgctactatttatgactctatgaatttgttggtttaatccttgtttatatgattttagacatttgaaatagaatgataatcgtatgattcacactaatgcggtcctcttttgcttaagttaattcacatcccttaatatttgctaatctatcttaattgatatagtatatatggtttgataattgattccttgacttaataggatatttaattaatttgtgtctaaatgtttatttaccataaaaatcaaaagtgttttctttgctgattgtaaccctttgtcatgctaactgatttcaattattccctttaacttgcttgttaaataatgacttattagttggcttttctaggttgacttgctaataatcctcataattgatttatttaataactgtgattgactcctttaattttaataatctttagtctaccataagtcattataatttgtttaaatatggaggaatttgattgcatacttactggaaattgattctttctctcctggtgaaaactgggtcaaatctttgtttacttgt

SEQ ID NO: 14855 - DNA, 873 bp, Solanum tuberosum
  Predicted polypeptide sequence is orthologous to G2834
gaagaacattggctgaccttcaatctggaagcagattcagatatggatcctgacgacagtctaagtgaagatccttggataaaatcttcttcgtctggcaatgaattgctgaaaattatgccctcagataaccattcatttaccaatttaaatctgcatgcgcagaagtgggaaggttcctcttatttggatcaacaaaacaggattgagcaacagttttctggatttgctaaaccaaaagacacatctgagatggatcaacaggggcatcagaggaatgaaaatcatgacacgaccagaatacatgactgggatccaagagctttgctgaacaacctttcctttcttgaacaaaagattcatcagctccaggagctggtgcatttgattgttgggcggagaggtcaagatggggttcagggaaatgaccttatagttcagcaacaacagttaatcacagctgatcttacctctattatagtccaattgatatcaactgcaggaagtcttcttccaactatgaagcacacactttcctctgcgatccctgctgccagccagcttgggcaggttggtggtgtcacagtttcttctacagcaggtactagtgctggtgggcggacatgtaatgacggtgttgcgaaggtggaagatcagtccaaccatgttgaccagttgagagattgtgggattgaacacaatcatgctgccgatgaacatgaattaaaagatgaagatgaagctgaggaagaagagaaccttcctcccggttcctatgagattctacaattggaaaaggaggaaatccttgcaccacacactcacttttgcacaatttgtggcaagggatttaagagggatgccaatttgcgg

SEQ ID NO: 14856 - DNA, 886 bp, Solanum tuberosum
  Predicted polypeptide sequence is orthologous to G2834
gatagcaaaacctgaaaaatgcatcgattattgtcaacggcgccgctctactatcctctacacgattaacaaatcctcctccgactcagccgccgtcgtcggtggaaatgaaaatcaatctaaaatcgaatcataagagatcgtttcccgagtttgatcggagagattttgagtcgaaagttgaggtattagacgaagaagaagaagacggtggcgattgggagattattgagctagatgcggtggagctactagcggagcacatccacttttgtgatttctgcggaaaaggattcaaacgagatgcgaatttacggatgcatatgagagctcatggaaatcagtacaaaacaccagaagcattagcaaaacctgaaaaatgcatcgattcatcgaattcgaataaacggaggaggttttcgtgccctttcatcgggtgtacccgcaacaaaacgcataacaaatttcgaccattgaaatcggtgatttgtgttaagaatcacttcaagagaagtcactgccccaaaatgtactcatgcactcgttgtaacaaaaaaagtttctccgtacttgcagatttgaaaagccatttgaagcattgtggagagaccaaatggaagtgttcttgtggtacgagcttttcccggaaggacaaattgttcggtcacatggcgttgttcgagggacacatgccggcggtagaaacggcgccggcggttgaaaatgaggaggaggtgggaatggatatcaatgatggggcgggtaatgggttgttggatattagaaccgggtcggataatgggtttttggataggttaatgcttgatgggtttgaatctattgatagttattgcttccaagatttattcggatcttcttctccaaa

SEQ ID NO: 14857 - DNA, 849 bp, Solanum tuberosum
  Predicted polypeptide sequence is orthologous to G2834
atagcaacaatgatactaaataacttgtggaaaaaacagttattctgaaaaaaaaaatgacatgatagaataatagctacaatgaaccaaagacaaattgaatactggttgatgttattccatttcactagaactcataaattttgcagccttgtgaggagggtattcacatgatccagatagcagaaatgagaatgagctatctgactcatcaaatggtggtcgagggaactcttgaaatccattaagattgctagtatcaaagttcaaaggtgagtaataactgcttggattgtatggacactcttttacaaccccgggattttgaaactcattgccatgtgaagcatttaccttatagttttcttgtcgagctttcatggtgacttcactggtttggccccggtcagatgtcccagcagatcctttagtttcatccggagaaactgcaggagtatgaccttgaaaaagggaaatatgtccaaaaagcttgtctttcctagaaaatgttgttccacaggaacaaagccacttatcctttccacaatgcttttcatgtgttttaagatcagcaattactgaaaatttcttaatattgcatctactgcaagtataggctttctcacagtgggttctcttgtaatggtttttcacacataagatggtcttaagaggttgaaacttttttatgctccttattgcgcttgcatccaacataaggacaggaatactttttgatgaggtgttggctcagaactgggttctttatgagggcttgccagaagcttgccgggaagtccttgtactcatcttccatgaacctctccatgtgcattccgcaaatttggg

SEQ ID NO: 14858 - DNA, 417 bp, Solanum tuberosum
  Predicted polypeptide sequence is orthologous to G2850
ctgaatttacagatagcatttcatcagttttcaatcttcagatgagttctacagcagcatgtgaaaaggacagtttgtcatacttcctttgatttgcaggaaatttaggatcagtgaaagactttaacaagagagtacatttcttgacaagcgcctgggatgctggtccagtggtaacaacgcaacatgtgatgtgtggtttaggtgcacgtcatgagtttgaacatgctgcggactaaactgatagttttagctgttttagaaacagatatatgggggttgtttcattttgatatcctatttcatctcatttttcttaacctgcagtctgcaatttgatctataactaatgctcatttccctctatttatagtacattaagccctaaaaaaaaaaaaaaaaaaaaaaaaaaaaaaa

SEQ ID NO: 14859 - DNA, 1026 bp, Solanum tuberosum
  Predicted polypeptide sequence is orthologous to G2851
gaaagataaattttttgaaacgatatgttgattgtacctatggatttccaagttacatatacaacacttatgaactacctagtaaggtagtatgattattcatgaaattcaagaaaataggaccatattgtacattggacaataccactttatctttgacccgatttcaaatgcaaaatagcatcacaaacagtcagctctgatgacttccatactgagaatgactgctttgtgatgttatatcattcattccatgaggacacagaggctccgatccgtcttatcatcagtttgttgacgtctcggtatttttatactgtcagtgtatataacttaaatccaatcagaataaacacttgtaacatcaaaatcctcctccgagagctggagcccagtaatcggcgccggtgtcacttcctatatttgccatgcaagaaataggaaccaagcacaaccctctactccttaaatccatcgctttgtgctgagaatcattcagtgattgttggggaatgtgacccatgcttcctgatgcattgcccaagtatggtgagcttaatgcctgaatttgagcctgaaggaatctgatgtagccaatagcttctgataggacggaggctgtatcagtctttccaaatggagaaacaagttggtggagtgatgttactctatctcctagcttctcctttcttacctttagagatggttgagctgaagattgttgaaccctagccttcttactaatcccaccactgcttgtgctgttacactcagttgaaattaggatctggatgttgatgcttatgttccccctttggttgttcagagaacattcaacaaggttatgactttaaacctgctggtataccacggagactagcctggtggaagaaccacatcttggttggacgaaccacatctagaaacgcaattagaaggtcctggttaaacaggatcggcatcctaaattcgaagtgcttttgttgcccggtatcaaacgatgtctcaaacttcgtggtggacctg

SEQ ID NO: 14860 - DNA, 906 bp, Solanum tuberosum
  Predicted polypeptide sequence is orthologous to G2851
ctctctctcctcctcctcctccaagtatagctacccttttatgtatctttcctctacttaatcaagagtaagaaagacctctcaaagtttctccaaaaaaaaaaaaaaacacaagactggaggaaaaaatattattggaaagaagaagatatgaaataaataagaaagagaaagttagctaagtttggaaagaaaatgaatagaggtgatgttatggagaaatcaccagtacaacaaattatgggtggaagccctaactggtggaacatgatgaataatatgaggcctcccatatcatcatctcaacaagctgttgctgctgctgctactactcatcatgttccttccttgttgcctcctaataatcattttcctcatttctcttcttcactaattcccatgtcatctactgctgcttcatggaatgatagtaaccaaaatcagctacctgaatcatggagccaattacttgtaggtgggttggtgggagaagaagacaagtcagtacatatgcaggtgaagaaattggagaacaattgggatgaacagacgttcctgaaccagcctgattctgttatagacgttaaccaaaaggatgtcggaaatagctataatatgtatgaagatggcaaataatgtggagttccatcaccaaactgcagaattagctgctaaaccaaacttggtcagcacagatgataccagtctcatctccaagtcttttgttacactttgagcagcaacatgctttgatttttctaacaaaaaaactcaaacccaaatccagatcattccatcttgagctggcaacaaggcagagcaccaaaattaagaaagggttagggttcccaaccattctttcgactcagtccccactttcaaggtgaagaaaagaaaattacgggg

SEQ ID NO: 14861 - DNA, 804 bp, Solanum tuberosum
  Predicted polypeptide sequence is orthologous to G2851
ttttttttttttcaagaaaccaatatgtatataccagtttgaaaataatatgtgtagtttaaaggttagtttaggagaaagaataaagtttaaaaaatgggaaaattgagaatcttacagattgctggcgcctcatatttcctgatccactacctaggtaaggcaagctaagggcctcaatttggctctgcaggaatctgacgtacccaattgcttctaacaggacagaagctgtgtcagtcttcccaaatggggagacaagttggtgaagagctgttattctgtcccctaatttttcctttctcaccttgaaggtggactgagttgaagatggttgaaccctagccttcttatttggtgctctgctgttgcactcagatgaatgatctggagttgggtgtgagtttttgttagaaaaatcaagcatgttgctgctcaaagttgtaacacaagacttgggagatgagactggtatcatctgtgctgaccaagttggtttagcagctaattctgcagtttggtgatggaactccacattatttccatcttcatacatattatagctatttccgacatccttttggttaacgtctataacagaatcaggctggttcaggaacgtctgttcatcccaattgttctccaatttcttcacctgcatatgtactgacttgtcttcttctcccaccaaacccacctacaagtaattggctccacgattcaggtagctgatttggttactatcattccatgaaagcagcagtagatgacatgggaattagtgaagaagagaaatgagggaaa

SEQ ID NO: 14862 - DNA, 983 bp, Solanum tuberosum
  Predicted polypeptide sequence is orthologous to G2854
caaatccctctagggtttccgccgccaccgtcgctgctgtcgccgtcgtcaaccttcttctctaatccgctcaccgaaaccctaagaatgcaaccagcgaattccatggttccacaatcaatggcggctccaccgcaacaacagtaccaacaacagccgcaacaacattggatggctcagcagcagccggcagcgtatcaggttccgcagcagcaatcggcctattattaccagcaacagcaacagcaacaacctcagtacaacgccgcggcagcttctgctcaaccgaccagttccgatgagatccggagcttgtggatcggagatctacagttttggatggatgaaccgtacatccagaactgctttgctcacactggagaggtggcctctgttaaagttatccgcaacaagcaatctggacaatctgagggttatggatttgtggagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactactcctcagtcaagggtgcaaaggttgtgactgatagggtcactgggcgcacaaagggctatgggtttgttaaatttgccgatgaaagtgagcaattgcatgctatgactgagatgaatggcaagttctgctccactaggccaatgcggataggccatgcagctaacaagaagagtgtacctggtcaggtgcaagcttcatatcaaagtaccaatggaaactcaaatgaggatgacccttttctatacactatattcgttgggaatttgggatgcaatgtaacagatgaccatctaaaggcaggttttttggaaattacggacag

SEQ ID NO: 14863 - DNA, 828 bp, Solanum tuberosum
  Predicted polypeptide sequence is orthologous to G2885
ttttctggaccatgatagatataatgagaattggcaaacttctctccagcctctgaagttccagtcaacctcctttccgttaaatgaacctttcagcaacagccatttgcctcaagacagagtacgagacaatgatacttcaactggccctcttttgcagaacaaccctgttgatttttcaacctctgccatagtttccgtacctttcgaggcttcaagaggagaaacacaatgccgtgaaagtttagagggtgctgttcagattatgaaccaagcaacctgccaacggtggccagatcagaaccaacattattcccacaattcaaacaatatttttggtaacatgagctctcaagtttctagcaatggtggaatggcctctttacctcatcctatggaccaaaacaatgatatgttctgcacaagggtggagacttctttgaccggcagatcaaatggaggttcttcaatgcacatacacaatcgtgaaagtgaaaaattaactcatgactcgaggacaaagacaaatgaagactacctctttcagacaacaaagcaacaagttggttttcttcctcagggctatggctcccttgatgatcttatgggtgaaatgaaacgggatcaagatggagccatgttaggaggagaattcggatttgatgcttattcacttggttcaggtttatgaggtttttgtaactagcaagttacgaaagagaggatctagctgatatagcaaaatgttatttgctcatttaagagtcttcttaaccaatatattgcatactatggctttttttcattggtctttccagtcggaacgtg

SEQ ID NO: 14864 - DNA, 755 bp, Solanum tuberosum
  misc_feature (195)..(195): n is a, c, g, or t
  Predicted polypeptide sequence is orthologous to G2898
tagaggttgagagttcagataccattgacaacgtcaaagcaaagattcaagacaaggagggtattcccccagaccagcaaagatcaatctctgctctgcttcaacttcaacttcaacttcaacttcaaccaaaagggtaaaatcagcggagaaagtaaaggcacgtagagtgaagcagagcaaacccacatcagncaaaaaaacttagcgccatttcgaacaagaagcctaagaagccccccactgccttcttctatttcttggaggacttccgtaaggaattccaggagcaaaatccaggcgtcaggtcaatgcgagatattgggaaagcttgtggagagaagtggaaaataatgacatatgaggaaaaagtgcattactatgatatagcaacagagaaacgaagagagtttgatagagccatgacgtactttaataagaaaaaggaaggtggagagtttcaagaatatgaagaagactccgattttgatgaatagtattatgcattgtttgtaattctttagtttgagatgttcggtaggaatagtgtgtattttggtattatttctgtacatccaacttatcgatctagtctctcgacttcatgtcttagcacctttgatgactgaacaagcctcctttgcccaaccaaagcagaatccacttggttctcaattatgggttctgtatgtacattattagccttgacagcacttgaaaatagattattccatgcaggttttctgcacaagtgc

SEQ ID NO: 14865 - DNA, 957 bp, Solanum tuberosum
  Predicted polypeptide sequence is orthologous to G2907
ttctgctacaagtttctcctcaatcccaccaggaaatgggaacagaaacacagcaaatacctatatacccagtaggaaccttgacttcccatcatgggggaccatttcaggtaataatcccgctgcatatcagtctctccattttcagccttctggtcaatcaggtgcaaataatatgatgcatgaacaaggaaacactacaatgggacaaatattctcaaataacttcacgaggcaggaacatgagaaccacattgatggcctggggaactggcagacttctgaagttgattcctcatttatatcgaagtggtccatggatcagaagttgaatccagatttggcatctggtcaaaccattgggtctagtggtgtatatggtgtagaacatcacaattccttggaggcttctcaggtacttcctgcgcagcaagataaacacccaatgcagaatgagcttcaatcacagctatcagatgcaaatattggaggctctctaaatgctgatttagatcacaatctaagcttaggggtgaaaaccgattattcagctttaaaacaacctttgttagatggcgtcttgaaaagagaaggtttgaagaagcttgatagctttgaccggtggataagcaaggaacttggagatgtaagtgagtcgcatatgcaatccaattctagttcctactgggataatgttggagatgaagatggagtcgataattccacaattgcttcccaagtgcatttagacacctatgtgctaagtccttcactcgcgcaggatcaaatctttagcattattgatttctcaccaaactgggcattttctgggtcagaaattaaggtcctcatcactggaaggtttttgaagtcccagcaagaagtggagaactgtagttgggcatgcatgtttggtgagttggaagttcagcagaagtatagctgatggtgttcttc

SEQ ID NO: 14866 - DNA, 1072 bp, Solanum tuberosum
  Predicted polypeptide sequence is orthologous to G2913
gcaaccgccgttgcagtcgccgtcgccgccgcaaggctatccaaggggacctctctcttaccctaagccggaagctgaataccatgaaattgttcaaaattcccaacttttctggaacaaacttcagcaattttccgcatcactgcaaaccaatttccagatccctcttgtagcaggaacaccactagatttacaccgtctttttgtggaggttacatctcgaggtggaatagaaaaggttattagagagagaaaatggggggagggtgaaaggaatattcagatttccatcttctgtgaccagtgcttcatttgtcttgcggaaatactatctatccaagctttatcattttgagcaggtttattactttcggaaagaagagccttctgtttctgtggctgatcctacaagcagtaatgtcagtggctctgcagctgaacatgctaatgatgatagcgctgctatggatcaaagttcagtgagctataatctggaggatgggaattcactggtaggaacaattgatgcaaagtttgattatggttatgtaatctctgtgaacctgggctcggagaatttaaatggtgtactgtatcatacacctgcattaccaaatcaattccaaaaggtgaatactttggctaggccttcccaaaggattaggaaaagacagttggctttgaaggacccctctcgacccaagccaaatcgaagtggttataatttttcctttgcctgagcattatgcaacgttgaaggcttcatatccaagggcaaagagagagctatccagcaaaaggaattggcaattccttgggagttcgacttcaccaagggtcttagaaccagctgttccgcgaacgaaaggttttcagaaggatgacgggcgacaatccaggctaaaatgttgggatacccgacatctcatgttacacccctcgtgaagcgcgtattttggcggcaactcctgtcgcatcttgtttgttggcaacaccagtttcaaccgggatactggggaggcgacacacgggcgcacctccctaatttgggggcaacatctggcacatgtat

SEQ ID NO: 14867 - DNA, 921 bp, Solanum tuberosum
  Predicted polypeptide sequence is orthologous to G2964
ggggaaggggagaggggaataaagctaataaacatgtcacagctaaaactaggtacttctgctttccgttcaaatgacagtaacttaataccacgaaatcgcgcattacaagagatcaaaaattgagaatattacaatgagcacaatcgggctttccacatagcaagggactacagagactagggtacctgtaaagctcacccccctgttttgcgcaattcagtatcaccatgggcgaagtggcacctttctccaaaagtgcaagaacctttagcaaaattttcgcacagcttagtcttgtagttgctcattggaggtgcaggtccaccctgtactgcaggtgttcttcctgggccaccaactgacccaaggctgctgatcagctctctcaccatggagctagcccgcgaaatttgttcaaatgtaccttcaagctcaatgttcctcagatttttatctatttcatgctcacggattgccagcttggctcctgtctgccgacagatctgcttagagttcactccgccctttccaatgatgggtcccacatggaaagcatccacgctgatctttgcagtggctgacgtaccaaagctagcagcagctcccgaaacaggaggctcccttcgcccgccaaaacggtcaggaataggtccaacacccatggcacgtggtgatggcacaataggcttgccaatttcccactccccatgagcaaaacggcatttgtccccaaatttgcatccctcagctgtgttgaacttgctgcaaattttggttttcacagcgggagtattcccactggcaataggtgatgctggagatggtgcaatattcatcatcttggccacagcattatagccaccaggaacataatgaagaaaatggcagttctcaccaaaagggcagccaacagtgctg

SEQ ID NO: 14868 - DNA, 897 bp, Solanum tuberosum
  Predicted polypeptide sequence is orthologous to G2964
gcacacactcgcatctctctcgtttagcccttcgtcttctcagagattttagggtttcgatttccattcttcttctgcaaattcgagttcttctgttgcttcaatggagttcgatggtggtcgaaaacgaggaaggccacatggacctatgaatggcaatggtggattcaagaaatctaagcaagaactggagtcaattccaactggtataggaagcaaatcgaagccgtgcactaaatttttcagtttttcgggatgtccatttggtgaaggatgccacttcttgcattatgtgcctggaggccttaaagctgtgactcagatgcttggtagcaacccagcgcttccagcagctcctaggaattcaatagctccaccatctttccctgatggatcatcttctccagctgttaagactcgtctatgcaccaaattcaacactgctgaaggttgcaaatttggtgacaaatgtcgttttgcacacggggattgggagcttggcaggccagcagctccattgcatgaggactcccatggtatgttccagatgcatggaaggtatggtagtcgaccagagaccaatcctgctggccttggagcagctgccagctttgggtcctctgcgactgctaagattagtgtagatgcctctcttgctggacgtattattgggaaaggtggcgtcaactcaaagcaaatctgtcgtatgactggagccaaattctccattagggatcatgagtcagatcctaacttgaggaacatagaacttgaaggtacaattgatcagattgaacaagccagtcgaatggttcgtgagcttattcagagtgttacaacatcagcaggacccccgatgaagaacaccagctcatccgtaacaagtaactataaaac

SEQ ID NO: 14869 - DNA, 922 bp, Solanum tuberosum
  Predicted polypeptide sequence is orthologous to G2964
atatggactccttatcaggtggtataggaagtaaaacgaagccatgcacgaagtttttcagcactgctggctgcccattcggtgagagctgtcatttccttcatcacgtccctggtggctataatgctgtggcccagatgatgaacttaggatcagctccaccagcatcaagaaatgtggctgcaccacccatgtccaatggaaatgctcctgctgtgaaaaccaaactttgcaacaaattcaacactgccgagggatgcaaatttggagacacatgcaattttgcccacggggaatggcaaattggcaagccgattatgccatcacaggaagatccacgtgccatgggggttggacctgctcctagtcgttttggtgggcgaacagagcctcctgtttctggacctgctgctagctttggtaccacggcaactgcaaagatcagtgtggattcttctctcgctggagcaatcattgggaagggtggtgtgaactctaagcagatttgtcgacagacgggagcaaagctggcaatccgggagcatgaaacagacattaatctcagaaacattgaactggagggtacctttgaacaaatttctcaggctagtgctatggtaagagagttgatcaacagccttggtccagtaggtggccctgggagagctccttcaggtcatggaagaggtccggctggtcctggtggccccgcccctcctatgagcaattacaagacgaagctctgcgagaattttgctaaagggtcttgcactttcggggataggtgccactttgcccatgggaatgatgaaatgcgcaaaacaggaacctgactttaagaagccaggttcttctctgtgttacctttgctgtggtcggtcatgctgatacattgtatatctcaattttgggctctagttat

SEQ ID NO: 14870 - DNA, 999 bp, Solanum tuberosum
  Predicted polypeptide sequence is orthologous to G2969
agtaacctcttccaccaaacaccaaccctttacctttatccccttccacattaccatctccctaacaccttctttttcccctttctatcatcatattcatcttcctctcaatgtaatcacttaccatggctactctcttacgtccccttttctctaatttcctctctcttctcttcctcttacttcacctcggctgcttcatctcatcccaaaatcactcttcaaaaaagcgaaaactctcttctaatcgcgattcttcacccccaccaccgcccactcgtctcaaatcctcaaccaccaacgctatttcctcttcatggtcttacatcaaacgtattttctcatccaataaacaaaaaatcatcaacaccccaactcaccataacccttcaattcaatctccctgttcttcaacaaggtcccttcaaaaaccaatttcatcagaagacccaattaaccgctccgtttctccaatacccgaatccgaaatcacctccgatcaattattcttccctttacgaaacgatatatacccatgtactttatgtggagaagtattccaaagccccattcatctcgaacaacaccaatcgattaaacatgcaatttcggaactcacagatggggattccggtaacaatatagttcggatcattttccaaacgggttgggttgataaagcgaagaacccggttatcaatcggatccttaagatccacaacagcaaacggatcctatcccggttcgaagaatacagagaatgcgttaagctaaaagcaagccgaaacgccgtcgttaagagagacgaaaggtgtatagctgacggcaatgaactattgagattccactgtagtaccttcatttgtgagctaggacaaaatggtaattccagcatatgtactcaacagtattgtagtgtatgtggaattataaaaagtggattctcacataagatggacggaatttccatgcaacctaccagctggaggggacacgtgt

SEQ ID NO: 14871 - DNA, 992 bp, Solanum tuberosum
  Predicted polypeptide sequence is orthologous to G2981, G2982
aaacaatcttgacattcatgctgatgatgcaggatctcaagggacagctgggaaaaagaaaagagctcagcgtgctactggaggggataagagtggtagaggactcagacagttcagcatgaaagtttgtgagaaagtggaaagcaaaggaagaactacgtataatgaggttgctgatgaacttgtagctgagttttctgatgctaccaatagtgttgcaggcccagatcagaaacaatatgatgagaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcctatttagaagaacttgaagatcaatatgtagggcttcaaaacctcataaaacgcaatgatcagttgtatggctcaggcaatgctcctagtggtggtgtggctttaccgtttattttagtgcagactcgtcctcatgcaacagttgaagtggaaatatcagaagatatgcagctggtgcatttcgacttcaacagcactccgtttgagctacatgacgataattatatcctcaaagcaatgaatttttgcggaagaccaaatgacagtgctgtcccacagaatttatctgctgatggaggtgaaggtccgagttcccgtatggccaacatgtttcagcatcatatcgctcatccatctgtcccaaactcatctggcaagcttccgacctcacctccactccccggaatactaaaggctcgtgtccagcatgagcattagcctgctggcttctttcttgatcgattactgtactcattaacgcatagtatttctgtacattatgtaaagtatatttactggaagcagcctcctctgtttgactaatacttctcttgacgcttgtctcatt

SEQ ID NO: 14872 - DNA, 803 bp, Solanum tuberosum
  Predicted polypeptide sequence is orthologous to G2983
ctagtggatccccggcctgcaggtatccatgtacatgggatcatcatcaagaagcttaagcatgaaggttgcatcaattcacacgtggattcttagagcatgaagctgcttctccttcacttacacttggttgcaaacgtttaagaccacttgctcctaagctcaacacaaccaataatgataccacaaccaccattgttactcctccttttgatcttaagagtttcattaggcctgaaagtagcaatagccctcctaaacttgcttacaatgaagacaagaaagattcctctcaggtggaatctcacccaggaggaacaagatggaatccaacacaagaacagatagggatactggaaatgttgtatagaggtgggatgcgcacacccaacgcgcaacaaatagagcaaatcacagcacaactagggaaatatgggaaaatagaagggaaaaatgtgttctactggtttcaaaaccataaagcccgtgaaagacaaaagcagaagaggaatagtcttggccttagccaaagtccaagaacaccaccacccatagtcactagttcctttgtcatttgacactaggggagaagtagtgagggatgaagatagtccatacaagagaaagtgtagaggatggacatttgaatacctggaggaagaacaaacaacaacaaggatgacgacgcaaattatcaattggtagagaaaatggtgataggacttcttcaactctttcccattgcatccagaaggcatgaccatgatgcatttttacacagaataatctttttctttttactt

SEQ ID NO: 14873 - DNA, 956 bp, Solanum tuberosum
  Predicted polypeptide sequence is orthologous to G2989, G2990
taagaagtttgtcttattgtaatgtttctatatattcttcaatcaccatcatcaatacatagaagagaaaaactcaaccaaccaaaacaaaataccaaaacccccatttacaataaaccttcaaaattttccaattcataatcaccatatccattaattatcatattttcttgcccttcttgtttatttgtagtcattttatttcaaaaaaacacatatttaaacaaacaaaaatggagttaacttgtagtactaaccccacccccacctccaccaaaaccccagattcagaagttgatacccctcctttaattaagcctttatctttcagcaacggcaataatcaccacaatcatcaccacgaactgccgccgtgcacggcggtgatttacaaagaatgtttgaagaatcatgcagcaagtttaggtggacacgccgtagacggttgcggtgagtttatgccttcgccggaatccaccccatcagatcccatttcactaaaatgcgccgcttgtggttgccaccgcaacttccaccgccgtgaaccgtcggacgattcatcaccgccggcccacttcatcgatttccgccaccatattttcccccaaattaagcgattttctccctctccgtcaccgtctctgtccctttctccgccgccgctgccgtcactgttccagccccaacccgttactcctacaggtttaaaatcagagaacccaaatggtagaaagcgatttaggaccaaatttacagcagaacagaaagagaaaatgcattcgttttcggagaaattgggttggaaattgcagaaatgtgatgaaactgctgttgatgaattttgcaatgaaattggagttggaaaaagtgttcttagagtttggatgcacaaataacaaaacactattgggaaaaaaagataccaaagtagtagagatcatagcttcgagaacaaa

SEQ ID NO: 14874 - DNA, 909 bp, Solanum tuberosum
  Predicted polypeptide sequence is orthologous to G2991
atcatcatccctcaaaccaaataaaacaaacctctctttctctttctctgcttcttattttgtcaaaaaatgagcctaaatctaataatcaaatcttaaacaaagtatatgtttgtcaagtatggagttgagcaataacaacagtactatttacacgaaaaccccagaagctgaaacagctcgaattatccaacacaataaacctttctccataactaatggtatactcaaacgccagaatcatcatcctctgcctctgcctgtcgttgtagtttacaaagaatgtctaaaaaatcatgctgccactatgggcgcccacgccgtaatggctgcggagaatttatgccatcccctaccgcactgctactaaccccagctccctaaaatgcgccgcatgtggctgtcaccggaattttcaccgccgtgagccagaggagctatttccacctcccaacaccggcgcagctctgcagtaccaatctcatcaccgacagcaccctccgctccgctgccgaatcgtggaagtggggaccacagctgccctaattccccatctccaccaccgatctcatccgttactacccatctgcacctcacatgcttcttgcactgagttccggtttgtcgggtcgaccgcttgaaacacaacaacaaaccaacctggccaataaatccaattcgactactctggtgtcaaacccaaatgcgagaaagcgatacagaacgaaattccaaacaaatcgaagaaaacttgttgattttctgaaagagttgatggatgcgaacagacaaagattttcacacattcggcggaattagtcaaagggtttcaaagttgtggccacaccaacatttggaagaactatcgttcgcacaacaaacggtaatgggttgtcacgatacaaaccc

SEQ ID NO: 14875 - DNA, 1943 bp, Solanum tuberosum
  Predicted polypeptide sequence is orthologous to G2993
gctattagcaatggcaagtgtgtgcaatagtagttctactactacaactctcaaaactcctttcatttcatccaatacttctttaggttccactcctaagccctctcaacttttcctccatggaaaacgtaacaaaactttcaaagtctcttgcaaagtttctaatagtggtgaccaaaaccaaaacattgaaacgaattctgttgatcgaagaaatgttcttcttggcttaggaggtctttatggtgttgctaatgctataccattagcagcatcggctactcctataccatcccctgatctcaaaacttgtggtagagccaccatatcggatggtccactagtaccctatacttgttgcccccctcctatgccaactaactttgacaccattccatattacaagttcccttctatgactaaactccgtatccgtccccctgctcatgctgttgatgaggagtatattgctaagtataatttggccataagtcgaatgaaagatcttgataagacagaccctttaaaccctcttgggtttaagcaacaagcaaatatacattgtgcttattgtaacggtgcttatataattggtggcaaagagttacaagttcataactcatggcttttcttcccgttccatagatggtacttatacttctacgagagaatattgggaaaactcatcgatgatccaactttcgctttaccatattggaattgggatcatccaaagggcatgcgtttacctcccatgttcgatcgtgaaggaacttctatttacgacgaaaggcgtaatcaacaagtccgtaacggaaccgttatggatcttggttcatttggggacaaggtccaaacaactcaactccagttgatgagcaataatttaacactaatgtaccgtcaaatggtaactaatgctccatgtcctcttttgttcttcggtgcgccttacgttcttgggaataacgtcgaagccccgggaaccattgaaaacatccctcatatacctgtccatatttgggctggtacagtacgtggttcaacatttcctaatggtgatacgtcatacggtgaggatatgggtaatttctactcagctggtttagacccggttttctattgccaccacggcaatgtggaccgtatgtggaatgaatggaaggcaataggaggtaagagaagggatttatcagaaaaagattggttgaactctgagttcttcttttatgatgaaaacaaaaagccttaccgtgtgaaagtccgagactgtttggacgcgaagaaaatggggtacgattacgcaccaatgccaactccatggcgtaacttcaaaccaaaaacaaaggcatcagtagggaaagtgaatacaactacactccccccagtgaacaaggtattcccactcacgaagatggataaagccatttcattttccatcaataggcctgcttcatcgcggactcaacaagagaaaaatgaacaagaggagatgttaacgttcgataacataaaatatgataatagagggtatataaggttcgatgtatttctgaacgtggataacaatgtgaatgcgaatgagcttgataaggcagagttcgcggggagttatactagtttgccacatgttcacagagttggcgagaatgatcataccgcgactgttactttccagctggcgataacagaactgttggaggacattggtttggaagatgaagagactattgcggtgactctggtaccaaagaaaggtggtgaaggtatctccattgaaaatgtggagatcaagcttctggattgttaagtacgttctcaattgaatctgctgagattacaactttgatatgttttttacttttgtttttccatgtaacttttcctgttgaaatcagcttgatgcttgatttccttggagttgttattcactaataaaatca

SEQ ID NO: 14876 - DNA, 780 bp, Solanum tuberosum
  Predicted polypeptide sequence is orthologous to G2994
aaaatggaatgaccattcttggggaatttaattaaattaaatcataagataattagagtgttagttaaatacaataaaatgagtaagagaggaaaagggaatatcaaatttgggcctctggcccaaatcctccaaatcttgggcctgctgaaatttccttaggcttttggccccatttgccttcaagaaatatgtgtatacactttaggtatacacttgtatacgagccatattttaggcttgttttcctgtattacccttgcatatcagttttgatttgtatttttaccttcgggcatgtatccctgcaatttgtgacttgtatatcaacgtacgccactgtatatcggcgtatacaggccgtatctcagcctattttcggccttctggaaacggtaattttagttttcagcctttatttgtagctttcaacctgtccaccgacttttctatgaacggactgactcgagatgtgagttgagttttgaaccaactcgagatgcaaggagaggaataaaagggagtcaaatggactcaaaccgagggagttcatgcaagaaataaagacaaggattagaaaatgactaatgaatgaatttgctataataaccaagtgacattgaaacgagataggtttagataagtttcatgtcaaaagaaagataaataaaatcaaagcaaattggcaacaatatcacaagatgtccccaatttaccatacttaaaaaaaaaaaaataggagacaaacatattaccacttcaaatttgtgaaatgagaaa

SEQ ID NO: 14877 - DNA, 495 bp, Solanum tuberosum
  Predicted polypeptide sequence is orthologous to G2997
ggagaattcacacttgacgacagcaacacttcacccggaggcagcaccagtttaaactgcgctgcctgcggttgtcaccgtaacttccaccgcaagttcacttgcggtggaagttacagcaacaacagtagccgcgatgatagagaaatcatcgcggctcatgattaccgtctggcgactactgaagagtcgccggcggtatcggagaggagcgggaagaagaggtttaggacgaagtttacgggagatcagaaggagaaaatgctggcatttgcggagaaattggggtggacgctacaaaggaaagatgaggaaaacgagactgagagattttgcagagagataggggtaagtagaaaggtgtttaaagtatggatgcataatcataagaataattcttcctctgtatccagtactattactggcaataatgcatcttctcttactcaataaaaggtctaatttaatttttacttaaaaaaaaaaaaaaaaaaa

SEQ ID NO: 14878 - DNA, 912 bp, Solanum tuberosum
  Predicted polypeptide sequence is orthologous to G3032
caaatcagccgcctctcccttcaactccaccgacgatggcgcgtctccgacgagaaccagaggagagggaggccgatctcctctcctcttcgccttctcctcctctcctgtccgccttctcttgctctctctcctcttctccctcacctcgtatcttttttttttctccgggcagcagcaaccggagcagtgctccgaccagcgacagcagcgcctggcgaggttcatgacagcagtagcgactgctccaaacagcaacgtcaacgacgccaccagcagccctagccggacagaaactagcagctaggtgcagtgagcaccagcaatgcagcagcagcctgctcttccctttctctttcatcagtgaacaacagcagcagtcatcggcgccgctccattctctagcgatggatcggcgagaacaaggcaggcgaagccaccggcgaacagtgaggacgaagcaacaacaacgccgaccaaacgaggcagccaccgcctctgctcgcctccaccttccctcttctccggccagtagcatcgagccctggcaaacccccttttaggggatttcgaggtcattaaagatggatctgttacagatccgtcaaggtatgctctttttttttcttagtgtgactgatttcaatgcatgtttccatactgtatgtgaaattatctcaccttaaacatttgccattatttgtgattctttgaaatggttgtaatatgccattatgttatatgatttagtcacttggagtgtattataatatgcttcgaattgctatactgctgaagttttattcatgttaatgtgatatgtgatcaaacttgtatcaaaaacctttgcttaaaatcaaaggtttgtgcttgcttatccccctctttagtgatctgattagtggaccttgt

SEQ ID NO: 14879 - DNA, 1088 bp, Solanum tuberosum
  Predicted polypeptide sequence is orthologous to G3044
ttttttttttattaaatgcaatgtgcatatacggaaaaacgactctacaacacttggaatttgctttcctagcttgcaaacaaatacataccaaactaactgccataaatatgctttcgtaattatctagtcaggttgaagatgcaactattaacttaatgaacatagtaatacaaggccattaacaaatttaggccaggttacataaattgtggcaaagaggtttggtggccggtcttcccttggaacccaatactttccattttgtggttaagacccaattaaagtgggttcctaaagaatccggttggccagaaaggttggtggccaagaaattaattaagcccggttattgaatggaaagattgaaccaccaatccaaacactggggtccggttattaaggcttcgcctcctggaatttattgttaagaattccctttgtggttccacggtttcccgaagttcttcctggcaagggttttccagggaattgggcaattcaagccctcttccaaagtttttggtggcatttgggaattcgcttaatttattaaacccttgggaattatccaaggcattacaaagaaaaaggttccaaaaaaaggcacccattaattacattcttggccaatagttcttggggtcccgggtcaaatggacctttaagacagtaaggaaccacggccctcaatttttaccaacttccctcttggaaagactttcaaattgtttgtccgtagcaacatagcttaatgttcccaaatttgcccatgaccctgggggaatgggcacagaaattcgaaaagatgggaaagggatccacggcaaattgaaccatgtaaggttcaaacaatcttcttaacatgtgaacaaaggcattgggtgtaccatttcatttgagcaccatttgcacctgccttaaaccgaagttctcccttccgtaactttaaagttccttcaagccttgtttaaccattatataactccaatatcttcacggggccaggaaaccataccggcactggggtacctccatttatatcttccaaataatctcgaataaggtgttcccgaagaattaaaccc

SEQ ID NO: 14880 - DNA, 742 bp, Solanum tuberosum
  Predicted polypeptide sequence is orthologous to G3059
ctgaaatgaaactcaacccaacaagtcaccgaccagtacagttatacacagcactattgtctttgaggatataaacctgtaatgcctaacaaatggtaaaactccaaaacggaaagaagaacttcataggttcatggacttggttccttcacttctcgtcatccctagcatgttaaaagtcccatggactcgtctgcagcagagaaaacctgtatacaagaccattgtaagctgctatgtaaaggtaggcacgaccactgcaaagcaggaaccttttaacctgcaaaaccttggaatagataacatcaatcttacaagaatgacaaactctatgaattatcctagaaagagagaagcccctagactgtagacaactaacaaatctaaggtgggcagaaatcttggaagggctatgtttttaactcccaatcactttaatcaaatgttccattttcaggaagaatgaaccagggagagaaaaaaaatcatttgaccagaggccctaaagttaaacagatgttctatcaattaacaggtgctacattactgttggctgggttccctatataagaaataaatagttgtcaataggagacaggaaacaggacattggacaaaatttaacaagaacaacttgagcactgccaagcttcactgtgccaagcaacggatgcatcagagtccgggaaaacatggcagtgttcctaagtaagcctcactatgatccctgttaaccaaagtc

SEQ ID NO: 14881 - DNA, 508 bp, Solanum tuberosum
  Predicted polypeptide sequence is orthologous to G3060
ataaattttccagcagtctgggttgatataagcaagagaataacacacatcacatatttgttccggattggcaaagttccgactaaactttaaaatccatatcaacactagtagataggttatgatctaaggaacagcaaacatgataaataacgaacccaagagagatatcgagcacattaaggatctcaacaaataaatgcctcaaaaccgagatattctaatggcaaaaacaccttatctactattttcacaaacccaaagaaaaagagataacagccatagggggagatatgctccctaacagtaaaatacagcaaagctcacagacctgacttacgcaattcttctgctccatgtgcaaagtggcacttctctccaaaagtgcacgaactcttggtgaagttctcacaaatttttgttttatagttacttgttacggatgagctggtgttcttcatcgggggtcctgctgatgttgtaacactctgaataagctcacgaacca

SEQ ID NO: 14882 - DNA, 772 bp, Solanum tuberosum
  Predicted polypeptide sequence is orthologous to G3060
gatataaaaagctcttttgacatttctcaattttgaagcccaattattctaaagcggcagtagcaagatcctatctaaggactcacataataaaagtgttttccggtcaccaatacacagatatgaaatacctgggcaaccctcatcctaaacggatatatattacactaatacagcacagacagtatcctttcgacgtttatccttgtactatctcctattggcaagcaatatttttgctaatacacagtatgaatgccatgaaatcaagtcaatggcttctgcaactcactggccccatgagcaaaatggcatttctctccaaatgtgcacaaaccttttgaaaaattcgcacacatctttgttttaagtgggccaggaggatctcgagtaaatggggcagctttcttcagcccgcctgtaggtgtactgatattcgatatgagctcccttaccatggcactcgcctgattaatctgatcaaaggttccttggagttcaacatttcttttgttagtgtccgtttcatgctcctttataaagagcttgacaccagtaacccgacatatgtgttttgagttcacaccactcttccctatgatgtttccagcaagagatgcatctatactaatggtagttgttgcagatgctccaaagtttgtagcagctagaccaggttgggacggttcaaggtagccggagaacccactcggaagacctttggcttggaaatcatcgtacgctggacgcacttgcttcccaatctccatct

SEQ ID NO: 14883 - DNA, 931 bp, Solanum tuberosum
  misc_feature (666)..(666): n is a, c, g, or t
  misc_feature (856)..(856): n is a, c, g, or t
  Predicted polypeptide sequence is orthologous to G3061
atactaaaatcaaacataaactcaaagaagaggaaaatcaagaagaagtgaagttgttataacaactctattgtttgtttttgttttaaaaacattgtacactatacaatgagtatttcttgggatttagctgttttgagcaaatcttgtgacttctcttgaaatcgagctgagctgagctgaactaaactaaactaaaccgaactttttttttttttggtgtgtgtgttcattttacttcaaattttgaggttcaagaagaaaatgatgtctaatgatggactttcttgttccatgagaggtggtttcactttcattcaagatccaaaaaaccctagtactaatattaatcatccaaatccaaaccctaattcaaatccagatgtttcttgtgctaataagaggaagagaaatctccccggaaatccagatccagatgcagaagtgatagctttttcaccaacatctctaatggcgacgaatcgattcgtgtgtgaaatatgcaacaagggtttccaaagagatcaaaatttacaactccatagaagaggtcacaatttaccatggaaattgaaacaaagaaataacaaagaagttattaaacaaaaaacgtttatatttgtccacgaaaaatcatgtgtacatcatgatccatcaagagcattnagtgattttaactggggtttaaaaaacccattattcaacgcaaaaacatggtgaaaaacacaaatgcgcaacatgtgaaaaacatgttccaaccaccacaactaatgcaggttcaatctgattgggaaaagctcataagtaaagattgtggtactaaacgcagtacacatgtgcatgtggcaccactttntttccagaaaggatagtttttaacacacagacatttgtgatgcctagctgaaaagtccagatttcttcaatccca

SEQ ID NO: 14884 - DNA, 956 bp, Solanum tuberosum
  Predicted polypeptide sequence is orthologous to G3074
ctttccccaaatcttctcctttctctctatctcacttcgagcaatgattgtcttcttctgattcttccaattccagaaagaaatttgttcactagattctctaatttagtatttaaatatccttagattctctcaatttctgaatggacagaatctgatttatcatgaggaagaaacttgatactcgcttccctgcggcccggatcaagaaaattatgcaagccgatgaggatgtcggtaagattgcaatggctgtgcctgttctagtgtcaaaagcattggagttatttttacaagacctttgtgaccggacatatgacataactcttagaagaggagcaaagactgttaattcactgcacttaaagcactgtgtacaaagctacaacgtgtttgactttcttcgggaagttgtcagcaaggttcctgattatggccattctgatgctgctggtgaaatgccaaaaagaaggaaagttgctatagaagaacatcatgacagtgaggatgaatacaaaaagagcaggacggagatgtctcctgttagcagtagtggtaggggaagaggtaggggtagaggaagaggccgtggtcgggtaagccgtgctgataaggagctcgcacgacctgatatgcaacttgaatcctgcacttctgctcagcagagtggtcaacaaaatccaaatcctggaactcagacagagaactgctcagaaccaaaagaatcacctaaacaggattccactgttggtgacaaggaaaactcagttgtaacaactcctaatctgaaggtcgatgtagatgatagtactgataaaccagctgcaccggaaatagcaccctgcaatccatcgccaaggcctgtgaacgagaaagcagaggaaggccctcagtggtccctcgaaatggacagaatggtcatcgaccctgctcatatgtcgcaactgaatacaagt

SEQ ID NO: 14885 - DNA, 753 bp, Solanum tuberosum
  Predicted polypeptide sequence is orthologous to G3083
gatagtctctatttatattgtagatatataaaccaactctccatgatgagtactagcaaaaatgggctagaaaatggcaaatcattccacaagtttttttgaatcatggctcgttaaacaaaatcaagatttggatcagcttgtacgtgcctcaaaagacgacgacaacaacaacaagaacaacaatgacatgatgttgtcatctttaattcatagtgtggtgaaacattatgaagaatattatagagagaaatcacgatacgctattagtgatattttaggcatgttgcacccctcatggttaagtaatcttgaagatgcatttttatggattggtggatggagacctagtatggcttttcatttgttatactcaaaatcaggtatacaacttgaagctaatcttcatgagttaattagaggatttaacacaaaagatttaggaaatttaagtggtaatcaacttgtattaattgatgagttacaacataagacaataagtgaagaaagaaagctaagtgaaaatttagctaaagttcaagaaactttagctgatgcatcaatggttgaattatcacatgttgtgagtgaattaatgagggatgatcaattagttgttaatgatgaagaggaaaaaattaagaaaaatattagtaaaaaagaggaaagtttattggatttgttgaaaaaagctgatgattttaggttaagtacaattaaagagattttgagaattttgacatcaacacaagg

SEQ ID NO: 14886 - DNA, 1047 bp, Solanum tuberosum
  Predicted polypeptide sequence is orthologous to G3086
aaaaattgtgcatatagtacaatatcacatcatgttaaaagtatctttgcaactgttttagcccaagtacttccttttatctaaaaaaagaaaagagttatttggacttttgaatggcaacacacacatttacacaacataataaaaggacctaaccacttaggctcatactaaagtagtccacaaaagcagctgataaagtcctaacattatattcctttcacagaacataagtggacaatggaaattttatgtacagtttacgttataatgttacatcagatgaatctgaatctatcttttttacacaccaaaatatggcaacctattctcttctttttccagtgccaaaaagaatccacctatctgctttgctatttccattgtcaatcctttttatcccactacaatgtgcacagcattgccctaccttatcattttgaatatggtcttctattcatgcgagcacgtacactttgaacgcgtttccgatagtgccttgacttgtgtctctagttctttgatgtagtcagctgcaaagtccaacatatccgccgggtctgtttgcttgtccatattggggacaagctcttgcagcttcctcattctttcgcttattcgtgttcttcttaccctttcggcgatgctacgaggatgagtggcacagcctctctttgctctgactttacatggtactgaatcttgcaagagcttctccatggcggataactccggtgatgtttgaggtaaactcaaatgagacaatagagtgggagggcgaagctcgaccttcagtactctgaattcttcagatgggactttcattattgggaggaagtggaacccggcgatttcatcaatccgtcctgggaacttggttagggaaaatccattcagttcacacaatttcgtggatattcaattcccaagaaagccttgtcgaaaaaccttgccatgataactgttcaatcactttttataatgggcctttaaccacaaaattttattccggcttggtttggccccttcaatggtttaaggcccaat

SEQ ID NO: 14887 - DNA, 739 bp, Solanum tuberosum
  Predicted polypeptide sequence is orthologous to G3091
ccaacaacactttgccttttaaatttcttaattaaattaattacaatgtacaataatcttccaactttttctaatataaaacaaattgtgcattattgctctcttttttctctttctttcctttcaaaagaccccaccatcttcaaaaaggaaacttcatcaacctttacaacccctccttatatgtcatgagttgtataaagtagttttttgaatgtattattttttggttaattattattttatatgttgttatgaaccaagaggtgctctatgaggaatcccttttcttcttctagcatttgaaggtggtggaagaaggggtggggtgggtatatattgtcatgttctaagccttcacgcaattgatttcctcctcttgatgatatgccttcacctctttgtaatgctagtacttcattcttggcatctaagataaagcttgaatctccattcctctttattcctacaagcttacatccaagagaacagaaacgaaaagtgtccaaaaggcttcttccacatatttcacaaacatgagaacttgctttgccactactctttggttgtggcctttcatttagaaataaaactcttgcactgttgattacatatgtttgcactccacttatatccaatactttttgaatctctgaaactcttaccacatcatgatatgatgatctccttatctgaatgacttgatgatctttatgtttcgatgagcggcaatagaagc

SEQ ID NO: 14888 - DNA, 1014 bp, Solanum tuberosum
  Predicted polypeptide sequence is orthologous to G3091
tcaagacaccactgttcgtgaattcaagcctaagaataggcgaatcatgggagctggaggacctgatgaggaagataatagatggccaccgtggttgaagccattattgaaggaacgattctttgttcaatgcaagttacatgctgattctcataagagcgaatgtaacatgtactgtttggattgtatggatggtgctctttgttcgatttgtttatctcatcacaaggaccatcgtgccattcagatacggaggtcatcgtaccatgatgtgataagggtgaatgaaatacagaaatttctggacatcacttcagttcagacctacattatcaacagtgcaaaagttgttttcttgaatgagagaccacagcctaggccaggcaaaggtgtcactaatacctgtgaagtttgtgaaaggagtcttcttgattccttcagattctgctctcttggttgcaagattgttgggacttcaaagaactttgttaagaggccaaaacaatcaccggagaagaagagatcctcgccggctgcagcagcactctatgactcggaggattcgtacagcagcagcagccatggccggcagaagagtccaagcaacaaggtccaccaaagtttcagtccgtcaacaccccctccaacttctgttaattacagaacagccaagcgaagaaagggaattccacatcgagccccaatgggaggactagttataggttattaagttttagaaaaatcaaatcaaagtccttcatttgctcctaattatacatcagccttagtaaagatcagaatgcagaatgcagaatgcactcctccttataaaaaacactagtgctttctctagaaaaggccagtgtttgctttattgtgtatatacttttagctactatagtgtatgatgggaaaagttggagggggtggaagttgaaataaagaaatgttaagggactaatagggagttcaaagttagttggggctggaaaataagctatatattatattata

SEQ ID NO: 14889 - DNA, 936 bp, Solanum tuberosum
  Predicted polypeptide sequence is orthologous to G3091
aagtattctaataatcacaatactatattcatatttacattttagattacaaaggctcgaagatacaatcaaaacatatgtataaacaatctaatatttattagtagttcatcaaactatagtagcttattttctaagcccaacttctaacttagcactattagtccttacattttttcttatttcaacttccacacctccaatttatcatatcatatcctatttgatcctaaaaactatatacaatacggctcttgtggactaaagagctttaaaacactggctttttttttggagaaagcactagtgtttggaggaattgcattcttgataaactaggcagtatatttgtatagacattatgcattttagatgtaaaataaaggactgagattgcaaagattaatattctatgaatagtcctcctgttggggctctatgaggaattccctttctacgcttggccgttttgtaattagcagaagttggagggggcgttgacggagtgaaactctgaatcttgtttctccggccatggctgctgctgctactacagtaaaagtcatcagattccgatgccgccatcggcgccggtaatctcttcttctccggcgaattcttcggcttcttcttcttcttcacgaaattacttgaggtcccaacaatcttgcaaccaagagagcagaatttgaaggaatcaagaagactcctttcacatacttcacaagtatttgtgaccccttttcctggcctaggctgtggcctttcattcaagaaaacaactttagcactgttgataatgtatgtttggactgaagaaatgtctaaatatttctgaatctcattcactcttatcacatcatggtaagatgacctccttatctgaatgacaggatgatctctgtgatgggctaaacagacagagcagagaggggc

SEQ ID NO: 14890 - DNA, 1153 bp, Solanum tuberosum
  Predicted polypeptide sequence is orthologous to G3091
caggccccctgccgattggttggaatttttattatacatattaattactaatattattgaagttccataatactagtatatcatcaaacacttggaaacaagaggaaaaatatataaaaactctcagctccttgggattttaactctttccaaacaggactttgcattagttggttgctctgtgcatctccaagtaatccttgttacttcattggaaatataaataaagctgatggggctatttcttctttttcccattcaaattgggagaaagccttgggcccttcaacaaattggttttcttaaatggaattgggaacccaattggaaggcttaaccaactttatcttggaattaattcccttggtttaaacttttggtttgtttccacccaacttggcttcttaattgttaacatttggctccttttgttaaccttttccgccaatttaacataaaattaattcttccaagggaattggaattccgcccggttgtttaaacccaaaggaagaagaagtttagggaaaggggcatttgaactttaatttcccatttggccctttgaatggctgaaaccctgggaagaacctcccaaatttgggtttatgaaattgagaaagttggttaaaaagggcccattgaatcttggaatattggagaggttgggcattaaccccaatttggtaaagttcccagggtttgaagcgaccaaagggtggaataaataaaattttcccacaccaaaagaattttggaaagccccctgaatttcacaaacttcttaaaatcttttgcttccaaaaggtaaacctttttctttccaagccccctaaaaactttccaagaaaatggccttcctaaataaacctcttctttgccccaacttttccccggaagttttctccaactaatacttccaaacataatttattccccggtaagaaggtttggctgggttggggtggggcgcagttgaaacatggagggatgtacaaaaggaacctttgagaaaaaatcttctcccaaaagaaagaacatttttcctttaacgaagttatttacaaccttgttacccatatctttacagcggatcccaagacacattggctttccccagtaaaaactttgtggtttttccttccttcggggt

SEQ ID NO: 14891 - DNA, 973 bp, Solanum tuberosum
  Predicted polypeptide sequence is orthologous to G3111
gattcgacatttcaaccacaccattgtcccatttcttctatattgttagatttgatttttagttatgactcgtcctgctagatttctgcttagcaccagctcttcttcaacgccggcggcggagccaccgtcgatggtgacagtggagtctgatttcgttgtaatactagctgcgttgctctgtgcgctgatttgtgtagttggtctcatcgccgtcgcgagatgtgcgtggctccggcgaggaatcggcgccggcgggatcggtggtagtcaaccgtcggcgaataaaggattgaagaagaaagtgttgcaatcgttgcctaaattcacgtacgatccaagcagtacggcgaatggtgcggcgttcacggcggagtgtgcgatttgtctggcggagtacgccgtcggagatgagatccgtgtgctgccgcagtgtggacatattttccatcttcagtgtattgatacttggctgggttcacactcttcatgtccttcttgtcgtcaaattctcgtcgttactcggtgccggaagtgcggtgagctcccggcagtttcctgtaaatccgacggagctacggttacaactccggcggagtctcgttcatgtggtacatctattagctcaaataatttcttggtctaaagtaacaaaaaaaaaaggaaattagcttttaagttatatacgctgacacagtgtaaacgggaaggtaatttacgctatcagtgcagttttacctgtggtaacatatcagttactgtgttgatgcaggttaggggtactcatctagggaagttacatctttgaaatgatctgtgtaaattttcttttaatatagtgaaagatagtctgatgtactaagctcagtcagacctcaacggtcaattataggtagccttaacacaacttaagcaattacgtcgaagtttcattctagaactcaccaagcagtaaaatacgaaatactctctt

SEQ ID NO: 14892 - DNA, 753 bp, Solanum tuberosum
  misc_feature (673)..(673): n is a, c, g, or t
  Predicted polypeptide sequence is orthologous to G3111
caacgttttgtttccctctgttaattaagctccgcactttcctcatgagtaattctgatccttcaccgtcgccgccgtctacaaccaccggaatcggtcaagtcgactccgacttcgtcgtcatcctcgccgctctcctctgtgcgctcatttgcgtcctcggacttgtcgctgttgctcgctgcgcctggatccgacggatctccgccagagcaaccggaaattccgctttttcgtcacctcctgctaataaaggtttgaagaagaaggttctcaagtcgctaccgaagttcagttactcagctgaacacgccgcgaaattctccgaatgtgcaatttgtttagcggaattcgtagtcggagatgaaatccgagtgctaccgcagtgcggccatggatttcatgtaggatgcatcgatacctggttaggctcgcactcgtcatgtccttcttgccgacagattttagtagtgacgagatgtcataagtgcggcgagttgccggtagcaagctcgtcgtcagctcccgtagctgagccggaaagccgattaccggcaaattatcatgtaaatgcatttctaccgtaaaatttaggtaaaaattagtagttaattaggctgtgtgtatatactactcctatattaattaaatctatgtaaacgtatatattcanttcagcctactatattaatatcatcaattagggttacagaaaactactgtttgaatttattaaccaaagattattactgt

SEQ ID NO: 14893 - DNA, 724 bp, Solanum tuberosum
  Predicted polypeptide sequence is orthologous to G3967
ccagatatgttttcggccctgccttcaaaaatcttgctgtggcagaactgcgaaccatggttcattcattgttcttggagtcatgtgcctctgttgagcttgcatctcgactactttttgttatcttaacagtatgtgtcagtcatgaagcaaaaccaaatgggaataaaaggcctaaaggtgaagattctcacccacctagtgaaatcggggtagacactccggcaaccatcggaaaacaaagaccaataggaagtaagaaagtgaaaaaacaaggacctgttgcagcatttgattcttatgtccttgcttctgtctgtggactttcttgcgaacttcagctcttcagtatgatttcaagagggcctaatcatccagatccaaaaatcatcatggatgaagccaagcctgcaaatgattcatctaatgagctacgaaacgggattcattctgccgtctctcatactcggaggatgttggaaattctagaggcacttttttctcttaaaccatcatctgttggaacctcatggagcttcagctcaaatgagatagttgctgcagctatggtagctgctcatatttctgatctgtttaaacgctccaaggcctgcatgcactctctttctattttgatacggggcaagtggggatatgaaattcattccagggcatcgtcaatttataacctaattgatattcatagcaaaactgttgcatcaat

SEQ ID NO: 14894 - DNA, 877 bp, Solanum tuberosum
  Predicted polypeptide sequence is orthologous to G3967
gtcatttgggtcttcatcaccatatctgtttagtccttcccttgctttgtttacttgtcaggcggacaaggaattgcaaccatggattgccaaagatgatgatcttggtcagaatatgtggaggataaaccaacgaattgtgaaattgattgcagaagtaatgaggaatcatgatacaccagaatctttggttattcttgctagcgcaccagacctcctcttacgggcaacagatgggatgcttgtagatggagaagcatgcaccttaccacagctggagctcctggaagtgacagctagagctgtacaaccagtgcttgagtggggagaatctggatcagcaatcgttgatggtctgtcaaacttgttgaagtgccgcttaccggccacagttcgttgtatttctcatccaagtgctatcgtacgtgctctcagcatatcacttctccgtgccattatgcatactggttcaataaaaactagagctaaacgagctgatgtaaatggtatccatggtcctgcttataagtacttaaacattggcactattaactggcaaagggatatcgagaagtgtttgacgtgggaagctaacagccgaattgaaaatggaatgtgtacagagtttcttgatatggctgctaaggaattagggtgtactatatccatttgatctaacttaaattaatgggggcagtatattagttttcttcccatgatttgccacatgaaattcacaagattagaaagtgaccatctattggaatgaggatggagaaaggagaaagagctttagttacacagtcaggaaatgagattagtgtccttttgacacatccatgatcatggaaatataggtagtccttctctggttgta

SEQ ID NO: 14895 - DNA, 952 bp, Solanum tuberosum
  Predicted polypeptide sequence is orthologous to G3967
tgcaaccatgggattgctaaagatgatgaccttggtcagcaaatgtggagaattaaccaacgtatagtaaaattgatcgcagaactgataaggaatcatgatatagcagaatctttggtaattctggctagtaacccagacctccttttacgggccacagatgggatgcttgtcgatggagaaacatgcaccttaccacagctggagcttttggaagtgacagctagagcaattcaaccagtgcttgactggggagaatctggacagtcggttgctgatggcctcacaaacctattgaagtgtcgcttacctgccacagttcgctgtgtttctcatccaagtgcacatgtccgtgctctcagtacatcagttcttcgtgacattatgtatgctggttcggtaaaaccaagtgccaaacaagcagcagatgtaaatggcatccacaatcctgcttatcagtaccttggcataagcatcagtgactggaaagcggatattgagaagtgtttgatgtgggaagctaatagccggcttgaaaatggaatgtctgctcaatttcttgatactgctgctagggaattaggctgtactatatcagtctgaaaactcacttttctggggcatatattaggtctctttgtaccatacctatcttgtaaaagtcacttttagttagaaaatatattttagagtcctttcactcatccgtgattgttgtacaatgacatgtagatagtcccacttgttttgtttttcatttggcacagattatgtttgttgtacttccaaatacaaacatgattctggaaataagtagatgtagttgtttaatatttgagtgacctacaaaaggctggctcagctttagaattgaatttttcctatcatgtaataaccgtcttactttgtattgtacattcagcagataaatatcatctatgcagttttgttt

SEQ ID NO: 14896 - DNA, 721 bp, Physcomitrella patens
  Predicted polypeptide sequence is orthologous to G28, G22, G1006
tgatcccgatcacaattcacgagtgaagattaatcaatggaggtttcaaggtaataaatgatgtgcgagaaggagcagacgccccgaaaattccatgttgtagcattctcagctgttgtacacactccaatggcgttgtaatctatcgatacattgatgatgcctaaaccagcggttcctctacgaagctttgtgagagttgaaaggggataatgatcgtccccgctctatgtaccgaaacaccactctccatgaaccaagagcttttcgtgaagaactctacagtattctgcacaaaaattgcaacaggagagccatgatccttccttagaccagcagctcatccttcacacgcggccgcttaagctcatagctttctgcggaggccacagcgctaggcctcttgttgctcgatgcgatcgcaatcttcgtaagactgtggatacatctttgcttttgagaattcttcgccgcttgtcggcaagatgaggacgacagcggagggcgaggcagtgattcagggttggacagagcggtggtggctttgagtgggaagtttaagagagcgcgtgagcctcgcatattaagagctgctcgatcgtaagccaatgctgcttgctctgcagtatcaaaggttccaagccatacccgtgcaccgttcttggctgaatctcgaatttcggctgcgaatttcccccaaggccgctgtcttactcccctg

SEQ ID NO: 14897 - DNA, 655 bp, Physcomitrella patens
  Predicted polypeptide sequence is orthologous to G28, G22, G1006
tattgtacaatatcccgaggaagtgctatctcgcgcttcctacacaaagatttgtaaaaattggagggtctctggaagcaatggcttcgaggcgctcaagattcctagtaagttcgctaacagtaccaaatgcggtggccttttagaggaatatgacctagagcttctcattcttcgcatcgatcacgcctatttgtggtaatttagattcttccatgctctccgtgatgatctgctgcgcgagcgtcgtcctgctcgattcgataggtttctcgatgcgagggtttctgcttccttgcctggcatatcgttcaagaaaggagcctagaagagaagaattctagaactgctgctgctgggatagaagtgatgctgaagcggccgaggatttcttggaagtgcgtgaggtggaggacgacacagggagggggtggcaatgactcagggttgggacagagcagttgtggccttgagggggaaattcaagagagcgcgagagcctcgcatgttgagtgctgctcggtcgtaagccaatgccgcttgctccgcactatcaaaagttcccagccatacccgggcaccatttttcgatgagtctcggatctcggctgcgaatttaccccatggcctttgcctgacgcctctgtaatgcggc

SEQ ID NO: 14898 - DNA, 725 bp, Physcomitrella patens
  misc_feature (70)..(70): n is a, c, g, or t
  misc_feature (200)..(200): n is a, c, g, or t
  misc_feature (454)..(454): n is a, c, g, or t
  Predicted polypeptide sequence is orthologous to G28, G22, G1006
tgcttgtttttactggcaccttagtgcaaatgtacatccggactgacggtcgatcgaactattgtacacnaaatccatctaaatgaaaaaagcactttgggagcaaactaatcataggggatgcagcccggacaacctaattgcctcatatctggatcgcgaagtcgaatcgacaatctggcagccgcaggaaaaatcangctgttgctaatttactttacaatgttcaaaaacctcctttgttttgtatcacacgtgatatcccaagaggaaacaaagaacttctcttgatgcatgcagctgctcaccatgggttttcgatccatccttcgcacatgatcacgcctcagctcgcaatctctttgctgtttcaagacgcacgctggagcagaatcgcttgttggatccagtcagtttcttgcagggcatttgtgagatgctttcgctggttggntgagttattctggatgcattgcggctggtggaggaaggctccggagcaggagggaaagactcggggttggacaaagcagtggttgccttgagggggaaattcaagagcgccttggagccacgcatctggagcgctgctcggtcatatgccaatgccgcaagctccgctgtatcgaaagtccccagccatatccttgagccgttcttcgaggaatctcgaatctctgcagcgaatttcccccatgggcgttgcctcacgcctctgtaatgtg

SEQ ID NO: 14899 - DNA, 745 bp, Physcomitrella patens
  Predicted polypeptide sequence is orthologous to G481, G482, G485, G1364, G2345
tttctttttttccaaagattgtacagttcccgcactgggtcagcagcatgttgaaaaaaatgctgacaaattcctcactgcttgatcccttaactgacgctgtgctgactggagctcaaaaagccctccgatttttccgcagacagcatctaaaatgagcagctagggtagaactgtcaaaaccagaagtgcatccacgactaacttcctcttcttttccttatgctaactcaatcgtcacgtaaaactgaccgttccccataagctctctacacctaaaggactatgggtttctgggttactccctaatcttcatctacaaggagagtcgaatgcctttacacagatttacaactttcacccaggagctcccatcatcagttgctgcatcttgtcatttcaaagatgcagaaacagaagcctgtaatactaataatgttgaacctgtagttgccaggattcatcatctgcgcttgcatgtaagggttatagcctccttgctgcaccatctgaacgccaggagataccatgccacttccctccttcttgccagaagatgattcaccagccttgttcgtcagagcaccctcagtctctctgtacttgtgaaggtaaaccttcagcggctcgacgtagtcttcaaaccctaatgtgctcatggcccaaagtaaatcatctccattgatcgtctttctcttttcccgctgacacttgtcgctagcttcgctcgtgatgaaactgatga

SEQ ID NO: 14900 - DNA, 733 bp, Physcomitrella patens
  Predicted polypeptide sequence is orthologous to G481, G482, G485, G1364, G2345
actttgcttcagcacgcgcgcgttgtggtcgatctctcgctggagcaacagaaagccattcttacttctagcacttctcggaggttattgatttctcgcaaattgctcttccacctgccctctttcgtgagggagttcgaagctgaaaagtaatgagctgaagattaaggtcttttacgagtgaacagcgagcacacagctagcaactctttcggagaatactccaggcgaaattggtcggatggccgatagctacggtcacaacgcaggttcaccagagagcagcccgcattctgataacgagtccgggggtcattaccgagaccaggatgcttctgtacgggaacaggatcggttcctgcccatcgcgaacgtgagccgaatcatgaagaaggcgttgccgtctaatgcaaaaatttcgaaggacgcgaaagagactgtgcaggagtgtgtgtccgagttcatcagcttcatcactggtgaggcgtcagataagtgccagagggagaagagaaagacgatcaacggtgacgacttgctgtgggccatgagtacacttggtttcgaagattacgtggagcctctgaaggtttacctacacaaataccgggagctagagggagagaaggcttccacggccaagggtggtgaccagcaaggagggaaagaagggagtcaaggtgttatggggtccatgggtatgtcgggcggaatgaacggtatgaacggtacg

SEQ ID NO: 14901 - DNA, 782 bp, Physcomitrella patens
  misc_feature (718)..(718): n is a, c, g, or t
  Predicted polypeptide sequence is orthologous to G19
gctgccttgtcttgtgacctgtaagtggtcccaacaacaatctaaccaccggcaaactccattgtttctggaatggctatttcaatattcaaactactatttcttctacatcatctttctctccagtaggcgcatttcaagttaccatgttgaaactccagtgactacattgccgaataactggttgaaccttcagttaccatattagaacatacctttttaaggagagaagacatgaattaataaaacctccggatcagtacttaagagtgaaagagccttgccgacttagttatttccatttctgttcggtgagctcagtaatttccactaactggcacactcacgctgaagtggcacagctgctgcacagaaatctggtgaaatcccaaaaaatagacccttaaagtcggtctgaataccgataagtgaacattcgaaagcgtcctagtccacgaatgtcggttttgcagaagcgctggggaaacgataaaatacgcacctctctgtcgacacacttggagggacctgaggagtgctggctgacttcggcggagttgcagtgctcacgccaactttgccattcctggcaacaacctcagctcaccatggattccgttcgatgtgtccacgcgatcggtaactccgcaagcttaacagctggttaccggcgattgagctatctcaccagccctgcgaccccaccggtcggtcgcangcttcaggctcaaccatgcatacctatcgtctaccctgcactgccacgaatcggctcctccgca

SEQ ID NO: 14902 - DNA, 786 bp, Physcomitrella patens
  Predicted polypeptide sequence is orthologous to G27
atggttgagaaagtagtggtgtcgtctttgcgtgtcaagcgaggaggcaatctcttggcgccactgaagaggaatgtgtccagcattgctaagaaatcctcaacgccaaagagtgggaaaccggtagggagccccaaagtgtacaaaggagtgcgcatgcggacttgggggaagtgggtgtcggaaattcgagagccgaacaagaggtcacgaatctggttgggctcattccccactgcagaaatggcagccaaagcgtacgatgccgctgcggtgtgcttgcgcggacgatccgtgaagctgaacttccccgacagccctcctcgatgcgcagcccgttgcaattcgccgcgcgaagtccaagcggcagcgaccgcagccgccgtggcatgcattccatctgcaaccgctctgaccgtggccaatttccaatctcccgctcagacattggagagcagtccacttcactcatcgccttcgtcttccgacatgagctctggggatgaagactcaggggaggattcagtccagagctttgtcgcggaggggtctcagatttccccttcagaagttgtgccagtattggaatgggttaaggtggaattcggcgacaaggaaacggttgctgctggggacgttgattttgattgtgactattctttcatctctgaattcgcagctgactccttactggcttgttcctacaacagcaaaggtagaactgagtacttgcctatagaaactcacgacgcggctctctatgattccacactttggttcttctag

SEQ ID NO: 14903 - DNA, 1813 bp, Physcomitrella patens
  Predicted polypeptide sequence is orthologous to G129, G136, G140, G146
aaggaaggcagcactggaatggaataatgagtcgtcactggcaaggcagcactcttcctcctctatgtgaggtggttctccttgtcgtctgttgttagattcatcaggagcaggaggtggaggaggagggtatggcactcctctcacctcttgatttggacaggtcttctcgtgtgcgactccaaccagcttgccttcagattcctttgagtgatgccagagcggctctgttgggtttgcttgcttagcttaggtgcggattcgtaggacgagggggctggggaagttggctatggatgatgactacagcgtctggacaaccctccgatcaatggcagttcggggtggttgcaccctcgactgccacggcgacgcaagagttgtctgttggggagattctggacgaggattgtgaggtgccaacgtgtttgtcgctcgggatgtcgagcgggaagggtgattcgagcactgagtcgacacggcggaagggtggggttatgggtcgcggcaaaattgagatcaagaagattgagaatacaaccagcaggcaggtgacattctccaagaggcgcggtggtcttttgaagaaggcgcacgagcttgcggttctgtgtgatgccgaggtggcgctggttattttctccagcactggaaagcactttgagtttgccagttcaggcagcatgcgggacatcattgagcggtacaggaagagctcggatggtgcagtgaagcgtggcaccaatactgatttacttggtcgggaggtgattaagttaaaacagcaagtagaacgattggaaagctctcaaaggcatatgcttggtgaggatctttcagctttgaaggtatctgaccttttggagctggagcagcagcttgatcagggtgcttcacgagtgagagcaaggaagaatcaactcattttagaagagatcgaagacttgcggagaaaggagcatgaactgatgattgcaaacgaggctcttcgcaagaagattgcagacgctgaaggtgctgcggaagcagcagctcgagctaatttcccggatgctcggctagaaagccccaaaccgttcgccagcgatttctcacgagatatgagtgtgagttcgcagctggcagcatcagtctaccctcatcccaaccttctacaggcgcaaagatcacagacgtcattacagcttggatggctatctgagcaacagatccccagcacggaagaaggttgtgcaggtgaatctagcttgaaatgggatcatccgcactttcacattcagaatagactccatgcaaacatatcaccaagtgtgagaacttataagttacatgtcgatcgataagccacttcgaacgacagaaggctctttgggagcccaggctatgggtcctagcccctcgtcaccgccgttgcttctcaataatccagatgcactccagctgtagcctgtagttgtagagtgtccgaggtttgatgtgatcagtgtcactcatctagaagcatttagtgtggaccaaaatgacgccctgacgggtattagtttgctctggttggttggtcttcggacggcaagtgaaacactttgatacccttatgtattaactcgtatcggtggtgtgagcgttgatcgaaacccagtttcaccgtggcttaaatctgcttttaaacctcaattttggcagttgaattagcgattttgttacatagcatcaaaaagacgtaaggagtttaaaaaatatcctagtttcttgtgatgagttcatacgctttgtattgttatatgtatcgggtaaaattttttgacccttgccg

SEQ ID NO: 14904 - DNA, 1777 bp, Physcomitrella patens
  Predicted polypeptide sequence is orthologous to G129, G136, G140, G146
gttgtgagaagcagactcgtaaggtgtagagagcgggctatggacgatgactgcgtctggacaatcctgcaagcagtggcagttcggggctgtacccagtactgccacgcaagagtcatcgagtgagataattctgcacggcgattgtgaagtgccgacctacttgtcactaggcgtggcgtgcggcactggaggggattcgacctattcgacagagtcgcggtccaagggtcgggttatgggtcgggggaaaattgagattaagaagattgagaatactacgagcaggcaggtgacgttctccaagaggcgaggagggcttctgaagaaagcgcacgagcttgcggttctgtgcgatgcggaagtggcacttgttattttctccagcaccgggaagctctttgagtatgccagctcaggcagcattcgagacatcatcgaccggtacaagaagggctcggatggaatgcaaaatggcgccagaaatgatttcatgggttgtgaagtagtaaagttacgcgagcaattggagcaactaaaagcctctcacaggcacatgctcggtgaagatctgtcgctgcttaaggtgcctgatctattgcaactggagcaacaactagatttgggtgcctctcgagttcgagcaaggaaaaatcaacttatattggaagaggtcgagtcattgcggagaaaggagcacgagctgctaattgcaaatgaggaccttcgccagaagcttgcagatgctcaagggattgctgacgcagttacagctcgagcgaacgtgtctgaaagccctaggcccttgacgagcgctctcacacgagacatcgttatgagctcacagcagcaggaagtcactgtgcatcctcaccccaaccttcgagacgcacaaaggtcacagacgtctttacaactgggcatgttctcttctgagtcatacctcccaagctctagcagggggccatctgagcatccgattcccgttgggccagaaggttgtgcaggtgaatctgccatgagatgggagcaccctcactttcacagtcagaatagactccatgcaaacatatcaccaagtgtgagaatttagaaccattccacgtagattggctgatcattgtcctctacgtgacagtctacacgccgttatccatctcaggcttcctgaaggccctgctctgaagcatcacttcggcagtagattgatgattttggatagaaatagactggggcttctgtgaaattcctgattacttttttatcaaagtgacttcttccattggcacgtgtagttttaggtatttctcgttcggtagacaccttcaactgggtagtttttttggatgtcttgttgaattgtagtataacaactgtagtcagtttcattagcttgttctgaaacgatttgatgcttgcatcgagaaactcttgatcagtttcagttggtagcaaaaagattctcgtcaccaatttatgatcacttgaaggtcttgaacataggttttaagcagaaacatagacagtgttgtggaagttaaatgagtgtagagtatcctcggtaacgtaagcttttccaaccatatatattcagctgagaagcacgttatctgctggaactcgttaaccactcaatctataaattaacctaacacttgtgtgtctgaaaagcatccttcagctgcacttggaacaaaattgacatgaaagtggtgattgttatcacaagaatatatttattgattttttgttgaatcagttcttcataaaaaaaaaa

SEQ ID NO: 14905 - DNA, 1397 bp, Physcomitrella patens
  Predicted polypeptide sequence is orthologous to G129, G136, G140, G146
gtcgacacggcgaaagggtggggttatgggtcgcggtaaaattgagattaagaagattgagaataccacaagcaggcaggtgacattctccaagaggcgtggaggtctattgaagaaggcacacgaacttgcggttctgtgcgatgccgaggtggcgctggttattttctccagcactggaaagctcttcgagtatgccagctcgggcagcatgcgagacatcatcgagcgctataagaagagcccgaatggcgcaatgaagtctggcgccagcactgatttcctgggtcgcgaggtcgtgaagttacaggagcaagtggagcggttgaaaagctctcaaaggcgcatgcttggcgaggatctttctgcgcttaaggtgcctgacctgttgcagttggaacagcaactcgatctgggtgcatcaagagtgagagcaagaaagaatcaactcattctggaagagatcgagggattgcagaaaaaggaacaggaactgatggttgcaaatgaggatcttcgcaagaagattgcagatgcagaagcagtagcccgagctaatctatccgaggctcggcccgagagccctagacatttggctagaactctttcacgagacgtgagtgcgagttcgcatccggcagcaactgtgtaccctcatcctaaccttcgagacgtgcaaagatcacagacgtcgttacagctgggcatgttctcttctgagtcatatcccccaagctctagcagatggccatctgagcaacagttcccctctgcctccgaaggctgtgcaggtgaatcttccatgaaatgggaccatccgcactatcacattcagaatagactccatgcaaacattttaccaagtgtgagaatttaaaaagttacatttcgatcggtaagcctctccgaacgacagaaggcttttaaaagttggggttatgtgctctagcctatcgtctccggtgttgtttctcgtttacacagatgcactctagctcgaggttgtgactgtagagtgtccgagggttggatttgatcattgtcatgctctcagaagtacccagtgtggttgtagtaaaatcctgcaactgctggttgtctttgttttatttcgtttggtttgttttcggttttggggtatgaacctttttgggatttctctccgtttacggtggtaataagctttgatccaatcttcagtcttttcctgttttgaagctgctcctaagcttcaatttagagggtgactattatatatcaaaaccatacagtgatagtagggttctcagaatccgtcctcgtcccctattaaaagttttcaagtttgttatatggatcagctgtaatccttttgattcctgagaaaatacagtaatactttattggggaaaaaaaaa

SEQ ID NO: 14906 - DNA, 501 bp, Physcomitrella patens
  Predicted polypeptide sequence is orthologous to G131, G135
ctcagcgatacggtatgttattatctatcagtctgaaagtcattacagagaaaaaaattcttcaagagctcctctggcaccagcactcgcgtatttgtgctctgtttgtgtgttttccaaaatccaaagcgtttattctaagctacctcactaacaaaagtcacttttctgtctatccagaggaaacagaaacccaaaattcaaatgaggcatcattacgtacaattacttccaccgtcgtcgcatccacagaacgcctttgtctgcagtcaatgcggagttcctcaacatgattactcaacaaaatttaacgccaagagcagaaacggctcttgtgaacctaaagttgcgttcggaaatcatattgccacacagcttgcttactagagaggagattgagagagcaacgcggaagagttaccgcctctcggaaactaaaaaaacacccaaactgctggaaatgcagaaggaaatgtgggaatgggcatacgtatcgctgag

SEQ ID NO: 14907 - DNA, 711 bp, Physcomitrella patens
  misc_feature (381)..(381): n is a, c, g, or t
  misc_feature (684)..(684): n is a, c, g, or t
  Predicted polypeptide sequence is orthologous to G187
ataattgatggcatatctatttcatgaaataagacatttcttaaagcttatatttatataaatatgaatgtatgttcgtgtgtgagaggttgtgatggaaagtgccttccatttaatccacagagctctaccttgttctataagaattaagcacatgggagggccaaagcatattgaccctcatgaccatgtgcgcttaaaacacagtaaatataatagttcttcagtgatgtagggcgacgtaaccgaaaggggtcacgtcgaattatgatgcagattcttcacagctacgaatcactgcatctgtataattttatttaaatgtgcagtcgatggttggatgtcgcattgtagtaatattgtagtttttttttccattanaatggaaatttgccttgaaaatggatggacctttgtagctgaacgtattgtcactggccatcttcctcagtgaccatcttcctcaatgtccatttcagtggtcatgagctccatttctcgaggatctaacttgttgtagatcttaagctggcttggacgtaccctgtccttctgaatgtctatttcaaaaccaggaacagcaacacgaagcgatgagacccgccgatcattctcgatacccatcggagtaggatccgaataaaacaaggaacgatcagtcggctctatgcaaataccccatanagttgtccatgatcatgcctgggaatg

SEQ ID NO: 14908 - DNA, 684 bp, Physcomitrella patens
  misc_feature (264)..(264): n is a, c, g, or t
  misc_feature (304)..(304): n is a, c, g, or t
  misc_feature (344)..(344): n is a, c, g, or t
  misc_feature (357)..(357): n is a, c, g, or t
  misc_feature (407)..(407): n is a, c, g, or t
  misc_feature (409)..(409): n is a, c, g, or t
  Predicted polypeptide sequence is orthologous to G188
tagtgcagattaaagaaataggtgtacaagtaggaaggtattaaacctaaaaatacatgttttctgttcaagaggaatccgtcaatgctgctggaaactcaagaaagcttcatgcagcagaatatattccaccaacgatagatagcagacttcatcttgatagtcgatggaaatctgatgaatgtgtgagacattcgcattgagaatcagtgcatcaggagtgatcaacggtatagccattaggctgcaattttttttttgtanaatagccgagtatcgtacatgtccacctatttctgggaanaaccaggagttcaatacaaatcgcccacattagctccaanagtcgggcctganaggatggtgggagggaactgatgcagttaaatgattagcatcaggtccananagtctgctagcccaggtgcgattgagtgtgatgggaaagcgcttcttgtaagacgagaaaataatgaatgtaaatcccgattcatgtgatgagcgccgtttcacctcttgggtcagcaaactggtattccactctttgatgacgacgaaatgtcatcatttaactcttcgtcttcagaatttttctctaattcttcttctttagcctcctcgattattgggagctctgcccagacaggatcactagcattggctgacgctctcctgaattcgaga

SEQ ID NO: 14909 - DNA, 501 bp, Physcomitrella patens
  Predicted polypeptide sequence is orthologous to G196
tcgaattcgttcgagaaccgtgggtctttgttgttcgatgagggatatgatggtgtaggtactgttctcatgattgtttcgcctggttgtagcggttggaggtattggtatttcgccgaagtattgagtgatgaagaaatcgttaagagcctgtggcattgtacctgcatcagtggctgacacttgaaagtcgagtcgtcgagggtttagagtggacaggtgctgtgccctgggcacgctgcgttgtgtgagtcctgggttgcgggtttggaagcgcggctacttcgacttgtgaaatttcgatagtcgggagcggacaagtggaagatctcctcagatttgaaagtaaggcgaatttacttctgaaatggctataatgacgcgacacatagtcgaagctcttccatccgtcgacggacaatgcgtgggagcatactgtccgcttctgaaaactaatcggtcagttgttgacgttgggagccccagatttcgagcacaaag

SEQ ID NO: 14910 - DNA, 738 bp, Physcomitrella patens
  Predicted polypeptide sequence is orthologous to G261
cgtcaatcaatatgaacatatcctctcgaagtcttttaactaagtaacaagagctataatagctcaagataataattctaataccaaccaagtcccgacatcattttaaaggttaattaaccaggcgctagctgacccaattgatgagataggaattcaacacgaggcctaccgaaactactttgctgcgcattcttgccaccctgcgacacatcttctgtctcagactcaggctcacgctcaagatcgatttcggcacgggtgacaggttgtgggtcttctgttaggaattgctcccagaaaccagaattgtgcgctgcggaatccgtgcgtgcgctctgcacttcagcttcatgggatgccgtgcctctattacagtccggctcatgcaaatcattactatcacggtattcagagtgaggatgcctgctcctctctgcagatttatcgccggatgacgctctcatgatatcaaagttgagtggcgatatagatgtagcttcctgcgcttcattgacactcacgtcaatcacaacaggcgcactagagaaaatatcaggaagtttggtattaatttcctcgactgtgactctggattgtcgattcaaaatattgctatctccgctattaggagaagtgtctggctctcgcatgagggcttcaaaatgacggctatccatagcggagtgggagtcagaagagcaaaagatctcaataaccctggcacgtgctctagct

SEQ ID NO: 14911 - DNA, 770 bp, Physcomitrella patens
  Predicted polypeptide sequence is orthologous to G261
atgagtgatgagatagagatcgtcaatcaatatgaacatatcctctcgaagtcttttaactaagtaacaagagctataatagctcaagataataattctaataccaaccaagtcccgacatcattttaaaggttaattaaccaggcgctagctgacccaattgatgagataggaattcaacacgaggcctaccgaaactactttgctgcgcattcttgccaccctgcgacacatcttctgtctcagactcaggctcacgctcaagatcgatttcggcacgggtgacaggttgtgggtcttctgttaggaattgctcccagaaaccagaattgtgcgctgcggaatccgtgcgtgcgctctgcacttcagcttcatgggatgccgtgcctctattacagtccggctcatgcaaatcattactatcacggtattcagagtgaggatgcctgctcctctctgcagatttatcgccggctgcgacattgaaaagaacttggggttagataatagcaagagtaggatggtctcgtgtaaactgtagacatcatcacaagggacctgacaacctgacccacaatgaattgagcaagttgtcggtgcagggttcaggctgtttaaacaaaacaatgcaatcagggtgaaacgaaaaaatatagttggagggaagttaactcacatgacgctctcatgatatcaaagttgagtggcgatatagatgtagcttcctgcgcttcattgacactcacgtcaatcacaacaggcgcactaga

SEQ ID NO: 14912 - DNA, 767 bp, Physcomitrella patens
  misc_feature (717)..(717): n is a, c, g, or t
  Predicted polypeptide sequence is orthologous to G275, G837
aatgggacaacgtggaaatacagttgtaaaagacagaatctccatatgattttctagtctagttgctctaacctaaaccctacagtctgagaatacgtaacttcacaacttctgaatttgctgcacactaaggttgacacaattatgacgatgcttctggtctccaaaatctcttctggactgcaaggagctcttcattctccttgttgaaggtcaaggtcacatcccagtgaagtgacttaacaatctcagctaccttagccaaagtctcctttttgtcccggaaaatagcccaaccatccggccgcaaaatgcgatccatctccatgaccaggtttacgacgccacacctgctttcaactgagctgacgacgtgattcgcatggagaagatcataagtcctaggataagtgctgtgcggttcacaccaatcatggtacattccaatcagacctcggtcatatacgataggtagagtgtctggctcatcggaggggataacgttcagtacccacactggttggtcaatgagagcagcagcaaatcctccataaccggccctcatgtccatcacattcctgatagtggtccaatccatcccaagaccagtcaagtatgtcttattgacaacattattccagtgctcagtatccacacggaaatcttcaggggcggccttcccatatataccagtgtccttctcactcaaccatttangagcaacctcactcgcagaggccactcttcgggccattcagtgcgcttgg

SEQ ID NO: 14913 - DNA, 699 bp, Physcomitrella patens
  Predicted polypeptide sequence is orthologous to G275, G837
aagctgcagggatgcagcaacactaccttagttcgttctaatgtcctaaacaacccgccgtttacagagctgactgatttacaatacaagtcttgctgtgaagtgctaacacaagtccacacctggtcacccccgtcgttacaaactgacgcccagtagggtgaaagattgggaaggcatgataactatggattctctgctcaagtttcgattgggcctatatcaaaaactacgtctttctaaaaccttctacgatgactccttggggtctggtctccagaatttcttctgcacagcgaggagctcctcattttgctttgaaaatgacagtttcacatcccagtgaagtgacttgagaatctcctccacctcaactaggttggacttctcatcgcggaagatagcccaaccatcgggccgcaagatgcggtccatctccatcatcaaatgtactatgctacattcctttgccttaacagaggtaatcaggtgatctacatggaggagatcgtaagtcctggggtatgtgctgtgaggctcgcaccaattatggtacatgccaatgaatcctctgtcgtaaatgattggaagtgtatctggttcggttacgggcacaatgttcaacacccacaccttttccgctctaagtgcagcagcgaatcctccgtagccagccttcatgtccataacatttctaat

SEQ ID NO: 14914 - DNA, 679 bp, Physcomitrella patens
  Predicted polypeptide sequence is orthologous to G280
tagaacgtctacaactcgatgtgtgcaacaacaaatgtccactacactacgggtgtgagcaacaacaaatacagcaaaattgagctggaagagtcaatgcaccagtaaataaacatgcacacttcaccagcaaagagccactttaaaatgacaacctagctagtcaaaaggctgcatctaaaaagatatcaaatttgtcagctggacgatttcgcctttggtggacggcctctcttcttcggcgttggcgtcgtagcggcggcttcggcaaactgtgtttgagcctctaccgagtcatcttcaccctcagcttcagatttaaccttcggaggccgacctctacgctttggtgtagcaccagcctcctctactttggccttcttcgcaacttccacctcttctgcagcttcaggtttagccttcggtggcctacccctgcgtttcggggttagaggactagctagatcagcttcacctgcagccggcttgccacccttgcctcccgaggcaggagcctcttccgaagacttgctgactgattccttagaagcatctgtttttgccttcggaggtcggcctcttcgtttggcaggctcactatcctttccaccttcctctccatcgctagcgcgagagggagttttcagcttcggaggtctaccccgcttctttgctcctg

SEQ ID NO: 14915 - DNA, 803 bp, Physcomitrella patens
  Predicted polypeptide sequence is orthologous to G280
cagcaaagagccactttgaaatgacaacctaactagtcataagacaactaaatctaaaagtggaatttgtcagctagcagacttcgctttgggtggacgacctctcttcttcggcgtcggcgtagtagcggcggtttcggcgtctcctgagccatcctcagcttcagattcagctttggccttgggaggacgacctcggcgctttggtgtggcaccaccttcctccgtcttacccttcttcgcaacctccacctcttctgcagcttcaggcttagactttgggggcctacccctccgtttaggagtaataggactggatagatccttcttctcagaatcatcctcttcggaagccttgctaaccgattccttggaaccatcagtctttgtctttggaggccggcctcttcgtttgggttcactaggactttccttcccggtctcttctccttcactggcagcagaggaggttttcagctttggaggtctgccccgcttcttcgagccaggagccgcaggactttcggttgcaggggctcttcgctgggctgtcatttttgtttttcggaggtcgacccctgccacgtttaaggtgtttcggtgacgcctactttctcttcagttgcctcttcctcggttgcatcggcagcctcctccacattcccaccaccggcaataggttctgccacgctgtcatcatgtggtatctcctcttcaacagcttgtctcgtcctggcacctttcaactcgggtccagtatacttctgtacattggcaacgaatgctgacgaccttccgctaat

SEQ ID NO: 14916 - DNA, 698 bp, Physcomitrella patens
  Predicted polypeptide sequence is orthologous to G291
ggagcgaaagaagcaatagtgtaacaattaatcactaacatggcttaacttttaaagaagccattgctgaaacggagtttaacaccaatacacatttgttcacaagattatgcctctaccataggttccggtcccgaggagtctgtggctgaagtaggtgtttcagcagacgctgcagcagaagcagaggcacttgacgtcactacattgaacaaagtattcttgataacctgcgacataagcccgtgcagctgctccacagttatcttggaactgtcacgcgatatcttggcaagctgtgactcttcctcctttttcttttgcactggcatgaagaaccctcccatacgcccagaatgagctagctgactctctgcttgctccagtttctcggcaagatcggccacttgtcctgccacataatctcgattggcgagcaaaggtgaggatgaaagagtattgacccaatatttattccagaggaggtccaggaggtgcgaatccaatgacgacttaaaataggttatatcaagagaataatactgtttataatgaacaccaaaatcctcaattttgtttaaaggtatcgtttgatactcagatgggggttcatctggcggcttgtaaccctgaggataggtgcggaatgctccaatctcaacttttccagcagacacagtgcgtgttggatcaattac

SEQ ID NO: 14917 - DNA, 753 bp, Physcomitrella patens
  Predicted polypeptide sequence is orthologous to G307, G308, G309
tcttgatagtaatctgaggaactatcagtgaagtagcggtgatgtcgagtagagatatacaactgctttgaaagttgactgtttatcgaagaatccgttactgatgatcactatagtataaaaagcggaaaatgggttgaccagctctaagctctcaaaattatactgcaaacccaatttgcaactatgtgactgaatccccctgcaaagacagggctaaggcataatcagcacgagttcctcatgtcacagctgtacaagaaacaatgtgatgtcgactagtgccttccaatctttagagcctcctgctgcattgtactagtctgagacattccaagtcatcatcacacagcacgttgtttttcattggtgaccaagctagtccctgtgggaacgaagtccttgtcaggcttccacgccgaagcagtgagcaggggttgctccatccagcccagtgtgacggccccattttcctctgctagtgtgtacccatccgaatcaaacatgcgtaggagaataagtgcctgcgtgtaggcactgtcttcaagagggactttgacgaagcccgatcggctcataattgagcgccacctggaaatattctcgtgcctttccatcctatctgtgccctcacatgacagaatgttgcgaatctcacgcgcaaatagctgctccacttgtacacgagcgctactttctcttgaaatattagcttccagagaatcaaaaacagcagaatagtattgtagcgac

SEQ ID NO: 14918 - DNA, 678 bp, Physcomitrella patens
  misc_feature (676)..(676): n is a, c, g, or t
  Predicted polypeptide sequence is orthologous to G312
cttttttgcagtcagaatcaatgtgtacagatttcttgtttctcactttcaatctacaaaaaccggctgccgtttccatccaaaaatggaaacaatcggcacctaacatgtgccacctgtatagaagctttcatgataactgtacaaaactaatctcagctaatctgccaccccgcagctacagctcggatacagaaaatactccaaaactgcttttctccgcaatggaatttacaatggcaaagctgcagcctgtctctagtcgtttcattaagctacggtgtcagcaaagacagagattggaaagcccatcacaggatccttgtatttacatctcctaactgagaactaactagaacactgctgtacactacaaaagaaatcgccggtgtcatcctcactgaggcagacctcggatgtctgccttttactgtatgggcaaccactaaggatcaaaaaaaacaggcaacccgaaaattgtgaagaaaaataatcaagcaaagttccgaatcgggagaaacaaaaaaggaaaaaacgaacccaaaataaactcttgtgactagaaagaataacacacagccttgggaagaggacattcacataagggcagatgtcggaaagagtagaataactcaaaacgtggggtccaaaggaagatctctgaaaactgatgaanag

SEQ ID NO: 14919 - DNA, 710 bp, Physcomitrella patens
  misc_feature (20)..(20): n is a, c, g, or t
  Predicted polypeptide sequence is orthologous to G319
cccgaattgtacagctaagnctgtgctcgcagagattaaattgcaaccagccttatccaaatacaaagactactcgtcctcataattaagataccctaattaccacatcctttcagatgcaatgtgaaaatgataccgattataatgtgtcgctaccggaccatgaaaattacaatcatctacaaaagaagctaggaaagaaggttgaaaatgacatcagctggttttgcagcaggcttcttctctatatcacgtacaccaaatgatgcaaagtcgggggcaattgaatcaaatagatcaggagccgcatccggtaacatagcagaacctgtattgctgtgctcacgcaagaaggtctggtcctcgagacctgagaaatcgatggatgaactgggagctttaacagggagcacccgttctccaaacaaatcgaagttgagggacaaatgagggtcctgagcagctgtgccgaaaaggtccagtgcagatgtggtggaggtctccttgttcagatccatgaaatccgggatgcctcctagtgaggctttgttttttacagcgtttgtttgatttgcaggcagttgattaccgagaaatccataagcatcagaatcattcttagtagccttgctgccaaggtcgaaaaggtctggagctaactgtgtcaaacctgagcttctggcagtggattccttgccaacacttgaata

SEQ ID NO: 14920 - DNA, 716 bp, Physcomitrella patens
  Predicted polypeptide sequence is orthologous to G325
gtcgtcttattatctttcgcaaaatgacttgcagcaggacaatagtttatactgaattctggttgtcttcggattctcgagaggggaaaaggttacgaatctagcaatcagtaagaagcccgtcacagagagcatatctcacgcaggaataaattagctgattctgttttcaactagctgcagatcgtggacgctctcaagagttcaactatgaggaaatgccctcgaggtgatggaaactagcctttgacacaaccgagggtgaagaactcattggcaggaggaagaataatttcattgctaattcgaaaaaagaagcttcgcatgtaatcttgttctaacagtgtgaaaaacttcaacacttattgcatgatcgatcagaattgaagaaaacgccgcaagctgaagtaaatgtcttgtttgctgtacagtggctgtcagggtactgcgcgatcgactactgtctacttacactttcagcataattctgtctcattgtatgaggaatcacaacgacacgtattttttggtcttatctggagtaagtgaatctcaccaagcgtccacgattcttggtcgtagcaaagtctaggtgagaacggcaatagtaatgacgaacaaggtttatgtgcgagtacatgtcccacagctagtcactaatgggaaagcgatcccatatatttgtgtattgagctgccataaatgccggcagaatg

SEQ ID NO: 14921 - DNA, 722 bp, Physcomitrella patens
  Predicted polypeptide sequence is orthologous to G325, G1998
tgatgaccgggggtagggtttcgtataaccggtggaccggtccgcatcgcccctttgctttctaactcttattcctatctcttcaatcctctgcttcaccgtcgtcgctaattcatgctcttggagtagcagattgtcgtgttcggttagttggcgttgtgctgagctttgttgcagcaatcaaaatggctgcgtcgtgttctatatagcgtttttggcggtaatcgacgtgtgtagctgaagaagaagagtggtgtagcgtttgggttgcgttgtggtgaaagcggttgaacgtgctctctattgccgagtggcacttcacattcagttgcagatctgagatgtccattaatgacatttcgacttacctcgaaggaggtgagagctgcggcggtgtacgacaagaggatgcgagcaacttgctatggtgtgaccactgttccatagctttgtgcttcgactgtgacacgaacttacacaactcaaagaacctcaatcacggacaccttcgagtccttctgcctgcttcacagaccgagtcggttcgaaaatgtgagcatggttcaggtggaagtggcaacgtgcgtcttgatttgatcaacaaacctttgctcaccaagagcaagagcaagagcaagagcaggagtagttcatcgaagaataagagggagaggagctcctcaaccacctctaagcttgagtctggacgtaggtctcattca

SEQ ID NO: 14922 - DNA, 720 bp, Physcomitrella patens
  Predicted polypeptide sequence is orthologous to G328, G2436, G2443
aacgtttaaaatcggaggaatgtgctgctccatgtgaagacacaggaaacatgcgcggcatgtccaccttttctagcgttcgaaatcaacaaaaagaaataacactaccggaacctcctgctctgtcctgcctcctgcagtgtccatcagtaagcgatgccctaccaggggaaaagaatggcatgacttagcgtctccgactgtatctttttacattctgcgtcaggcgctttcaacacaaggatagctctacactgttcttacagcagtcttaaggcaactcctctatggtacataaaataggcattcgacgtgaaacactcaacttgattgaagcaaggttgatcatacagatattcagaaagaaggcaccactccaaaacttgagtccatagagcaagagctgaacaactgctccacatcggagtccgtcctcttcgcgaacctgcctttgatcctcggccggccctcggcgtaagctttcctggatgcataccggatggttttctcaaacttgcgtttctgcctcttctccttgtacctcatcactcgagcttcccgatccactgtgtcgatgggcccgctcacctgctgcggcatgcgggtgccagacaactcttgagcaccttgagaatccagtggatagggtgttgagatgtcacttagactggagtccgggaccacggcagcgtctacagacgagcacgaaatgctgtgggt

SEQ ID NO: 14923 - DNA, 579 bp, Physcomitrella patens
  misc_feature (119)..(119): n is a, c, g, or t
  misc_feature (257)..(257): n is a, c, g, or t
  misc_feature (288)..(288): n is a, c, g, or t
  misc_feature (348)..(348): n is a, c, g, or t
  misc_feature (355)..(355): n is a, c, g, or t
  misc_feature (422)..(422): n is a, c, g, or t
  misc_feature (460)..(460): n is a, c, g, or t
  misc_feature (548)..(548): n is a, c, g, or t
  misc_feature (556)..(556): n is a, c, g, or t
  Predicted polypeptide sequence is orthologous to G328, G2436, G2443
tctgctgtacataaattatacttccaagtatccaccacttccagagttcaggagagagcgagagagagagagagagagagagagagagaaaacagagaaaagagcactaccagcactcntgctctggtctgcttactgctgtgagtatgtaattgaagccctaagtggggaaaaaaattggtatgacttagtgcctctgactatattttttttgcattgggtgtcgaaaactttaattctacactatttttacaganggtccttcgtagtacatcaaataaaaattcnacgtgaagcattggaattgaccaagactgtgttgatcattcaaatattcaacaagaaganggaaccnccccaaaacctgaatctgcggtgcaactactaaacatctgctccacatcagagtccgttctcttggngaacctgcctttgattctcggccgactctcggcgtaanctttccttgaagcgtaccggatggtcttctcaaacttgcgcttctgcctcttctctttgtatctcatcactcgagcttcccgatccantgtgtcantgggcttgctcgcctgatgcggc

SEQ ID NO: 14924 - DNA, 732 bp, Physcomitrella patens
  misc_feature (708)..(708): n is a, c, g, or t
  Predicted polypeptide sequence is orthologous to G343
acctctttttcttgcatcaatttgatccaagaaaattacacaatgtttttttgtacattcaagtgaattacactttgaaactaacagtttgccactaaaaacataaacatttgctgatttattgcaaacatttttcccccaaccgttttgcaaataccaatctttaaaccaaaaatgccttaaataaatttactctcttaaactagttgttttcaattcatatagcgctacagtatggcaactgccatgaacagatttccaagtctgtggagtccaagactcttcaaacggcgctggaattcacatcagctgcagttgctacagcaatctcaagctttcattgtatccattcctcgcccaaactagctccgaatgaaactaacattcttgcagtgccacgcagaactcgttcacactcagttcacacaacaactccgtgaaagatctgctgacaacagttcgaagcccagtcccgagcagatctggtggttgaattattcctttatgcgaagaaatctttgaagcgtcacctggatctccttattgctcgtctttgaattcttgacgcgtgttttggcactgaatcggccatccgtgcaaacataatcgagggtgcggattcgaagatccagctcaagtaacaagttgagcaattggatcagggaagatattgttgttgctagcctccagtttgatgatcaacgttgnaatcatcgtcgtcttcatcaacta

SEQ ID NO: 14925 - DNA, 745 bp, Physcomitrella patens
  Predicted polypeptide sequence is orthologous to G347
ttggttgaaatgcacaaattgaacctcatagccctatatcctaaacccaccgctatgcatacaccagcatcctactactacccttgcaacagctcgctgagcttacacctctgggtaactccagacaccaaaatgaccccgctcgataagtcactacgacatccttgcgaagaggatccggaggccgccagtagttctgcaccacaatctacctgctctaaattcgccgctgccttcaatgtccttcccatcatcatcatcatcaccataacctccttattcaaagtggtttgagtcaccaccctgaacaccattcatcgtatgatcaggttcgccatcgattatctccccgccttgtgttgcttgcctgccctatcctacactttgtacctggtaccgatcacaagccaatcaccactgcaaacatgcaactaaacaatcgccagctagcatcgttacctccgatcagtggacacgcccacagccacattgctcaccagcttcccactctcgtccatcgtcatggggttctccaccaccacggtttgcgtgtgagacgatgtgagagcaggaggtggcccgccatgggcttgcggaggccttggctgctgcgatatcgatggcagctggacccgcatgctcggcatcgtgatggttgttacaaactggcacagtgcgcatttcacactctgtgcgccatatgcgtacatcagcgtcatcccgcacccgccacaattgatatgag

SEQ ID NO: 14926 - DNA, 757 bp, Physcomitrella patens
  misc_feature (756)..(756): n is a, c, g, or t
  Predicted polypeptide sequence is orthologous to G347
agttgggggcaattaacgtgaaacttcactgattcaaatgcacaaattgaacctcctacacacctacattctaaacccaccgctttgcatacaccagcaccctggtacaagcccgctcagcttacaatttcgagtatttctaggcagtaaaatgacgctgctcggtgtgtcactgcttcatccttgcgaagagtatctagatgccggtagtcatcctataccaacatctacctgcgtctaccaacatctcaaattcgccgttgcgttcagtgtccttcccgtttctaggattcctccgccctcattcaaagcgattcaagccaccgctccgaacaccttccttcaggttcgtcaccgatcaccaccaccctgtgctgctagcttgccttaccctacactttgtacctggttccgatcacaagccaatcaccactgcaaacatgagatcaaacaatcgccggctagcattgttacctccgatcagtggacacacccacagccatattgctcaccagcttcccgctctcgtccatcgtcatggggttctccaccaccactgtttgcgtgtgcgatgaggtgggtgcaggagcagggcccccggcggcctgcggaggtctaggctgttgcgatggcagcggcactcgcacgttgagcatcgtaatggatgtcacaaactggcacaacgcacatttcacactctgggcaccgtacgcgtacatcagcgtcataccgcacccttccacaattgatgtgcgnc

SEQ ID NO: 14927 - DNA, 591 bp, Physcomitrella patens
  misc_feature (556)..(556): n is a, c, g, or t
  Predicted polypeptide sequence is orthologous to G362
atctctgggcgcgtgaagggtcgctgcccctttgggtcgagcgcagacagcacggaggatgaagaacgcgagggaaattcagatgtggggcaggggtccagttgacatcaggcaatgtaattcagagattattgtagggattcctgaaccaatttgtatggaggatttgaagctatttgaatttgtttcattggttcttaatcgcccaagctagttgcggtgcaggcgccaggaggcatttagcggagtagaattgtgagtgtaagattacaaggtgccgaagcgaatcccgcaatggcgaaaccagcagtggaggcagccgaagacttaaagtcactgcactgggatttgcgatccaaggtgggagactgggaccccaagtacaaaaacgcagggccgtgtcgagtggcgggatgtggcgcccgcccaatgcagtcgccgcttacctctgatttgtcccttcggctgagcacttgggattcggagcttacggaagcatgcccccagctcgctggagagtgcggaggaacgtggattgcgtcgggcgcaacaggangccccgtcggtcgaggccccatcttcgccttggat

SEQ ID NO: 14928 - DNA, 689 bp, Physcomitrella patens
  misc_feature (12)..(12): n is a, c, g, or t
  misc_feature (16)..(16): n is a, c, g, or t
  Predicted polypeptide sequence is orthologous to G371
aaatgctttganttgntgtgtctggaattttaaatctccaaaagcctgagccaactcagtacccgcaccagtcgaattagcccaggctatgacccgtgtgtgtaaatcctctaggatttgaacgcgtctatcatacttaattccaacatcaaattgtggactcctaccagttgactggttcatcaattggacccagtgatgaacacaggctgcaacgaacctcctgacacaaagctcacaatcagaaactgcaggcggtgctgatctagtaacacaaaaattggtatcaaggtgagttacaagggcagaagcaaacggaacccagctgagatcatcttcaattctcgcatcatcttttaagtgttctgtgcggtgcggaggctcagaggagttgtgtcggttcacagaacagcagctcacacaatggaggtcttcacacactgcgcaacaggatcgtgatgataatggtacctcggaccaggaggagatacccagtagtatcatagaaaaaagcaagccgccaatctgaggaacccaaaagtttgcatctgaagaaatagaagctattggcagtgtccgaattactctccaccatccatcgtggtagctctgacgcttgctatcgttcttgctgtcttctaaatgcagtgattgaagctctcttccaaggctacacaatctcagtaacc

SEQ ID NO: 14929 - DNA, 745 bp, Physcomitrella patens
  misc_feature (702)..(702): n is a, c, g, or t
  misc_feature (728)..(728): n is a, c, g, or t
  Predicted polypeptide sequence is orthologous to G390, G391
gcgtttccttcctttgtattgtgaatcgcattgtgaacaaagttttcttgtgtcagtaaactcgcatgtttatgttcactttactgcctctaagatcacggctgggtgattatttacaagattactacattccggcggtgattccttaagccacagtgtgaatgtacagtttgttaccatctactctgcctaaaatttgaaccttattttcggtttgggattccgtcccgtaaaagtgcttcttcaacggagcaactcttttcgagcaaaccaatcttctccgacagtccccttctaaaccttcgttgcgagacacgtaaaaccagcggtgcactccgccctcccgaaaaatgaatgcttccaacagtcatgaccatgaagaaatttgcggagtgcactaatgtggtgaagagatggttctccagaattcgggaggaaaaattcagagctgggagtaagagtgagggcttgaaccgatctcagttctttctggtttcggcgcataagaattgtgcttcaaaatgcagtcaccttcagtgcctgtgatgatgggcagaaactcaaaggagcagcgctctggggacatcgtcaagggctggtgatgggtggctagcgactcaaacacttcctccgactcccaattcttcatcgtgggttggtagatatcacacaatgagttgtgggagtgtgagctccacgaanaatggcgtgtagtcgagtcagcttgncacacattatggctaga

SEQ ID NO: 14930 - DNA, 3591 bp, Physcomitrella patens
  Predicted polypeptide sequence is orthologous to G390, G391, G438
cagaaattgattacgggcttcaagagttcggggaagcttaagaggttgtccaagatttttgcaagggtctcaaagaatttcaggagttgacttgtgtccaacctgaggatttggaggttgaggaggctgcttgttatgaggacaggccgctgagacaggaaacatacgactgaacggtggttagaaagtccgtattaagtggaatatttgagatgtagggggtgatatgcttcgagctgtgcagtttctatgatgagcgaatctgctagttgatatgcggtactagaagaatcgagtcaaagagtgcttgctgctgaagaaacttgaagctgatgtttcattgcagatgagtttgctgatattacaactccactgcaacctctcgaacttcacatgacagaaacgtggaaggaccaaacgatggatgcgtcaggaaaatacgtgcgttacacccaggagcaagtggaagccttggagcgggtttaccatgagtgccccaagcctagctctatccgacgccatcagctgatcaaagagagccctattctggcaaatattgagcccaagcagattaaagtttggtttcaaaatcgacgatgccgggagaagcagcggaaagaagcaacaaggttggtcagtgttaacgcaaaactaacagctcttaacaagctcttgatggaagagaatgagcgtctagcgaaacatacctcgcagctcacgctggagaatcatgcccttcgtcagcagattcctaatctgcctttccccgatggaaggcatcgtctcccatcacagattttgcagagtcccctcaaaaaagaaggagcagtcaatggtggagatgagagctctactcaaggcggtatttgtgtaaaggtgcacgggcaggctggtatagcctccacagatactagctgcgattctgctgtcactggtggtctaccacatcgtctcactcctcagcattctcctcgcgattccagtcctgcgggattgttagctaccgctgaggagacgctgacagaattcctggctaaagccacaggaacggcggtggattggattcagttacctggtatgaagcctggtccggatgccattggcattattgctatatcccacggttgcgttggtatagctgctcgagcttgcggcctagtggccctcgatattagtaaggtaacagaagttctcaaagatcgtccacgttggttacaagactgtcgacgaatggagattctcggggctctccccacaggaaatggagggactatagagctgttgtacactcagatgtacgcaccgactactttggcacctgcacgggattactgtactttgagatacactacaattttggaagatggaaacgtggtgatatgtgagcggtcactaagtggtgttcagggtggacctacaatgccacccgtccaatcttttgttagaggagagatgtatccaagtggttacctgatccggccgtgtgatggcggcggttgtatcattcacgtcgtggatcattataataacgagcctcggagtgtaccggaggtattgcgtcctttgtatgaatcgccagctgttctctcgcaaaagtctactctggcggcattacggcatctaaggaggctagctgcagaagaaagcggcgagggagttccgcggaatggtcagcatccagcagtgctgcgcacactatgccagcgactaaccaagggcttcaacaatgcggtcaatggatttccagatgatggctgggaggctacgattagcgatggcctagatgacgtcagtgtgatgctcaatgcaactcccaaatctatggaggggcagattgcatcggataagctgctatactctttgggtggaggcatactttgcgcaaaagcttccatgttattacaaaatgtcccaccatcactgttaatcagattcttgagagagcacaggtcagaatgggcggactatgatatagatgcaaatgtggcctcttttcgtagcaatggcaacggctatgttcctagatgtggtggggtgtctcatgttcagttgcctctacctttggcctattctggagaatctggagagatattggaggttgtgaaagtggaaggccacagctcagtacaacatatggttctgtctcgagatactttcctgcttcagctatgtagcggagtcgatgagagtgcagttggggcttgtgcgcaattagtttttgctccggtggatgttgctctggctgatgacatccctcttcttccgccaggtttttgtgttagtcccatcgacacaaatgttgtggatggttttggtcttgatcgcacgcttgatctagcttctactctagagggtggaaatgatttacgctcaaatggtgatgcgaaatcaagtaatagccccggtcagatgcggtctgttttgacgattgcctttcaatttgcgtacgaggtgcacacccgtgaaactgttgcagctatggctcgtcaatatgtacgcaatgtagtggcatcagttcagcaggtagcgatggcgttagctccctctcgaggagcacctcctcctcgccaagtacctagtaatccagacgcgctttctttagtacgccatgttctgagcagttatagatttcacatgggtatagatctaataagaccagaaaatgggagtgatgaagctctgtttaaagctttctggcatcacacagatgccatcgtgtgctgtgcattgaagggaataccagagtttgtgtttgccaatcgatcaggccttgaaatgttcgaaactgcgacagctagctccctgaaagatttagattgggaaaagactctcaacgagaacgaccgcaagttatcatatgccacgtttactcatgttttgcaacagggttactgctctcttcctgcaggagtgcgcatgtccagcacaggtcgaactgcaacctacgagcaagccctggcatggaaagttctaaacgacagtgaggcagtcgagtgcattgccttcctctttatcaattggtccttggctacttgatccaggaactctcaactttatcttgtttagcaacttgttgctggacagcgaagtcgcttttctctatttttgttctgcatttgatgcgagagagtaggtacccatattccaggctggtgaggtgagcgtgttgtcaacgtcatgcaaactttattccagctgtttttattttttatttttatttttcaaatcgaatttagctgaagcagactgactggattcagggtggactggactcgcttttgctatttatgaagctttagagtttttggtgttgcgtactgtgctctcatggtcctatcggaagctttacatgttgggtttgccgttcacgtttgatgctagtatgggcaccatattggatcatcagcatgaactccagttttgtagttcaaatagactgctctgaacccagcaaattcgcgtctgacgaagattttggcatcagttcttgtaagtttagagtagaatgcaaatgatcctggcagctgtcagccgtaaattcctgtaaagcaatttatgtaactgcaagttttttatgactgaggaaatgct

SEQ ID NO: 14931 - DNA, 1481 bp, Physcomitrella patens
  Predicted polypeptide sequence is orthologous to G409
ctgtgagtgttgggtgcttgcgatgtcctttcttgcagtgagtggaggcgaactagtcgccagtgcactaggcatgaaatgatgtgctcgaggaatttagccatgtgacggatacaaccagatgcaggggataactacagagggacgtcgctagatcagttgtggagttgctaggattactggaattgtaatggcagctttggggagagctggagaaacgatgtcgatgacggcagtttctagttcgggaggaggtctggaagaggaagctacagggcgtgggcagaagcggccccaccatcccatatccgacaaagggcctggggaggagcctgaggaaggtgacgattgttgctacgacggcgcccacccaatggagaagaagcggcacctctcgttcgagcaggtgcggtccctagagcgcaacttcgaaatggaaatcaagctcgagcccgacaggaaaatgaaactggccaaggagcttggactgcaaccccgccaaatcgcggtctggttccagaacagacgtgcacgctggaaaacgaaacagctggagcgcgacttcgaactgctcaactctgggtacagcaaactgaagcgggacttcgagaaggtgctcgaggagaaagatgtcctcaaggccgagctcgtgcgtctctcagccaagattatccccaaagattcccaatccgtagacttttcccagagcgagaaggactcgcattgcaagccaacggcaaatgacccagcgaaatcagacaagctgaaggaatccaagcctgcgactcccaaggataaccaaagcactagatcctctcccaccacagtcgtatgctctgccactacgcttgaggcagagataacctcaacaagctctggcagcaactccagcgatctgctcgacgcggacagcccccgcactacggacagcaacccccgcgaggagcagctggcaaattactgcggccaactccttccagagaactttgtgggacaccttacagttgaggaggctgtgaacacttcgcagaaagtttattcggtgaagcttgaagatggtttgccatcacttccaagttagacgcgactagtggctattttttgccgcccatggctgagccaaagtattcttccttggtgggattggccgtaaccggggcattcaaattgtgcctttgcggcatttttttcccttagatcttggttagtttaattttttagttctctctctctctggccctatgtgaggatcaggctggttatgttcaatcgattctcgttaccgaatacctcgaggaccacacaccagtagcatctaactgcaagtgcatgtccagtttgctccaacgacttgtgtgatatatttagttcagatagagttggtagagcttcaaaggtagtgacgagcatccatgattttttaggactgataagctgaggtcttgctcatccttctcattttttagcactttgtaaaggcg

SEQ ID NO: 14932 - DNA, 1802 bp, Physcomitrella patens
  Predicted polypeptide sequence is orthologous to G409
ccagagaatccagctgaactgaaggcttctagactcgaaagaccagtccattgttgttggctcatccctctctgctctccctagccgttcaatgcgtgcattcacattgcacacgaacgaacaacaaacaacaacatcaacaagtagctctgagtcactgtgtttgatcaccgtttcagggtgagaatctggagaccggaatgaaagcaccctctctcgggtgaacagagcgatcagggatggcaattacaagcatgggagggtacccttgccagagcgcaatgcagcagctcatacgcaacgagagcagctcggattcgttggctgcaattctcactccctgctcccctcatgtgggcctacaagcgccgccacatgtaggaggatcgctagaagacgctgttcttgtagcgtcggagggaagcagacagaagcgtcctttctttgccacatacgatgccccgacggttgaggatggctcagttgaggacgatgaaggtgccgatgactctcaaggcgcttcacagctcgagaagaagcggaggctgactttcgaccaggtgaggtcgctggagaggaatttcgagatggagaacaagctcgagcctgaacggaaaatgcagctggccaaagagctcgggttacggcctcgtcaagtggcggtgtggttccaaaacaggcgagcgaggtggaagacgaaacaactggagcgagattacgaggcactagccgcggattacaagagcctcaagcatgactacgacctcgtgctggcagagaaaaacaatttgaaagctgaggtgcaacgtctatccggcaaggcgccaacctctccttgtgctgatggcaatcaaatcgtcgcgggtgaatctgcacaaaccccggaagtagacgttgagacttcggagcttgttgcaaggcagcacacctccaggtcaactccaaccgtggacgtttccctggcgtgcgtgaaggacaaagacttcgaaaccagtggttgcacggacgggaactccagtgacgtgctggacgccgacagtccccgaaccaccgatagtagcagcctctcggcgatgtcggaccatgatcagctgatatacagccatgaaatcccaccacccgagagcttcatgggcctttctggcatgctacacgacgtcaccgtgaagctggaggaagggagcggccacgggttccacgacgacaattcttctaattattttcttctccatctggaggatcaagccggcgtgcttccgtggtgggattggccttaaagcattcacggttttctgtacatagatccacgtctgggctgaacgatttcacctcaattttccaagaggagttcaagtatgtatcatgacttacgtttgccgtcaccaacacttcgcgggagcttcatcccgccgacttattgttagccgtttatgtacatttgcagagtggattttgtgtcacgtagtttgaacttgcaggagtcattggatcatcgggtactttgttactagatttcaagagtttagcacacagtggcagcgtcggattagccttagcatctgttccaaagaggtccgattggtctaaccaatcgaccgcgactcacagcgtcaggcatgatgcatttcagccatcaccatcctggaatacttcagcatcgtcaacatcggacatgtaatcacatctccgatcacatgatgcatgttcttttggtagattggctcatgttgatgtatctatcaaaggcccgcgctgcgctctttgcagcaattttccctccgaaataaaaaccattggaattc

SEQ ID NO: 14933 - DNA, 1593 bp, Physcomitrella patens
  Predicted polypeptide sequence is orthologous to G409
cacaggttcaatgcgggaacttcctagcgcggcaatgttggggcagcccaggctattccggtataattcttaggcagcaaccagacttatcagaggtgcagggggtgttcaatcccagcactgcgaggcttgacatggcgagtaacgtcggcagaaggggttacagtcgcggtgggtccaatgtcgtgcctgtgcgcaacgacagctccaccgacaccttagttgccatgcttgcttcctgctctcctgttgctcttcaagtacaacgtactggtggaagcttggaggatgcagtggtaagctgtgggcagaagcgctccttcttccccttgtttgaagcctcgagggaagatgccggagacgaggatctgggagatgactgcacccacaatgtggagaagaagaggaggctcactttcgatcaggtcaggtcgctggagctcaactttgaggtggagaacaagcttgagcctgagcggaaaatgcagcttgccaaggagcttggtctgcagccgaggcaagtggcagtgtggttccagaaccgtcgcgcgcgatggaagacaaagcagctcgagcgtgattatgaggtccttactttggattacaaccggcttaagagcgaatttgaggctgtgttgcaggagaagcaagagcttcagggcgagatggagtgtctgacggggaggttgcagacgtcaccccaacttgcctcaggcgatggtgtgtcagaaaaaccttctaagaaatcatcgaaagctgtggcgtctcaactttcgctccaaaagatggtatccgaagagtgtgtcgaagttagagagtaagcctcaggacccaaacgacagtagcaacgatgacaaggaggaaggctcccgagccacaagctcagatagcatttctagtgggattctggacgcggacagtcctctcaccacagaaatgatcactacccaccactttgccacatatttcaatccacgtcgccgcagagatgcccctgagctcccaatatcatcaacatgagcgacaatctctgcaaccaaatgctgtccccccatgcttgccagcagatttctgtgaagcttgaggacggctcgtctcaggacgaatcttctagtaattacatcctgacgcagttggacgaggaaaggggtttgccctggtggggattggccttgactggatcgtgcggcggaactcgaaaacgccttccgtgagattcgtctattccttttgaaatccagttgttattttccaggcactaccatcgccagcacaaccgatttgttcgatctgggtgcatggtggtccagatgcagcgctgaaagccttgatctgttatcgctaccagattactcagcattcgtcctgtgagcctaagtgttatatatcatatcttagagaaaccaggttctgctgttgtaagtcatttccatgatgctagactaggagtccgaaatgatgcaacatcagatcaaataaattttttgctcctgaaagacaacactaatgtgccagatcatctgatgtagaacttactgaaataacaaatgggacggatctgcagtgtcagaactgtgtccaagcctgtaactt

SEQ ID NO: 14934 - DNA, 1324 bp, Physcomitrella patens
  Predicted polypeptide sequence is orthologous to G409
catgcatgtgcgaaacgatagctcgggcagcagcttggttgccatgcttgcctcttgttctcctgctgctgcggttcaagctcaacctggaggtggaggcatggaggatactgttagttgcggtcaaaagcgaccttactattctactatcgaagcgtcaggtgaagatcctggtgaagaagatgttggggatgattgcattcaacaatctaagaagagaagacttaccttcgatcaagtcaggtcacacgagaaaaacttcgagattgagaataaactcgagccagaaagaaaaatgcagcttgctaatgagcttggacttcagcccaggcaagtggcagtgtggtttcaaaatcgtcgcgcacgctggaaaacaaagcagttagagagggattacgaggtccttaccttggattacaaccggctcaaaagcgaatttgaagctgtgctgcaggaaaagcaagagctacaggacgagatggagtgtttgacggaaaagatacaaaccgcaataccgaattctgcggatccaatattggagaaaagaaaaagaatcatatcaatgtctcagccttcttcgctgaagacattcgaaggtcctgtgaaatcggaaaggatagccgccgaagctaatggcaggaacgatgccctgacaccgtgcaaggaggagggttccaaggaggagggttccaaggagacaagctccgatagcatttcccaggtgaaatacttaacgcggacagccttcgtactatggatagcggctcgcttctcccattgcccgatagtatgagcacattttcacatgtttgtacagagatggtagactccaacatcatacacatgagcgaccaactctgcgaccaaatgctttctcctcaagcttgccaactcgtttcggtgaaaattgaggatggctcatatcaagacgactcttgtaattacatattgacactaatggattcaattgaggaaaagggtttaccgtggtgggactttccatgatcagtgctctgcacaagcatcggagggagatttttttttttttttaaccaattcgacccttcaagcgtcatgaagtcgcatccacttccattgtagcgatgtaaagagttaagatgcgccgctctcgctgtcgcaactacaggacgcacttctctctcttcgagcatcgtgtacttccgtatttaagtcggaccttccgaatcagcggccgtcgaggagcgccaatcgcaagagcacttcttttcttgtaacttgcacatatttattatggaaattgaaataataaagtgttgctgttgcaactcatttcgagggcggt

SEQ ID NO: 14935 - DNA, 690 bp, Physcomitrella patens
  misc_feature (10)..(10): n is a, c, g, or t
  misc_feature (15)..(15): n is a, c, g, or t
  misc_feature (58)..(58): n is a, c, g, or t
  misc_feature (107)..(107): n is a, c, g, or t
  misc_feature (123)..(123): n is a, c, g, or t
  misc_feature (143)..(143): n is a, c, g, or t
  misc_feature (184)..(184): n is a, c, g, or t
  misc_feature (192)..(192): n is a, c, g, or t
  misc_feature (197)..(197): n is a, c, g, or t
  misc_feature (227)..(227): n is a, c, g, or t
  misc_feature (269)..(269): n is a, c, g, or t
  misc_feature (301)..(301): n is a, c, g, or t
  misc_feature (303)..(303): n is a, c, g, or t
  misc_feature (319)..(319): n is a, c, g, or t
  misc_feature (333)..(333): n is a, c, g, or t
  misc_feature (335)..(335): n is a, c, g, or t
  misc_feature (399)..(399): n is a, c, g, or t
  misc_feature (454)..(454): n is a, c, g, or t
  misc_feature (456)..(456): n is a, c, g, or t
  misc_feature (497)..(497): n is a, c, g, or t
  misc_feature (508)..(508): n is a, c, g, or t
  misc_feature (681)..(681): n is a, c, g, or t
  Predicted polypeptide sequence is orthologous to G427
tgatgatccngcttnagtatcttgacatgtgtacataatcggtgttgaaaccagaaanatgaacataaacgtacataagcaggaaaaagagaaatctaatctattcnctgaacggacatttcnaccggcctctgaaatcgtanaggacctgtatacacagtgaaaccgaccatgtgaagcgaangctctacnaatanctgctgtcatttacccctagatggtttccnactaccatctggagtggatcgctgagattttttattcgaggntgatggagcatttacgtcgatatccataggtncnacctttgggactgaanattccttgtttacnangcctgaagatgagaggaatttcctaagtggtgcttccttgctctccttgataacaaattcgtcnatggtagcaacgctctcaaatatttcaccattgtcaggggtgttgttggagaagnanagatggttaatgcgtcgcaagtagtcccgctcatacttccngtacttggcancatacgcggcggcctccacagcgtcggagctggccatcatcgtactcgcttggggctccagttccagtgctgctctgatcaaccaaccccccgctctggcgatggcggcctctctctctctctcactcggcctcgttcttcttctccttcttctccttcttcttcttcgccgncgctcttag

SEQ ID NO: 14936 - DNA, 730 bp, Physcomitrella patens
  misc_feature (30)..(30): n is a, c, g, or t
  misc_feature (43)..(43): n is a, c, g, or t
  Predicted polypeptide sequence is orthologous to G447
cctgaggaaccccttacaatgcatggagtntactagcaccagngggtgcacaccagttcgtcttccatctcttgaaggctctatagatactcgtaatacttctgccgctgtatacaacctacatttatcataaacgttcccattacggcctgtagcaatgcaatgctgtacacggatcaggcttttgcagtcaaaactctcctactacataggagaaaagcctttcgtccctagccgccagttctgaattggagggctgcagtcaaaatctcacaaaaacaaaaagggacaatatgaacactcagtgccacatccaaaatgagagacaccttctagccactgctctgaactgcagaaagccaatcatcgtcctcgtcacagttgttcatggggagttttcctacgttctgtcccgcagcatcttgtggagacaggatcttcaagctccgcacacaattgcagaactcctcccaaggatcatcccccaccaggaggacgttattttcgtggtcagtgtaaacaagctgccaacccttcgtaacatcatccagttgaccttcaaggccaaaaagggtcgccagcatgcgtctgagagcggcgtaactgtcacactttttgagatcaacggtacgaccgaatttcccataatagttcactttggttccgctcctcactggaacggtgggcggctggtatgctccgtttgcaagcttgctcacgtgggtatcga

SEQ ID NO: 14937 - DNA, 749 bp, Physcomitrella patens
  Predicted polypeptide sequence is orthologous to G447
tgtctttcgctcttgtgaactgagagctctatagataaccgtaaatctcgtccgccgctgtatacaatcctacgtctttcatcattgtcccatcaccgcctgttctaggttctgtacaaagaagaggctccgtaagtccaaaactctcctgaagaggagaaaacgccttcgtccatagccatcaactgtaattcaggggggtgcagtcaaaatttcaaaaaaggaaaaataaaaaggacagcagtattaacagttgtgccgcggtcacttaagcggacctccattagctgctactgtcgtccatcatcattctcgcagctgctagtgggaaacttccccacactctgcccagcaacatcttgtggagataaaatcttcaaactccgtacacatccgcagaactcctcccagggatcgtctccgacgagaagaacatcgttctcgtggtctgtgtacaccaattgccagcccttggtaacatcatccagctgcccttggaggttgaagagatttgccaacactcgcctcagaccagtgtaactttcacactttttaagatcgatagtgcgaccgactttccctggttgatataccttaatgccacttctcatcggagtaacatgcgcctgggtcgcctggcaactttcagctgtgagcttgtttccaagatggcctccagacgtaagatcggttctaagtaattcaactgttacttcagagacctcaccatgagatggcgctaacgtcac

SEQ ID NO: 14938 - DNA, 2594 bp, Physcomitrella patens
  Predicted polypeptide sequence is orthologous to G450, G456
gagggtttgaggtgcagaagaagagccccccgccatagccactacaaagcatacgctgcaactccacagttaagcttagcttgcgagttaccgagtgtcgagagtacagctacttttgcctctggagttccacaccacaggagagcgcagaatcagttccctggtctcgcgacgagggtcgctgtacagtcgcttactgtgaggtttcgaaaaacggaacaggatactggaagcgttttggctggggaaggagtgggaatacggttgtcgcgaaggggtggctcaaaggctgactgactgcaagtgctttttgaaactaagctgccacaagtcgtggcgcggttaagtgcagataggtggtgcgaggtcgtggaaggtggtggtccagttcacagcggagcttgactcggcgactgaggggaggagacggagacggttcgaaagagttggaaacgagggcgttccattgcctttgacctagtcgtaaacgtggctggaagttgtaggatgagctggaagccgcatggtccacgtcaacgtcaagttctggacgaacatgcctgcagcttagggaagagataatgaagtttagcaacgaagttgtccacaagtctatgaacatcaccgaagattgcagcgccctgaccggtgcgctgctgaagtactcaaccgataagtcaaacatgaacttcgagaccctttacagggatgcagctgtagagtcccctcaacatgaagtcagtaacgagagtggcagcactttgaaagagcatgactacttcggtctctctgaggtatcgtcctctaacagcagcagtggcaagcagccggagaagtgttgcagagaagagctgaacctgaacgaaagtgccactacgctgcaactcggccctcctgcggcagtgaagccgtctggtcatgcggatggggccgatgcacacgacgagggtgcgggtccagagaaccccgcgaagagacccgcacaccacatgcaacaagagtctcttgcagacgggaggaaggctgccgcagaaatggggtctttcaagatccaacgcaagaacattttggaggagttccgggccatgaaggcgcaagctcacatgacgaagtctccaaagcctgtccacaccatgcagcacaacatgcatgcatccttctctggtgcacagatggcgttcggtggggctaagaacaatggtgtgaagcgagtcttctctgaagctgtcggaggaaatcacattgcagcgagtggtgtgggcgtgggagttcgggaagggaatgacgatgtgagccgttgtgaggagatgaatggaacagagcagctggatttgaaggtgcacttgccgaaaggcatggggatggcgcggatggcaccagtatccggtggtcagaatgggtcagcttggcgtaatctgagctttgacaacatgcaaggtcctctgaatccgtttttccgcaaaagtctagtgagcaagatgcctgttccggatggtggtgattcatcggcgaatgccagcaacgactgtgcaaatcgcaaggggatggttgcatctccctccgttcagccacctcctgcgcagaaccagactgtgggttggccacccgtgaagaacttcaacaagatgaacacgcctgctcctccggcttcgacccctgctagagcttgtccgtcggtgcagaggaagggcgcttcgacgtcgtcgagcgggaaccttgtgaagatctacatggatggtgtgccgttcggtcgcaaggttgacttgaagacgaacgacagctacgacaagctgtattcgatgctggaggatatgtttcagcagtacatcagcgggcagtattgtggaggtcggagctcaagcagcggggagagtcattgggtagcgtcgagcaggaagctgaactttctggaggggtcggagtacgtgttgatatacgaggatcacgagggagactcgatgctggtcggagacgtgccttgggagttgttcgtgaatgctgtgaagagactgcggatcatgaagggttcggagcaggtcaacttagctccgaagaatgcagatccgacgaaagtgcaagtggcggtggggtgaggagattgcaatggcgggatgtgcgagcgtggagggaagggggttgggtgtgcgcgtgcgcacgtgatgtggggttgcagtggtggctgttgcacccggtggagcaagagaaagtgaaggcgggtgcatcatttttcattgatcggcagtcgtggaggaaggcgaagggggcacagtggcgatggatgtcagtgtggagcgttacataaagtcggtggcgggaggcggccgttttttttaaagaaactttatttatctttattttttttatttttttggaatttgcaatgggaaagaaattggagttagaatattttctcgattcgcgtatgtggcgggttcggggtaggatgggggacatactggggggcggtagtgtggaggcggaggaggaggatggaagtgtagatcccgagtgcatgggtggaacggtgtgcagtgcgggacgtgctgtattttgtagtttcctgttgtgaatgttatttatttaagcctctccgc

SEQ ID NO: 14939 - DNA, 2174 bp, Physcomitrella patens
  Predicted polypeptide sequence is orthologous to G450, G456
agcctactccgccgcagccgctgccaagctttgtcctcctcctccctccgccatagtcgcactcttgtcgctgttgttccgcttgctcccaagtgagtcgcctcgcagagacgagttggaagctagactgccaatgtctacaaagttttatgatgggatatgtgtgcggttaaaaacaaaaacaatgaacttttagcagtgaagttggacattattcaatgaacgtcagcgaaggttgtagcaccctaactggtgcgcagctgaagtactcaaccgacaagtcaaacatgagctacgagaccgtttacagggatgcagctgtggagtcccctcaacgcgaggtcagtaacgaaagtggcagcactttgaaagagcatgactacttcggtctctctgaggtattgtcctctaacagcagcagtggcaagcagccggagaagtgttgcagagaagagctgaacctgaacgaaagtgccactacgctgcaactcggccctcctgcggcagtgaagccgtctggtcaggcggatggggacgatgcacacgacgagggtgcgggtccggagaaccctgcaaagaggtccgcatatcacatgcaacaagagtctcttgcagacgggaggaaggctgccgcagaaatggggtctttcaagatccaacgcaagaacattttggaggagttccgggccatgaaggcgcacgctcacatgacgaagtctccaaagactgtccaaaccatgcagcacaacatgcatgtatcctactctggtgcacagatggcattcggtggggctaagaacaatggtgtgaagcgagtcttctctgaagccgtcgtggcgaatcacaacgcagcgagtggtgtgggcgtgggagttcgggaagggaatgacgatgtgagccgttgtgaggagatgaatggaacagagcagctggatttgaaggtgcacttgccgaaaggcatggggatggcgcggatggcacccgcatccgggagtccgagcttcgacaacatgcaaggtcctctgaatccgtttttccgcaaaagtctagtgagcaagatgcctgttccggatggtggtgattcatcggcgaatgccagcaacgactgtgcaaatcgcaaggggatggttgcatctccctccgttcagccacctcctgcgcagaaccagactgtgggttggccacccgtgaagaacttcaacaagatgaacacgcctgctcctccggcttcgacccctgctagagcttgtccgtcggtgcagaggaagggcgcttcgacgtcgtcgagcgggaaccttgtgaagatctacatggatggtgtgccgttcggtcgcaaggttgacttgaagacgaacgacagctacgacaagctgtattcgatgctggaggatatgtttcagcagtacatcagcgggcagtattgtggaggtcggagctcaagcagcggggagagtcattgggtagcgtcgagcaggaagctgaactttctggaggggtcggagtacgtgttgatatacgaggatcacgagggagactcgatgctggtcggagacgtgccttgggagttgttcgtgaatgctgtgaagagactgcggatcatgaagggttcggagcaggtcaacttagctccgaagaatgcagatccgacgaaagtgcaagtggcggtggggtgaggagattgcaatggcgggatgtgcgagcgtggagggaagggggttgggtgtgcgcgtgcgcacgtgatgtggggttgcagtggtggctgttgcacccggtggagcaagagaaagtgaaggcgggtgcatcatttttcattgatcggcagtcgtggaggaaggcgaagggggcacagtggcgatggatgtcagtgtggagcgttacataaagtcggtggcgggaggcggccgttttttttaaagaaactttatttatctttattttttttatttttttggaatttgcaatgggaaagaaattggagttagaatattttctcgattcgcgtatgtggcgggttcggggtaggatgggggacatactggggggcggtagtgtggaggcggaggaggaggatggaagtgtagatcccgagtgcatgggtggaacggtgtgcagtgcgggacgtgctgtattttgtagtttcctgttgtgaatgttatttatttaagcctctccgc

SEQ ID NO: 14940 - DNA, 789 bp, Physcomitrella patens
  misc_feature (713)..(713): n is a, c, g, or t
  Predicted polypeptide sequence is orthologous to G489, G714
aagtctaaagaagaaaaaacaggacgatgagaaaattaccaatgctaggataatggatacttacgccttcaacctgaacttaaatgaaattctgcaattgctaatacttggccggcgggcagtaatctatagattcacaaagtttgcgtgatattccctgcgctagttacggtgcttaaataaataccttcatagctacaatgagtagaactgagaatcatttatgtcgatgtttacagttaagatgtgcagctactcaaatataatttaatgctaaacccaaaagtgtcgatatgacaagaatacacctgcatgttgcgactcctccttccttgtagtgacaattaataataccattacgatgagtaccgctgcatgtgacgttagccacttggttcaagagccctgtatctcagagctcagaagttcttgcattctcctgaggttactgcatctgctgctgctgttgctgctgctgctccggcgcgaaagcagccggtggtggctgatacatcatttgtgggtttggtggcatgcctggctggccgaccatcatctcaggggctcccataggatgatgcattggctgcccgggcatgggagggtagtacattcctccatattgcaccccctcagctggaatccctggaactccagaccatggaacacccaagtcttcttcctttaactcgtcacgtggaacaatgtctacnaggaagtcaaaaatgtcgcctctagtgatagcgccagcaatatcatttctttgaagtgttcgtcttttattctctt

SEQ ID NO: 14941 - DNA, 779 bp, Physcomitrella patens
  Predicted polypeptide sequence is orthologous to G536
atgatgccaccattcgttggctattcgcaaaggcggaaacttttaagattgtacatcactagttaatgtgttcatcacatcatttcaggaagatgcgtcatccaccagacaaataaacaactcgcttgcttacaaagataccggcactataagagcaattggaaaagcacaagcaccaacctgtaaattaaccacaacagaagtgcttcgcaaagcagcggcttctccacggacttgccagaaaagtcccacaatgtcctgatccggcaatagaaaagtctctggtattgcaccactactcgcaccgagcgggaaaatcatccactaaccatgacctctctgctgtgcaaagataaatatagcttaagttccacttcagtgctcagcatcatcaactttggcatccttgacctcggggccgacctcatcctgcatatcagaggtccacaacgtcaggttgtcgcggaggagctgcataataagagtgctatccttgtaagactcctctccaagagtatcaagctcagcgatcgcttcatcaaatgcctgcttcgcaagagtgcacgcccgatctggtgagttaagaatctcgtaataaaacacagagaagttcaatgccaaacccagtctggatgggggtgggtaggagccaactctgtcaacgcaatatcttgagcagacttatacgccaacaatgtcgcttcagcagcttccttcctctcggccccggtcttaaactcagccaagtacctgtgataatcacccttcatcttcaagta

SEQ ID NO: 14942 - DNA, 733 bp, Physcomitrella patens
  Predicted polypeptide sequence is orthologous to G536
acaggtaatcccccaacaggctgcattcacagtgaaataggtcaaaagtaactacggtccaccaagccgtaaagatggtgaatcaaattaagtctatattgtgcgtgatgaagagatgcgagaatcaagtgcttgtttagattccaaaagacccggatgtaacaagcttaagtagcaacatatcaagagagccattaccattaaatgacactgctacatcgtcgtagatctggtcagataccagaaccggcgagaagcatgcaacacaagaaaacctggagatgtaatggttatgccgatagggtttcatttaaaacaatctacataacccagtgctaattgttctgggaagtcgagcacatatccgtaccagcctcaacttagtcgcctggacatgagtttctattctaagttctagtggtcatcagcatcttcgaccttggaatcctttccttcttcaccaatgtcgtcctgcatatctgaagtccataaggtaaggttatcccggagcagctgcataatgagagtactgtctttgtaggattcctctcctaaggtatctaactcagagatagcttcatcaaaagcctgcttggcaagatggcatgctcggtctggagaaaccaaaatttcgtagtaaaagacagaaaaattcaaagccaatcccaatctgataggatgtgtggacgccaactctgtcgttgaaatgtcttgtgcatgcttgtacgcgtgc

SEQ ID NO: 14943 - DNA, 787 bp, Physcomitrella patens
  Predicted polypeptide sequence is orthologous to G536
agtcgcctgcttagagagatacccgcactaatggaggaaccgggaaagcacaagcaccatccggccgagaaactaagaaaaacaaaagagctttacagcgcagcgactcacgatcttgccagaaacaaggtcaacagaataccaatctggtgataggcagggctcagatatttcatgactagtcaacattgagtgggaaattacccactcaccattacccctctacaatgttaataactgataacttaaccagtaatttagtgttcggcttcttcaatcttggcgtccttgtcatccgcgcccacctcatcctgcatgtcagaagtccacaacgtaaggttgtcacgaagaagctgcatgattagtgtgctatccttgtaagattcttcaccaagggtatcgagttcagcaatagcttcatcaaaagcctgtttcgcgagagcgcatgcccgatcgggggagttgagaatctcgtaatagaatacagagaaattcaaagccagtccaagtctgatcgggtgagtgggagccaactccgtcaaggcaatatcttgagcggacttgtaggccaacaatgtggcctcagcagcttccttcctctcggctccagtcttaaactcagccaggtacctgtggtaatcacccttcatcttgaggtagaaaaccttagactcccctgtgctagaagtggggatcaagtgggaatccagaagcttgagaatactgtcgcaaatggcactcaactcagactccaccttggcgcgatacgtcttgatggcggcaacgt

SEQ ID NO: 14944 - DNA, 746 bp, Physcomitrella patens
  Predicted polypeptide sequence is orthologous to G536
tatgtgaatcatttcttcgctttcagagaaagcaggtaattggagattgtacatcgacagataatgtgttcatcacattattccatgaagatgcttcattaaccagataaataaactcgctactaagataactgcactagaggaccaaccggaaagtacaagcaccaaccggacaagaaactaaccaaaacagacgagctactttctcacgatcttgccagaaataaggtccagtgcaaaccaatcttgtggtagacagggctcaagtattgcactactaatcgacagtatgtggaagattatccactcaccgtcacccctccacaaataaaagcaacttgaaacttagcatgcgtttcagtcctcggcttcaacaactttctccttgtcatccgctccaacctcatcctgcatgtcagaagtccacaaagtgaggttatcacggagaagctgcataattagagtgctgtccttgtatgactcttcaccaagagtgtctagttcggcgatagcttcatcgaaagcctgcttggcaagagtgcacgcccgatcgggggagctgagaatctcgtaatagaacacagagaaattcaaagccaaacccaatcggatgggggtgagtgggtgctaactctgtcaacgcgatatcttgggcggacttgtaggctaacaatgtggcctcagcagcttccttcctctcggctccagtcttgaactcagccaagtacctgtgataatctcccttc

SEQ ID NO: 14945 - DNA, 673 bp, Physcomitrella patens
  Predicted polypeptide sequence is orthologous to G536
actcgcctgtttaatagatatctgcgctaaaaggatcaatcaaaatagcacaagcgccactgagcaagaaactaaccaaaacaggaagcacccatcctcccccggtcttgccaaaaacacattccatggtgtaccaatcaggcgatagacagggctcatgtattgcatcactaatcaacacaaaagaatgtcatgcgttgactgtcaccactctacagagcaaagtcagggttgtagcttggtctgcacttcaattctcaacatcatctactttggtgtccttatcttccgcaccaacctcgtcctgcatgtcagaagtccacaacgtaaggttgtcacggagaagctgcatgatgagagtgctatccttgtaagactcttctccaagtgtgtcaagctcagcaattgcttcatcaaaggcctgcttcgcaagagtgcatgcccgatctggggagttaagaatttcgtagtaaaaaacagaaaagttcaaagctaaccccaatctgatgggatgggttggagccaactccgtcaacgcgatatcctgagcggacttatacgccaacaatgtagcctcggcagcttccttcctctcggctccggtcttaaattcagccaaatacctgtgataatcacccttcatcttcaagtagaaaaccttagactccccaga

SEQ ID NO: 14946 - DNA, 791 bp, Physcomitrella patens
  misc_feature (755)..(755): n is a, c, g, or t
  Predicted polypeptide sequence is orthologous to G549
acttttcttacaaaagacaaaagaagtggaatcccacagagcagcactaaaacctacgaagctttaaaaccttatgctacatcgtttaacctacagcacccatgatacatatacaatgaaatgctaacagctcgtccaaggtattgggccatccacttcaagatctttggaacgggagaacgcactgtcgcgagatgcatcaccgtacaaacgaaccagacttctcctttttcgcaaaattatcagaagtctccattatcgactcacttgcattgaccatgtcgagatcatcgcccacgtcttgacaaagcttccgcttcttggaccaaatcgccgccttgaatcctcttctctcccccctcgcagcttctggaaactcttcagtcataatctcatcaagctccgactcggacatctctaacaatgtggctaccgtatacttgctagaagctagtttcttagcaaaatctcgaacggtatcttcttccaaaaaatcctggagcaacacctcgatgttgtcttccaaagtacccgccatttgcatttgtctaattgaatcttgcagactaaccacctttgctatttttttcttaagatatatgcttgaagaaactcctccaaagtaaggagtgagcaggccacaaggaggccggggagacggagaggttccaaagcgtgcttgcttccgagcagaaccaatgcgtgactgcttgggactgcctcctatcagctcatccaatgcctcaaaccagggncatttgcaaggcacattgccagccaatttgtctttc

SEQ ID NO: 14947 - DNA, 745 bp, Physcomitrella patens
  misc_feature (687)..(687): n is a, c, g, or t
  Predicted polypeptide sequence is orthologous to G549
gttgaatggtttcagacaatgcaggaaaatatcacaattggggtttttttctaacgtaccctgcgtcctcagtgtcaagtggctggaacatggggatcaacgccaaaggagccaaactccatcactgccttcatctcactctaattaagcttggtgcattgatcaacataacgagtggcaattaatccagtgatatcaaatcggagatgacaccaactgggagttccttgccctcattttccactttcgatcaatcaatgatccctcacacaccgacactgcctattcaacattgtcttttcatcacccttctgttgtatctgtcaccgatgatactaacctcagctgccaatttcactgcagtgaagttgccttggtttctgtctaggactgtcaatgagaattgaggtccttcgattgccaattggggtctggtgaagaagcttcacaactcctccttgctagtgccctcaactgttagtaatcaccggatagtggacatttgtttccctgtatcgtggaaggtgatcaaggttgaagtaggagcccttgtcaaggatcttgcagagggaacccacaagcgaagtcgcataaaaacgctttgcaacactatcagagtcgggacaaccacaggtcccagataagcatgtcccagccgaatgggtccctcccactgtcgcggccgangcatgattcctcgttatcctgcatcttcggtactttctcggttcagggaaattgaaat

SEQ ID NO: 14948 - DNA, 600 bp, Physcomitrella patens
  misc_feature (538)..(538): n is a, c, g, or t
  Predicted polypeptide sequence is orthologous to G549
agtggcaaactttccattacgaatcgacaaaaagaagtgagaaggtcacaaaaaaagtttgttttaagtaagaaaccttatgctacatcgtttaacatacagcagccatgatacatacaacaatgaaatgccagaagccttacaaaaaaggtccaacggccaggcacttccaggataatgaacagaagaatgaactgtcaggagttatatcaccggacaaatgagccagacttcttctcctttttcgcaaaattgtccgaagtctccataatcgacccactagcattaaccatgtcgagatcgtcgccacagtcttgggtaagcttacgctttctggaccagatagccgccttgaatcctctcctctccccccttgcagcctctggaaactcttcagacatgatctcatcaagctccctctctgacatctccagcaatgtagctacggtatacttgctggaagctaatttcttcgcaaaatctcgaacagtctcctcttccaagaaattctggagcaatgcctcaatgttgtcttccnaagtgcccgccatttgcaattgtccgatagagtcttgcagactaaccacccttgctagtttt

SEQ ID NO: 14949 - DNA, 1453 bp, Physcomitrella patens
  Predicted polypeptide sequence is orthologous to G549
gctcggctgcattccagctgcactctcacgtcgtcgtcttgctcgaattccgttttgggttccttccgaacggactcgcagctgggctatcaattctgtcatcatgtgggcaatcgtgagcgttgcaactgccgtggcgcagaacggggtcaggcttcaggaagtgattcctgtgcgattgatggttagggttaggttatggtagatgattgtttagaatcagttgttgcttcagcgaccaggtggcatgttgcattggctgttgatggacattgggtgatgtggtgtaattcggcttgtgggtagcggaaggaggtgcgacctgctttggcattgggctggactgtttccgtggggtttgaatggtggacgactgccctgtgcacaatatgcaggcccatttcgatatggtccaggctgagccgacagccctgctttataagaggcctgatggaacagcgctggccggcagagaaagccgaaggttgaaggagctattcaaggactttggggttcaaccgtcaactgttacagtcatgggacagatgggtttcaccttgagcacgctgatcaacatgaaagacgaagaagttgattttgtaatcaaatctatgatcgaggaatatcacttggatctcttgatgggtgaacagtttggtattaaggctgctgttagggccaaacgaagattggttgtggaggagctggaacagcagcggatggatatggctgccctaagcaatgaaaagaaacgtaggctagaggagccatctgatggtttacttttgaaggatggcaatggttctttggaagctttgggactactgggtctgactgatccagatagtgacagtgaggggaaaaaggctgctaaaagaagacaaaggaaaaggcggtcgaaggaagtcggagatgacggagaggaaaggcctcgtgaacatcctttcattgtcacagagcctggggaacctgccaaagggaagaaaaacggtttggattatctgtttgatttatatgaacaatgcggaaagtttctggaagaggtgcagcacattgcgaaagagaaaggggaaaaatgtccaagcaaggtcaccaacgaggtttttcgtcacgctaaactcactggggctggctacatcaataagccgaaaatgagggactatgtgcactgctatgcattgcactgtttggacgtggagacatcaaataatcttaggaaagagttcaaagagcggggagaaaatgtaggtgcgtggtgtcaggcgtgctacttccctttagttacattagcaaggcagaatgagtgggacatagatgacctttttaaccagaatgataagcttcgcatctggtatgtccccacaaaactccggcaactgtgccacattgagaggatgaagcacggcgaatgagcccttgtacactattttgtagacttatgtgaaggttaagg

SEQ ID NO: 14950 - DNA, 1343 bp, Physcomitrella patens
  Predicted polypeptide sequence is orthologous to G549
tgaatggtggacgactgccctgtgcacaacatggcccagtttgacatagtccaggctgaaccgacagccctgctctataagagacccgatggcgtagcgctcgtcggcagggaaaaccggaggttgaaagagcttttcaaggatttcggagttcaaccgtcaactgttgcagtcatgggacagatgggtttcacgttgagcacgctgatcaacatgaaagacgaggaagtagattttgtaattaaatctatgatcgaggaatatcacttggatctcttgatgggcgaacagtttggtattaaggcggctgttagggccaagcggaggctggttgaggaggagatggagcaacagcgcatggatttggctgctcgaagcaatgaaaagaaacgtaggctagaggaatcgtctgatggtttacttttgaaggatggcaatggttctctggaagctttgggactattgggtctgactgatcccgacagtgacagtgagggcaaaaaagttgctaaaagaagacagaggaaaaggcggtcgaaggaagtcggagaggacggagaggagagaccccgtgaacatccctttattgtgacagagcctggtgaacctgccaagggaaagaagaatggtttggattatttgtttgatttatacgagcaatgtgggaaattcttggaggaggtgcagcacattgccaaagagaaaggggagaagtgtccaagtaaggtcaccaacgaggttttccgtcacgcaaaactcactggtgctggctacatcaacaagccgaagatgagggactacgtgcattgctatgcgttgcattgtctggacgtggagacatcaaataaccttaggaaagagtacaaagagcgtggagaaaatgttggtgcctggtgtcaagcgtgctatttccctctagttaaattagcaaggcagaatgagtgggatattgatgacctctttaatcggaatgacaagcttcggatctggtatgtccccacgaaactccggcaattgtgtcacattgagaggatgaagcacggtgaatgaatgagcccttgtacattaaatagtatacttatgtcaaggtttgaggttggagtagttcttcattctaaacttacattgtatcggattcacatttggagtctcctggaacacacgggtaggattacacattttatgtacggggttactgcaccaatctacacactttgtttttaatgtagatgacaggcttaattttgtacaggaatctgtagaaatctctgtaggttgtgccccccctgtccttttcatagttgcaatatatcataattacaattgcaattagcaattactgg

SEQ ID NO: 14951 - DNA, 655 bp, Physcomitrella patens
  Predicted polypeptide sequence is orthologous to G562
gcatttaaataaaaatgaaaccccgttgcgcgacgtgtgaaaatgtacaaaagcaactaccaattatcctaaacatcaccttgagtgttcgctgctactttcaaagaatgctggaccagcgcagcagtgaaataaactattcactctaacctctcccagtcaccaaccatccctcgaacaggacacccatctgtggaagaattcaaatgtttgtgcagagttaaattgtacatgatttatagaggggcgtgtagaaagagggaaaattcgaaatcgttttgttggaacccccaccgattcgccagctccgacccagaacctccaagcctatgtagctgcagcttgctcctcttgaactttcgtacctgagccaccgttaactgcaggcttcccctctttcggcttcgtgatgtttccgttcccatcattctgtgactcttctatctccttcgctgacaacactgcctcgttctccccacccacgggagcaacatctcccgcgtctgcagcagcagcatgtgcaccacccatctccgataccggtgtgccgcggatcttctgcaccagagagccattctccgcctgcaatctcttgcactcttccgtcatccggttcaactccgtcagcagggtcatgttctctgccgtgagcgtt

SEQ ID NO: 14952 - DNA, 770 bp, Physcomitrella patens
  Predicted polypeptide sequence is orthologous to G585
actggtattagaagcatcgtgcatagcttgagacacgtcttgcgcggcacaagagaagagtcctccgttaatcgacaacacttgaactttatcgaagccggtttctccattccactgcctttaaagtcacctcaaggaatgactccttgacagaactccgctcattgggtggttatcgcactcagagtcagagaactcctctcattcggtactttccatccctcctaccttctcatgatcgtctatgctgctaaaacaagcccagaagttgtttcaagcattattatttagttatttgatacaacagtgcttgttatcaggtgtgaagctctattctagaccgcacttaaactggtccttctcgcgagaattcatgttggatttgcagtatgtcactctactgtgccaggtccccctccaaaatggaaaaaagttcaaatttaactacctgcgagggcccaaagcctctaaccctcaaagtacttcactttgctgtgaaactcgtcggaagcgattctacttaaaatgtactacagtagctgatgttaatccctacgccttgtcacaggctcggaaatatgtgcctatgcccggctgcttgggttgagagacactgacttgttctctcgcccgcttactggaaccgtcgggctgtttctgtttacgacccttcttcgtcggttgcaacgacgagcctgcactctgactctgcctggatcgatatatcccttctaaaatgtgccgctgttcttcaacgtcaaacgtctcaa

SEQ ID NO: 14953 - DNA, 742 bp, Physcomitrella patens
  misc_feature (653)..(653): n is a, c, g, or t
  Predicted polypeptide sequence is orthologous to G592
tcttccttgctgcagtatgttacactcgaacttctccgagattgattcgagcgcggtgaatcacaccgtcgaatcgttgtggtgaaatctttgtaagctacggctatctatccagactagactgaatatcgtcgaactagttacttgagttgttattattcgaattttttgctctctgcgaggcgtcagccttaagccgcgccacagtatcgctgagctcctgcacctttcgctggagcgatttcacgtattccacggtctcgtcaagcatgtcggaggtgttagtctgcttgtccatgttaggcactaggtcctggagccgcttcatgcgttcgctgatcttggttctgcggacgcgctctgcaatgctgcggggatgcgtggcgcagcctctcttcgcacgagtgcgcatggggacggcgccgtagtggttatcctccaggccggggctgttgggaccgccgtttgttgagggcaggctcatgtgacgaactaggccgctgtgttggcagttgcggtaggttgatccctctgctgagccacttgatgtttcgctatcgccgtctagaccccgttgcctcttggctggacttgtaggcgacttccaggtaaaatcttcttgattgtatcaatgctgtgtaaccgttgatgangtggttgttatcgtctgaatcacgagagctgctcttgcctgaaccgttttcagccatcctatcttgcaccgctgagttcagctgcgaca

SEQ ID NO: 14954 - DNA, 650 bp, Physcomitrella patens
  Predicted polypeptide sequence is orthologous to G592
cgcttgaacttcagcgtggcagaacttgtgaaatgtggcaactacatagcttcttcatgccacacagcatccaaggcggagaagaaaaaaacagcaacggagctattaaacatctgcgctcttagatggaccattgaggaagtgagattatggactgatcggacacatattgggtacaatatgatacaaagggattgacgggctccgcatcagatgaactaagttattttgaaccagtagtatcagtcacggcgtcctaacctttcctgcagttgctgcagttcagcgacggttttggacagctcttgcacttgctgctgcagctgtttcacgtactccacagcatcatcaagcatgtcagctgtgttggtttgtcgatccatgctgggtaccaggtcctgcagctttttcatccgctcactgattttaccccgccgcactcgctccgcaatacttcgggggtgagtggcgtgtccacgatttgctcttatggtcttcagaggcaccgccgagggatcggcaaataggtcgtcaaagtctacattaccactgaacggacggcttggcgcaggcagactagagtgtcgaattaagccccctaactttggtcccgcctcgccaactctggctggatttgtagggcaattcca

SEQ ID NO: 14955 - DNA, 762 bp, Physcomitrella patens
  Predicted polypeptide sequence is orthologous to G602
cctcctctatatgtttattaatgcgtgtagatgttacaactgtgacagttgagctcactctttacaactaaggacccccaaaactacttcgtcatggaacacgcagagatgacccggaataagaatgtcgtacactaaccgtaggatagctgcaatggaaaagcagatgggcatttgtccctatactagactgagctggatgtttttcacatgcgactttacaatacaccgagattccgtgaccttcttgcctcccaaaatacagagtctagtcgatctcgtcaaatagggtttgctaacgcattctttccacacaggttgatattgataaaatcccataactctaagagaaaatctatggatgtaggggagaaatgaaagtcgaggattttaggccgcaaaacaaccgtacttcacagggaattttcccgttgccctgatcttagcagccatctcctgggttttgagaatgtcttcacccttcttagcagcgttaacggccctcttctcctcggcggccttgtgggcagctgcgatttcatttttcatcatctcctgtacttcgcccgtaagttctcaagcttctcctctttttttctaaggcgggcttcggctttggtcttcattgtcgcctcctcttcagtgatcctcttctcctctctgttaaatctattatcaattttcgctttcgcagactcctcccaggtttccactcttttatacagcaactcatgctcaattttttgggtagccttctccatg

SEQ ID NO: 14956 - DNA, 684 bp, Physcomitrella patens
  Predicted polypeptide sequence is orthologous to G611
ttctcctcaatcttaagaatgtcatcgtacttgtgattctgaactacaaaatgaggtccaactacactgggcgtctcctacgaagtatacgggacccgagtaaagggagtttgttcccgtggtcaaccaaaatgtcctgacgacacattggacagggcgcatcgcacctcttgtgcctgtctggatataaattagtatcaagcactaatcttcacacaattgccaatcgtcgtgctggtaacctctaaaccagatagtaaccgccaattcgagtacaaagttgcataaaataggtcacagattgagggattgcctccttcgaatggcaagagtgggatcgccaataccttgactgatgcaaaatacctccgcgagacctgaactgcaacagtaaatgagccacttaagcaactttctgtgctcgtccaccggtacttggcatatcatccctcttgttgttaggatcatcaggttttcttgcccatacgggcgctctatcaggctcgtattggtagtcatagaatagttcttccccagctccaattcgttctttagcgaaaatccctaccctatggtctccggaaaccataataaccttggcatagcagttgggagtaggtgaatggttcgcaaatttgagcttgtcgccctttcgacatgcgtccagcacatactgatcattta

SEQ ID NO: 14957 - DNA, 748 bp, Physcomitrella patens
  Predicted polypeptide sequence is orthologous to G652, G1335
tagctgtttatgcaattgctaacgcacaagtttatgcagcaattgttaaaactcgcttacaataatggtataagaaactcatggtgttttcatcattacgactattttgtgcaccaccgctactactcatagcatgcttgcaatgcaaatgcagccaaaacatcgaagtccacaacagtcgaagaactctcagctacacatttcctccacattctttaaaaaaactctatgcatagtggctgaaactccctactgctattcacactaaatactaccagctctggttgtaatttccgctgcgcccaccagatgagtatctacggtcatcataacttcctgcgccatagccgccaccttgggaagcaccatactgtgtagtatcgtcataagtgccaccaccaccataacctcctccatagccaccaccaccgtatgctccaccgtaactgctgccaccgccagcaccacgggagccatatcctcctacattagcaccttggggacactctcgagccatatgtccctcttggccacatgtgtagcatggcctgccaccgccaccgccaccaaagttgccaccatacgctcctgcacctccccgactgccaactgggttggggcattcacgagaaaaatgtccaacctctctacagttgtagcatccttcttgtcccttattgccacccttgactccaccccatgtatcaccgtatgagcttcctcttatgccgtcacgttcacgactccg

SEQ ID NO: 14958 - DNA, 1797 bp, Physcomitrella patens
  Predicted polypeptide sequence is orthologous to G657
atgtctgacacagtcgagttttatcttattactcgaagcattattaaagtcaaaaatttcagacgaacaggaggcccaactcgacgatcttcaaagggaggatggacaccagaagaggatgagactctgagacgagctgtgcaatgcttcaacggaaagaactggaagaaaattgcggagttcttcacggatcgaacagatgtgcaatgcttgcacagatggcaaaaggttctcaacccagatctggtcaagggtgcatggaccaaagaggaagatgatcgtattatggaacttgtgaacaagtatggagccaaaaaatggtctgttatagctcaaaacttaccgggtcgaattggaaagcagtgtcgcgaaaggtggcataaccatcttaaccccagcataaagcgtgaggcttggactcaacaagaagatttagcgctgatccgcgcccatcaattatatggaaacaaatgggccgagatagccaagttcttgcctgggcgtacggacaactcgatcaaaaatcactggaacagcactatgaagaagaaagtggatccgttgaccgcaaatgatccaatctcaagggcgctcgctgcttatcaagcccagcaggagcagtcgatgaattcaggttctggggttggacaagttgactctggaagcatcggaggtaggactggtccacctatgagtgagacaaccacatcttccgatccaagcaggcacaactcgaacactcgtggtttaggccgcacatcccattatgtagagcaggacacgaagtctactggatcagcaccccctccaccttacccagatacttatcccaatcgtgggaaggatcagcagaggaatgcaagtcaccttcaaccgaagaaagaagagtctgatcatgacctaattgggcagtcactaggattctctggctggtcttccggccaattaccagtgtattctggtgggttctcgggagtatctttaggtacatcgtcgctatctaattcagttaccgaacagttagtaccgtcagtgcaacataaacgagctatgtcgaacattgagctcactcggattgcttctttctcgaattcgtttcctcggatccctgctccagagtccagctcccaagcttatcgaagctcgtcaatgtccgtcccgctaccggatttgggttctctcttcgcttctagtcacatgcccatggcggcgcacaatgacactcaaccattgtcttcttttaacggcacaggggtaccacctggtgaagagactttggccatgatggggtcaaagcagaactatgagcctttgaggagatgcaaccttccccctagtcaaccctctgagggtgatgctgcctttgaagactccggagcttctgtccggtgtgactcccagatggcagaacctatggacaaggccatggaccaggatgtgtccgagtttccatccgataatctcctccgggattctagtgaggcagtcaatgagtaccagtcacaatctccgatgcttacggaggaagatctggaagataaaggcgacagtagcagagttcaggatcgtgatggcttgttctatgagcctccgcgaatcgtcgaccctccattcatgaattacgacttggtgagttcgctcaacgcttacagccctctgggtgttcgccagatgataatgcctgctggcaactgtataactcctcccaactacctccagtcacctttccaagggaagagtcctcagtccaaacttcgcagtgctgctaagagcttcagcgggtcaccctccatctta

SEQ ID NO: 14959 - DNA, 189 bp, Physcomitrella patens
  Predicted polypeptide sequence is orthologous to G669
tgtaggcttcgatggaagaactatctcaagcctggcctcaaacgggggaaattctctaaggacgaggatgagtttatcattacactgcacgctctcctgggaaacaggtggtcattaatcgctggccgcattcccggtcggacggacaatgagattaaaaaccactggaatacgcacctgaaaaaaaga

SEQ ID NO: 14960 - DNA, 760 bp, Physcomitrella patens
  Predicted polypeptide sequence is orthologous to G715, G1646
gagtgttgctgtataactagatcaggtcaaaaactgtagattgggacacccggtacagtctgaaagataaaaccagggagacataaaagaaacaatggtactaagaaaatggatacccgatcctcgaacctaacattaagagcaactcctgcacatgctaataattatgcctgcactagtatcactattcacaaatttctaccagatccatggaggggtcgggtccctttgtgcccttcatgacttgctaaaccaaacataaactctgctagaattagcagtgctcagaactgtcgcatcaccgcctacagctacgatttccttaaaatatagttgaaagccaacacaaaagcgctgtagtgaaaggtaaaatcctgatcctgtgaccccttttgccataagaatgacagatggtagcaacagtatgataaataccattcccacgtgacgaaagaatctcgatgcgatagccctttccttgagttgtcccgtcttcgatgctcagcgttctctaggtggtaatgcattcactgttgctgctgctcggggacaaaggcagtctgtggaggctgatacatcatttgtgggtttggtggctgcccaaccatcatctcaggagcccccatagaatgatgcatttgctgtccagccatgggtggatagaatattcctccgtaaggtacagaaccatcccctggaacaccagtccatggcacacccaaatcttcttccttcaactcgtcacgtggaacgatgtcaa

SEQ ID NO: 14961 - DNA, 746 bp, Physcomitrella patens
  misc_feature (745)..(745): n is a, c, g, or t
  Predicted polypeptide sequence is orthologous to G715, G1646
aggcttttagagaacagattgaaaatagtatacagtttcagacgccacaaccagagcccgaacaatcaggccaagaaacattgacaaaccatgttcaaggaacttgcctgtcaatcaaagaccaaactactgaatgctctaagctgctttatcatcaaggagatccccaagcaatcacacatctgtgagtccttcacgtgcaaagcccattgctcaccagtctacatcgaccccagtctacatcgatccgtactttcacaaccctagaatacaatccaaccgcgccgctcacctgcaaacgccacaatcaaattcgtcaactatttggcggcatcccagcttgctgattaggtggcatttgagttggttgctgttgccacatctgctgcatcggagcttgctgctgcatgtactgcattgggggtcgctgcggctgcgactgcggctgcggttggtacatagccgtcgggtccatagccatggctggcctcacgcccatcatcgagttgcccatcatggcaggagagcctattgcggcttgcggaactgggccttgcggtgtctgtacgtaatacactccttcgtaactcacagggctaccaaccggcatggcacctcgagggacgccaagaccgtcttccttgttgagctcgtcacgcgggacgatatccaccaagaaagtcgaagatgtctgtgcgagtgatagcagctgcaatgtcgttcttctgcaaagtgcgccgcttgnt

SEQ ID NO: 14962 - DNA, 788 bp, Physcomitrella patens
  misc_feature (698)..(698): n is a, c, g, or t
  Predicted polypeptide sequence is orthologous to G720
tcttttccaaaataaataaaaataggacaaccttaaaactactggaaacgatgatacacttttcaaaatttacggtgagtactaaaatgggagtgccaccagattctgagacccttaaaaaccaacttgacacttcctgtcaccaactacctggtctcacctgtaagaatctaaatactaggcacatctaaatttcactatacagggctcaatcaagccttcaatttcgaatggatggagagttgacccgccgcgcaaagtttgcaagtaaccaatgcacaggttcacaacaaccccagatacctgaaggagcctgaataggccttccctgatcctctcttttgaagtgtgatgtgatggaaacttgctcagatttcgcggaggatgtatcaacattgcctgacaaagatgtagcttcgacatctttggttgatccagccgagttgtcagccagcttagattctgatatgttgatgagaggcaccgaagtcccctcatttgtggtgcgtaactctttaattggagggctctgcgtgctatcaactgaaaaagaagtaccttcttcactttggctttccagcaagtgttgttgctttcctgcggtcccatctgcaagtggctcttctatttgcacgctcgaatcacctgagaaagagccacctgtatgcagaacctctccagcttgatgctcatctccnaatccatccttcggaaaagcttcctctacttctttggtgagcagctctggagctctatccttcagcatctcttcaatctgcaagcctgaa

SEQ ID NO: 14963 - DNA, 773 bp, Physcomitrella patens
  Predicted polypeptide sequence is orthologous to G732
ttatctttcaacgtttaaaacaattcagtttctcccaatacatttccaggaccctaaaaaccttaccaaatctgccttcaaggtatccatacgttagggacatgacggatggaaatcatggcaagtaatcagttcagatgtaagatgtatcataacatcttcggcagacaaactccaaccttcaatcgttacacttcagttttctgtcagagacagagttacgcgttcaaacactccgtgaaggacccataccactgctcttgaaggagaactggaacaccactaatgctagcgtcgaactggtccgagtcaatttcgtcgtagagctcctgaaagaagccacgtgacatgtctatgcaggagaagtttcgcttcttcgcaccgaatgttgaagcagtcggagggctgcccttggaagatatttcaagttttatgcaagcgtctggggaaatcagccctccatcaaccatgtgacagatgccagagtttacatctttgccttcactgagttccccagaatctgcctgagcacgtggatgtcgggcagaatcgagttctttcattaactcctccactttgacagccaattcattcttctcgagctcgagtttcttggcgagctgctcggctatctttaacctacgggatagagtggcgttctccaaacgtaattgagcagtcaaaatttcgagctcgtccagacgctcctgctttctttgtccttgaccgttgtgctgacgcacgatttgaggacatcctcctctttcttttct

SEQ ID NO: 14964 - DNA, 705 bp, Physcomitrella patens
  Predicted polypeptide sequence is orthologous to G732
gaagcggatgatttcaaatagagaatcagctcgacgttcgaggctccgaaagcaacaacatttggacgaattgcgatcgcagattgcacaacttcgagccgaaaatacacacatgctgaatcgattcagtcttgcttctcagcagtatgcgcagctgactgaagaaaactgtgtactaagatcaaatgctaccgatatgagacatcagctccaaatgctgcatcatgctgcttcgagtcaccaaccattgtctctggaacgtggccttggcacagtgcaaccccttcccttaaatttgagttgtgttctggtctaacggaggatgccaattggtgatagcttgaaatttgagccccttttcagtttggcgtttgtatatgtttttttgggtagggctcagtgtgaaatgtttccagatgagttgatttgcattaagcaaatactcttagtacggattgatttgcttggatagtgcctgtttgaatgcacgcaaaggcgtcaaacagacgtctctagatcagttagcgtgaccgctgcactgttttgtgcaattactggtggaagggttctatgcctcaaatttattgtgggtattggtggtaagtcagggagtgcaaaacgtatccaccggtctcactcatgcgaaaagagcatgaggtattcctgctttccgaagcacatagtgaaacagattgaattatctga

SEQ ID NO: 14965 - DNA, 776 bp, Physcomitrella patens
  misc_feature (734)..(734): n is a, c, g, or t
  Predicted polypeptide sequence is orthologous to G735
ctttaagtcggtttttgtatcttacgataattagaattttgtacaaaatagtctgctgtgtacagattatattgaattgtatatatcaattcacatggcaaacaattagcaatgaattgttgactagcagtgttcaaacattagaagtttaggttggaactgggaaatcactgagctgggctgatcttcgatgagctgcatgagcaaccgaggtcacgcgttcaaacactcggagaatgattcgcaccactcctcttgaacaaactccggcactccatcgctgaagctgacgtcgaactgatcgagatcgaatgggtcaactaggtctgcagagatgtcggactgcgggtcggtactggagatgcttcgctgctcgacatcgaagtttgtattatcgctatcgtggctgctctgaggtgacatctcagaacccacactttcgcctgaaagagattcgccttcatcgacctttttgcagaggccggagatgtgattgccatttggcaatgttccagttccataatagggtgacccctgcgctcgtgcctgtcgagcctgctccagctcctttctcagttcctcgaccttcttcgccagatcactcttttcgacctggtattttttgactagctgttcggccaagattgacttgcgagagagagttgagttctccagccgcaactgagcagtcaaaatctcaagctcgtccaaacgcccttgcttcctcagtctanatctttgagccgatgcacgattcgaggacattccttcgtttc

SEQ ID NO: 14966 - DNA, 709 bp, Physcomitrella patens
  Predicted polypeptide sequence is orthologous to G735
ctgtaggtgaataactattcaaatacggaaaaaattaaaatttaatactttctattgtggcaatacctaggcaacacgctcagcttctcagttcatcataaccgcaacaactattttcaagtctcaatatcaatctcagactacgagcttttatgcatgatacgcaacctctcacgcactagccatattatgtgcacccttccaattaagaaaccctctgtatttctggagcataaacgtcattttctcaacattttccacttaccctagactcttgttcctgactaatacacgcgaaataactggtggatacatcgatttcactcttcgacatcttagtgtggaggcattaatcagatgccatgtccctgcacgatggcaggtttatccatttcccaaccaccccaagccgctgtattgcaggaactcccattgcggacacgcatatgctccagaccggcaatccgttgcattgatggcgaacgccatatcttacccccaatgctgcatggatgctgttgttgctgatcgtaacgcatcattgagctgtgcctcatttgctgcggaagtggtctctcacttatcatgatcggggagataaagctcaaattggagtcaggaatgaaatttaccataggttgaccctgctgggccaccataccttctgtcattttcaccttggcacgcaacgcttcaacatctgccttca

SEQ ID NO: 14967 - DNA, 730 bp, Physcomitrella patens
  misc_feature (717)..(717): n is a, c, g, or t
  Predicted polypeptide sequence is orthologous to G735
tatgaatcttctcttcctctgaagcaacaacaatatgatcctttccatgcctacttatcagaagaattctacgccacttctgaaaactaaggtgaagtcccttcttagcgtaaatctattccccttcaacccaagtctaaaataaataataatctcggatcttccacttgccctgaactctcgctctcgcttgaaataagcggagtaaatgtaagttacatcgattctactacatagtcagcgcggaaacattgatcagatgccgtgttcctgtaccatggcaggtctgtccatgtcccagccaccccaagccggtacgttgcaggaactcccgttgcggatacgcttcgtcagatgctccaggctggcaacccgttgcattgaaggtgcacgtcccatcttacccctaatgccactagcaggctgctgttgctgatcatggcgtagcatggaactgtgcctcatctgttgcagaaatggtctttccatatcattcacattgaacggtgtcataaagcttaaactggggtcgggaatgagatttgacatgggctgtccttgacgggccaccatgtcttcagccattttcaccttagcacgcaacgcctccacatctgcctttagaattcggttgtcgacagatgcatctttatgcatgtgggtaatctcttgcaatctttgcataagcgtagtattttcaactcgcaattgcgcaanctgcatttctaga

SEQ ID NO: 14968 - DNA, 730 bp, Physcomitrella patens
  misc_feature (25)..(25): n is a, c, g, or t
  misc_feature (92)..(92): n is a, c, g, or t
  misc_feature (644)..(644): n is a, c, g, or t
  misc_feature (665)..(665): n is a, c, g, or t
  misc_feature (674)..(674): n is a, c, g, or t
  misc_feature (706)..(706): n is a, c, g, or t
  Predicted polypeptide sequence is orthologous to G748, G1900
gcgataatagacctcatttgattanaacataattagtagcagagataaccaaaaaaaacgataacagtgtaaaataccggcagctacacacnaaacatgtaaatgaccagacgaggcctcgaggatcatgtgaaactccatgaaaaaattcacggttatatgctaaaaagataagaaactatataaaggcagggagcagcactggcactttgtatacctactttatttatagaggaaacaagaatgattagattgtcatgatttcacttgcttcctatcacctgatgtgatagacactttgttgtctcccactgggagaaacgccttaaaattactaccagatgcgacagtctccacccgattctcagctcccacagcagtccacacagagcttcttggagtgtttactgcatcgtctattttgaccatctttggcacccaaagagaactctccaccctctccagctctggccgatctcgtgggtgcttgttcaacaccggacgaataggcaacctactctgaactggggagacgtttccagacataggaactgcaggaacctgcatggaggctgatgcggcagcggctgcggctgcggctgcgtccggtccccaaggcatgggccaaccagcaccccatccangtgacatccatgatggtccangtaacccancgggcatccctggaatgagagtcgatccccancaaacattagaccaaagcccattc

SEQ ID NO: 14969 - DNA, 750 bp, Physcomitrella patens
  misc_feature (131)..(131): n is a, c, g, or t
  misc_feature (499)..(499): n is a, c, g, or t
  misc_feature (578)..(578): n is a, c, g, or t
  misc_feature (650)..(650): n is a, c, g, or t
  misc_feature (662)..(662): n is a, c, g, or t
  misc_feature (708)..(708): n is a, c, g, or t
  Predicted polypeptide sequence is orthologous to G748, G1900
gtgcgagcaagtaaaaaattattaaacacttcaataaatttaaacatagttactggcgaagagaaaagaaaaaagaaccataacagtgtaagttaccatgcaggtatacagaaaaacatagcagcgactangcgagaccccacatgtccacatgaaacttcaagaaagatttcacggaggtatgccaaaaaagatgagaaactaaataaaaagcagcaagcaatactggagcttttcatacctactttattttagaggaaacaagtatgttgacagcagctgggttgtcatgatttcacttgcttcctatgatgtgtcagatgctttgctgtctgccactggaagaaacgccttaaaattactaccagatacgacagtctccacccgattctcagctcccacagcagtccaaacagagcttcgtggagcactcccagaatcgtctaccttcaccatctttggaagccaaagtgaactctccaccctatctaggtctggncgatctcgtgggtgtttattcagcaccggacgaataggtaacctgctctgaacagggggaaagccgcttccagacatangagctgaagcagtctgaaaggaagccgatgctgatgctgccgcagcagctgctgctgcgtccgggccccaangtatgggccaanccccaccccatccaggcgacatccaaggcggcccaggcatccccgnggggcatccctggaatgagagttgatccccagcagattcctg

SEQ ID NO: 14970 - DNA, 611 bp, Physcomitrella patens
  Predicted polypeptide sequence is orthologous to G791
ttttttttttgaccaaagtgcacgcatttgctcctttcctcgtttgctgaggaggtcaaaatttaaacaccgggtttccaaaaccagaatattgaacccaacccctaattacagtgtatataagaaaggaagaagatcgaccaccggctgggagaggaacggtgacaagtttgaaagatattgctctttttcactgggggcctcaggacatgatcctgtgatgtgtcaacagcagcaggcggcatccattgccacatggccatgccaggatacccagcaatttgcgcagctttattggatgcagcctgtgtctgtgcagcgaaagcagcaactgctgcatgtaaagccgcaggatgaggcatgtatccggcgggaatagtcatcgcctttacttgctgctctaacctttccttgtctgccttcagtcgagtcttctcctcacgcagttcattcttctcattcttcaaatccttgattgtttctcgtagctgattgttcgactctgtaagcccttgagcctcagcacgaagctgagttaggatgcgaacagcatcacttaagattgtggctttgtcagtcttaggtggccttccaggttccaatgccgcact

SEQ ID NO: 14971 - DNA, 779 bp, Physcomitrella patens
  misc_feature (635)..(635): n is a, c, g, or t
  misc_feature (728)..(728): n is a, c, g, or t
  misc_feature (741)..(741): n is a, c, g, or t
  misc_feature (758)..(758): n is a, c, g, or t
  Predicted polypeptide sequence is orthologous to G791
attcacgtctttactaagtgagcactttgtcaaaggacaaggcgcattcaggggcctgctaactagtgcgggtctctctctcgctccgatcccaaggtagagtgccggagaaccaacttctgtacacttctgaaagagatccgtaaggaaaggctcaagttgtttcaattgaagtagatcaattgtgaaatacagggacatctggtgagaaagcaacttggatacacggcttaccgaatgccatgccaaatggtgttgctcacagagtccaaagtgaacattgctcctttcctcgtttgacgaggaggtcaaaatttgaacaacgggttcccaaaaccagaaaaatgagcccaacccctcaataaagagaaaataaaacaaaggagtaagaagatcgaaccactaattggaaaaaaacgaccctggaaaagcttgaaatgatttgctctacgccactggaggcctcaggacatgatcctgagaagtatctacagcagcaggcggcatccattgccacatggccatgccaggatacgcagccatttgcgcagccttcgttgatgcagcttgtgtctgtgcggcgaaagcagctgctgctgcatgcattgcggcaggatgaggcatgtatcccgtangaatactaatcgacttcacttgctgctctaatctttccttatcggccttcaatcgtgtcttctcctcacgcaattcattcttttcattcttcnaatcctttattgnttctcgcagctgattgntggattctgtaagcccttgag

SEQ ID NO: 14972 - DNA, 768 bp, Physcomitrella patens
  misc_feature (654)..(654): n is a, c, g, or t
  Predicted polypeptide sequence is orthologous to G791
atcaattatgaaatacaaggacgtctggaggaacagcaactagatcacgcagcttttcgagcaccatagcagatggtgttactcagagtcctaagaggaaattgctgttttactcatttgaagaggtgagaaatctaacaccagtttccaaaatcaaataaatgtcctttcaacataatttacacatgactatggattgagaagatcgaccctcctactgtaaagactgagattaaaaaagcagaattgaatagctctaggccactggaggcctcaggacatgatcttgcgaagtatccacagcagcaggcgacatccattgccacatggccatgccagaataaccagccatttgcgcagctttggttgatacagcttgtgcctgtgctgagaaggcagcagctgctgcatgaatagctgcaggatgaggcatgtatctggtgggaatggtcattgccttcacttgcagctctaatctttccttgtcagccttcaatcgtgacttctcctcacgcagttcattcttctcattcttcaaatccttgattgtttctctcagttgattgttggattctgtaagcccttgagcctcagctcgaagctgagtcaagatacgaacagcatcacttaagatagtggctttgtcagtcttangcggtcggcctggttccaatatcgcacccaattccaagaatctatcattgaggcgatcacggcgcatcttttcacgacatgctttgttgccagcaccaccactaatctcttctc

SEQ ID NO: 14973 - DNA, 587 bp, Physcomitrella patens
  misc_feature (41)..(41): n is a, c, g, or t
  misc_feature (65)..(65): n is a, c, g, or t
  misc_feature (126)..(126): n is a, c, g, or t
  misc_feature (312)..(312): n is a, c, g, or t
  misc_feature (387)..(387): n is a, c, g, or t
  Predicted polypeptide sequence is orthologous to G805
acttgagtttgacttctactgattaaacgactatggtacanattggtaacagcctccaaagccantgctatctgggcttcacatcagcttgtcttgagctattcatgtctgtctcttggctgccgntggctgtgcccgcgactagagtagaggaagggatcggtttggctataaaggtgggctgactctcccccgccatgatgacacacgtgaacggagctgcaccatcggcaatcgtcttcgtggaagtattgttggaatccgcagcgctcgtccccgagttttcgtcgttgggatggggctcagtcgcanagtagaatgtgaccgtggtttccgaggctctttgattgcttgaaggacgagagctgtgacggaggctaacacggngccacttgaggaacaagcagaagaggaagagtagagtgaagagggccaagactatcatgcctatcacagtggtgacgaaatagaacaccgacacttgccgtctttgggggcaattctcactattggtcggaatgctgctgtttttccaacatggtgatgacccatgatcagaattcatcttgctgactttcctgacttgt

SEQ ID NO: 14974 - DNA, 704 bp, Physcomitrella patens
  Predicted polypeptide sequence is orthologous to G807
tcatacattaagatgtttgccctgaaacaacccttagtccctacccaggtgctagctgtcccatttgaacagacaactgctcgacactaggcttcttactccaccaatttttcacttccccaccatgttcgtcaccagctaaaatttcaactgaatcccccacaatctcatctccatcagcctctttgtcatgaggacctaaatctaaatcaccatctagttcgtgatctactcctgatggagtctcactcaagaattgctcccaaaatatatcgttagcagctgatacggctgggctgccgaggttcgatatcacttcatctccctctaatgaagttctgcctccttctgaggcaaattccatggactctccagtgatatcctcgggcttgatttctgcaccagagtgaatactccctttgttcatacttagggcaccttctagtcttggaattcgacttgtcagatgttggggcattggcaggtcaggaacttcagttgaagcatccatgacagccggtccaggtaaagcatcaccaaggccggatatattcatttcagtgagcgtgacgccagattgtcgattcagtgcgtcaggaccagaaggggcggagcctagatccctaaacaaggcttcaaggggaccactatcaagactaggtgcggatgcagcatctgttgagttgaaaaactgcataatcata

SEQ ID NO: 14975 - DNA, 663 bp, Physcomitrella patens
  Predicted polypeptide sequence is orthologous to G837
atctcggattccctatagatccttctgtcgcagaaaggtcggtttttttctttttcttcttgctctccttcttgacctcagagtttccaacggatccctccgtcacaccacttgtttgcttctcgtctgtaagagcccgtttctgaaccgatctcgttgaatctcctctagatttttcccctgatgttatgccagatcttatgctacggccaccaagtgaagtctctttctgtatctcaagctgtcgtctaaaacatactttagatgtaattctacgcacagaatgctgagaagagcctggcattattgcatataacttcttcctatccacattctccgtcaccacgttacatatatctcctcgaatgctgtagaagtgcccaattttgccatccgaatcaggaggttgtatgacccattgtttgtccatcaagtccttgggacctaattcgttcacagggagttgcacgagccatagctcggtgttggacgatgccgcttcttccacgagaggcgccagaagctccacttgtcgaaacccatcgccaggcgagtacccagagtacccatcgagcattttggcttccttcatggcgcagctggttgtgtgcgcttctcgcagaacaaggcgcgacgattgaacatcgcaaggtgaggcgagtc

SEQ ID NO: 14976 - DNA, 717 bp, Physcomitrella patens
  Predicted polypeptide sequence is orthologous to G839, G1196
cgactccttgagaaaggaaatcacttctgataatattttacaactaccaatcgtcatcaaatatacatgcttctaccactgaaaaactgatcaagaatacacaaatccaaatcgactattctgattgttcgatgtaccaggtatttattgccccctcactcttaagcctgaaagaaccattaggactgcagagccctgcactgcttctaaaaaagtacagcgtcccaaaaaatcagtattcgactcttttcgagatacttcacgtcttcattcctttaactgttttcaggtaaagatgaggcactctggtattcgcaaaaccacttgattgaaatctctttgcgcaattgactacctttttgtcaccatgctgccgctcgtacttctagaagatgatgaggatgaagatgatgatgaaccatcttgcatacgaggtctcttgttcttttccattcccctctctgccattttgtgctcatcaaccttcgatttcggaaaggaatcctgaagtatatccttcaattctacgagatgcctctttttcatgagcttctcctcaatatttccctcatcgttaggttcaacgtagtcatcatccagaacatacttgtcaatgactgccgagtagcatggaaagtatctgcgtcccatttcgactgcaaattttacacgacgaagtaagtgaaaccaagaagatgtaaataacatagcaaaggt

SEQ ID NO: 14977 - DNA, 566 bp, Physcomitrella patens
  Predicted polypeptide sequence is orthologous to G839
agattttgttgattgttcgcatattggattcggtctgctcgtgtttgtgcgagttgtgtcatattggcttcggttaaggatgagatggacacctacctctggaatgcggccggagatccacaattccgttaccgattacgagtagcttcgccggtgcctcgttatgtaaaccctggggattcaagaaacatggcagaactatgaagctgttttgtgttacttttagtggtttcgcggcttaggttgttgtttttaggagaatgttttccgcggagccttgattctatgaaagaagatgaccttgtaggcagggaggaaataaattaagtgagattaacgtgaggagctggtggggttttttactctagccatgtcggatctcagtctggctctgccggtgcacgatactaccccaggaggggttacaccagcctcattccaggaactctgttctgatcttgaaacactcattcagatgcccgatgaggaatacagtgaccttaatatcattgtagagggggaatatgtgccagttcacagatgcattctcgcagctcggtgctcag

SEQ ID NO: 14978 - DNA, 763 bp, Physcomitrella patens
  Predicted polypeptide sequence is orthologous to G843
tgattatccaacgtgtaatgaatgtatctaagcgagaaaataatctgtgatctgagagtcccttcataccaatagattacattctatgtgcatgaaagacctctacacttcactctgggcagcacgacttaagattgtggacaaattgcagcagaaactgagaagccacctgagagctcccaatttgcctttctgcctatacagattattatctatgtttctggccagggaccgtgcaaaccccgtttctgtagtgcaaatgttctcaaacgatgtccttgggtgcacctgaggaggccacatttgcatagtacttcacctatccgaagctgacgcagtaggtccatctccttgtatccaaccttttgaaaggagcagttcataaacacgatcagtcttcacgggatccactttaaacatttgatgtgcatcggaccttcgaacttgccccgacttcaagctctccagcatgagatgttccttcatccttaagtaatgagcaggtatgagcctgtgctgtacacatagatcttgctcagtgtgagagagtaagtccacaccaggaaagcctccaagttcaaaagatgctgaagttcttttcgagctctttccaccagaacctgctaggagactgctcccaattggcagaagatggggacctactcgtcctttcgggacctcgcgcgtactgccaggaaatgcagcttccccttccttctccctactcaagtaccgattaactcgatgcgttgaaaatttgcca

SEQ ID NO: 14979 - DNA, 756 bp, Physcomitrella patens
  misc_feature (400)..(400): n is a, c, g, or t
  Predicted polypeptide sequence is orthologous to G846
ccagatccgcttaattaagacgtcattttaatacaatctagtgtacaaactgaagaaaagaatgcctcttcagtaattcactgttcgtgctttcaggagtattccaatcgactacccagttactcacgaatgagaaacccaagttctaaagtttcacaggcctgtaatccgaaacttcaagacacaacactaccttggaaataatttaatcagcaagatagtgactacagccttacggatcaatatcaagagagggatcaaatgtaatatttgaaactgccaattaccctacagactaagcgcgggggccctcgaatggtaaagcagcccaactcctacgagtattgtcaaacaaagcccactgcttctgctattgtgtttgggtaatattacatatcanaaacagcagtaatttaaaagtacagaaaatccactgaaccacttagactcggaaaaggtagcgaaggtcctccactgtcagacgattcttttgttcacctccgctgttctccccaaaagcagatgccacaatttgtctctttcgctcctgtaatgctaaaatacgatcttcaattgtgtttttaattgtgaatcgtgagacattgacagttcgagtttgaccaatacgatgagctcgatcaattgcttgatcttcagtggtgggattccaccatacgtccagtaggagcacatggtttgcagccaccatattaagcccaaggcttgcagctttcagagacataatcatgactgtca

SEQ ID NO: 14980 - DNA, 744 bp, Physcomitrella patens
  Predicted polypeptide sequence is orthologous to G852, G2633
gtgatccccctgtctgacacgattatatgaacttatatacactgatactttactagaacaactactcgagcgaagattgcgcatggtgcaggctcatctcgtcactggcggtatgatctcaccacctcagagcttccaccgcaagcttcattcatcaccgcctaaacctacgacagccgcctaactgacaagtactggtacaattatgcacagtttttcaatctaattgtttagggctcccattcgagggtgtcaacaactccaagcagacacaccaatcacaggagtttcttgccaccctaaaatcagagatgttgattcctctgaaagtttatacggtatgggagagttagcttgcatcaagtgcttcgaggtcaagatctccagcagcatctgagcttgccgtacagtatacgaactgaaagccatagatcgaaatccagctttcttaaacaaggctcgccatgtctctgacctcacatgtcgcacacgccgactactgtccttacttgcgaggatatcattaatctcggcagcaaatgccgtgctctcaatatggaatctgtctgcgctgtcgcgacctaacgctccttccaaagaatcgaacagcgcacagtaatagtgcagtgcctcgataaatctcgtaatgaacgaggccgcattatagttagcttcggcctccagcagtgtcaccacattcggtcttaggttacgaaacatgcacagcaacttttctaaaacggc

SEQ ID NO: 14981 - DNA, 620 bp, Physcomitrella patens
  Predicted polypeptide sequence is orthologous to G852, G2633
gacaaacatggtgagaaagtgagaatttagagggaactgaatcgggaagttagttgtgcagcttgctgcacttacatgagtgcttggggttggtgcaactagacgatttccagactgacgtgaaggtcgtgggttgcttgcgccacagaaggctcaccatattggattcaatgaatgctgtctcccaaaattcgctgtggttagcaaccaggttctgagaaactttcttcgtctcttcgctcagctcgcgcggcatgaatccggcgcgcttaatgcgccgcgcccactgcggatacgactcatttcgttcgatgcgggcgatgccctcgcatgccaccatgttgagcagcatcatggcaccctcgtactcgatgatttgacgctcgtccgggtcgcgaccgttgtaaccaacgtcaatcgactcaaagcatctccaccagaaggagaccgcgttctggaaacgcgtcaagaagtcctgggagcagtgatcgctgtcattgtcgctctggatgaagatgtgaggatctaatgtgaataaaaagtcaaggaatttgtcccggggggacaggtccggtggagacgactggtagtcgagttcctctgataaccggtgaaggcga

SEQ ID NO: 14982 - DNA, 758 bp, Physcomitrella patens
  misc_feature (7)..(7): n is a, c, g, or t
  misc_feature (699)..(699): n is a, c, g, or t
  misc_feature (728)..(728): n is a, c, g, or t
  Predicted polypeptide sequence is orthologous to G852, G2633
gcggttntataagtccgattgtctggcactgttacatcaacttatgtacattgatacttattacgttaacatgtcgattgaagattgcgcatgctatgtgcctactcatcaccggcaattatcaccgcctcagagtttccaccgcagtcctcattcattttctaaatctacaataggcgcattttctaaatctacaatcacatatactggtacaattatggacaatttctaacctaattgttctagctccgattggtatttgattagccactagcaagtccaagcagatacgccaatcacgggagtttcttgccaccctaaaatcagggatgtcgattcctgcgacagtttgtaaggcattgtagcgtttgcttgctgcataggcttcgatgtcaaaacttccagcaacatctgcgcttgctgcacagtatacgaactgaaagccatggacagaaatcctgctttcgcaaacaagccccgccatgtctccgaccgcacatgtctcacacgccgcctatttcccttgaaagcaacaatctccttgatctcagcagcgagtgctgtactctcaatatggtatctatccgcactgtcgcgacctagagctccctccaaggaatcaaacagggcgcagtaatagtgcagcgcctcgacaaacctcgcaatgaacgaggcgccattatgattggcctcggcctncaacagtgtcaccacattcggtttcaggntgtggaacatgctgagcaatttatctaaaa

SEQ ID NO: 14983 - DNA, 690 bp, Physcomitrella patens
  misc_feature (688)..(688): n is a, c, g, or t
  Predicted polypeptide sequence is orthologous to G852, G2633
ataagtagtggatgcaaaattttacaaatagaacaggctagggccaggcagaagtctattcacaatgcgcaatcctgactaataggcaactatttacccaggactgaaattctagcgaaacgtagtcttcgcaactaagacagttcctcagcaaacacaatgctgaagcaagtcatatgagtatatacagcaatcacgaatgggatctagtgccacgcagaagaaacaatgagtggccgattcttccagcccaggaaaagggctccaccctcctctttaagcctgtatttatcactgtacgactccaacaatgtctttattgtgttgttcactgtttggctcaaagggtagggtcgaaacccagccatggtgaggcgcgcccgccatttgcccatcatttcatgcctttccactctgtcgatgccttcacaagcaataatattgacgatgtcacgggctaggcattgttgctcaacattaacacgctccttgctctctcgagctaaggttatatccaaggactcaaatatggcagagtaataactcagagcttccaaaaagcgtggaaagaaaggggcggtgttcgtattggactcctgctcgacaagagtcatgactttgggattgaggccttttatcatatgcagcatacggtcccgaggattgcttgtgcaaacgctctcatcangc

SEQ ID NO: 14984 - DNA, 753 bp, Physcomitrella patens
  misc_feature (698)..(698): n is a, c, g, or t
  misc_feature (742)..(742): n is a, c, g, or t
  Predicted polypeptide sequence is orthologous to G852, G2633
ctaggattctagcgaaatttagccttaccaaatgagacaggtcctcagataactcgaggctgaaccacactataagaatatatacagtgagaacagacgagatctactgccatgcagaggaaacaatgagggaccgattcttccagcccagataaagtgctccgccctcgtctttaagtctatacttatcactatatgactccagcaatgtctttattgtgttgttcactgtttggcttaaaggatacggacgaaaaccagccatagtcaggcgcgcgcgccatttccccatcatctcatgcctttcaactctatcaataccttcacaagcaatgatgttgacgatatcgcgagctaaacattgttgctcaacattcacacgctccttgctctcacgggccaaggtaatgtccagagactcaaatattgcagcgtagtaattcatagcttccaaaaagcgtggaaagaatggagcagtgttagtattagactcctgctcgacaagggtcacaactttggggttgagggctttgaccatatgcagtatacgatcccgaggattgcttgtgcagacactctcgtcaggcatatggtggagatgtagggcgaaattgactgcaagagcttcccccggctgccgctccagcatccatgcttctacctctggccctttcttcgctacaggatggaagtcgaanggaactccaacagcttccgctagtttagcaagccgcttcccaancatctcaacac

SEQ ID NO: 14985 - DNA, 690 bp, Physcomitrella patens
  Predicted polypeptide sequence is orthologous to G872
taacctttacttatacaacccccctacacggcatgtgtacacacacccaccttcaggttctttttatttctttacacaatgagaagttccttcaggttgtttttcatacatatttcttcatagaaggagaaattccaccactgattccaccaactccttcagagactcctcacatgatcaatagacaacactattgaaacagaagatttacagaatatgacacaactcccaaatatgatacaatatttgttcactgggtggtcctcggagcatgactgactgatcaagtcttcccttgacaaatgcgagtgtgagcaagcggagagatgtttagatttttgtcatatcacgaggttgtggatgccaggggggccataaagaccgtaatgctgagcgagtttttttcacattgataacaagcacttccaggggctgcgacacaaggtgggagaagaatccctccagaatgcttttcgagcggggatcgtagaagtttttgttttttttggcgcagaagaagaacttgccaacatctagagctcgagctgcctgcacaggcgtttcgtaagttcccagccatactttgctgtatttggagttcttctggcggcgtttcttcatgactctcgtctcacacgtccatttgttgcctttcttcacgacccccttaatcatcccagttgttggtaa

SEQ ID NO: 14986 - DNA, 698 bp, Physcomitrella patens
  Predicted polypeptide sequence is orthologous to G872
aataaaatagaaagaccctagaggaggttatcgacctcgcgattaatgtactgagacaatgccatggagacaactaccacgaccagatatccagtcaatgatatcatggtcgtaatagcccaaggtattgagagaatgatacgcaagaaaacaagctatttgttcagcataatgccgatgaacaagttttaacgtgatcctccgccaacttctgaatggcctttcttctgtccgatttggagaggctacgtacgtttacaagaggcccaaggtacttaggagaatccgggaagttgaaacttcggcacctcttggcactgcaatgatactttcctgcatcaaatgcaagtgcagcctccttttcggtatcataagagccaagccatactttctcgtttgtttgacctatcctgatctcggacacccatttcccatttctcctccgaactcccttgtacagctgactgcggttctcaccgaatcctctaattttctttcgtatgataggctgtccctgcagtggacgtttctccaactttttcctccgtacaagccttgtgagccttatacaggcgccgataattcgaaccatgactccccaacctcgccctgcattggcttggtgaggtgctaatacagcatcctccgcaccaatttcgaaaaactgtttgaaccactgcaagcggtcttcgaacttc

SEQ ID NO: 14987 - DNA, 714 bp, Physcomitrella patens
  Predicted polypeptide sequence is orthologous to G872
acactcttttaaatcctaccgacatttctaaagcggcgacatagtcaattctgaacagtctctgcaaagcgccgtgtttgcaaagcaaatcgacatcctacaatgtcaagaaaaaaaattcaagcggctgaattcttgagcagttctattgcgcacatgtataactaagaataatccgtttactaactcgacatcatccacggtctaaactgctctttatcaccaactctgaggaatatctaggaaacaaatcgtgaagattaaaaatggtgggtaccgatcaatgctgctactgtacacgtaacccgcagaatatctaccaagagtgactgcaatgctcatgcccttcctttcaccgaatgtttgtcgatccgtaagctttgacatgatcttctgcaagcttcttaactgccgtcttcatctcttcctcacgtaatttgataatattaatgtactgcgaagctccaagtttctgaatagactctcggaagttgaacttcttcaacttcttctggttgcagtgatgcaaccccgcatcatacgcaagcgccgcgtccttcttcctggtgtacgaacccagccacacttttatcttggttttggccaccctgatttccgctacccacttattgtttcgtagccgaatccccttgtatttgggggaatcttcctcgcccataatgctactcgaactagctccattctgtcttcgag

SEQ ID NO: 14988 - DNA, 813 bp, Physcomitrella patens
  Predicted polypeptide sequence is orthologous to G872
tgctcgattcttttatattgcaactttggaacttcctccgtacactgaaatttttcagattttaggcgaaatcctcagaactaaactacactcgccgtctaaagctggctatctagtttacaatatttaccaagtgatgtggttgtcatcgcataaatgacagatctaacaatctagttcttcaagcatctagtaatttccttcggcaaaatctttcgcgaccttcttgagctcagtcttaatcttctcaggagggaggagatgcagatctttcttaggcccaagtaattgaggagagtcaggaaagttaaacttgtcgtatctcgtagatgagtgatacttaccagcatcaaaggcaagggcagccgccttctccgtgtcgaatgaaccaagccatactttcctagatgaagaaaaaaccctgatctctgacacccatttcccatttcgtctccgaaccccaatgaacctttcactgtgatctgcactcctgtacctcgttcttgcccgtgcacgtcttcgaaatctccgcatcctcgacatccatttacaagcagaaaatatcctcttcatgatatgccatcctcgcctccccgtgctttggtcatgttcttcctcctcgtcgataacgcaattttcgacagcccaagcatacagtgccaaggtggaggaaaaaccgccaacatctctgatgccctcggccattgcactagaattgagctgcaagcccttcgagtcataacacagctcggagatcatatcatcacattcatcagcactccctttactgctgggcaagggattgaacgagtc

SEQ ID NO: 14989 - DNA, 726 bp, Physcomitrella patens
  misc_feature (15)..(16): n is a, c, g, or t
  Predicted polypeptide sequence is orthologous to G896
aacgtttatattatnnttttataataaaacatattacagacattggacaaactgttcgtttgtggtcccgcgaatattacaacttctcacattctggacatcttcgtgagctctcgttgagaatttgagtctttctaacttgagcatttatcaatagaactagtatgttgagaatttgagagtctttctaacttgagcatttatcaatagagctagtatgtcgtccagaccatctagggaaaatctttgaagtttcttaccaattcattatacctcttggttcgtgcccaatttctgatgtcaggcatcggtatccgctcttacaaaggaaatactgatttgaacataaccctcactaaccacaaaactgaagtgtgatggaagttactacttttgtattttgacgcaggctactgcaaattcctgcgactctgacatgctcaaccagggacacgaccttttaggtgtgaccgaggtttaaatgtacaagtttttaacttcacgagcaggtaaaccctttttacgattcacatactgcaataagcacttctcactcggccgccatatcagttaaatcattttaaatattacccacccacgtttcacgttcatagtctaaacggcgttgaaacgtcgaaacatcttgacgatgttagttgtggttccggcgtgtcaccgccttcgtagctgccaccttttagaagcatgtcaatgagtgatgtgacc

SEQ ID NO: 14990 - DNA, 742 bp, Physcomitrella patens
  misc_feature (287)..(287): n is a, c, g, or t
  Predicted polypeptide sequence is orthologous to G896
atttggaactcatcctcatgacaaggatactcatcgcgactgcggactctgagtgctcatctattctacaccatcaacccccatcagttacactacattggtgttacaactaccaaatcacaaccagaagaactaaatcccaagccctttacaaaatcacacccgatgtcgcaagcgtgaacattttcaagattgaaaattgtaagataaccctacaggtggaaaggagagttaatgtcaaacgcctcattcgccgtcaattgcggttcctgagtgagaccaccagncaggctaccacctgataccaacatctccatcaagcttgtgatagtccctgtacccattcccgagttcaccttagttgtgcgaattgcttcacgcatggcgcacaataaactaccatacgtttgagcgtggcccctttcaatcgcttgaataaagcagaaggtcattgcaccagttgacgtgatctttgacagtgccgaagtatcagccgatgtttggctgtcgtcacaaccactgaaagagtaagcttgtcctccactggtacctttccaacggcggttagctggccgatgatcctcccacgtaaattgaccgtatctattgaacctgcaaagaaacggcaagtcgagaacagttccactgtgacaagcgtcgataattgcatgaagtcgcacaccatggggaagaggcttgacgatagtatcattaatttcatcatcaacaatcattcctgccg

SEQ ID NO: 14991 - DNA, 783 bp, Physcomitrella patens
  Predicted polypeptide sequence is orthologous to G913, G976, G1753, G2514
atttctcttcttctgctgctgcacacgtgcaccatgcacacaccaccccaacggctggccataacagccatgaagattgattattattctgaacaaaaccacctacaacctaagtattaactccattgtactgctccgtgtgggcttcgcttcatgctcaagtggttggaactcgtaacctttaagcaactcattcgaacatcaacatcatggcccacatggattggcgagttcgcatccgatggtaattctcagccgaccagtcttgcttgcactgctgggtccaacctagaaccgacgccgctaacgtaaccgtgcctctgtctatctgtcctctctccctctttctttagccggaagaaggtactctcgcacgcttagcagccgaggtcgccctctgcttcacaagggcggcgaagctctcccacggaagctctggggggatggggtagagctgcagctgctgcggcgaatcctcgaaattgtaggggattttcttcttggtgtagaagatgcccacatcatacgcacgcgcggcctcttcaggggtttcatatgtgcccagccagattttgcgcttctgcgatgtgggtcgaatttcggtcacccatttgttcaactcaggccggtgccgaactcctctaaagatagtagtatcgccagtgccaacactcacatcatctgaatcccatgcggatggcaccttattcaaatctatattccgaaatttaagcgcattctgaccgctatcatctcttgccgctaaccgcattcctttcctct

SEQ ID NO: 14992 - DNA, 690 bp, Physcomitrella patens
  misc_feature (663)..(663): n is a, c, g, or t
  Predicted polypeptide sequence is orthologous to G922
ggttgcggtccatttcaccagattctctggttcagttaggctgcatatgtacaatgttgccagtgtgcattgcgcacaccaaacaatagatcagtaaatctactaacgttctaagcaggcactaatccgcaaataaactacgctaatagggccaagcatctacagggccaatcgttggtattagacccatcggcacccactcagagacacctactgatacacttttgtacatgagttatcctacttctactgtcattttcggcggctcctcgcgctagattgattcaactcgttgcgcatcgaagtcgccaggcccacaagggttagcaactccacgacgagacagccatgacgggggtatcttgccaccccatgatcagcacaccgaactcttctgaaagcttatacgtcggggtttcccctgtgacgaaatacccgagcagaagttgcgcctgttgcacggcatatgaactcaaaggccggttgcggaatccacatttcgtgaaatgactctgccaagtttcggatttggacgtggcgggcaccgcggccgctgccctccaaagcaacaatgccccgtatctctgaagctaaggtgatgttttcgatgcggaacctgtcagggctgtcgctgcttacagaagcttccagggcatcgaaganggcgcagtagtaatggagagcctccac

SEQ ID NO: 14993 - DNA, 847 bp, Physcomitrella patens
  misc_feature (4)..(4): n is a, c, g, or t
  misc_feature (20)..(20): n is a, c, g, or t
  misc_feature (24)..(25): n is a, c, g, or t
  misc_feature (27)..(27): n is a, c, g, or t
  misc_feature (30)..(30): n is a, c, g, or t
  misc_feature (32)..(32): n is a, c, g, or t
  misc_feature (34)..(34): n is a, c, g, or t
  misc_feature (36)..(36): n is a, c, g, or t
  misc_feature (45)..(45): n is a, c, g, or t
  misc_feature (48)..(48): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (70)..(70): n is a, c, g, or t
  misc_feature (77)..(77): n is a, c, g, or t
  misc_feature (81)..(81): n is a, c, g, or t
  misc_feature (84)..(84): n is a, c, g, or t
  misc_feature (88)..(89): n is a, c, g, or t
  misc_feature (92)..(92): n is a, c, g, or t
  misc_feature (95)..(97): n is a, c, g, or t
  misc_feature (103)..(103): n is a, c, g, or t
  misc_feature (106)..(106): n is a, c, g, or t
  misc_feature (111)..(111): n is a, c, g, or t
  misc_feature (116)..(116): n is a, c, g, or t
  misc_feature (122)..(122): n is a, c, g, or t
  misc_feature (125)..(125): n is a, c, g, or t
  misc_feature (128)..(130): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (162)..(164): n is a, c, g, or t
  misc_feature (171)..(171): n is a, c, g, or t
  misc_feature (177)..(177): n is a, c, g, or t
  misc_feature (197)..(197): n is a, c, g, or t
  misc_feature (203)..(203): n is a, c, g, or t
  misc_feature (210)..(210): n is a, c, g, or t
  misc_feature (221)..(222): n is a, c, g, or t
  misc_feature (224)..(224): n is a, c, g, or t
  misc_feature (238)..(238): n is a, c, g, or t
  misc_feature (241)..(241): n is a, c, g, or t
  misc_feature (250)..(252): n is a, c, g, or t
  misc_feature (255)..(255): n is a, c, g, or t
  misc_feature (258)..(258): n is a, c, g, or t
  misc_feature (265)..(265): n is a, c, g, or t
  misc_feature (272)..(272): n is a, c, g, or t
  misc_feature (275)..(275): n is a, c, g, or t
  misc_feature (282)..(282): n is a, c, g, or t
  misc_feature (286)..(286): n is a, c, g, or t
  misc_feature (291)..(291): n is a, c, g, or t
  misc_feature (295)..(295): n is a, c, g, or t
  misc_feature (300)..(300): n is a, c, g, or t
  misc_feature (312)..(312): n is a, c, g, or t
  misc_feature (318)..(318): n is a, c, g, or t
  misc_feature (326)..(327): n is a, c, g, or t
  misc_feature (337)..(339): n is a, c, g, or t
  misc_feature (347)..(347): n is a, c, g, or t
  misc_feature (352)..(352): n is a, c, g, or t
  misc_feature (357)..(357): n is a, c, g, or t
  misc_feature (361)..(361): n is a, c, g, or t
  misc_feature (367)..(369): n is a, c, g, or t
  misc_feature (373)..(373): n is a, c, g, or t
  misc_feature (379)..(379): n is a, c, g, or t
  misc_feature (389)..(389): n is a, c, g, or t
  misc_feature (393)..(393): n is a, c, g, or t
  misc_feature (397)..(397): n is a, c, g, or t
  misc_feature (400)..(400): n is a, c, g, or t
  misc_feature (404)..(404): n is a, c, g, or t
  misc_feature (407)..(407): n is a, c, g, or t
  misc_feature (415)..(415): n is a, c, g, or t
  misc_feature (427)..(427): n is a, c, g, or t
  misc_feature (436)..(436): n is a, c, g, or t
  misc_feature (446)..(446): n is a, c, g, or t
  misc_feature (514)..(514): n is a, c, g, or t
  misc_feature (536)..(536): n is a, c, g, or t
  misc_feature (540)..(540): n is a, c, g, or t
  misc_feature (552)..(552): n is a, c, g, or t
  misc_feature (575)..(575): n is a, c, g, or t
  misc_feature (587)..(587): n is a, c, g, or t
  misc_feature (619)..(619): n is a, c, g, or t
  misc_feature (664)..(664): n is a, c, g, or t
  misc_feature (845)..(845): n is a, c, g, or t
  Predicted polypeptide sequence is orthologous to G938
tgangcaaatcgataaacgnccannangtnantncnggaaatccnaanttggcatnanananaacntgantttgaangacntcngccnngantgnnntacaantcntcacntgacngtggcntcntannngcacngangangtgaggantcgnaantgagannntaaccantagaantcctaaaagtgccaaggcangtgacntccacantgaaagcaacnncnttgacagagaagantcntcccaaccnnngcntanttcaaanggaccangcnttcaaangtcntccantaantgaantgtttgccaccntgcagnttttttcnnacaggtgtannntgaacaantgcgnttcantgcnttgcannntcangaagcntttggcagcntgcntcangcntgantcnttagggcnttgggtttccangaagtaccnttcccaccgnaagaatgaaccccctcctttcctgaaatttttgaatccctccaagaagggggtgaaagggggaagcantcccgccccgaagacctgcaantgantttggacaccangcggttagcggtcgaaaatgccnatcctccgccanttgatggtcaatctggccttagaatccggccnagaatcaccttgccttcctttcggtgccaagggtgggtggtcaanttccaaggtcctgcctcgcctcaatggtggttttaccttggctcctccacctgcgtttgaagaagggaggcaagctcctgaatggtcgaaggagagcgagacgacccctcccggaggtttgaagcctgtaagcctgggcctccacctccatggtggcctcaggagaaagcggccttgcggncc

SEQ ID NO: 14994 - DNA, 790 bp, Physcomitrella patens
  misc_feature (712)..(712): n is a, c, g, or t
  misc_feature (787)..(787): n is a, c, g, or t
  Predicted polypeptide sequence is orthologous to G975, G1387, G2583
atggtgtgaaaggaaatcatccgcaatgcatgatgcaaaatgatcttagtcacaacgcattttttttattattattattaagattttctaatttcagagtgcattgcggcaaaacgccttcgcaacaatggatcgagtatctgtctacatgcaaccctatgttgctggcagggaccttctggaacttacgccagaaagaaaccccaaagaatgatagtgaatcgaagagtaaaacaattactctgactatgtacaaaacttccatgtcatttgcaaaaaattcctcgagcatagccgatgagttggagaacagaacacaattgttcgtgctcatcgcacatttctttgccgttgccgttgccgttgccgtgaaagtactcgggcaaagaatagcgactcatctctgatacggcgggctacaacaaaaccgtaagatctactcttacatgcacagaaaggtctccgcccattcggaaatgagaattagaagaaaaaccatagccctcgccccgaagtagaccaatttcaccagatcaccacagaaagaacatcttataaccctctgtgacgcttcgcggcagagacggcttgcttcttgacaaaaggagcaatctcctcccaactaccgcaaggcaactcggggagattttccattgaatcggggaaattcaatggtatcttcttgccagtgtaaaagattccaacatcgtangcccgcgctgcctcctccgccgttttgtacgtccccaaccaaatcttccgcttctgcgccgtggggcctaatttncgt

SEQ ID NO: 14995 - DNA, 535 bp, Physcomitrella patens
  Predicted polypeptide sequence is orthologous to G977
acgactatctcctacttctcttgatcggtagcttgttgggtagctctcgcacttgtgaagtatagcattcctcagctccccacaatctcccctccccacacacacacacacaacccaaactacttcgttgttgcaagacgagaccagtgcggacagatacagagtgtgagtgtgtgtgtgtgtttgagtgcgtgtgtgtgtgagagagggaaaactagcagtagtgtttgagttggtggagatcatgggcaggccgcagagataccgcggggtgcgacaaagacactggggatcatgggtctccgaaattcgtcacccacttttgtatgtgactctgttgctgcttcctctcccactcggaacttctcatgttggcttgcttgtagcattgtgagtgtgtgggattctgttaagtgagtgacaatttacttgcattggttgtgggggagctcgggacgcttgtgaggatgttttttttctttttgtcttctctctctctctctctctctctctctctctgtttttttcatttttt

SEQ ID NO: 14996 - DNA, 759 bp, Physcomitrella patens
  Predicted polypeptide sequence is orthologous to G987
ttgggatatttcccgtactcagttatacaaggaacatttacatagctaggagcacttagcagtatctggagtatcctgggatttcagagcttttcaagtcaagacccttgaatccttacggagctgacaacgtaggatgggacatggttaaattaccatgtcctcattcatggctaccattataaaagtagtaaaaaatggtaatgcttctggctaatattggtaacttaaaatatttggcagaatgcaagcacgttgttagcttgagatgctccacctatgtgaatggagcaccaacagaacggctctcactttgttacagataagctggcatcattctattgttacacgaacagagatcagttcctgtgaaacctgccaccatttaccatgaaagtgattctcagcatcggctaattatgctgcctactgttgcgttcaaaggagccagctccaatctcattcttcaagatgtggttgttcgatttccacactccattcttcagcgctttcgtgagtgttgtttacgaggtgaggctccaaaagctcgccttcaccttctatgtactggtcggcctcttccacgtagtgaccgttttccatagaagaatctttgttcaaatgtaagtcctctacctcaccagtcaagtcacttagttcaccattgatgtaactcagatattgcgaggctggaagaaagttggcgctctgctccttgttcttgacttccgcatcacaagccaattcccaatctggaaa

SEQ ID NO: 14997 - DNA, 670 bp, Physcomitrella patens
  misc_feature (666)..(666): n is a, c, g, or t
  Predicted polypeptide sequence is orthologous to G987
caaagcctctacaaggaattgggggttgggtactagcgcaaaggcagttccagatatagtattccagatacatcatcctccctctcagctggatatggtacaaggttgacgtggtagaagtggagctttgagaagactgcgcatgtgagaacaatgagaagacaacgcatcatcttcatgtatcccatcaaggcagaagaatcacattcaaacccaattataagatccatgcactgactaccacgtccaagtaagtgagggtatactaggaatgtacacaaggatgcacaatgagtctaagttgtgagaagttggaacttatgggctcccatcgcggatgggctcccaaatggtcatggcgtgagtgatgtggttcttccacccgatcagaaaccagtgaccgtcatgtccaacgccgtaatctctgtgataaactctcatcgccattttgatcttcgccatagtctccccactgctcggtatctgctggaacccagcacgcgtagtgcgcgcctgccattggcggtaggtttcagtgcgctccactctctccagcccttcgcaagcgaccacgttcagaatctctctgccaacaatctcgtggtctatgagttgtctgtctacatgatctggagggaacgaggactccatcgcatcgaatattgntgag

SEQ ID NO: 14998 - DNA, 747 bp, Physcomitrella patens
  misc_feature (721)..(721): n is a, c, g, or t
  Predicted polypeptide sequence is orthologous to G1017, G2567
aaatcattccatctcaaaccctggaacgctttacacttgtccacttcggcgaaagctgtattacacacatataccctgcatggcttccactccacccttgtgtgaaatcgtacgttcggtttgtgcaattcttatccacaaccctcccgtgccacctcccccaccataatctacgggaacacgtctcacactccacccattgcaacgaagccagccccatcactcattactgccggtacgtacgttcttccaaatctactcttatatcatgtaaaaaagacctactgagctatgatcgcacacccaaaacccccatttgccttcttcacggaagaattgtcagccgcctcacggctgccacaaagttcccgtatggctccgcacccactggcagcgtacacccctcgccatcctggtaaaccactcgattcttgaaactcgctgccggaacgctgaacatccctgccaaacgatcgtacacctcctcatacgacttgaagttcgccaggtccagcgtccgccccacctcatcgccctctctgaacaccttgcagtgctggagcgcctcgttcgaccccttctccttctccaaccgctgctccttaaaccacttcaagctccccacctccgtcccaatcgacagctctggccacggcccgccctcgttctgccggtaccttgacatcgccccatcccccgtccctcccgacgcgccgttcangtccgcattgaatctcctcatcctgt

SEQ ID NO: 14999 - DNA, 550 bp, Physcomitrella patens
  Predicted polypeptide sequence is orthologous to G1033
gaccaccttccgcatacttcattttcatggagactttccggaaggagttcaaagcagcaaaccctgatgtgaaaggagtcactgcgagcgctaaagctggtggcgaaaagtggctcagcatgtcagaagaggagaaagcgccttacgttgctgaggcctctgttaggaaaggccaatatgagcaagccatgacagcctacaagaatggcaaagccttagagtcctccctgtagctgaaatggcagacgaagtccagttaacaaaaatgaccctgtggttttcggctttccaacgactaagatcaaatttaatgcatataaatcatctgcggttgaaggcttataggtacacagattcttgttgtttagttttgatatagaagcagatacggagatttttcaactccaatgttcattgagcacagtgcgtacatcagctctgttttcaggctgtgttgaactcttccacagtaaagtgtctctgaagctccttgaagatgtttaagccttttgctcggtaatattcaagttgaactatgtcacaagtctac

SEQ ID NO: 15000 - DNA, 531 bp, Physcomitrella patens
  Predicted polypeptide sequence is orthologous to G1052
ccattgtccacctctgcgccactgcattcgcctctcctcctcgccctcgtgcttcgtcgaaagctgtggaagatttgccaagcggatttgagggcatttgccaagcggttgatgagacagggggggtgatcaatcaggaaatttcggcgcagttgagtttcgaaggaaagtgtcgcgagtgtcgattgataggtcgcgattagagttagttgattggatatacgatgcttgagctgggaagttcggtgtgatgattggattggcgaacgatcgactctgagattgggctgaatcctagactagcgggcggggacgtttctaattaagtgatctgaattcggtgaggttgaatttgaagttggacgtgacaaactttctacgcgatttttcttttcgatctcgtcagcattgctgaaacttcgtcgacaagagtttgacaggatcgtgacgccgacaaattctcaatgtctgaacggaatcggaggagcgatacttcctcatcgcagtaccgaggcgtaagaatgcggcgat

SEQ ID NO: 15001 - DNA, 770 bp, Physcomitrella patens
  Predicted polypeptide sequence is orthologous to G1062
atgtgaattagaactcttgaacagccatttagtctgatcacagaaggtgcaatagaaaactggtgagcatccatgcaagtagacaaactacatatataatgagagtactatccagaaagaaagtctagagcaccctcaacgaaacagaatgctactctttgctgctcattacatgcttacaaccgaatgcttgcaaatcacatcgttgaagcactgtcctaacaatttagatacccagttctgattctgatataagtatttttcgtttgttgactctccacttttctagagtttccatggagaagaaaacaactggattccaacaactcagtcacttgggatcattctcagaaagatcttgacggatggctcggaagatgagctcttttactgcctcctcttctgcttccaaaggtaggcactccgggccagcgtgtagcagcatggtctctttctagcatctccaggctgaaagctcggaaggaaacgttttcgcaacacatgatactgccttgcattacactgatgctcttcgagtcaagcgcggcaaggatgtcgatcaaaagccctggccggtttacacaagcaatgcacaactccaatctcccattgacgcgtttcacttccacctgtggatgctcataaagaacatggtttgtggaaccgatgtctgttgtttgccccccaacctgcgcatttggagggaacgcccctttacctttgcttgcagggttattctctcgactgctcggtaatattgattgcaagat

SEQ ID NO: 15002 - DNA, 468 bp, Physcomitrella patens
  misc_feature (324)..(324): n is a, c, g, or t
  Predicted polypeptide sequence is orthologous to G1067
cgtggagtgcagtttggccttcctttaataatatgcccttgtgcctctcggttgctgccttgtggtgttcgcatttgataagaaggggtctgatgttggtagtactcccgacgctggtgttctcgatggtagctcgcaatattagccagttgagcatgctcaatattttggttctattatcattgcctgcattctgctgtgtactgtaacgttatcattttgactgatagatttgaaaggaggcgtgttttgtccatgcacagctcacaaccctccgatttgagacagtgaaatgatctttcttatgttcaggtgatattgtanttcacctgactgagtgtagaaatcatgggcttttataagccttgacaagtccattaaagaattagtgataggttctcccaatctatccatatattctactactcaataaaagatgaccttgttccgaaaaaaaaaaaaaaaagt

SEQ ID NO: 15003 - DNA, 607 bp, Physcomitrella patens
  misc_feature (579)..(579): n is a, c, g, or t
  Predicted polypeptide sequence is orthologous to G1075
taccttatcagtacccttcagaatccttcctttggttatttaaagtcactttacatcttccctgaaagtaggatgtaaagtaaaagctagacacgtcacgccgcggatctcaagtaacgagcccggttaagcgataagtttatgtgtgttccgcttcttcgcggtttagaaatttagcgatggtggaatatcgttttcgtcttctctccgtcgcccagtcgtagaaggaacatcctccaaacaacggtcgatgtgttgcatttctagggctcgagctcgagctttcaatttcgagacgacgatgaaatagacgattgcaatggctccggccacaacagccaccaccaccacgacgtaacccgtgtgacttgtggttgtcggcacgatgacaaccccttccgccttaacggggagtatgagtgatgacatcaccagcggaaggccggttttagtccacagcgatgactttgtcctcgctgccccgtagtccacggcgtcctcattccatcccgtgtcatgcaacccgggaaaaccgttcacctcggcccgatttccacgttgcgcggctgcggctcctanggtggatgtacagccgtcaattgccgtg

SEQ ID NO: 15004 - DNA, 605 bp, Physcomitrella patens
  Predicted polypeptide sequence is orthologous to G1075, G1076
attgcgctgcctgctggctgttcaggttcggattgctctgtgggactatgttatacaagttttgtaatgcagtcgatgggttataagaggacaaatccggtgattgcattgtcggtgcagctgaagctactgtcacttgcagcatcggcggctcgtcctccgctagcggaagccgatcatacgttgcgcccgtgaacgacgtcgcaaccaccaaaactgggctggccgccatcaacgctcctacaacacacccacccaaaacttgccccgacgcccccgcaaaggaaattgtgagccccgttgtaagccctgctggaggagttggagacggtggaggcaaatacgacccagagagcgagatgatttcaaagcggccgtggatggtaacagtcgccccgggcgttgtagattgccgtagagtcacattcgtcacagtcccgcttccgcccatgacgcaaattcctctctgtcgccgacgagcgaagtctgcaacgctctcccaaacatcatgcccacttgcaacctccaggatgtggggtctcatggcattcccgttctccctggtgataataactggaggtttaggtttatttttggagccagga

SEQ ID NO: 15005 - DNA, 646 bp, Physcomitrella patens
  misc_feature (632)..(632): n is a, c, g, or t
  Predicted polypeptide sequence is orthologous to G1084
gtgatgtttgggagtctccaacgtttacatatgtaaaatgcctcctgatctaacaacttgtggtttaattggaagccttttggtgaacaagtgctcatgccaatgctgcagcgttgaacttccccgagatagttcacgtttggggaaagcctgatcgccacggacaaacttctataaggtcattactatcattggccaaaaatcttactcctgaaaatcccataacaccatccttggactcggcacttcgcattcatgcagacgcaatcctgtaggtgtcccagccaagggactattgaaactagtatgattcgcgttggtagcactgctcgagctagagtactgtccaccgtaccctggcaacgtctgctgggttgtcatgtccagaacagaaccaggggtgctagtcgatgacgttgtggatggcccactgaagttcctgtagccgaaactttctggcagaggtctctgttgattgtatccgagattgatcctcacatccaacttactcggcgctgatgttgactggggtctcgacaaatctgatccctgcatgtaggaaacttcagcgtggctttgagcgagctgattgtgcacttcggaactgaaccggctgagcggcagttgcgaancggcgcaactggga

SEQ ID NO: 15006 - DNA, 726 bp, Physcomitrella patens
  Predicted polypeptide sequence is orthologous to G1089
cgtctgccactgggtttggctttcaacctcctccccagcagcatcaacatcagcatcagcagcatcactctcagcacgtgcgggacggcgttcactcgtgcaacgaaaacgattccagtatggacatgcatgcggatagcgttgctgaggactattatcgctgacctcatctcagggaaggtcggcatgcactatcgggtatcaccaccggctttctgacatgatgtacaggcaattttcagagacggtggtttgctaattcagctcagtgttagctattttgtcctcacgaacgccttcttggtgtcatacagatgacatatgtttccgctaattatggctcctgaattgtgagtattggagatgtatcaactgcgagggttatcaagagcttgtgctggcagaaaagattgtaagaagtaggattggattgtgctcaaagggaaccattacactggtggttggtaggtggttcaaatgtgggtggcatgagctgccgccttgggcacttagcaggtagattgaactttaaataaaactaactagggtcaaccttgtatctgttgacctgggcttcaataatggagtcctgggaagtcgttgccaagtgttttgtagagcaatgtctcaaggaaacattccatctcaatggaacgattgtaacggaatgcgatcgctttacaggttgatattacctcatagagaattatagaggcattgtaatgg

SEQ ID NO: 15007 - DNA, 663 bp, Physcomitrella patens
  Predicted polypeptide sequence is orthologous to G1108, G2394
aactttcgattcatacaactcgttctgatcacaaagaatggtgaattcggtgccgcctgaaagcgtcgcactcacacaggaccacacatgtcggcaacaattattcaaaatctcggatgctgtctcgaccggtgcaagtgcaggttaacaagctaggttaaggacttccagttcagatttgtctagtctacgccatggcctacatcactacctccggacgatagtcgaacattgacgatagaccgtagtagctggctctggcgatgactcgcctccgaacgatgtgtaaagccagattcccagcaggaggagcaaccagtgagctccataatctagcaatatcgacatcgtgcctggctggttgttccggttgcgagcggtggtggatgttgcagtacactaaggggccaccagggccataggaagcgccgatcctcctttccgatgcgccaaggcgaccgtatacgggactcctggagtttcctgcaaaaaactgaaaccagagaagtattgcgataggcacccacatgagagaaggaaggaagggagctggcttctccttcggtggatggtatgacacactgcgacattgcatggtgggtttcggcgcctctttgtacgcaattgcaacgagaagaacaaaggcaagaattatggcgggca

SEQ ID NO: 15008 - DNA, 725 bp, Physcomitrella patens
  Predicted polypeptide sequence is orthologous to G1134, G2555
ttgatgaaagtttaactttcaaagattcaggaaacaatctccagggttgagacgacggaatgatatgcagtttgaataggctaagcagggggctcctctagaacccaacagctaatgcaagcctaccatgtggttttggcaaggtgaatacggttccataccaactacgagatagtttacagtgaggatgcactcgctaacagtgcaatgatcagttgaagtccgtgtgttcgtccgtcctctgtcggaattcaaagtctgggattcataagtggccttcaaaagatgacgacgacgacgacgacctagatgacggcgagtgatgttgatttccctcatccaagtcatacaggagctgcagacataaaagcacactgccaaacccacagaggctctgatgtgtatctccgctctacgaggaaggaaggtatgatgtcttcgaaaggacgcaaacaaatcccaaaaactgtaggctcagttatgccgtggagtggcaattgccaatgcccgctacgaagggttccaaggaattaaacgtccgcatgaatccactttcatggagcaaacttggtgtgttgcagaatcttcaactcgcggtttgtgctctaatgctgttcttcaaacgcacaattgtctccgaaagatccttcacttgagtttgtagatgctttacgtactcaaccgcttcgtcaagcatatctgctgtgtttgtttgcttgtccatg

SEQ ID NO: 15009 - DNA, 758 bp, Physcomitrella patens
  misc_feature (756)..(756): n is a, c, g, or t
  Predicted polypeptide sequence is orthologous to G1136
acagaaggaagaatgtatctgctcaccttcaaccccattgtacacccagctgacaatcgattaagagattcctgtgcctacattcgagttagaaaaactatgtttcctagataattaatttcctctaccaaggtgagtctagagctacaacctaatcaggctactgctgagaaatgactaaattttctacaatttccaattgcgacggtccagtatacacatccttatatacaccaaaaggacagtttttgggattagggaggattgcctagtttttgcaaagccgtgtcacttccttcccgcttcgtcaaatacccagtggcttgatcagacctttcaagtaacgcagcgagctgctcctgcgtgtacctttcagttggtttcatcttagcaacaacaatatgcaagatgtcatcacttgtggaggatgtattagaatgttgtatgtccaagcgcaattcttgcagggccatcatcatgttgacaacagagtaagcatctcgcacgcagttgactcgtatcattgcctcctctccgaagacgttcacggcaatgctgaacctcttaccaccaggaaatatgccaaacacaggccgagtgccattcctctcaggcttcagttgggtatcgtctttaggtgcaccaattacaagagcctcttggccacgctcgcgcttcgcactgcaaaccctctgaaggtcctttatgcgcatttctgcgtcatgaagtttctcctgcaggtagttgatgtgcgcnat

SEQ ID NO: 15010 - DNA, 431 bp, Physcomitrella patens
  Predicted polypeptide sequence is orthologous to G1146
atcatatagctctagttcttggggcatggggcgagaccttttgcagaagaatgaagaacggacaagtctaaacaaggatttgcccgaaagcgaacacaacccggacggacggggtcgaacaactgacccgacggtcgtcggatttcaccaggacgaagaccggcattgggtcgccgagctttcctgtggtcacacccagcacttgcgccaccagccgccctggcaatcccgggcctgggtcacagacccggcgcaacgccttgaaaaaatagacaagccctttacgtgcggctggtgtgcgcaaggctcagataaagataaccttggcacctgattcccggtaggcatccaggcataggccgccaccgaagccatgcacctccagagaattcgcatgcagactttttttatcgcgccaaaaaaaaaaaaaa

SEQ ID NO: 15011 - DNA, 549 bp, Physcomitrella patens
  Predicted polypeptide sequence is orthologous to G1146
gctttgtcacttcctttgcctccgagagcgttgctgcgctgctgttccttttctattgctgctctcacaggacgtgtggttcatcgttgcggagttggggaatgtgatatgaaggtatctgcggctccgacgcgttgttttggactaatttgttctgttttcatgctcttgcgctcggatccggggtgtgtaatgaagttcctgttgcggtttgcgacactatcgtgcctgtgtatagttcagtactgccggattggagtggcgtgtccatcagcttcggccctttgttgacgcggcgttttcggtcattagattgagaagaaggtttggcgccgtgttacaaggtagagagacggctggcattagtaacgtgaattgaagttgaagcaccagggaccttcccgagaatttcagtttgcctcttgaagaagtgtgggataggttggcgaacttcagttagtcaccttgtggagctgggaggtctgctttaaactggaaagccgaaggagaagtacgttagtcttaaagatgttgccatgtaccaagaat

SEQ ID NO: 15012 - DNA, 334 bp, Physcomitrella patens
  misc_feature (231)..(231): n is a, c, g, or t
  Predicted polypeptide sequence is orthologous to G1150
tttttttttttttttttttttttttatccaaataaataattgaatgtattaggttgagacacattcatgatttgaatggaccatgtcaatcttcctcgagcttattagaggatcacaaaactgactctttaattacattgtatggccgaattaaactattctccggcggcttgcaggatgaatcttttttttactgcatgcactttgttccaaacgctgtaatttgcgtcnggcccccaacctccccgcattgatttttaaacatttcaactgcctgcgtatccctcaagaaatataaaacattcctcccatgcctcccattcctcccattcca

SEQ ID NO: 15013 - DNA, 785 bp, Physcomitrella patens
  Predicted polypeptide sequence is orthologous to G1190
ttgcaagagttcacatccttgaaacatcatatataatatgaatctttcactaaaattcccagcgatatctagagtaccaagtcattcttgtgttaccatgctatcatgtgttgcaaaaagctttccagtaacttgttagaagtacaagacggcatggtatccagcgcgctgaagggctggtagcgattatacacaggtatgacagtggtagaagagtggccaccaaatcaagggtcacataaaagcgggccagcgaaaatttaaacagttgatgcttcggatgattcccagaaggttttcttgcagaatagtagaccctcagtgtcagcaggaccaacctcagtgtcgtggctagagcatttccatcgcatggcctctcccaggactttagcattctccctaaagtttagggcatcacgcagcacgacaatgccctccggtctaaggatacgatctatttccagcaagacatctttcatctcacacctgtggctttcagccgtaaaaagtccagcgacgtggatccaatcgtacgttcttggatacgtggagaatgcctcacaccagtcgtgcactgcgccaatcaagccccgatcatagacgatgcctagtgtgttggcagagtacgaggaaacaacattcatgacccacacatcagaattgatgagagccgctccaaaacctccaaattctgtgtacatgtccatgacattccgtatctgcttcgtcctcaagtccgcccacaagttcttgtaatgcgacattctttgctgccataatttcgt

SEQ ID NO: 15014 - DNA, 747 bp, Physcomitrella patens
  misc_feature (710)..(710): n is a, c, g, or t
  Predicted polypeptide sequence is orthologous to G1190
attttctcagatgccacactactgcttccttaaaaacaattaaattagaataggaagctgtttcagaaagacccacacgggatttgttttcttgagcaaaactatccaacttcctacaaatatgtgtaaaatcaatgaagctgcagcaacatctgagaaaatgcatttaagaaaatctaaaaaacccttgaatcgaactcgtgaggcgaagctccgggcctgatccgatgggggccacagtgccagccctctatcttagtctttccaatgttgatatttcatgcgggatcactgctttgaatctctctcgggacaaatctctgatcgatggtgagcgatatactcgcagaaattacgacaaaactccccgttctgtggcaccgacaactgcttccagactgatgtgtttcttttgttatcgatctctaggcctccagcagggcgacagaacgacgcccggccacgaaatgagagcactcagacccattctcagattgtgagagagctcgttgctttactcttcatcgccgttgctggccgacttcgcttgccagaaggacttcctgcagatcaacaagccatcgctgtcctgaggaccccacctcggtgtcgaagcgggtgcactcccaccgcatcgccttgcccaataagtcagcctgctccagatacgcatggccgtccctgaagatcgtcagggcgccgggtcttanaatcctgtcgaactccaacatgacgtctttcatttcg

SEQ ID NO: 15015 - DNA, 612 bp, Physcomitrella patens
  misc_feature (39)..(39): n is a, c, g, or t
  misc_feature (291)..(291): n is a, c, g, or t
  misc_feature (506)..(506): n is a, c, g, or t
  misc_feature (586)..(586): n is a, c, g, or t
  Predicted polypeptide sequence is orthologous to G1202
ttttccccttttttacatatatatatatatgttacattntgcacacacttctaacaagaagactgtcaccgttggaattcacaaacatagagagaatgtggctattctgcactaataaagagtatctttttacccatctttatagctactaaaacagtagcacatctgtagcgctcaagatgttcaccgctgccgccgttactaggcgggtggattaacgttacctgttgcagacttacacacagaacagcaaggtggggatcacatagatcctcagctgttaaaatgcanatccagtaggactgcaaatccacaagccacaggtcctgttgggtcagccttgctcctgcgatcacctcatctgccgttagttagcaaaaaactgaacaaactgtacacttagatgtgtatctattagctctggaaacagaagcatgcgtcccggtggtttttgggtgcagtccctgcggccgctgtcaggagagcgccacagattgttgtgctgngatggctccatggtgtgcttgtgggagcgcgttcaggaggatggacgccagcccttgcccccgaactctcccaccacctncggtggcgtggttgccgctgttgtgg

SEQ ID NO: 15016 - DNA, 742 bp, Physcomitrella patens
  Predicted polypeptide sequence is orthologous to G1206
ttttctttgactttctcattgtcatcgtactcaggaagctttatgtgtgctgattcagcctgcttacccccaggctggagtccgtgacgaagctcgtgacagcatcgaagacagaggtcgtaaccgcattctttacaattcctgtggtagtcgacgattgaagtgctacaattattgcaatacaaacgctcgtccattgaaattgctgcccgctccacatttacagcaggcgttccttgtctactgcgctcgaccttcagctcctcacgctgctcctggtgcagtttctgcaagcaaggtagaattttgaccaggcaatacagcaaaatcttcttggtttcctcgtcagaaagaggtgctttctccagggtaggcccactggaacgaagacaggccttgcaattgcagttcccacgacaccatgggcaattttcaactacatcgtcaaatgtcagcaagggataccaattctcaatacaatcggagcagaagcgcctgcgattacacttcctgcaaaaagcaaccttctccttcttgctgctctggcattggcggcacatgcgaacttctgtgaaatcccttccctgtcttccatatatcggcttcgaatgatcacaatcactgttgtcgggctcctcagccttgctatctgcagcccgagcatttcttttcctttgggattttgcagaatcattggggactttcagttaccttttccttctttaccctgtgaatttgctta

SEQ ID NO: 15017 - DNA, 753 bp, Physcomitrella patens
  Predicted polypeptide sequence is orthologous to G1246
taatttcctattgatagtaataatttacacttctttacttgtagcagacaattggtgacacaacacagatctccatgatttagtcatggagtttttgactctacaggtgattacatctcatactcaattgcagccccagacaatgatttaggatatgtatccaaatgagtcgcgtggaccctttccgcacgctcactaagtgtttgaaggtaacgagtcctgttcaagaaccttactaatctgatctcaaagtattcttcgatacggctcgactccttgcaccgtaacaaccgaaaagcgagtactttcagcggaaagcctaaacggtaactccatgctcaagctgataaagtggatatccttgcaaacgcagcattccaaccaaccgctgagacatcaaagtaccttacaaagaacaaacatgtcctcccagagtatgtttagtgacaaaaatcactgaacctctcagcccgatccacacgagtcaagggcttcgttgagaatcgtctccagtacttccaaccacgcaactccgatcttgtgtgctcagttgtgtcactgagaaggccacgagcagcaaatcctaagcccaaaaacgagggagtatccacaaatcctcggacccttgacagaatagatggcttagatataggatcccagtcatccagttcaaaaaattcctccatctcagcctcagaaattttctgctctgaagtaatcaactctacgctcatattcgtttgttcctctgta

SEQ ID NO: 15018 - DNA, 774 bp, Physcomitrella patens
  misc_feature (721)..(721): n is a, c, g, or t
  misc_feature (773)..(773): n is a, c, g, or t
  Predicted polypeptide sequence is orthologous to G1255
cctcatgatgtataacagcttttgtatacagctctttctttacctactgggctggaacctggtgtattacacatcaccagccatatcactagaaaaactactactccatcgcctgcttggatccatgctcttagaatcaaaacttcctactagcaggtcggaaaattggaacgatctagatcctcctcatgatataaatatggacggtgctgagggtgtgcaccacttgaaaaatagcttaatcaaccagctatatttttgtctagtaggcgagcttggattgtttgcaggggtcccattcacgtccagcattaagctagaagtgctctcattttggttaatgcttgaggtagtcgtcacacaatctgtatcacctcatgtaggaacgacgttttgtcatgagccacctggtgtttgcttgacgaatcggcccttcatgcgagggcggcgctcagcgttgagcttgcgcacttcgtaacgaatctttttggagaagaggcgagttcgccgtttttccttgtaacgcatcacacggaactctcttcctttgtcgccggctgctagtgttgctccttgagcgtattgagtattaatatctggcaccaaacctacgtccgttcctccctacaaaaactcgaacaatcttacaaacctgaaagcctaggtacagtttattatggaaagattacagtagtacaaagcacttttcagcattcgctangatccaaagtcctacgtcatctttggaggcaagcttccgtaactaatcctgnt

SEQ ID NO: 15019 - DNA, 557 bp, Physcomitrella patens
  misc_feature (242)..(242): n is a, c, g, or t
  Predicted polypeptide sequence is orthologous to G1317
taactgttacgaactccgggatggccgggggggtagaccaggaccagaaagtttccgcttgagatctggacctgcatcttgaggtccttccatggattgttgcgtggccaaatttcttagcgtattaggtttttgcgtatttggattcagggagcttgttctgagccttgctgcattcaggcgtctagaaaggaggctgcttggattaaggggttctggagttggaacttgttttggttcancagccaggtcggcgtaattctgcaataaccttgaaaggtctggcagagggaactggggaagaccttgtgggttgttggtgaacggattcttcgaaagtcctcccgcaaggccctgctgagctgcattgtaactcatgaactgctgaatcctagcctgcaattcaaattgtaatctcacgagttgatatgccatgatcatgctcacgttgtcctgcagcctaggaggtggttgggcaagattgaatggaagcgttggccaagctgaaaataaattgccgagatttggaaggtgggccaaattgtcctgatgtggtc

SEQ ID NO: 15020 - DNA, 405 bp, Physcomitrella patens
  Predicted polypeptide sequence is orthologous to G1326
gactctacggtagtttttgtatataggacgttgagatggtccgactggcggccgattttcagtgtaggggcacgctttccttgaagtgctatggatccagcaagggtggaaatggcttttggagtaggttttttaatttaattttaaatcatcatcaggggtctgtacttagaatgtaaagttcattggagagcgcaaattatcaagaccaagtgcacatgatggttgacggagattgtccaagctaggttgtgttcggtcaattgagttggctgacctatttccattatcagtaggcctaatgaagctccttcttgctgcgccattgagctacggagtggcattccaatcttctggaccgtgtggtatttagtattatcctgtggacttgatagcacggatgga

SEQ ID NO: 15021 - DNA, 754 bp, Physcomitrella patens
  misc_feature (738)..(738): n is a, c, g, or t
  Predicted polypeptide sequence is orthologous to G1340
aattttaactatgtcacatcgaatggattcgatagaaaacctaagccctcgataggcacaaaaataaattgccctcgttaatctcaggcttggccagttgcagcgaggactgctccaagttgcttcaggccatcgccaatgctgttaagagcattaatgtaacctgctcccaactgcatcgtccctcgaaacttctccctttcaaaatcaagcttcttcttctccatatccatgtcttccctgtggcgtttatctttgcggttctcactttccatcatcgcatctatgacccttttattgttcatcttcaggatacaagccagaccataatcctctgtcggcggatataaagaggtctttctctttcgctttctcaacaaagattcagggtcaccctcagcatccgaatcctccgggatggagaactcagcgtcactgaccacctgaatgctgtgacttctatgagacgcaccagtatgacgaagcggccctgatgagtctagctcccctggatctgccgggcggcttttgctgtaccactctactaaagcgttgtaaaccgccttgtagaagttaggaggcatagctgtcttcttcttctcttccttggacatgtcccaataagacttctgaccttcagggagactcttttcgtaatcgtgcactttcttgaattctgacaccaatagctcccacttgtcttgacactgttgagcacttctatgaactccttggctncagctgtaatcctcta

SEQ ID NO: 15022 - DNA, 563 bp, Physcomitrella patens
  misc_feature (495)..(495): n is a, c, g, or t
  misc_feature (516)..(517): n is a, c, g, or t
  misc_feature (539)..(539): n is a, c, g, or t
  misc_feature (542)..(542): n is a, c, g, or t
  Predicted polypeptide sequence is orthologous to G1341
gatgttcactttagagttgtaaattacatgatcctgggttactctatgccaagctaggccccagcagcacaacctcgaaggatttctaccatttgttctcctactttgctgcgcctgctgtcgcacatgcatgcgaaatcaggtgagagcgaagcattcactaaactgctctaccatcatgttgtctctctaacctactcctcaaatgggaaacgccgccaacttgctggtacacactcccaggtaggaaggtgcagttctacaagctacccacttcagagctaccaaaactttcctaccttaacttccacaccccagcgaaggtgctagagccaagaatagttcaacctagaatataacaccaacccccccgtccctccccactcccaccccttcctccttttttacccggaaccccattttctacacagtgcataggcttttgaacctccatatacaataaaaaaaaaaagtcgaccattataaaacgcccanttgaccaacccagtcccttgnnctgcttcaaaaggaaagtttcntcnccttgaggaaagtttcattac

SEQ ID NO: 15023 - DNA, 664 bp, Physcomitrella patens
  misc_feature (15)..(15): n is a, c, g, or t
  Predicted polypeptide sequence is orthologous to G1357
aatccttctatagtnactacccttagctacattttattgtatatctcttctttattccaatgtctcccattgaacgctacaccattctattcaatccataagttctatgtaataatccctcatagcagcaactattgtctactaacacttctgaatctctgaggtatcctatgagcaaagattctttgcttccaagtcagtctgtgatcttccgctcttgagccattgatttgtgaaaagttatttgtaggacttttcctatggccgctattgagtctgtagtcaattgcaaagatagaagcacctccattgtctgttattcccatggatctacacctgcaaactcgttgtgctaacgaagtcgtcccaagtgctaacagtgtattgtgtacccaagttcttgcctcaagtcgtcgacggaacggccctcctctcccggtagaacggagactgtatattgaagacatcagaaaacgcctctttcagactccagactcctcgaatgcgagttcagcttctactgaagtttatacagccgtgcatgtggaacttccagtggttacccacagcacgcacgaagatagttcattctggagggacagccgctcaaaaaagactcaacctttgaggcttcacaatataacagacatgcagatcgacaaag

SEQ ID NO: 15024 - DNA, 748 bp, Physcomitrella patens
  Predicted polypeptide sequence is orthologous to G1380
caaaaagctctttaatgaataaatggaagtgtggtactgaaacagggtgggagcgatgatggtgaaatgctctccgatgtgtgtatctgtgcctcagcgcgacgttagaagcaacttactacgctaactcaaaaagacttgtatccctggttgggacaaaccgaagtcggtttctattgccggtccttgcaaggaggttgattaaggtctaacaagaagggatagggtgttcttcgcatcacgggcttcgcatcgtgcggcgtagggggggtcgcacatgctgcctcagagttgagaatcacggaagaggacgaatcgcagtcactatggcaggcacgcgtctcgggagtaatttcagacgcatgctgttccattccaagtactgtgttttcttcgctgcccaaccaatcacgaccaactgacaacctctcggttggagttatcggagtgggtttcttcatgaccctctgacgtttactttcgactacatggccagcctcttcaaagagagcatggatcgggctcggtccagcccgtttgctcgataaagcacaagtaacgccctcctcaacgcacgaccgaccagcgcttacactcttgtattggagttgtccgtcatcggtgacaggcaacggatcctgcgccacagatacattcaggtccaaacgattacgccacgacgaagactccgatgctcccccactagatcgatagagattaatgtgaatacttttggatggatgatgag

SEQ ID NO: 15025 - DNA, 684 bp, Physcomitrella patens
  Predicted polypeptide sequence is orthologous to G1380
tgtctcttttaaagattgtaatgtaattgcttcttcagcatgtaaactgcaagagtcagaagctctgtcgcggcagctgctaaattacgatgtggtctaaactctggaacaagctactcaatcaaaaaactttgacaaccgtggcctagacgagcaaaaattgtccacggccttgtcggctggctgatcatcagaggaaggggggaaattcaagtccaacaaaaaagggggactttctcgcgcagcaggattagtcttttgtagcaatgcagctacaatctctggactctctgaattgagaatcacagaggaggaggagtcgcagtcactggagcaagctctcgcctcaggcgttgtggcagatccaggtgctagcaaggtcggttgaaagcccatgacgagggctgcattatggtctctacgaccgtccatcgaccattgagatggcgaaacctcgaggacaggcacggaatgagttaggggtttcttgacacttttggatgcaatccccatggcatcctgaaagagggtttggacgggcgtagaggaagggcgcttgccagagtacgcaagctcgatacctccaccaggtgaaacataggaacgaccggcactaatgctctcgtttagaacctgagccatctcttgaacctggtaatggtgatcttgtgacgccatggccga

SEQ ID NO: 15026 - DNA, 731 bp, Physcomitrella patens
  Predicted polypeptide sequence is orthologous to G1380
agtgtttcgtgctacacttaatggtataacacatgcaaatagctctttaatgaataaatggaagtgtggtactgaaacaaggtgcgagcgatgatggtgaaatgctctccgatgtgtatgtctgtgtctctctaccctttgagattgggagcaactacctaagctaattcaaaaagacttgtatccctggtcgggacaaaccaaagtcggtttctattgccggcccttgatgttcaaggctgcaagggggttgattaagatctaacaagaaggggtaagctgttcttcgcatcacgggcttcgcgtcgtgcggtgtagggggggtcgcacatgctgcctcagagttgagaatcacggaagaggacgagtcgcagtcactatgacaggcacgcgtctcaggagtagtttcagagagctgctgttgcattccaagtgcagtagttgctaagctgccaagccaatcacaaccaacggataacccctcggttggagttatcggagtaggtttcttcaaggttctctggcgtttgctatcagctacatggccagcctcctcaaaagggacttgaatcgggttcggcgcgactcgtatgcttgatagagcacaagtaacgccctcctctacgcaagaccgacctgcacttacactcttatattggtgttgcccaccatcgtcaacaacgaacaatgaatcctgagccacggaaatattcaggtccaggcgattacgc

SEQ ID NO: 15027 - DNA, 805 bp, Physcomitrella patens
  Predicted polypeptide sequence is orthologous to G1444
ttttgaattcagcatgcaggcacaggatatccaacgtttggctaggcatttccaggcataaacgtgcataaaaattagcatctccatgagcaccaagaagtggcaaacccatctattacaagtcagcttccgatttaaacctcatatgctttcttacagccataatttcagtgaagtttcggcgagtgcatgtcctcttctgatagtcgattgactatagatagattagaattttcttggccgcctttagctgtctcgtccttcgttggatcatttaatagatttcaacgatcgggctttaattcctctacgccgttgattgtgctcaggattctctatatcagccttgtccgtaggaacctgattgtaattttcactggagccttcgatcgccactttcgagtgtaattctggattcaagttcacatctacatcagcagcacccgttcttcgttttagccaagttcagacgaagagtacgcttgttcattagagcttgatggtgttcacagaaagaaaaaccttcttcggtctcccgtgtgcactgccagcccctgccatcatatcgcttacactgcctgggtccaattgcgagctcatgctgggaagaagggtggccgtctcctgcgtttcttgaattccactttctcggccaaaggtaaatcaatccctaatatatgacaatttgaagacttatccttagtacctttcgaaccaactgccgttttcaaacgtgtctgcactgagccagcaactcgcttccttctaccactatcaaaacttggagaattgccactcatgtccc

SEQ ID NO: 15028 - DNA, 735 bp, Physcomitrella patens
  Predicted polypeptide sequence is orthologous to G1444
aagacctgccagcatgcgtgttaaaggtgagaatgtgacatgtgcttcgaaatggcgctcagtatcgaaattctaccagtagtcgatgaaaacccaaaagcataaaaagtagctaggtgctaagcttgggcgaggtcctagtctactgcaattttggagcacaagtagaattcgagatatcagtagtgtaaaagaattaagctaacgggtaaaacgttactgctaagctgcattcattcatacaatcaatcaatcaatcaataggcgctatgtaacataactagaagcagtattcaatctgggtagtggtcgagatctcccattgggtttgtgaccctatctccaggagtcgaaaattcgtgcccagctgtgtccaccatgtgagggtcttcaagcgtatgagagacctgtgcctcatctgcgggagtagtagccgatttcttcttcttcttcgatctacttcccggcttgcatcgcagcttgttgaggtgataatcgcatagttggtacccaggttttgccaacaaggggcaaatccaccccttcccgtcggttcggctgcactggttaccgagctcttcagcattctcttgcttcaaatatttcagctttttcggtcgtccacttcgcacaggcctacttttcacttgaatctctagttccgatgatgctacctcacgttcttgagcaacacgattcctcttccatctctgagcaatgatcgggagcttgccc

SEQ ID NO: 15029 - DNA, 1698 bp, Physcomitrella patens
  Predicted polypeptide sequence is orthologous to G1480
ggcaccaggtgctgtgggaggaattctctggggatttcgaggccttgttgtatgttgttcagtaaagggagtagctttttccacttgaaggggctggtgctgctgttgttgcaagtcttttgacattgaaagaggcggggttgcacgccccggtgtgaggaagagtcttgtagtaggtgggttgtgttgtgccgtggtatagtatgccgaagccttgtgatgcatgccatgtttccagcgcggcggtgttctgccgagcggacgctgcctacctgtgcgtaggctgcgatgggaaggtccacggggccaacaaactagcgtctcgacacgagcgcgtgtggatgtgcgaagtgtgcgaggttgctccagccgtggtgacctgcaaggcggatgcggcttctctctgtgtggcctgtgacacagacatccactccgccaacccgctagcgcagcgtcacgagagagtgccggtgacacctctgttcgagagtgcgagtcctttgcgtgggccagatttctgcgtgttggtgtcagagaatgggtgccatgatctgctgaagggctgtgaggacgcctcggttgtggaagctgtctcgtggcttcttccgcaccctaagatctcgaccaactctattatcagaggcagcgctgcagccgacgagatgggttcgtcgcctttccacgaccggccctttagtcccaagcccaagaaacagaaggttgaattgcccgcggacatattctctgatgtggaccctttcctagacttggacgatgcaaccgttaccggaattcaacccgacagcttggtaccagtccatatgccagaatgctccgaggacacggattcgcttgctcactccatggacccttcgtttactaaatttcctctctcggcgaagagcggttacagctatggcacatctacccttactcagagcatttcttgttcgtctctagatgccgccgttgttccagactccagtctcagcgacatttccacaccctacctagactcacaaagctcccaagatatgtcagctcgcctgccacaccagactggaggtcccattgacaccgtcgaccgtgaagctcgcgtgttgcgctacaaggagaagaggcagaagcgcaagtttgagaaaacaattcgctatgcatcaaggaaggcatatgctgagagccggccgaggatcaaaggaaggttcgctaagagaactgattccgacatggagcagtttggctcagtggactcaagtttcggagtggttccaagtttttgagttttcttgtgtattggagtctccatcgagcaaggtcatctgaaatggaaagctgctgtgtaacatagaggagctgctgtaagaactgtgtagagccatccaagtggtgaagcacctgaaaaagtggcagcaatgtaaattgttcagactctcaatggtcaccagtaccaagtcatgccattctataatccctttcagaacacgattaaatgccttgtggacagtacaggatgtagtcagagttctagtagtggtttttttctatttttctttttgttgattgagagctttcggaacggtgagaacttcgtggcgcgaatcctctgtcctgcgatcgttatgatgcagcgaattcttccgatcttgatgtatttcaacacttccataatgctcttggatttttgggtcatttcctcag

SEQ ID NO: 15030 - DNA, 754 bp, Physcomitrella patens
  Predicted polypeptide sequence is orthologous to G1519
tggaattttacttgtgcatgagtatgtgttagattcagggctctcttcaagaagtctaccgatacaaccacagaccgcaacgttatgactaaaacgcttgccagtgtcgggcttgcatattgtagtctacagtaacgctcgaccaaaagataatgtaggagtaggaattcaggaaaaatcagaaaattccgattcttttgagtgatgaatgagaatctagcagcgtatttgagaatttcgggactggtgccaaaccttatcttccactaattgatataattatgctcaacgttacatttccttgacgctgataaagaacgttgaagttgccagatttaattgagggtgcgttacaggcgaccgacaaagaggacattcaggcttctcgttgcaccactctgccacgcaattccaacagaaaacatgaccacacggtgttgcagtgggatgttgacgtgggctaagacaaagcggacattttctccttccacctccctcagcatctccggtattggcagctaatgtccagtcatctcccactgatttcatctctttcttgaaagtattggttccatcaacatctaaaattgctatactttgtcgtcctgaggacactgctgaaggatcccttattcgagatctcatagacgtagccagagcaggcagaacactgcggcgcagccagtctccacctacaatgctaagctgtattagcagaaacataccaagcatatgataccttggcctctggtgt

SEQ ID NO: 15031 - DNA, 602 bp, Physcomitrella patens
  Predicted polypeptide sequence is orthologous to G1645
atcggagcagatgtgttagaataatagaaaatgacatcctttctctagatgctcgatcctcttgcaaaccgaggcgtgatcactgtaaaaaagtccgcctggtggttcgcgctaataaaacagcattgtagctgttaggatatttctctactaaaaagtttttttgaattttttaaatttcaatcataagtaattcactgcttcaataaaactgaaataagtatggtcagacaatagctcaatcgataagacctagataagtccagctgcaaagttcgctccagcggatggaaagagattgatggagatccgctagcaacaattcagaaactcgttcttgacttcagaatggacagtccaacttctgtcaactgatatgcaaggaattgagtctttatccactaaactgaacaacagcatcatatgacctggtcattgagcgctaccgaaacagatccatctcgccgaacacactggagaagatacccgcaactgtcctctggtttcggcccatcggattggaacatcgcatgggtgacaaaactcgaaacgccaagaaactgagttacgaaaaataaaatacgtgaaactggcgagcttcc

SEQ ID NO: 15032 - DNA, 522 bp, Physcomitrella patens
  Predicted polypeptide sequence is orthologous to G1652
aaacaggaaacgggtctctgtcataccgaattgaagctccggaaagtcatcgacaagagttctcggacgatggacgtcaagcagaagcggcctccggagcaatctgaccatattctgcgagagcggcagcgtagagacgacatgactagcaagtttgcgatcttggaatctctgctaccaattggtgtcaagcgtgacaggtctaccattgttgaagactctatcgcgcacttgaagaatctgcatcatcgtatcgaagaactacaggggcggaggtcggatttgcaacgcgcaaccactgttaagctagacaggaagagggcccgcgtccatccggaaggcgccgctgaggtcttgcaaccgtatgaaggtggccccagtaagtccagagagacgcctgctgccgctcagataccttccatctcgcaggacgagatgagaaatattcacgacttacttggcaactgtttagagaagatggaggttcacgcggaccgaccgcgtcaggtggtcattgagatg

SEQ ID NO: 15033 - DNA, 722 bp, Physcomitrella patens
  misc_feature (673)..(673): n is a, c, g, or t
  Predicted polypeptide sequence is orthologous to G1660
tttgatatttgcccttcacatgttataaattttatcacaaggaatgatgcacaaacctcgtaaccaccataatacagaaaccatgaatctccaaggcgaagtccaagccctggtttacctgtatgagttcagaagatggttaatgacctattctgttcaactttgtttttgctctcattgattttacaactgctgctcctgattgtaggggatatacaagacttcgtcctgtaaccacaacccaaacttcttgtgtacttcctcctttaccaacgcaataagagcctgcacatcctgtgatttcgaacctcccccgttgatgagaaagttggcgtgcttttcagagaccctggctcccccaattgcaactcctttgagcccagcttgctctatcaaagcaccagctgactggcatcctgcccctgggttacggaacacgcaacctgcgctcttctccgtcactggttgtgtcctcttacgcctctccaaatatatccgctgtctctgctttgcatcagaattcggctgcaaatcgaaagtggcggcgacgatgacagaaaagtcggacattttttgaaatggggaaaatcgataatcgaatttcagttcacctgcatctcgagaaagtgagtgtgaaactccactcgtcgtcaggatctccacgttttgcacnacatctcccgtttcctgcccatctgcacccgcgttcatataaattgctc

SEQ ID NO: 15034 - DNA, 1485 bp, Physcomitrella patens
  Predicted polypeptide sequence is orthologous to G1660
ggttcttttcttcctacatcgtgtcgccaggttttgtaagagctgtttgttatgatcatctaagtcgaggcgatggcagtaacaaccatgggttgaatccgttatctggttgcgatggctgtgatgtctttgtacacaagcaggggattccatcctagcttaactgattggagaaaccattctagattttgggaagggcgagttgagcatgtggagttgggatatgagctaagtggaaggtgttttggagcatcgaggtcaatagcatgtactcgatggtgtcggactgtcgtttcatgcgatagcggaagagcaagtagaggtatctcagctggtgctggtcaagcagaggtggattccggagctcatcctgtgaagtttaggtatgatgtgatgctgagtgaggtgagcacatggggcattggcggtccagcgaggatttacgcggaggtttcaactcccgacgaattggctactgtgctcaggtattgtacatgccacaacgtgcggtggtttgtggttggcaaaggatcaaactgcttattcgacgaccgtggattcgatgggtgcgtaatcctcaaccgcatcaattttctggagaagcttgggaccggtcggtaccgagtaggaagtggctacgcattcaacacgctaggagtccaatgttcccgagatgggttttctggacttgaatttgctggtgggattccgggtactgtaggtggagcaatttatatgaacgcgggtgcagatgggcaggaaacgggagatgttgtgcaaaacgtggagatcctgacgacgagtggagtttcacactcactttctcgagatgcaggtgaacggaaattcgattatcgattttccccatttcaaaaaatgtccgacttttctgtcatcgtcgccgccactttcgatttgcagccgaattctgatgcaaagcagagacagcggatatatttggagaggcgtaagaggacgcaaccagtgacggagaagagcgcaggttgcgtgttccgtaacccaggggcaggatgccagtcagctggtgctttgatagagcaagctgggctcaaaggagttgcaattgggggagccagggtctctgaaaagcacgccaactttctcatcaacgggggaggttcgaaatcacaggatgtgcaggctcttattgcgttggtaaaggaggaagtacacaagaagtttgggttgtggttacaggacgaagtcttgtatatcccctacaatcaggagcagcagttgtaaaatcaatgagagcaaaaacaaagttgaacagaataggtcattaaccatcttctgaactcatacaggtaaaccagggcttggacttcgccttggagattcatggtttctgtattatggtggttacgaggtttgtgcatcattccttgtgataaaatttgtaacatgtgaagggcaaatatcaaatgataattatgattctacaaattcactaaaaaaaaaaaa

SEQ ID NO: 15035 - DNA, 753 bp, Physcomitrella patens
  Predicted polypeptide sequence is orthologous to G1767
aataacctcagagccgaacaaggactcttcagcttgaacaacataacatcggtgcctcttatcgttctccactgacacttcttcaaatcatttacgacaccagtcgctaatcttaactttaaaaatgtcgctttgtacggcaagacagaggcacatcacactccgcaagcagtagaaaagagcatgacagcaagaagactgagccgagatgttagatcgtcaggatttggtaatgtacaattcagctttcctaaccatcccccaatcgtgctcgtcagtgctctgaaccacaatcaccagtggcgtgaaaactttaccagtggatctcactgatcagccacggcgaccaacctaaccaccaccacagcaagcccatttggaacttgacacctactctaaatcaacattttacactggctttgccacctaatatcctatataattcaacacaacaccactttcgcactatcctccacacgtacaagacacagacctgacatggggaattccaaaaaaaccaactcttccatcagtgtatccaggcgctctctgcacctcagtgttacagtgaaaaccttccaaccaccaggcctctcccttttgattgttgaggtcgatggtgtttacccagcttccactcttggaattggacttcaatccagtgtcgcgcttaaccgggattagtatctgtcccgaggattcatcgcaatccaatattgtggcctccttaatcctggaactgtgacgctcgag

SEQ ID NO: 15036 - DNA, 800 bp, Physcomitrella patens
  misc_feature (733)..(733): n is a, c, g, or t
  Predicted polypeptide sequence is orthologous to G1767
aatagtggttgatttagaccacaagtagagtcaatgcagattaggagtatgtcacctcttattctaattagtctatcttacagcaagaaatcctcgcgcaacaagtaacgcatgaggagaagtacgagatcccaatgcaactcgcctcatattttgtaacgttagacgggcatgtaaagatgggctcaagtaggggattagtgtggcatatatattcttcagtagatctcactcgaggtcatgactgttggaatctagtccctctgattttgcttcgtcgggactaccactgaaagttttcatttcgggcgcagcatgaaaaacctccttcatagaaatgcgtaagtcgtgtaatcggctgccaaattcttcggagaacatctgcagttctttctctaaatcctgcagtcgagcattgcaaacatctcgtcggtgctgctcacgagccagcttgaacattgcatcctttgcggctagggaaggatcatggaccttaggtccaaagaatctcatcttttgagacatacggttcaatccaaagtccagcctggatcctaatatcacttctcggctgcactctccttgctctctattgcaacttaatgtacttgagtgcaagctccagctcgcacaaccatctcaacaggaactgcacctttccccttcaagcacacctccttctgaggaacccaccttcaccccaactgtcacacatgtgactggcagcgcggangtcggcccgtctccacccaatctaagaaagtacagctcctccccgcaccccaccttcgcgatggatt

SEQ ID NO: 15037 - DNA, 683 bp, Physcomitrella patens
  misc_feature (667)..(667): n is a, c, g, or t
  misc_feature (669)..(669): n is a, c, g, or t
  Predicted polypeptide sequence is orthologous to G1852
ggactcctcttctacacacaacttcgcaatgacctatgcccttccatggcatggtccttggtttaatgacgcattcacatgaaccttgacagaatctcaactaattgactgattaatccaacattcaactacctactctttctgtgaagaaacctcgcctttgacaagtggcactgtgctgtccgggtggacatatcccgtcagttgtgaaactagaggtaaataacgtgtagacctgccataaacctgaagtttctagatagaagaagtgcagaacatacattcacttcaacagaaatgttaatcaaatccaagcaaccgagttctaaagaagaaaaggtatacaatcttgacgccaactagaaaaggaataatttgatcaaaacaattacaaaagtcaaaacccccaaaattcggttgacttcattatttgtattattgtggctccgcgatctcagccttccaaaactgtttagttgcaatcaaaatgcggtctgttgctcccggttcgccgtcgaaaatctcataattccattgtatgccattagcaactttggaaactcgggcgagcatagcgggagtgtcccgtattatgactgttccttttggtctcaagatccggtccatttcgaccataatttctgctaaactgcatctattttgcgangntgtgagcgcctcta

SEQ ID NO: 15038 - DNA, 745 bp, Physcomitrella patens
  Predicted polypeptide sequence is orthologous to G1855
tcttgattacaatggaaaaggttcaatgacccgcacatgctttctgattgaccaaagaactcagaaccactaattgttcccatgaatcccctgtatctcaatgcattgtacataatacaatcgactaacttagtctgaagaatctcccgataacgtagcgttagctgctttaatttcaccaacccaataagtcttcacacaaaccaaaatcttctctctgatgaatggaccctcttcatgatctgccaaccggcactcccaacgcataccttgggtgatgatcataaccttgttgacaacgtcaacttcatcacgtatcaaaactgccccctcaggtcgcaggattcggtccatctccaaaagcacgtatgtaatatcacacctgtcttggtacatgctgaacacgttatctgcatgaattaggtcataagttcgtgggtacgtagagaatgcctcacaccaattctggtaagtcccaataaatccacgctcgaaaattacacccaatgtgtcagttttagcttccgggggcatggcgttcataacccatacagggtctttgacaagagctgcagcaaagcctccaagacctgcattcatgtccataatgttcctgtatctaccattggtaagtggtggaatcaaatgatttttgtagtatttgactcgcttctcccacaattctgcgtcttctttgaattcctgagctgtcataagcggaacacttccgctagcgatccttgga

SEQ ID NO: 15039 - DNA, 776 bp, Physcomitrella patens
  Predicted polypeptide sequence is orthologous to G1855
atgagttttcatcaatatggaaaaaagaaaaagactaattggcatgaacatggttcctgatcgatcaaaaacctggactgcgattctaatcctgctgctcacaaaccccacagcacctgataacctgcaaaaatcgtgtcagtctgatgcacccatcgatgctgtggtattggcagctttgatctcaccgacccagtaattcttcacacacactaagatcttctccttgacgaacgggccgtcctcgtggtcggcgagccggcactcccaccgcatgccttgcgtgatcaccatgaccttgttcacgatctccacctcgtcgcgtatcaacaccgccccctccggtcgaaggatccggtccatttccaacagcacgtacacaatatcacacctgtcttggtacatgctgaaaactttgtctgcgtggatcaggtcgtaggttcgtggatacgtggagaatgcctcgcaccagttctgataagttccaataaaaccacgctcgaagatcacgcccagagtgtcaactttagcttccggaggcatggcattcatgacccacacaggctccttgacaagagcggcggcaaaacctccgagtcctgcattcatgtccataatgttcctgtaccgaccgttagtaagtggggggatcagatgggttttgtagtacttgattcgcttctgccacagcttcgtgtcctccttgaacttctgcgccgtcatgaaaggaacgcttccactactgatccttgggggaatggcagtcgaacgcgcag

SEQ ID NO: 15040 - DNA, 774 bp, Physcomitrella patens
  Predicted polypeptide sequence is orthologous to G1903
agcgggggcagtacaccccattcccttttaaccatcgtacattctattctcagagtaaattctaaaagccaggtataaaatggaagctctagagaaaaatgtatgtaaatgcagagaaaaactctacaaagacaccgcactgaaaactagatacagatcttttgcaatggccaaagattcaaccaatggctttcgtgataggttaaaggctagcccaaactttgtgtggttttgacctaccacctttctccagagactgttttcaatcaaattctagtaaatacaaaaataactagatgactattaacagaccatgtgtccatgacaagacattcttgaagtcgttgacacggccctaatacagaagtctgtcgcgacttttgcccctatccactgtggaggtgcttggatatacattgcgatgcatccaacactgcaccttacaaagtgacagcatttcaattttgtagaatttatccaaaacatggataaaaaatctgtgacgattcatctgctttgggccattcaaacggtctcttcaaagcaccattcccaaccttaccgattgttagcagcactactagcagcaccgaaggcggccaaaagcttgaccaagtcggtgactgaggtatcttcccgcccatcagaagatccccccgaggaccttgtctgtgctccccccgcagcacttctacgattgtgctgatactcgtaagcagcagttttcgacgttcgtgcagttgacagtacgctcaggaaatcagattgcttaag

SEQ ID NO: 15041 - DNA, 597 bp, Physcomitrella patens
  Predicted polypeptide sequence is orthologous to G1928
gatgtgacaagaacgtaacaaggtggaaggtattgttatctgaaaacgagtgtcgaactcgcgcagttttactaaatagataaggtggagtattcattggaggagttggaaggatttgagaagccttcattgacgtcgaagtgtgcaagggttaggatcacgttgtggtggttgaataggttttgttgggacacatttgtggaaagagaatggcagtctcactgttatcgacgccatgggggggattcggagcgttaggttgcgacattaccccgcgcactaagatgtggaatgagctggaatatttgcaaggattcttgcttgatgagaacgaagaggagttggagttctcggatttgattccggaaagcgacaactttgtggctcctgaaagtctcttcactccgcaacccttcgacgacggtttgccggatatgcaagccatcaacgctcaagggagttacttggagtcatcaagccaacaaagtgactcaaccggcaccttggaagtgagtagcgaagattgcagtaccggaagcaggttattgcaaagccgtaaacccagccggctgacattaatctcattgaacttgaaga

SEQ ID NO: 15042 - DNA, 1837 bp, Physcomitrella patens
  misc_feature (1835)..(1835): n is a, c, g, or t
  Predicted polypeptide sequence is orthologous to G1935
gggatgatgcggtggctgtttgtttgatcaagataaacatggaggtgggaactgccggaactcatgtcaacgctgtctagatatttatagtcggtaagggccaagcgtgcgtgtgtgcactttgtcgaggattctgccaggaatttggagagcggtcgtcgcgtgcttagtgggttacagtagtgtacacttagtgtgtgtgtgtgagagagagagagacacacacacagcgagagtaactggagtgacctgggagttttaaagtttttgggttcggctggcggtgcattcaaagaggggattgtagcagcggcagagatggggagggttaagttggagataaaaaagatcgagaacccgactaaccgacaggtgacattctcgaagagacgcaacggcctcatcaagaaggcgtatgagttgtcagtgctatgcgatattgacttagcgctcatcatgttctcgccgtctggcaagctcacgcagtattgcaattgcagcattgaagaagtcatcgccagatttgccaatttgcccatgcacgagcggaacaagagttttgaggatatgttggcacgcttttcgaacaatcacatgcaccatgaccgcagcaaatacaataggaaggttgaaaacttggagcagctgcaaagggcgttgaaaaagctcgcagaagaacatggtcttgccgctagtcaagatcatttgtctggaagtaaatcaacgtatgaaatcgagttattgcaacaggagttaaagaaagcacaacaagagaaggaattggtgcaacagagagcaaggttgtacttggctgatgagcagcttttgcaaggtgttacctccgttccgcagcttgctaatatggaaagcgaattagagcaggcacttgagcgtgtgcgggcgagaaagaattatgtgagcagtgcttaccagaatgtaatacaacggcagcaacatgaatttcttgggaatagtttgcagatgatggcactgagacagcagcaatcgcagcaagcgcagcaacagcaggcaggcatgacaccatcacaggtaccatacatgcactggacgatgcaacaagagcgcccagaacctacaccccaagattttatggacagcaaacgaatccagctgctccactcaggcatgcatcgctcaacagagagccaggaagtaacggtgaatcaaatccaggtgtgggatatttcccatctggaccacaaccatcgaacatggaaacactgcggcaaattgggatggggggtgtcagtcgaggattgacaatgcacgagatgtcgctggaacagccgaatgtggcccagtacagtgaggagcagaaaaaagcgaaggttgaagccagcatgggctttgttacctcaaccagtgcgggtccggttggcgctgaagcagtgtcaaagactaatttttctcgagagcaacaacctgaacaggctcatggcaccgtcagcgcttcagagtggccgccacacccggcgaaccatcaccctcatgcgtacggtaacggcagtctattcttcagccagaatgaacaccatgcatggaagtaagttgcgtggacttgcaatctttttagctttagacacgtagttgaagaagcagcttcatatgggatacagacggctcatccaagtcaaaccacttcggtgtcaactactcagtcggctgtatcaatttgtggacaagagatgatatcagtgaactttcgagtgacgctcgtgggatcatgaatctgaccactggtggaagttttgtgatctaggcgctgtgctacgtagagcagctatcacccatgtgtgttcgttgtaccccacctntg

SEQ ID NO: 15043 - DNA, 2292 bp, Physcomitrella patens
  misc_feature (1951)..(1951): n is a, c, g, or t
  misc_feature (2245)..(2245): n is a, c, g, or t
  Predicted polypeptide sequence is orthologous to G1935
gatttcggacgttgaaggcacggattctgtagtgaagtggattgtagggatggtccagcgagcgtttgcgtggtcatgagaattacgtggagtgtgctgtgtgctggcactcacgtcaacgctgtctagttagaacccggcgcgtggttactaggttgcggaatctgcaattggatatcgagcggtggtcgcatgcttgggaggacgttttagtgggcagcgggtgccgagggagttaaggcgtagacacagggagccttcggtgttcaggaggtgggagaatttggaagggttgcacaattttatttatttatttatttatttttatatacaaattatcagggagaagagaacgggtttagcgagcggttgctgagatggggagggttaagctggagatcaagaagatagagaacccgaccaacagacaggtcacatactccaagcgacgcaatgggctcattaagaaagcttacgagctgtcagtgctgtgcgatattgatctggcgcttatcatgttctcgccttccggaaagctcactcagtattgcaattgcagcattgaagaagtcattgctcggtttgcaaatttgcctatgcacgagaggaataagagctttgaggatatgttgactcgcttcgcaaacaatcagatgcatcatgaccgcagcaagtacactaggaagatcgaaaatttggagtatctacacaaggcattgaaaaaacttgctggagagaaggatcttgtttcgaatcagcagctcttgtccgggagtaaatcaagttcttacgaggctgaggtgctgcaacaggagctgaagaaagcacaacaagaaaaagaattggtacaacaacgagcaaggctgtacttggccgatgaacaacttcttcagggcgtgacttctgttcagcagctggcgaatatggaaactgaattagagcaagcactagagcgagtacgggccagaaagaactacgtgagcagtgcttatcagactgcaaatgccctgcaacggcagcaacacgaatttcttggaaacagtctacagatgatggcattgcgacaacagcaacagcagcagcaacagcaagcgggtatgggaggaactccgtcattcttgcactggacgatgcaaccgagcgtccagagcccacccaggatttcatggagcagcaaacaaactcctcggcgtcactcatgcctgcaccgttcagtattcgggaaccaggggacaacgggggagcaaatccagcagcggcggcttatttccccgctggaccgcaaccgggagcattagaatcgcttcggcagatgggaatggcggccgccagccgtggattgaccatgcacgagatgtctttggagcagccgaatggccagtacatcgaggatcaacaaaagaaagccaaggtggaaggcagcatgggctttgctacctctagcagtgccgccgaagccgtctccgagaatactgtcacgcgtgatcatcaacaatctgagcagactgacgtcaatggcggtgctgcagattggcctccacatcccgcgaatcaccatccgaatgcattcacgaatggagggttgttctcaagttttagtcagaacggacaccatcctgcgtggaagtaataaacggtgggaggggcctaatttcacttagatggagaaggagctactcatggtccgaatttgagattcaactccggcaaaccgtgccagaaatctgtcaaggtgggtgcaagctaagtcatcaaccactgagctctcgggttagtgggaagctggtcatcatcgggctaagggttggtcactagaaacagtgtgagaaaaacgggcactatgtgctttgagcgcccgatgaccaaacgtgctctctgctctttctttcccccgcgtcctttcactgactccaccttccccgaagaatgctcatgtcaccacgccgagcanaaggttgacttggattctagcgttggcgtggagtgccggagatttttcacctcgtgtgcaattgtaatgagagaacgattcatctagttgactgtttctctgaatccgagacttgcatgtgatacatgacttggcccctgatgaggatgcctgaaccggagtcttggacctcggtgcagtgccatcagtggctcatgtatcatagttaggctgaccgtttttgaaacctagactcttccagactctcatcggtcgtggcagtcggcctggccttgtgtcatgttgcaacgtctntgaattgtactcgacaagcttatacttgaaaaccaacctcgtctcgt

SEQ ID NO: 15044 - DNA, 1795 bp, Physcomitrella patens
  misc_feature (24)..(24): n is a, c, g, or t
  misc_feature (26)..(26): n is a, c, g, or t
  misc_feature (173)..(173): n is a, c, g, or t
  misc_feature (675)..(675): n is a, c, g, or t
  misc_feature (806)..(806): n is a, c, g, or t
  misc_feature (813)..(813): n is a, c, g, or t
  misc_feature (815)..(815): n is a, c, g, or t
  misc_feature (854)..(854): n is a, c, g, or t
  misc_feature (1646)..(1646): n is a, c, g, or t
  misc_feature (1683)..(1683): n is a, c, g, or t
  misc_feature (1716)..(1716): n is a, c, g, or t
  Predicted polypeptide sequence is orthologous to G1935
caattagacctttaggggtggtananatgggtcgtgtgaagttggagattaagaagatcgagaacccgaccaacaggcaggtgacatactccaagcggcggaatggcctcgtcaagaaagcctacgagttgtctgtgctttgtgatatcgacctcgcgcttatcatgttttcnccatccgggaagctcacgcagtacagtaattgcagcatcgaagatattatcggtcgattcgccaatttacctatgcacgagcggaacaaaagaargcttgaaaatctcgagtatcttcacaaagcgcttaagaaactcgcaggtgacaaggaactggtctccaatcagctcatctctggaagtaagagctacgaagttgggttgctgcaagaagagctgaagaaatcacaacaagagaaagaattagttcaacaaagagccaggttgtacttggctgaccagcaactacttcaaagtgtcacttctgttcagcaactggctaatatggagacagaattggaacaagccattgagcgtgtgagggcaaggaaggcgtacgtgagcagtgcttacgaggcagcttctgtcatgcaaagacaggtgatggctttacaggtccgggctcagcagcagcaacaacaacaaggcttatcagggagtacacaccctccatttttacagnggaataatcctgagcgcggagaggcaatacttcaagactttatggagcagcaaacaaactctcagtcaatagttccagtgcagatgaacagggaaataggaagcagtaatgaagctggtccatcaaccttnttccctnanactggttctcaatctaacctgcacagtttagccggacanatgagtctcgtcggagttaatcgaggactaagcatccatgacatggctttggaacggtccagaggccagtacgaggatcgcaagaagtccaaaggcgaatccaacacgggcttcggagcttcgtcaagtagcagtggggctgccgcggatcaaggcaccggtgagaccttcaccggccaatctgagcctgcacatggaagcgcccccagcgccccgaactggcagctttcgcaccaagcacatcacgcgcaagcttattccgctgctcactatccaactggctacktcaatcagaacacagatacttggaagtagttccacgcgctgaggcggcttaccactgtaggctacagtctgtatagaagactaagctcagaggaattaaccacttagaaaggttgaccagtggtcatgcaacttgctcggtttctatgttggggtgattattgtagagggaagaatcattttcgagacgaaaacaaacgtgctatttgaaccgcatgttttctcgggagcaagtcttgagggatcaaacaacgcaggaagcacatgcacattgccgcgtcgaccgatggactgttcagcttttcgtcactggaacattataacgaacgccaacatgatgttcgtgactacgcagctacgaaggttcggcgtccaacagtttctcagcggagacacggccccacctcgtgcaaacaaaaacactcttggactgttcgtctgtgacgtataatatccagcttcttatacaaatgacgttcaggtaacttatagtgaggatacattccnccttaggactccaggccagctgcagcagtattcgtanactcaatggccaatttgcagtatattgcaaggnggacaagtatcaggttcwtgatacctatatacccgatgtattttggctccaacaagctggttaaataagaacgattctc

SEQ ID NO: 15045 - DNA, 1713 bp, Physcomitrella patens
  Predicted polypeptide sequence is orthologous to G1935
cagacttgggggcttcagttcagtctagcgcctgtggatgcgcaggcacgctggtccggtttgcctagatcattcctggaatggatcttgtgccttgtggcaagcgcccgcgggaacaagagaattcgccccgctgctacgaggaagggaacaatacctgattgaagaccgctgttcaccttggtgtgattggttactgttctgaaagcgcgaaacttttttgttttttttcgtgtctttttaggtgatctgaggcctagttgtgagattcggctcaggcttgcctgcaccttgtcctcttttgtctgcgcttgtctgtagcagggtcgaatccgtctgtgggaagaattcgatcgaaatttgggctctgaggaagcggagatgggcagggtaaagctagagattaagaagatcgagaattctgccaacaggcaagtgacgtactccaagaggcgtaatgggctcactaagaaggcctacgagttgtcagtgctctgtgatattgacctcgcacttatcatgttctcgccgtctgggaagctcacccagtacagcaattgcagtattgaagatatcatcgatcgctttgccaatttgcctacgcaagagcgaaacaaaaggaagattgaaaatctcgagtatttacaaaaggcgttgaggaagctaacaggagagaaggaatgggttcccaatcagatcatctctggaagtaagagcgaagaggttgagttgttgcaagaggagttgaagaagactcaacatgagaaggagttgattcaacaacgaatcagattatatttagcagatgagcagcttctgcagagtgtaacttcagttcagcaactagccaacatggagactgaactagaacaggcacttgagcgtgtgcggacaaggaaggcttatgtgacaagtgcttatcaggctgtttctgtgatgcaaagacagatgttggctttacaagcacagcaacaaaagcagcaacgagacaccttggggcaacaaccgttaccgttgcaatggaacaatcctgagtgcggccattcgatgcttcaagaatttatggatcagcatgcaaaccctcaagcaattgtcccagtgcagcatatgaacagggagatggggagcaacagcgaagcgagtccatcaagcttcttttcccagtctggctcccaatcaaacctacacaatttggctgggcagctaaacctcgtgggagctaaccgagggttgaacatccacgacatggccttggaacgctcaggcagtggccagtatgatgagcagaagaaatctaaaggtggggccaacgccggtttcgcttcttcaagtagcagtggtgctgccgctgaagggagtgccgagacgttcactggccaatctgagcccaacgcatccaactggcaactctcgcatcaagcccaccatcacatgcacgcatattccagtgcgcagtaccctactgggttctctaatcagaatgaagaggcttggaaatgattctgcccgttgatcaggaggctcggaggatatactattgcaagctctgaaatgagagggtgatgaatgatcaagggactcatgaaccgcatgaagctcatcaagaccttagacaatcctgttagaaagttactttagatggtcgacgtaacatgcatgccgattgttcagataataatttttactggtaaatgaggcgtgtaaaaattcttc

SEQ ID NO: 15046 - DNA, 1615 bp, Physcomitrella patens
  Predicted polypeptide sequence is orthologous to G1935
atgggaagggttaagttagagattaagaagatagagaatcctacaaacagacaggtgacgtactcgaagaggcgtaatgggcttattaagaaggcttatgaattgtcagtgctttgtgacatcgatctcgcactcatagtgttttctccgtcggggaagcttacacagtacagtaattgcagtatcgaagatgtgatctctaggtttgccaacttgccaatgcatgagcggaacaaaagttttgaggatatgcttacacgcttcgctaactttcatatgcatcatgatcgtaccaaatataatagaaaaatcgaaaacttggagtatttacacaagtcattgaagaaattaaatggagaaaaagactccgcatcgaatcaacttctcttgggaaacaagggttacgaagttgggttattacaagaagaattgaaaaagtctcagcaagagaaggagttagtgcaacaaagagcaaggttgtatctagcggacgagcagcttctacagaacgtaacttctgttcagcagcttgcgaacatggaaaccgagttggagcaggcactcgagcgagtgcgtgcaaggaagagttacgtgagcagtgcttatcaagtctccagcgcaatgcaaagacagcaacacgagttcctaggcaacagctatcagcagatgatggtactacgccaacagcaggctcatcaacatcatcatcagcagcagcagcaacaacaacagaaggctcagcatcagcatcagcagcagggaggtattccagcagcagcacaacagttgccattcttgcagtggaacggcgcacaagagcgaccggaggcgacgcttcaggacttcatggaacagcaaactaatactagccaggctatcgtgccatcacagatgtctcgggaagtggtgagccaaagagaagtgagtccatcaaataacggtttcttcccaggcacagcatcacagtccactctgcacaacctggggcagatcggtcagctcgtgggagcaaaccgaggaatatcaatgcatgacatggccctggaacagcgtggtggtcagcacgaggagcaaaagaaagctaagcttgaaataacgaagaacatgggatttgcatcgtcaagtagcagtggaggagcagctgcagaaggatctgcggaaactaatctgaatcaaaccttcaacaaccaaactgaacaagtgcatggcaacgccaatgcttccaactggcatcaggctaaccaccaagctcaggcttacatcaactctcagtacccaaacggattctttaatcagaacgcagatgcgtggaaatgatatacgctaattaatgcatcgtcacataacagaggtaggtcaaaattgaatggttcaaacgcggatgacatcagggatgaagtgaagagagaacactatgctcttgccagtggagattcacatcagagtatttaaacaattgcgtaacgagatcactctgaagagttggcaggggttggaggcttggagcagcaatctgtaatgagacacatgtgtcttcctttagagtatcatctgtctcatcccggattgtcactagtatcattagctcaatttagtgaaaatgagacttgaaact

SEQ ID NO: 15047 - DNA, 1318 bp, Physcomitrella patens
  Predicted polypeptide sequence is orthologous to G1935
ggtagcgaaaatgggaagagtgaagttagagattaagaagatcgagaatccaacgaacaggcaggtaacgtattccaagaggcgaaacggtctcattaagaaggcatatgagttatcagttctttgcgacatcgacatcgcattgatcatgttctcaccttcaggcaaactcactcagtacagtaattgcagtatcgaagatgtcattggtcggttcgccaacttgccaatgcatgagcggaacaaaagttttgaggacatgctaacgcggtttgcgaatttccatatgattcatgatcggaacaaatacaatagaaagatcgagaacttggagtatcttcacaaagcactgaaaaagcttgcgggagagaaagaccttgtgtcaaatcaacttctgctgaatggcagcaagagctacgaagttgggttgttgcaagaagagttgaagaaatcacaacaggagaaggagcttgtgcaacagcgagcgaggttatatctggcagacgagcaactgctgcaaagtattacctccgtccatgagttagccaacatggaaaccgaattagaacaagcactcgagagagtgcgagctaggaagaattatgtgagcagtgcatatgaggctgctagtgttatgcagagacaacaacacgaattcttagggaacagttatcaacagatgatagccatgcgtcaacagcagcagcagcaacaacaacaccatcagcagcagcaagccggcatgacagggacacaatcatcattcttgcaatggcctgtgcaagagcgtggagaggctactcttcaagattttatggagcaacagacgaatcctgctgctgcactcatgccaacaccgttagcgagccgggaggtgcctagcagtggtgaagcgaattctactggtttttttggatctgcgtcacaatcaagtttacaatcactgggacatatcaatattttgggtggtaatcgaggtttgagcatacatgacatggctatggatcagtcttctgctcagtatgacgatcacaagaaagccaaacttgaagcgagtatgggatttgcctcttcacctggtagagctgctgcagaagcagctgcagatacttttacaaatcagtctgagcatggaagcgccaccaattctaattggcaccaggcacaccaccatgctcaagcatacacaaattcccagtatccaacaggatactttactcagagtgccgatgcatggaaataatatttggaatagcatcagtgtggagaaatttgaaatgggattggcaagtattcaaaggggggtgttcagtgagca

SEQ ID NO: 15048 - DNA, 792 bp, Physcomitrella patens
  misc_feature (713)..(713): n is a, c, g, or t
  Predicted polypeptide sequence is orthologous to G1950
attgttgattgaactggttcataatactgaacaaaaaaaaccttgtgagatcaaggtttggtggcaatagcaaaagctgtggtgggattaggagcacctcaaacagagcctcaaacagagcctcaaacagacatggataatttcggctatttcattagcggctgtatcgaatcaaaagctgaggccgtacagggtagttaatcaccaaattctctaagtacttattttagcgttaagctctagttggccactgagtgtaatgttattatccatacaatgtatttccatggtaacggttggtatagaaagtactcccgttatatttatgttgaaaatacctccgctagctcaggaaagtgattggaatttctggcaacatcaaccgcggtcaggccatctctgtctctggcattcacatccgccccagctttgaggaggagtttacatatttctgcatgtccccatcctgctgcaacgtggagagttgaacggtacatatttgcagctgacgggttggcttttaccaccttaatcaaaaatagtaccatctctaactgtcccctgctagcggcccaatatagggcagttgaacccttgcaatctttcgcttccacgtcaacacccttctcagcaagccaacaagctgccgtcacatgtccagctgatgcagcacaacgaagaggagtgcatccactagcgtcacgagcacttangtctgcaccccttgaatacagtaattccagacaacccacgtggccccctcttgctgcttccgtgtatgggttgcccacc

SEQ ID NO: 15049 - DNA, 717 bp, Physcomitrella patens
  misc_feature (680)..(680): n is a, c, g, or t
  Predicted polypeptide sequence is orthologous to G2057
atgtaaaacttcgttgaagaaatgtagatacattacaatcacaggtcttcatacagaagaatcggtctccaaggaaggactttaattaggcaccaaaaagaaccactgtcacttctccttgaagtatatctatgttcctgaatacaattaaaacttaaatgacttttcatgagaatcccagaacatatcccggtggcccagcaagcactccctgccaagaggctaaaacgtgggaatgcggcatgagtccacgtacctaagagaatcactttcgtcctcttctgtgtgtttcacaaaattctagaggacgctcaaataaacattcaaagaatgtactagtctggtgaaataatactccacatccaagatggataagacaagacatatcgctctgccaatagagcacgttgacccaagaaaaaagaaacacagcgggggtgcagacgaaaggcatgacctctctgtacgaggctgcaaaagagcggaaatcaacattctgcgcacagtagtgatccgttctgtacaaaatgtagacactagatccttctctctagtgatccgcaaggctgatttcctcccccccgaaatactcttgccacatccgatgatcaccgaatcctgagtctggcgcccaagagacgtcactcgtagattcttggcacgaaagagagggcgtgaanggtgtggttggaccaatattatgctcattagcttctt

SEQ ID NO: 15050 - DNA, 747 bp, Physcomitrella patens
  Predicted polypeptide sequence is orthologous to G2094
ttgcgtgtacccggcggccaccgctttattccgtttcctatgaacactagtccaacacaccatagcggagtatctgcatgaacttaatggtactggaagtgaaagcaaatcgacatcaatggggattcagggatttttagggcggttggatccctgttcacctgtgcactctaacaatgtacacaagctgaaatattccagagcttggaaggcgaaaagaaactctgctgtgctggggcagataaacctcatgaacaatctcgcttaacttgtctttttatctaagcgcagaattttcctacaaaatggaattatcccggacttctttttttttgaaccctgcctcattgtttaatgccggtttcttccattgtgaaggtgatggtcgacaggcttgacagaacgcgatgtcaactccaggattgccctgcacaattgtccctaaatttctactacatgatgcacagtccagcgtttcaggacttccacacactctgtctgtgtaagcgcgtgccatctcaatcacagcatctgcgtgcgcaccaccctctcgcatcgagatggccttcttcagcattggatttggtgctgcagcattttgacatgctccggagttgttgtaagacctgtgtagctctatgggtttctggtcacacaagcgaccacacctatacgaccgtgttctttgaagtcgtcctcctagtgcagggtaggtctttggaagctgtgaattgttcaattggtcca

SEQ ID NO: 15051 - DNA, 685 bp, Physcomitrella patens
  misc_feature (32)..(32): n is a, c, g, or t
  misc_feature (34)..(34): n is a, c, g, or t
  Predicted polypeptide sequence is orthologous to G2137
tgttgagaatgaggactacacgtgggagggcncngtgatcttgaaggaagcgtgggacatgggttggatttcagctcgggattgctgtagacgttgggacgtgaaccaggctctaaagtaaattttgcggagcgtgcgcatcttttgctcttgagtgattgagtgattgaggggatgagtctcctcgtggacgaagtggaagattcagtgtttggagaagaggtttgcgcagctcaaaagaggagatctgaaattgtgagccgcgatgcagtgtaatttgcgtatgtgtgtggctgcggatttggtactgttgtagttgtgcagtttgcaacacaatcgcttggtgtaatcgcggaggagctgcagctccagttcgcaattgaagcacaagggagtattgatttgtttgtctgcagcaccaatcatgtcgcgggagatggcgttggatttctttccagtaacttttggtgacatcttgaagaagcgcgcgcccgagtttttcgcttggctatttcctgattggattgccaaaagatgccccatgccatcaattaatctccaggtaagctcatggcatgtcttgcgcttcatctcatgctgcactcacatctggagctgctgtggtatgtatttgtccgattcgactcgtctaccgaaatcgtgttccgtccgcgaaatttgcgaa

SEQ ID NO: 15052 - DNA, 756 bp, Physcomitrella patens
  Predicted polypeptide sequence is orthologous to G2142
atcgatgtattatacagatggcagggaataaatacctgcaaggtcatcaaaaccacacaagagggagtacctatctttttcgatcttcccacacccactacgaagcagacaatgatgcttcgtgtatgctgaagataatagctacaccctgttagaagaccactacaaggctatggatgctgtgctggcagatgatagatgagtgtcgctaaaaccatcttcaaaacgtaatctagaatcctcctgacgtaattgccattggcacaacaaaactgtgtgtgatcctagggtcaggtagatcaaaacccagaggcatgaatcacgcccaggtacgatacaattctcttgaagtggtaatcaaatgattctcaaattcaagacatccagctattcgtgattctcaaccttcggccttttccgtgcaggttcagactctggaactgatggtgctggtcgggtcctgccctgagattgatgactttgagcggaggactccggcgttgtagcaaccttggctgaagtatcaccaggagctactgtagcgttcttcccgagatcaatttggacagatatatttgctcgactcaaatcaactccggaactctgcaatgctcgtgtcaaagtgtccaacaacccttgagagtacacagaagacacgttgatgactcctccttgtatacgtggaaaaggttgaggaatattaggaaaaacggcaaagccatctcgagtagccatatgatcattctgatttgtctg

SEQ ID NO: 15053 - DNA, 656 bp, Physcomitrella patens
  Predicted polypeptide sequence is orthologous to G2142
atctttcaaactttaactcccatgagtgactctcttttccgaattaactcattcgctatagtagctggattatgcatcttctgtcgtggaagagaaccatgggaggttagtaccagttgcatcaaaaccttgactacgcttccctggcgtactcctcactggcacatttaaatccccaagctgctccaagatgctatgtgatcttgagaccactacccaaagacttgaatcacgacctggtattttacaattttctagaattcaaaaacaaatcaacctcaaaccagagacatctatctactcgtggttctccagctttggcctttttagagcaggtgcaggctctgcggctactggtgccggtcgtgtccttccttgagattgatggctctgagcagaagactcaggtgttgtagcaaccttggctgaagtatcagcagccgctgttgcgacattcgtccccaaatcaatttgaaccgatatgttagctcgacttagatcaactcctgagctctgcaatgctcgcgtcaaggtgtccaacaaactttgtgaataaacagaagacacgttgataacacctccttgaatgcgcggaggaggctgagtgggacaaggagaggcagcagagccatctccaggtgcgatctgaccatttt

SEQ ID NO: 15054 - DNA, 807 bp, Physcomitrella patens
  misc_feature (694)..(694): n is a, c, g, or t
  misc_feature (730)..(730): n is a, c, g, or t
  Predicted polypeptide sequence is orthologous to G2142
atctttcgccgaacgagcatatccactagagtgggtgaataatgatccatattctgtataaaagaagctggctctttgaggaactacacaaagctggatgctggcatatctttcgtcgaaatttcatctacagttctcccagcgtaattcttgcttgcgcatcaaaattcccaagcttcctcaagatgctatgtaagcttgggaccacataggtcacaacccatagacataaatcacaaacaggcattatacaattttctggaattgatcacacaaggcatcctgaaattctagacatccttctcgaccttcggccttttcattgcaggttcatgctccgcagcgacgggtgctggtcgtgtccttccttgagactgatccgaagattcaggtgttgtagcaaccttggcagaagtgtcagcagccgccgctctagcattaactcccagatcaatttgaacagatatgttagcttgacttagatcaattcctgagctctgcaatgctcgcgtcaatgtgtccaacaacccttgggaatacacagaagacacgttgatgacccctccttggatacgtggaggttgaacaggaccaggagaagcagcagatccatcttcaggtgtggtctgatcacttcggtgctctggtgaatgccttgaaggtttgaccgctttgtctttacactgagccgacntcctgtggttgtctagaagcactagcattagatggntgccctgcttgggctccatctatcataccaacaactgtcccagctgcgatctgatgttctgctttttgattgctggc

SEQ ID NO: 15055 - DNA, 752 bp, Physcomitrella patens
  misc_feature (720)..(720): n is a, c, g, or t
  Predicted polypeptide sequence is orthologous to G2226
gagccgaacttcatcacgtagcaagaacacatgatgcaagacagtgttgtgaacaaaaactacataaaaaaaggactaaacattaccactgtatagagactccctgtgcaccgcgagtagcaaggtgacttggaggcacgtctggagacattggggtcgtcgtcttgtacccagaggtggaggtcgtcacttttctacaacgagatcaaccctacaaattgggcaagcagttcctccgcacgagagccacgattccacacaatcggcgtggaaagtatgcccgcaggaggtcgtatggttcttgtttgcatctgagttgggtccaaatgcctggaaacagatggaacaaggctcatcctgcggtgcctccgcattcggaccatctttggaaacaactgggagtttctttgcaacgatgatcagattctcccacttcaccatgttgtttgcccgtttgaaatactcatacttgtccgatgctctataccacggaactgacgatgtcttggccgaccgtgtcctgctgcttctccaacgtggggtagtagtcatcggttggagatttcccactaaagcactttgtaagaagattagtaaccttactgcaccgtcgtgacagttctgagccacgtaagggtggggaagttggtgattgctttgcggccctcatacatccacatacaactcgtgaaggagcaagtcttgacttgcaccccttgnttgcaaatcggacaggtaccttgctccttgga

SEQ ID NO: 15056 - DNA, 671 bp, Physcomitrella patens
  Predicted polypeptide sequence is orthologous to G2340
cagatggtgcgtgattgataatgtgtgaggattaataccctctctcctaggcaaacgggttgcccgtcttcatgatacatctgggtttgtgaaggatcctctccggtctacagacacattccgaaaagaatctctgcaggaaagactgccaacctagttctgggtttggcaatccgctcaatctcatctcaaacactgtcatattaccagattacaagtcttcgtcatattttacgacgaagaggcttcataacgcagtagaaagacaacttaaaacctcattctgggaatatgacaagcaattgcttgtgaaacagttcatgtcgtcatcatctccttggatcctcgcataaaaatagttctcgacgatgagacttgataattaccgactcccagcggttactttcctctttactttcctctttgcgaagacattaggagcttgacgttgcgtgccattcttgttctcaatctttttaccatccaagaggcctgtgataagacccttcgcagcgattaccgaccccgtcaaagactcagatgacaatgaaggcctacgatatgcttgtgaaagagttccgtcagcgtggacaggcaactccccttgacctaaaaatgctagtcttgtcacatctccaatgtgaatattcagagccctgagtgctgcagag

SEQ ID NO: 15057 - DNA, 789 bp, Physcomitrella patens
  Predicted polypeptide sequence is orthologous to G2348
agactcccagaactggctatttgaaatgggctgtaagtacaaatattccctcgaagcatgtacatattctctccgcagaacccacttgatcaaagtacactaaatcaattactccaaaggcaacgccgcaatgatgtcgatagttgggcaacctgttccgggtgttgcaggactacgcaaagtcctgcacatgctgccgtcgcgcttgcaacagcaaacacaagcctgtaggtgttcctaccccatggagaacgacgcttctctctcatcccccgttgtggtagtagagacgtggtcgttaaatccttgctgctgctgttacaaactacaatgtgtgtatgctcgtccgcatctctcttgctctgtgccagcgatggcatggagtaacttcggctcgatactggaaccgcaaatgatgaaagcttgtaagtcgagtgactatgcccggtgctttcggcccagatgtttctccagtcaaaagagcgtgcgtccgcggctccgactaatttacgcaaaacaccccgcctgtcagctgcttctagaatgcgctcagcaactcgctcccatcctttcgcattcgcataatcgagtagcgaacggagacgttgaatcaaaacacccgaatcaagggtgctctccttgagcatccaacccaagtcgaacagcagatcttgagcttcgcagctgctagtatacaactccatgctttccacctcattgcaaaattctgcatccccgactagcaccaccataatgttgctgagtctgtcttcgttctcaacctcaatg

SEQ ID NO: 15058 - DNA, 741 bp, Physcomitrella patens
  misc_feature (678)..(678): n is a, c, g, or t
  Predicted polypeptide sequence is orthologous to G2371
aattttttttacagtaccgaatagtatacattgccagtgcaaaccaacggcagtgcatgaaatactgaaaataggaagaagagcttattattatggcagtatagtacgagactttcctcatcaaacttggccgtcgttgcagatcctcaaacatgtgtgttcacagcgagcaacattaaccaaagcatgcagttttgcagactgagtagtgggcttcgagcatagcttgtggaagcaaccccatctgatgaaaagcttgaagaggaagagggtgtttctctgtcaatgcaccacctcgtcgtgcttttgtagatgttttctttttttgtcgtagtgccacaaaagtactagcaactcattcatagaaatcacctctggaatcgtctatgggtaagaaccttcaaaaaggttgcgtagttcagagattcagcaacagtctggtgaatccaagcagtctgtgcacgaagatctggcttaaattcaccgagcacttcatgctttgcaaacgcttactgggtcacggatgaacctcagcttgtggactcatgggcgactacgcaaaatattagaccagagtggcgaagaatcttaatcctaaatgaggtccctttgaatgcaagatttcatacacttccaccgaactggaaaccttgttgatcgtttgatatttgctggggntcggcgttgcctactcaaccgccaacattgaacgatttccaagatgatgaacgctgctaccaa

SEQ ID NO: 15059 - DNA, 772 bp, Physcomitrella patens
  Predicted polypeptide sequence is orthologous to G2456
tttctttttctttacaactgtgtaaaaagcagatatggaagtaaatgttctgaaaaggacaagaatcaaatcatcaatatttcttaactgaaactccaaaataaatatcacacaaaaaggcacacaagtaaagacagcaatacaacttgtggcaccattactaacctaactgatctccataggtactagatttctatcattaaacacagctctgtggggatgatcctcaaagcattgtcaagtatctgccaggtgaatgtcgaacgtaagatgggcttatcatcacatctgtgtaggactccttgccatgcacgaacctgacgtaaaagtagacgcgaagttggatatggtacctacctttgttcaaaccgtctgtaattgtagataagcgggagcagaagtggcattttggatacagagacggagtagataggtccgcagtggtagcattgtgcaagacgtctcagccaagcacaaacaggctaaaagtctggggaggatcaaaaactgggagaccatgcataaccaaatgtgcaccatattgttgaatacaggtgcacatttcctctacatggcgcttcagtgtgcactatcgaactggttagatgatattccaggacagaggcgcaccacaatcctcgcctgtcctacctctttggcccttaccatatggcttcagttccactcccaaggaacgttcacaaaaaatattgaaatcgaaagaattctcacagctagttactgctgcattcgcactgacctatgtatcacc

SEQ ID NO: 15060 - DNA, 740 bp, Physcomitrella patens
  misc_feature (722)..(722): n is a, c, g, or t
  Predicted polypeptide sequence is orthologous to G2510
caatcagccggactgcaggtacggcggcgcgccagaggacgagacaagggggatgattgacaagtatgcgaatctggctctctgaaggcttaaacgtgctttgcagtgtccttatgtaaaaccctttcaaaagtgattaagtcgcgttttccttcgactgtgattcttcgcggtgaagtagttgggaattgcgaggaagtgttttggaaagtctggtttcgaaagatctagattgggaagatcagagtgtggtagtgaaacaaaaataaccgaaaggtttggtgaggatggttgagaaagtagtggtgtcgtctttgcgtgtcaagcgaggaggcaatctcttggcgccactgaagaggaatgtgtccagcattgctaaaaatcctcaacgccaaagagtgggaaaccggtagggagccccaaagtgtacaaaggagtgcgcatgcggacttgggggaagtgggtgtcggaaattcgagagccgaacaagaggtcacgaatctggttgggctcattccccactgcagaaatggcagccaaagcgtacgatgccgctgcggtgtgcttgcgcggacgatccgtgaagctgaacttccccgacagccctcctcgatgcgcagccgttgcaattcgccgcgcgagtccaagcggagcgaccgcagcgcgtggcgtgcatccatctgcaacgtctgaccgggcattccatctccgtcaaaattggngacacattatcatcgctg

SEQ ID NO: 15061 - DNA, 682 bp, Physcomitrella patens
  Predicted polypeptide sequence is orthologous to G2522
acttttgtattacaaatagagaacaagtcttaatcatacagatgaagatttttaaagtgtcgacagtattgggacctctagtttccactggcaagcttcccaatgcttttgttatcatagaaatccactggagaccccggtgtgatccctttctcagcaaccattctgatcgccttcgcaaccgaggtaacaccactggctgctcttccaccagtaagaaaattaagaggcttgtgcaaggagaccgcaattgactcggcaaatctcgttttctcccgcttttcaccatcatagacaagaataccaggttggaagattgacaacttcgcaaaacctagctcagagatgtgttgctcgattagacccttggttttggggtacagcaatgaagagctcgcggaagcacctgagctcgacagaaggcagaaatggaggggcttcgatgggtttgcctccttgaacagacgagcaacatggagcgggatgtcatgatctatcttgataaactgctcatcgctcccagcgtccgctcgtgttgttcccaaggtgttgaaccccacgtcaagattctcgagaagcgctttgtgctcttcaatcttgccaaagtccaccacgtgctgatccagcttctctttaccagggccatcgtacgctaccactcgccgtccaagcgtcacaattc

SEQ ID NO: 15062 - DNA, 488 bp, Physcomitrella patens
  Predicted polypeptide sequence is orthologous to G2574
taatataaattgcaattcacaaatacatttttttaattacaaataatatccagtcgtcactcaattccgcccccctacgctcccaaacgtggataatatcacattttgcatactcgaaatcacagatctgaacatcattcgtaagtactcaaattgcagagtccccagaagaacaaaatgttgaaccttcaagtgggatttgtaacttacaagtccggtaaaggaataacacgaacaagaccaaagcctgctctggttatgcttatcttccatgccatcactcacaattcctccacacgccgccgctgcggcaacagtcggcagactagcaacctgcaattaggacggggattcgacaagcaagtccacaacaaccatgaaagagcacactaactcccaaaacatgtcaacgatcaatcgaccagtaaaacgagcgcagagagagagagcagcgctgaaggaacgctatgatgagtgccgcactacac

SEQ ID NO: 15063 - DNA, 717 bp, Physcomitrella patens
  Predicted polypeptide sequence is orthologous to G2574
gtcagctgactccgcaacaaatatcacttggatcagaagcaatcaaagtctaacaatcaacagggtggttcttagtcacaggaattgcatcccactatcttcttggggatatcaactcaaatgtcacctattatgaataacaacttcaggaaaagggtatttcccatcatgtctatattgtgaccttgcatcaatgttgagcctagacattgtagcaaagtcgaaccttacagtacaaagccaaaaagctaacctttttctaaagggtcctgaatacaacgctccccggaaataaaatggttagcatccatctcctacctatcaaatacaactccagtcattacagttccaaaatgtccaaagaggagtgcacagatatttactatgctcctgagcttcatccaggaatcgagtgctgacgggtaatagacagccactgtgacagttcagtgttaaacaaagggattaacaccaccagcggggcggacaacgttttgtgagaaaaattggttgttgggataaggaccgtcttgaccaaggggttgagtggatatgtatcctccagaaacattcgactgcgttgaaaacacagggctaggtgacgtcgattgatctgagccgaagttaagagatcctggaggaaaagaatgatcatgaaactgcgagaaggaatgtgcccagtcatgtgtagccgcattggttggtatagtctgtgga

SEQ ID NO: 15064 - DNA, 721 bp, Physcomitrella patens
  misc_feature (712)..(712): n is a, c, g, or t
  Predicted polypeptide sequence is orthologous to G2592, G2713
actgctgttgctgagaacaaaaaatgggcataataagacaccatcatccaattagagagtaattttcagaaactaaacaaaagaatgctaacttatgtacagttcgaatagctgagagggacagtatcttacctgggcaacctggtaagtacaaggccctaacctacacaaagtctcaacggtgactaaaatgtccatttctttgagaggccaccagaacagttcgtacacatcgctctctctatggtaagatgagaaatcatgagatagcgttatgcgacacaaaccaccatcaagcaggaaccatcgtggtgttcgaacctgctcaataaaccgtagcactatggaccccgacacagtgtctttcaattagtgaagtggacccaacgagacacacgaaaagagtccagtcattcacaaaaaattaagaactggacttcaaggaatgaagataacaacgctcttccgtctcactgcacaacgtcctactcacaagccaacttcgtgtcaaagctgctcaaacagatcgcaaacgcctggaaagcgctcagagggtaccggtagtccatcgtgaacatgtccttcccaatcttcccgaactgcagcagcacccttgtcgtggtccgcggacgaacttgacgtcgttgctgcggcacttaccgccttcaccgatgtcgccgccaccaactgggaaattcttcaccgacgccancgtcaccct

SEQ ID NO: 15065 - DNA, 659 bp, Physcomitrella patens
  misc_feature (655)..(655): n is a, c, g, or t
  Predicted polypeptide sequence is orthologous to G2592, G2713
taacgtctttcaagggctttctggaagtggagtgtcatcaacctatttacagatcgcctaccatattcacatcttgcaatagcagattctccacttccaagcgccggcttctttcatttgtacaattttgtcagctgggcggagggctagagaaaatgcatcaccgctcttgacggaatacatacatatgttgaaatcagtgtgcaaaatttcagctccccagagtattaaagctatataacctagtttcaaccccagatagaatgtaaaaggataatcttcggacttaaactagctgtaagttaagtttcacaaatcataattccaactccatactccgaagtttccatgtacaacctattcacaggccaacttcgtatcaaagctgctcaaacagatcgcgaaggcttgaaaagcactcaaaggatatcggtagtccattgtaaatatgtccttcccaatcttcccgaactgtagcagcaccttatcacgatcactctgtgagcttgtcggtagcgattccattgaggccaccaactgaaagttcttcactgatgccacagtcaccctgccacggaagttcagacaccaacactgcagctgttcatgccagcgaggagctttgttcttcagtactaaaaggctcgtccttggncaaa

SEQ ID NO: 15066 - DNA, 727 bp, Physcomitrella patens
  misc_feature (724)..(724): n is a, c, g, or t
  Predicted polypeptide sequence is orthologous to G2592, G2713
ctgaaagcgacaagctgtttacctggaagacctacctaaaaggtacatgacccttaactaaccaggagtggaattaggactaaaacgctaaatttcaagacgctactgaatgagccagtaaagattgactccatgatcagagctaagcagtcacagactgcgtcctacgatgccaaacatccttttttaaggaaccatcgtcgtgtcaaaacctgccagctgaaaaatagcaaaatggaggctaacaaaatggtgttccaagaataagaaaacctaccaaatgacacatgtggcaactacacaatctttcagaaaaaatgagctaagcatcaaggaaagactgatagcatcacccttccctctcaccccacaaaaccctattcacaagccaacttcgtatcaaagctgctcagacagattgcaaacgcctgaaaagcgctcaaagggtaccggtaatccatcgtaaacatgtccttcccgatcttcccgaactgcagcagcaccttgtcgtggtccgatcccgaactcgtcggtgctggtgtcgctgcacctgctccacctccacctcccgttgctgctgccgcctcacccgccgtcgtactcgtcgtcgtcgacgatgtcgtcgcagccaccagctggaagttcttcacagacgccaccgtcaccctttcccgaaagttcaagcaccagcactgcagctgctcgtgccatcgcggtgccttgntct

SEQ ID NO: 15067 - DNA, 776 bp, Physcomitrella patens
  misc_feature (723)..(723): n is a, c, g, or t
  Predicted polypeptide sequence is orthologous to G2633
atcttgaagattaagagcattctttccgatacacttggcatctttttgctggggtcactaactagcagtgctcaccagctaaatccgtttcagtgctttatgtgggaaatactctgtcatcggatgcaatgctactccatttttccttcagctagttcacaaacactggcgggacatcaagaaaccacaaagcgtctagcccgtaaaattcagctgctatgaaatatataccaaaatacaaggtgacccactctgtaaaatcaactaaatcaaaattgataatttctaatctattctcttgaagaaaggcaactctcgcaacgctactctttggaatccacaatgacagtcttagaagcccactgcatactctgcctccttcttgtataaggtggttcctgaaccataagtttgctaatgctacaacaggacaaatataaaatccgtccaaacaccaatcacacgaaagtaccctcaagcacatacgcaaaacttgctctatgcttaagtactgaagtgaggctttcgaagtcaactcctcataccagagtaggcaatcaagattgctacacatccagccagtacaaccttgacagtgtaagtaatggtaatgttttgataggcactagaagtatccatcgttaagcggtgtccagttacgccgctgacgcaccctcatcaccattgacagaaagagcaaaaggtccgatcttcacatcgaangtggctactgacttatcggcggggtatttcatctggtaagtaccttccattcg

SEQ ID NO: 15068 - DNA, 724 bp, Physcomitrella patens
  misc_feature (642)..(642): n is a, c, g, or t
  Predicted polypeptide sequence is orthologous to G2649
aatctggtctgttcatcatacaccatgtacagcatcgtcaaactccatcctagtccaaccctatcagtcttaacttcttacaaaatttgtccctcatgaaacagtctgccacacagtgtaccattcgtcgctggaccacagtgctgggatcatcgccttagagggctcattcaagcccaatcagaccccttgctactacgtaaaccacggaggtacacgcgaatcctcacccccaagaagcgcgttgccaggaccatacattccagaaggatccagcagaggggacgacgatggaaggttgcttcgcacgccccctgctccacctccgcccaggtgtagctcgctcggattcgatgtaacagctggtggagcaagatctagcccttgatcatacaacagtcccttgaaaatgtgtcctcctatcttcactgtggcttgataagcacactcattttcgccatcttccacgcctgtcactcgcacacacttgaatagcgcttgagctcgcacttccggcggcaatccccccctgccttgggctggttgagatgggtgaccagagttgatatcagagccgcggggcgaatttgcagacgttgtagtcatagatgtggttgctccggcaggtacagacagtgcganggtgcgggcacgtttcgactttggcctgggttgtccagcggctgctgctgctgcctccgcggcttgacgctcacgcctctta

SEQ ID NO: 15069 - DNA, 189 bp, Physcomitrella patens
  Predicted polypeptide sequence is orthologous to G2701
gtgtcaggctcgagacacactgcatccgtgggcatttcttggtgttgacccacatttcagtgccatggttgagtaagtcaacatttactgtagcagcagcttgacacaggtgggaactctgtgcaaccctcccacagcataaagtatggggaaataatggggttaaccatcaaccacacaaaaaaaaaa

SEQ ID NO: 15070 - DNA, 725 bp, Physcomitrella patens
  Predicted polypeptide sequence is orthologous to G2834
acgtgttgttaattttttttcagaaagaccaccggaagcggtattgtggtgcctgcttacatatgattggggactagcggtcatcaggacgctcggcccacacggatcaaacaacaaggtagcctggaggtagtcctattttaatctctacaaatttacaacatcactttcagggtcttactatacagctgaattgggcgacgttaacaggatcaacgaaaatcgtcgtgtatcagagaccaggagttccgatcacaggaaaaacttgcggatattcgtctgatctctcaaaattggcttctgggccaatgacctcgtcattcccaaaaagccatcggagacttgcttcctaaaccaaacgcttcagcgggtgactggtgatgatccacaattaaattcgatccaaccccaccttccatatcatgcagaggcattgcaggagcatgacccacgaacaaaccaatgtgccccacaagcttatctttccgtgaaaaagtagtgccacaagaacacagccacttttcacgaccacagtgcttttcatgagtctttaagtccgcaacaactgaaaatttcttcgtcgagcacttctggcaattgagaactttcggacaatggctacggcgatagtgattcttcacacacagaagagtctttagaggctggaacttgcgatgtttcttgttcctcttacatcccacatacgggcaggagtatcgcctcga

SEQ ID NO: 15071 - DNA, 696 bp, Physcomitrella patens
  Predicted polypeptide sequence is orthologous to G2851
gccggacaatttcaagcttctacttcatgattggtacaatggggagagaaggggatcatgaatttaattcagcaaatagagcctaagagtagtcctaaatatacatcgggctatgagagcttttgttatatacggagaattattgtaacaatactaaccccgttaccgctggcatatcaaacatgtcgaacgccataggttgtggtaccaagcctggggctagcgtggtaaccatgcgcttgcaagctatctcgatgatgatgtttggttcccaactgggacatcatcgacaagtcctctccatcatgggctgaaaaggatctccatttcgaccacttcgactgtttagtgttgttgctggtgccgcttgttaatgccatgtccaaagatcgacgagctgtttcaaagtcgctggaggcgaaccgaggtctttcctttccttcaaaagaatcgatagatggaggtgactccacggaatattttaaagacaaacttggagaagagtgaatcgtagtgttgagtctccacatctttttgtcacctgatccagattgcactctaccaggagctgtcaagtggagtgtagcatgtctaggagccgcggagaccccacagccggatacactcctttgtagcgagggactcttgtgaccaatctgcggattgctaggggtagttagcagtccactatgccca

SEQ ID NO: 15072 - DNA, 761 bp, Physcomitrella patens
  misc_feature (716)..(716): n is a, c, g, or t
  Predicted polypeptide sequence is orthologous to G2854
cctctcttctgttacgcctcgattatcaatacaagtgaaaagaagcggaccgagtccctcgtctatcgactaaccagttcaagcttttcattgctcggcagaaaagtccatccggatgttacacctaacccaacgcgtctacccatggcccccaagcctacgtcaaaacatacaaaaagctttccactacccctgcagaaccagcttcggcctggcatcttatgacttcaaaatgttgcaacatctattgccttgccatcagtacatgtgaaggtaaaaaggcatcccacgtttcaaccactattctgcactgtcacacacgccaaaaacgctccagcaggaaatcacttctcacagttgctgaactcttcactgctggggatagtttccgtagccagggtagttcccgtattgagcgtatgcagggtcctgcggcggctgtgctggatatccgtactgatcgtacccttgcgcatatccctggtagtaccctcccgcgttccactggtttgggtcttggtgctggccccatccaggatcagcagtctgtttgttcccaggacttctcccccacgacagccgcaccgcttgcgtcccgatcaccgtctggtgaagcctttgcagcgcctcctctgcacaagctctgtgtgtgaactggacgaaaccgcagcctttcccagccgggaatcttcacgtacaccagctccccgaattgnccaaacacgtttctcaaatcttcgtcgcctacagctggggtcaag

SEQ ID NO: 15073 - DNA, 636 bp, Physcomitrella patens
  Predicted polypeptide sequence is orthologous to G2994
tgtgtttttcttcttgtaagcataccgacttcacatctaacagtgagtgatcaacatgtgctgccctaccaactacgagaaatgagcccaatatgggggcaaaaaatcatgtgcgcgttgtgacacatcaccgcaacacggtggccatgaacacacaacgcaagaatgagggcgatcatcgcgaaacagactgtacaaagtgtcgctcacaaggcttgcaactgtctatctttctccagcggaacagcgttgtgttcgtcgccgaagctgcggcacctcgcgcgtcgctttgtgctgacaggcaggctccccaggaatgtagtttttcatgatggaggagcagttcatcacacgctgggacgtgtccaccatttctcttgctcacagtctccacattcagcggcccttcaggagcctccagcatcgccttcgcccccgcagcatcgttccggccatggttggaacgtcgatatcggtgctccatcggcggggaaccgcagtctctagtagctggtgccgctgaaaaggactgctcccggcgagcgtgatccagacgggaacctaccagcacttaacacttcttttcgtccacttggaaccacctccatcaccgtcggtgcgtcgtcccgccatcag

SEQ ID NO: 15074 - DNA, 587 bp, Physcomitrella patens
  Predicted polypeptide sequence is orthologous to G3032
tggggaactccgtgtttagtcgccggagcaagctgcgagcttaccatataatagcactggacttgtgttctatccagggtatatgtgctgctcaaatctcgcacttattcgcgatttcaacgggctgcgactgaggctgctttgggagggtggtcggagctgatcgggagcggcgcttggtttttggcgtcgagcttcacaattaatggggggaggggaggacgacgagatctcgatggcagaggtcccgatgcagactgcggagaaggaaagggtcgacggattctgccccggaagggttgagaagacaacggagggtggtgcgaaagaaggtggaggtccagaggtgtcgctggcaattcatggagagaagtcaaataaacaggatgagagtaggattgaaacgaatgactccagcttagcgaatgataaagatggatcacaacaagtatgttcgggcagtgactatgacggcggcaaaagtgatgacgtagaatccaccggtggaggtggatatcctaaaactaacgaaccaatccaagatgcctctgctgcccaaatcgcccaagagaacaatgatgtagcaa

SEQ ID NO: 15075 - DNA, 2108 bp, Physcomitrella patens
  Predicted polypeptide sequence is orthologous to G3032
gcgggcggggaatcatcgctagcggggaagggagcgagggagagagagagagcgagcgaggaaggcaacatggagttgtcgaccctgccctctctgcatttctcccgcagtatttgcactgctgaggtgcggcagccaggttgttgtggaattggctccggtttcgcaacggcagcgtctcggattgagcccaggctgggaggtggagctgcagtattgcggcgagctagccatggctatggcgtgggatgtgaattttctataccacgcttcgtgttggggtcattagatcataagttgggtgaaaagctgttgcgtagggctgtgagaagcggagcgtcgggtttgaggaatcgacgggaatggagatgtatgaacgcggaatttggagctgatgccagcaacgcgggttcgccaggatctgtgcattttgttggtattggaggagcggggctttcagcacttggtcttcttgcactgcgacagggttggcaagtaagtgggtccgacttggtatggagcgaggaagttatccggttgaaagaggctggtgcccgtgcatatgttggccacagtgtggctcaactggtgcctcaagggtcgcagccgccggatgctgttgttgtatccagtgccgtgggtccaggcaacgaggaggttgaggctgctcgtgccctaaatgtgcccatttacaagaggggtgattggctagggaagattacagaaggctaccaactgatagccgttgctggaactcacggtaagaccacgacgacagcaatgttaagtgtggtcctgcgcaacttaggggaggacattactgctattgtgggtgctcaagttccacagtttccagatggaggcagtgcattgtgtggaacgactcgcaagtttgttttagaggccgatgagtatgatggctgcttcctaggtgtttcacctcacctcgcagtattgacgaatgttgaatgggaacacgtcgacatgtttcctgatgaggaagctgtcaaaaatatgttcaagaagttcgtcttgcaaatcaagccaggaggttgtcttgttgcttgtggcgacagtgccggtgctaaatccgtgttaggactgatagaagaggagcaagagaaagatttaggttctccattccccagagagagacgggttgtaacttttggtttaggagcgagcgattggcgagcgataatgcttgtcccaaatccacagggtggaactgattatacggttgtatacaagaacaggcccatgactcgagtcagtttacgcttgcctggcatgtacaatgtgctcaattctctcgctgtcattgtggttatgtcgctgctggcagcagagaaggaaagcgacgttggggcacaggcaaaactcatgaagaggaccgccgaggccgcaggaagagctctaggagctttttcgggagtacgcagacgctttgattttgtaggatctgttcatggatgtcatataatcgacgactatgcccatcatccaactgaggttcgtgctgttctacaagcagctcgtcaacgatatgatcagcagcccatctgggtgatatttcaacctcatacggttagccggttggctgcatttctaccagactttgctccggcttttagtgctgcagatcgagttattgtgacacaggtgtatgctgctcgcaacattccaactgagaaggttgtaactggggaagatttagccaatgccattattgggcctccagccgtctatattccagacttggatgttgtagttgagcggctatcgtgggaactggcagccctagataagaatgagatgaatgaccgcggcaacattgtgttgcttactcttggtgctggtgatattaccgacgtgggtcgacgactcatgcaggcatgtgaagtcgcatcacgatagaactttacttcgaaaacccaaattttactctgcatcgattcctgagcgtaggcagctttatgttggtggtatgagtctgttggtttcttcgctggctcacactcatcacatgattttatttcttatgtaatttgttcctgtggttataacttaaagatagcccttgcaacaaaagatgctttcacagtgcc

SEQ ID NO: 15076 - DNA, 2261 bp, Physcomitrella patens
  Predicted polypeptide sequence is orthologous to G3032
tggagagagagtgagtgagtgagagagtgagagttagtgagagcgggcggggaatcatcgctagcggggaagggagcgagggagagagagagagcgagcgaggaaggcaacatggagttgtcgaccctgccctctctgcatttctcccgcagtatttgcactgctgaggtgcggcagccaggttgttgtggaattggctccggtttcgcaacggcagcgtctcggattgagcccaggctgggaggtggagctgcagtattgcggcgagctagccatggctatggcgtgggatgtgaattttctataccacgcttcgtgttggggtcattagatcataagttgggtgaaaagctgttgcgtagggctgtgagaagcggagcgtcgggtttgaggaatcgacgggaatggagatgtatgaacgcggaatttggagctgatgccagcaacgcgggttcgccaggatctgtgcattttgttggtattggaggagcggggctttcagcacttggtcttcttgcactgcgacagggttggcaagtaagtgggtccgacttggtatggagcgaggaagttatccggttgaaagaggctggtgcccgtgcatatgttggccacagtgtggctcaactggtgcctcaagggtcgcagccgccggatgctgttgttgtatccagtgccgtgggtccaggcaacgaggaggttgaggctgctcgtgccctaaatgtgcccatttacaagaggggtgattggctagggaagattacagaaggctaccaactgatagccgttgctggaactcacggtaagaccacgacgacagcaatgttaagtgtggtcctgcgcaacttaggggaggacattactgctattgtgggtgctcaagttccacagtttccagatggaggcagtgcattgtgtggaacgactcgcaagtttgttttagaggccgatgagtatgatggctgcttcctaggtgtttcacctcacctcgcagtattgacgaatgttgaatgggaacacgtcgacatgtttcctgatgaggaagctgtcaaaaatatgttcaagaagttcgtcttgcaaatcaagccaggaggttgtcttgttgcttgtggcgacagtgccggtgctaaatccgtgttaggactgatagaagaggagcaagagaaagatttaggttctccattccccagagagagacgggttgtaacttttggtttaggagcgagcgattggcgagcgataatgcttgtcccaaatccacagggtggaactgattatacggttgtatacaagaacaggcccatgactcgagtcagtttacgcttgcctggcatgtacaatgtgctcaattctctcgctattggcaggtcattgtggttatgtcgctgctggcagcagagaaggaaagcgacgttggggcacaggcaaaactcatgaagaggaccgccgaggccgcaggaagagctctaggagctttttcgggagtacgcagacgctttgattttgtaggatctgttcatggatgtcatataatcgacgactatgcccatcatccaactgaggttcgtgctgttctacaagcagctcgtcaacgatatgatcagcagcccatctgggtgatatttcaacctcatacggttaggtaggtacttagttcctgaaacttgaatgtttttcacttttttgaagactccgttaataacatcttttgttgatttttgttgtcacagccggttggctgcatttctaccagactttgctccggcttttagtgctgcagatcgagttattgtgacacaggtgtatgctgctcgcaacattccaactgagaaggttgtaactggggaagatttagccaatgccattattgggcctccagccgtctatattccagacttggatgttgtagttgagcggctatcgtgggaactggcagccctagataagaatgagatgaatgaccgcggcaacattgtgttgcttactcttggtgctggtgatattaccgacgtgggtcgacgactcatgcaggcatgtgaagtcgcatcacgatagaactttacttcgaaaacccaaattttactctgcatcgattcctgagcgtaggcagctttatgttggtggtatgagtctgttggtttcttcgctggctcacactcatcacatgattttatttcttatgtaatttgttcctgtggttataacttaaagatagcccttgcaacaaaagatgctttcacagtgccaaaaaaaaaaaaaaa

SEQ ID NO: 15077 - DNA, 733 bp, Physcomitrella patens
  Predicted polypeptide sequence is orthologous to G3059
gatatgtctaagacgcatggaagtttttacaaatgtggcttgagcaccacgctttctcaatagggttcgattgtttgcttcagtaaagatcaggaaatggcctaaaatcataacgatttcacctattattatacacaatgtgcttacaaaaaccgggtctaggatttttgctactcaccgcagcatttcagcggctgattcttccatgataggatcgtatagttgcggatgctgcacaaattgatagaagaacgtcgccggctgcaaagattgagagaagaaatgggaagaaatggagcgagggtggatgtgggggaagagttggtttctagaggccgcagcagcaaggtccatggcaaggccatgtgcacacccagcacgcaatgaacgccgccgcgcaccaattcgcagctcggttgctcttcttggggtgtgtcccagatgggccgtaaatcactggaccctgcgggtgttgcacgtacccgcttccatggttggcattgtactgcggttgtgcgttgccgcgggtgtcgtatgcgtatccttgctcaggcacgttcacatccgcccctgcttcatagccgtagcctagtttctgtcccgcgggggtagttcgctgttcctcctacgcctccccccgccggaacgttcacataatcctcagtgtggttatgcctcctgtgaaacatcttcgcaggctttactacttgggtgtgcgaaacttctctgaaga

SEQ ID NO: 15078 - DNA, 708 bp, Physcomitrella patens
  misc_feature (10)..(10): n is a, c, g, or t
  Predicted polypeptide sequence is orthologous to G3086
gtttgctttncacccaacaatccgtgcatttacaaccggaggggacggcaccaacgaactccaaacttaataccgatcgactgtacaagtttcgcaaacctggaatgtgagtcagatttcaatggtaacgtcgaattcatgatatgttacaaaacgccgagaaatacgcagaaatcagtcgtcccactcatgagctcgtgatttgagtggcgctagcagctttgagcttcgcaatcgtctcttggagctcggaaactttcacttgcagcgacttcacatactccacagtttcgtccagcatatcagccgtgttggtcgtcttttccatattgggcaccaggtcctgcaatttcttcattcgctcactgatgcgagtccgcctcacgcgctccgctatgctcctggggtgggtggcacatccacgcttggcccgagctcgcatctggacgtaatggtcatcagtgttaaggctcatgtttggcacatctccagatgttggcaagctcatgtggcggataagaccagtggactggttattgttcagccggtatgatttggagttcaactccgagccactcgatatctcgttttctcccacaaaccctcgttgcctctttccccctggagtgcctgggcttgttggcatagaagtcacagtatcgttgttcaacaaatcgtcctgtgaatacatagccgctttgagtccac

SEQ ID NO: 15079 - DNA, 668 bp, Physcomitrella patens
  misc_feature (447)..(447): n is a, c, g, or t
  misc_feature (508)..(508): n is a, c, g, or t
  misc_feature (516)..(516): n is a, c, g, or t
  Predicted polypeptide sequence is orthologous to G3091
ttttttagtttttttagttatttatttatttattattttttttaatacatcaaacagcatcctatacttctacccgctttccgaaaggagcagcacacgatgcagaagggaacgctatgtataaaaacaccacctttggtacacgggaagagagttctgtgtcggcacttctgctgcatgcaaactctctcgatccatttgttgttgttgttgttgttgttgctatactaacaagcagtaatcacagcgctaccctttgaagtgatatatacacttaaggtttctagacactgcactcacaagccctactaatcctaaggtttcgtcgagaatacgcacagtttttttttatatacagtcggtggcgggtcgacggaaaacctggtgtcggccgactgccgccccgatcatgtctttgtcttttgagtgtctaaatgatgctactanaacaagtggtcgcacctgttgtgtggacgtttgggcaggtggatggatgtcaggcacgganaggagctntgtgaggaattcccttgcggcgtttagcgattcggaggacgttggcgcgaggcggtgttctcggcgacatgtcgaccacgagaacaggcaaggagctcgtcgcgcggtggaggtgctctgcactacatgctggtgagggcagcaggcccgcc

SEQ ID NO: 15080 - DNA, 738 bp, Physcomitrella patens
  misc_feature (737)..(737): n is a, c, g, or t
  Predicted polypeptide sequence is orthologous to G3091
ataaatagaactacaacaagcaagatctgcttgacactacttagtaaatgaggatctctgtaaattgtctgtaattgcgggccaccaactatgtctcaacccgcgggacagttagccctctcttctcggattggaacgcttctctacccaagtcccaaagccaaccctcggctcctcattccgatccggtcccaacagagactccctacctagtgtgtgcctaccgcagacggaagaatcaagaactacagccgaaactctactaggatcattgtccatagaaatcagcctgagttgggctgtcgaggcttccaatcgcctcggcccgccgtgtgtagcaaaaaacttcgcagactcttaaagtatatcgtcgagctagcagacatacaagaatcaatcaaaccgctccttccaacctctgtaactgtaggaataactctcgaccggactgggagaaccagccgcttctgctgttccgatcagtcgtaagaaacgacctgcagctttgtcgatgaaacctcccgtacaagggaggccaataacaactactgggtaaccgactgagcgagataccaaaaaatatgtgggatggaggatgaattacgcaacatggctctctacttggagcacgtgcctaacaaaatggagatctgtgaggggtccctttccttctcttcacagacaccggaaatattacagacttcggcgacgtcgctatcgccgaaatacgtccgctnc

SEQ ID NO: 15081 - DNA, 972 bp, Aquilegia formos X Aquilegia pubescens
  Predicted polypeptide sequence is orthologous to G28, G22, G1006
atccaaaactctctctcgtctcttgcactctcaagtctcaaaacaaaatcccctccctcccaccttaattttatgtaccaatcgaaatattctgattctgattttggtttaattgattcaattagtagacatttacttgaaacttcaaattccaacactatgagtttctcttcatcgaatccttcaatttattgtagaagttcaagttttagtagtttgttcccatgtttaacagaaaactggggtgatttaccattaaaagttgatgattcagaagagatgttagtttatggtgttcttcgtgatgcttttcatgatggttggttaccttgtttagattcttcaaacttaacggtaaattccgttaagtctgaacctatagatcaaagatttcaactacaacaacaacaacaacaacaacaacagcagcagcatcaacaacaacaacaacaacaacaacaacaacaactagctcatcagcatcatcagcttcaaaatgtaatgatgaatacaagaataccggaaaaagcgacgaaacccgttgtcgcaaagccaccagtagtaaaaggaaagcattatagaggagtaagacaaagaccatggggaaaatttgcagctgaaataagagatccggcaaagaatggagctagagtttggcttggaacatttgaaacggctgaagatgcggctttagcttatgatcgagcggcgtttcgaatgcgtggatcacgtgctttgcttaatttcccactcagagttggtttaaatgagtcaatgactcagcaacaaccgattcaaggcacgtcaaagcgttcgtcaccggaatctacgtcatcttctgcgtcattttgtttaacggataatggttcaccgaagagaaggaaaaagagtgttaaatcggagagtcagagcggaggtgaattggtgagtaagttgagtcagtaatagtactgcaatagtgcaatgaatgat

SEQ ID NO: 15082 - DNA, 952 bp, Aquilegia formos X Aquilegia pubescens
  Predicted polypeptide sequence is orthologous to G1073, G1067, G2156
cataacatggtaacatacacactagatctggaaatcgatgagaggaagattgatgattgaaaaatataaaagtgaaagaaaaggcaagacaaaagatccggaaaataaaatgctttgtacatgaagttcaatttactgacctagtggagtcttttctaccatcttgtttatatggaagacctatttcttcaataaataggtatcaacatatcaaaaagcttgcgtcaaaatggtggcctagtagcattaccaccccaaccatatgcatccccaggtaactgtaaatttcccatgttcattcccaaattataaaatgaaacaccactaccacttggaccacctcctcctccaccacttccattagcaccttcccctaattgtgcaccaacacctcccccaccaccagttacacctgaggactgtgacgcggtaggctgtaactgcctaggagactcgtcttcctccaatggtagcctttcaaacacggcatttgcaaatgaagcagccatcaaaaccactggaccagatgccatcaattgcccaacgacactgccaccgacaacctgcccttgtccacctgataaaaatattgtaagcccacctgcacctggaggtgctggtggtgggagaactgtacctgacagtgatagaatttcaaagcgaccgtgcagtgtgactacacctcctgatggagtggccggttggcgtaatgtgacatttacgactgtaccaccaccactgagaacacaaacccctcggcctctttgccttgcgtaattggacacacattccattatgtcagcacctgatgatacttcaagaacatgagatcttagtgcatttgggctatcccgagtgacaattatagggggtttcggtttgttctttgaaccaggaggtcgacctctaggtctgcgggaggcattattacctccaccgggagctagttgta

SEQ ID NO: 15083 - DNA, 915 bp, Aquilegia formos X Aquilegia pubescens
  Predicted polypeptide sequence is orthologous to G1760, G152, G153, G860
agaaaaccagatctctctttcttcttctagttttctctcactttattcatcttcttcttcgttgattgtgccctagatcttaaaattctctttattagttttgtttcagtactcaaaccaaccaattccaaagcttcatcaatgcagattacgtgtggatttcgacgatcgttatcttcataatctttgttaattatttgctgagtttcgcttaaattaactgagtaatcaatatgtaaaagaaatatatcaatgctcggatcgttaactatctgttcagcacataacatgattcctttcagtacatatcagtttatcagattttgaaggaatatggaagtgttcagtttaccccaacttggtagcccctggtgaagtctcatagttttgttgctctggctgacacaactggaggtggataggaacatgcaactcttctgaaatgctgaaaccatttggaagagagaagattgcataatgtcaaaagcagattcagcagagaatacatgaaacacatttaaaatggtggtaggtctataaaatatggcgaaggaaagttgatggatacctttacttctgaagttggattcaatagttgatgatgttcctccttggatttgttgtatcgttcaataacagtcttcatgctgataatgacacaggaaatgttttggaaatctgctctcagttgagattgggttgtattggagcacccagaaccagcatgtagagtggttccagaaagatgcattgctgcatgggaaaggaactggcttgactaataactactgggcccaatgttgtgctattgctgagttgtgaattggcaagacagcatggcttagtgtatggatggaatcaaactctgctgctgcagttaatgcattcagagaggcaaaataccatgggagctaa

SEQ ID NO: 15084 - DNA, 914 bp, Aquilegia formos X Aquilegia pubescens
  Predicted polypeptide sequence is orthologous to G1945, G2155
ttatctaaagaaaaaaaaaaaaaagcattattaacaacatacattttaaagtaaacaaaattacataaacatgaatcaaaaaggttgttgttgttgttgtggttgtgggagtcttggagttggagtccaaataagatcagaaggtgaaacatgatacatagacataccaccacaattatctaccatttgatgattagaagatgaatcttgatgatgatgattatcttcagaagatggtattgatgatatttgttgttgtaatggtgatacatcatctaattcaataggtaaacgatgatatgaaggattatcaaatgaagcagctataataaaaacagttccagctgtaaccaaagaaccagcaactgacccaccaataatctgaccttgtggacccactaatgatatcataaatgaagatggcagaatcaatggtgttgatgatactactgtttctgatgatcgaattggtaaagatggtggaagaaaagtagctgaaatagaaagaatctcaaaacgaccattaaatataaccgttgaagaagaaccattgcttggtggtggtggtgttgatgtagtattgctgttgttaacagaaggttgacggagtgaaacgttagtaacagaaccagaagcagtgagaactgttaaaccaatgttacgtttatgagtaaaacgagctatagcttcaataacatcgattccatttggtaattctaagaaaagtgggcgcattgcacactctgttgttgtatctcgtgttataatcaatggtggttttggtttattttttgaacctggtggtcgccctcttggtctttttccagctacttctatactaccgccaccaccttgacttcttctccgttgaatgatctttgttgtagttctgatgatttgggttcggtttgagt

SEQ ID NO: 15085 - DNA, 921 bp, Aquilegia formos X Aquilegia pubescens
  Predicted polypeptide sequence is orthologous to G2
tcttattccgatagagaattcatggttacaagaattaaattggcaaaataacaaatggggttagaagaactcattggaaaaagcagatgatatactggatcaagggagctggcaaatcaataaactaacgagtcaggtggatctcatatgagagtggaaactgttcgttggccaagctgttgttggtctaattatctgcaatgggaatcctgatgatgctgcaggggtcgcatagggtgtaccagcaagccaactattactgcttctgttccagccagactgccgaagttgctcgcctgttggaagagaaggtccacctcccccacctagaccagttaggcctccattgtcgctatttggtaattggtagtttggtggactgaattgtggttgggcaatatgaaacatcgacacttctccactcctccttggctgcccatatatgaatggttcactggcattaagtctgttgggtggagattggatgtgggtctggttgagcaaccgtatggcctcactctcactatacgcattctgtttgtaaagatagctatgatttgcccccatgtgatttgcattggcatcaaacttgcgcatagaaccgcgttgattgttgctccaatctgatacatacggcatctgggaatatctcggatccattgcatgcaatctgttgtcatccctcgattcatgactatcactagtagaggttgaattccccaggctcaaatcaagattatgaacagcattgttaccttgcagcttctgtttcagtatcgaagagaccaagatacacatatccaaaaattgtcccattctagcttcccatcttccacatttgtgtaaggtaacccctctaaatttagagcttcctctaggaaatccggtactttggcgacgaagtacatgaacaaattcctc

SEQ ID NO: 15086 - DNA, 971 bp, Aquilegia formos X Aquilegia pubescens
  Predicted polypeptide sequence is orthologous to G2
tggaatgatgagaagattaattaacatgacaaattaacttgaaaaagagtggtggttatctctgctcatctcatgaaagagtgaaatccattctttggcagatatgtacttgtttgtgaagggaatcctgatgatgctgcacctgtgtatatttgttgttggttaggtggatttgatccccaactagtccaaccaggttgttgctgctctcctgttgctagatacagccctccacttccaattcctatgcctgttcggcttccgttgctgctgctaggaaattggttcataggtggattgaaatgatgaaggagttgaaccataggggttcctccatttctgttgaattgatcatatcttggcagatcagccatcctgagtgagactggtgattgaatgtgtgtttggttgagaagtcgaattgcatctctctccttacttcctccaaattgctcatccaaaggcattggcctaatgccatgattggtggtgttattcctccaatctgtttcaaaccgccgtggtgacaatggacggtctctttcctgaatcccattcttggatgaattccccaagctcaaatcaagattatgattggggacactaccatttgagctgagctcagtttcataaatactaggatcaaaattggtcacagcctccttcccattatacttgattgcagccttgtcgtaagccctggctgcttcaatttcagtgtcgaaaaggcccaaatacacatattttttgcccaagaactgccccatccttgcctcccatcttccacatttgtgcaaagtaacacctctaaattttgaacttcctctaggaaatccggtactttggcgacgaagtacatgaacaaactcctccttagttagattattcatctgttttagatcatcttcataatcattaagactaaaatttatatctgcttcactcccctgacttgatgctgctctatcata

SEQ ID NO: 15087 - DNA, 919 bp, Aquilegia formos X Aquilegia pubescens
  Predicted polypeptide sequence is orthologous to G2
catatataccctccatttaataagaaggttcaagcctaaaccacattctgtattgtgtgttggtaatgggaaaacatatttaccatatattatgtcaagcagatatgaagtctcaatacatatacacgagaaggggatgaattagatgaccacaatggtcgttctggttgcttacccccaaacttgtcattgtattttggtgattcagctccagcagcaatgttgtcgtggttttaacttctgtagtggtgttgggaggtggtggaaggaggataatatccatagtgtgtcatgcttatatgcggagggtgtggtggatgaagggcagctgccgaaacggaggtacttgacgaagagaatcctgatgatgctgcagtagagaacagtggcattggggtactgtcatctatgtggccgtgcagttgccatgcccagttggagagacgcctagaacctacttcaacccttttctctatctttctttcctcataattaggaaagaagctgggatatccaccattccacatgggaggatgcttggatcccattgccaggccatagaggggttgaccgcccaaggttgtcaaagaggggttgtctgtccttgctctcttggcatcaagcaagttgagagggtcaacgtggagattaaaagctcccacactttcgctctgatttaggtcatcagcagaagaagggggagtgatccccaagttcatgtcaagattgcacgcatttcctccattttcaatttccatgatctcgctatcataagtgctgggctcaaaattggtaacggcttccctaccattacatttgattgctgccttgtcatatgcccttgcagcttctacttcgctgtcgaacagcccaagatatatatacttcttgccaagaaattgtcccatacgagcttccc

SEQ ID NO: 15088 - DNA, 920 bp, Aquilegia formos X Aquilegia pubescens
  Predicted polypeptide sequence is orthologous to G4
aaaaattgttctcagagtaggtatattttagtaccatgaagtcttatttacatacagacagcaagcagccaattcctcagaagacaccccccaccatctgagggaaatcttcaaagctccagaggtccatcgagttcccaccatcctgagtagcatccccactgaataggctatccattgaagaatcccagcttccctcaagatacggaatctgaagaaacttcatctgagactcgaaggcagacagctcctcagacaaattctttgctgtatttccctcaaatggtgccgcaaccccagaattggtcttcagtttcttacatgggttagcagcttccatgtattcagcagactcattgccttctgttgtagttgagagaactgaggttatttctggagtcttggattcatggtctccccacccaaaatcagaacaattaaacgagttgctcccttgatcagaagtaaaacagagggctcctccatcagatggggtaaaagactggagtccattttgatctttcattgctgcaaaacgactcataatccctgaccctttgatcacgggcttctcctccacaaatccaagagagtcattaaaaccttcacttgagtagttcataatactaaaatcctgattgaggattgggttctctattgtctggcttgctttaggcagtgccttctgtgaatttgtcttcacagtacgattttgagcagttgggaaattctcttcagggaaattaactttagctttgttgccccggattctacgtgcctcagcatcgtaagctcttgcagcttcttcagcagtgttgaagttccaagccacactcgtacaccttttctaggatctctgatttctgctgcccatttcccccaggggcgctgtcggatacctctgtattggttcttccttt

SEQ ID NO: 15089 - DNA, 923 bp, Aquilegia formos X Aquilegia pubescens
  Predicted polypeptide sequence is orthologous to G4
accctaacacaaaagccacacctgtcaaaattccaaccagggaagatgcagattataggtttttctcgacctacgccgccaaaattgccctgagcaataggacaaaaattctggatccaatacagtaataaacatgtttaactatgaaagagagacttagaaagttgtaagtttaagaacatgtaactttgtaaattggaggatatcaagaagcaaatttagaagatgccatccattggtagaagaaagtcatcaaggctccacatatcgatcttgcattcatcatccccgttgaggaggctctccattgctgcattacagctctcaaaatttgggatttcaaggaagttcaattctgactcaaaatctaagaaatcctcctgaagtttttttgtcgtatttccttcacctgggcctgtctcagagatagtctcaagtttcttattcatgttagcattttcagcagtctctagtctcttattcatgttagcatcttcagcagaataggatgcttcactaacaagacttgaaagacctggtgggatttcaggggcttctgaatgacaatccttcaatccaatgtttgaaccattcatgggattgctaccctggtccgatttaatgagggacgctccatcaggaagggtcaatgtgtcgagttcagttggattttcaatcatggagaaggaacctgtgagtttagagctattggctgagacctcctcctccataaagtcatgagaatcaaagaaattatggcctgggttgctccatacgttgaagttgtcattgagggtgaggttgaggttgagattagactcctccaagataggactggctttgggaagaagcttctgaagctttgacttgactgccttctgttcaacatcaaaggggatgttcatcatcgaagcttgcactag

SEQ ID NO: 15090 - DNA, 975 bp, Aquilegia formos X Aquilegia pubescens
  Predicted polypeptide sequence is orthologous to G5, G974
atattaaaattcagctaaattattacatgaatacagatacaacgaatgattctggtcatgcaatgaaaaaatatcagcagaccagaaaagaacacaagtattaacattacatgaagagttatatactagatcactacctaacactaagagccctgcaaatgcaaaaaactcattgcagtagctcactagacacactatgaacttgaacaattaacaacacaaaaataataatcttaatgactaataacataattaggatagtatagaatcccaatctatgtcaaatgaaggatacttctgcaatggatagttgtcaatggagggatacttctgcaaggcaaagttatctgaatcattccatggtgtttctgtgcattcctggaacctactaatatctgactcaggtgaagaagccacatcaatctctgattgagatgttgttaaggaactctccatcttgatatcttctgatccaagaatactcatttctccattagatagattttcaacactcttattaatcacattggtttggttttttgatgatttttggctcattgtcttcttcttcgcattcttcttcaatacgacagtgggcttccctaaattcccttgtttcatgttttcacaaatagcttcaagctttgcatcaacagatgaatgaaggggcttataatcaccaaattcactaccaacatgagaaccttgatgtcgaagatgagggaaattcaaccttgctaagtcaccacgtagcttgtaagcagccttatcataagccaaagctgcttcttcagcagtgtcaaaggtaccgagccaaagccgtgttcggtttcgaggcaatcggatctctgcaacccattttccccaatgtctttgcctaactcctctgtaaagcttggtggatttgatgatgacccacttgcttcattgggatggctttggactgagaaacttaggttgttgctgttgaagtgg

SEQ ID NO: 15091 - DNA, 1004 bp, Aquilegia formos X Aquilegia pubescens
  Predicted polypeptide sequence is orthologous to G5, G974
tacaagaagcttacataataaatctccctgatcaagcaagaaaaaactacaagatcagatggagagagacatatatgaacattaactcctaatctgcaactcccaactctctacaagaactaaacccctgcactattcctatcaaacctcactaaaagctctgcaactgcaaaaattccgttgcagaagcttacaagaggggactaaactgaacaaattacaaacaagatgaacaactacatgataattaggagagaatagcttcccaatccacctcgactgaagggtacttctgcaacataaattgttcgaatgaaggatatttctgcaacatgaagttgtctttctcatacatgggcgcctctgctaagtcctggaagatctcagacattggtgaataatactctgaagacacatcgctgctctcagttagagatggcgatggcgaaggcgatggtgatgatgaattttccactttaatatcttcttcactggatgaatcctcaactactactggtggttgcttgcccatagtcttcttcacagtgggcttccctgaattcccttgtttcaagctttgacaaatagcttcaagctttgcatcaacagaggaatgaaggggcttgtacccaccatattcaccaccaacatgagaaccttggtgacgaagatgagggaaattcaaccttgctagttcaccacgtagcttgtaagcagccttatcataagccaaagctgcctcttcagcagtatcaaaggtaccgagccaaagccgtgttcggtttctaggcaatcggatctctgcaacccattttccccaatgtctttgcctaactcctctataaagcttggtgggttttgatggtgaacccacttgcttcattggaatggcttttggactgagaaaactgagggtttttgctgttgaagttggtttagcttctggttatggattgaagctgctgcagccatagcagccatgtgttgttgttgttgctgaagtt

SEQ ID NO: 15092 - DNA, 879 bp, Aquilegia formos X Aquilegia pubescens
  Predicted polypeptide sequence is orthologous to G15
ggaagagaaagctgctagagcttatgatcttgccgcactcaagtactggggtgcttctacccatattaactttccgttggatagttaccaagacgaacttgaagagatgaagaacatgagtaggcaggaatatgtcgctcacttaagaaggaaaagcagtgggttctcaaggggagcgtccatatatcgaggagtaacgagacatcatcaacatggaagatggcaagcgcgaatcggcagggtggctggaaataaagatctttatcttggaacattcagcacccaagaggaagcagctgaagcctatgacattgctgcaatcaagtttcgtggtgtaaatgcagttactaactttgacattacaagatatgacgttgaaaggattataggaagcaatactctcctagccggagaacttgccaagcgaaacaaagagattgaatacaacgttaaagctgttgaacagccttcttctaagaattgcaggaaggaagctagattgcctgaagaggataatcgtccagagtggaagatggtccttagtcattatcctgaacagcagtctatcactacaagtgacccacttgatcacaaggaagcagagcttggtaattacatgaataaccctttctcctcatcggtacatagctcatggattgaagcgatgaactcagcccaacaagggatagatgagtcgggcaaactagcacctcacttatctaacaactcgtcagtggtaaccagcttgagcaactcaagagaaggcagtcctgataagaatggactgtcaatgctgttcccaaagtcccccccatgctcaaagttttcaactcctattgcaccgacttcaatcccatcttcacagctgaagccttcaat

SEQ ID NO: 15093 - DNA, 926 bp, Aquilegia formos X Aquilegia pubescens
  Predicted polypeptide sequence is orthologous to G15
gttatctaccaattctttccctcctctccaatacttgtgttttttaataccctcttcttttcccccctcatgcaagattttacaagttacattagtcatggatattttaagtatcagtccaagcagcaaacattggcatatgtgacatagaacctgcaggccttaattgagcagatgaaatccaagaattcattgatgtaactggattgatgaatttggaagtcgatgtaggccttgcaaacagcattgacatcccattcttatcggggcttccttctctcgagctgtttacgcttgtcactagagaagatgaattggataaatgaacacctagtgtggcagagtcatccaccagttggtctgaattcatattgtgaagttcgatcagatcatgtaaggcacccgagaatgatgaattcctgtaatttccaataccattcggtttctgctcaatagattcagcaacatcacttggtccatgaggggaagactgatacatgaccattttccaatctggtccacctacagtatgctcttctgataaaccgacatccccattgctgttctgagtagatggatggtgatcaatggcttcattgctagctgttatctctttgtttcgcttagcatgttctccagcaaggagcgtattacttgccataatccgttctacgtcatatcttgtcatgtcaaagttagttacagcattcgtgccacgaaacttaatagcagcaatgtcataagcttcagctgcttcctcttgtgttccaaatgtcccaagataaagatctttgttccctgcaaccctaccaatccttgcttgccatcttccatgttgatgatgtcgtgttactcctcgatatatcgagccctctcgagacccgctgctcttctttcagtgagcacatatctgctagtcatatctc

SEQ ID NO: 15094 - DNA, 876 bp, Aquilegia formos X Aquilegia pubescens
  Predicted polypeptide sequence is orthologous to G20
caaacagataaaatcatagagttcgccaaaacatacactataaatgccataaaaaccacgaggaaaccttgctgcttgcatgcagatgacgaggtaaattttaatcatcgttcctcctgatgaaaacaagcatatgttgagctgggctcagtcttggtaacctcagtaacgacaggaagcctgggtggcggtacagaagcaagagatgtccaaagtatagggtccatagcaggatccactgtattgtacggcgtaagcatcggcgcggagatgaactgggtcaatggacatgaacttctttgaaaaggcaaccagttcatgcccaataatccaagtctctcactcccaccatcgccacacggtatttggatcgacttacaatagtccatttctacattgttcttgttctcattgctatagtcgttttcatcctgctcctttaaaactttctctttaaaactctggtaggcaggagaccttgataggatgctcaaagcagatagtgcagaccctcgatgcttcttactttcacatgaaaggccaagagaaggcattttatatggttctgttggctggacaccccattctaatgctttaagctcactaccaatatcttgttgaccaccaaattttgtttcttcaaaagatttctctgttcgacgtgttttgttgggcccccaccacttaaagtaaccagtcaaatcaatttttctctcgatgcaaaagcctcctggatattcactttctgtgggtgcaccctcagttgtaccataccgtatactacttaagtactcgggcatgcctatttgattgagagatgtttcccatggactattttgagatgctctggaaaggcctcggtacttagagatacca

SEQ ID NO: 15095 - DNA, 918 bp, Aquilegia formos X Aquilegia pubescens
  Predicted polypeptide sequence is orthologous to G25
tattattaaaattaaataattacattaagattacatacatttcatttccaattagggaaattaacaactaacaagaagaacgaacaacaacaaaagcaaaatgaaacaacaaatgaagcaatttctaagctaaataatcaactccagtctccagagattacataactgtggcagaagaattcatgggaggaggaagaacatcatcaaagctccagagattcatagtagaatcaacaacattttcatgaacaggataatttgaaccaatagattgttgttcaacttcatcactaccatcaagataaggaatctgatagaatttcatataggattcaaatgccattagttcttctgacaacctatccacttcactctcctcctgctcattatcttccacaaccacaaccacctttttctctttctcttcatcattaataacagaatccctattattagtagtaaatgattcatagttcttgagatcatgaccaccatcaaatccaaaatcccaaaataatgttgaatcatccacactcttgacaatttgatgagaaagattatgataattgggtattggaaaattttcaatttcttcattagggaaattaactttagctttcttaccccttatcttccttgcttctttatcataagctcttgctgcttcttcagcagtattaaaagtacctaaccaaactctaaccccttttcctggatcacgaatttcagctgcccattttccccatggcctttgtcgaattcctctatacaaattctttcgctttctcttcccatacttttctttttttcaaacccaccacaccacctgaaggagtagatttttctttgaaatggttgaattgagactcaaaagagagggataagccaagatcagagcagaaatgcgcgctaccacac

SEQ ID NO: 15096 - DNA, 960 bp, Aquilegia formos X Aquilegia pubescens
  Predicted polypeptide sequence is orthologous to G38
cactttaaagtcagccaaattctctaaatctaaaacctatagagaatcggctaaaaggaaaataaccagaacagcagtcagtactatactcctagctcctcctccgagaagcaacagcaactttatttctccaccacccagctaaaaccaggcagccaagaacaacattttacaatctcaaacacccaaatcaggtgaccaggaatcattcaagaaatcatatccatagtccattcctgctggtgctgctgcttcgtccatatgatacaagccctcgactacatatgcatcagacttgtgtctctcataaggcaggcttgacaggccaccctcctggaattgcccaccactagaaaagccatattgctctgaatcgaagttgtactcttcacttggcacaggaacatttttaggttcagattcaatagttcgaagaagttgttccacatcgaacatgtcatcaacactgacatcttgcaagtactcttgattataccccttgaagggattgaaattatcagcatccacattctcctccgccacttctttcttcactgcatacattgtcggagcaggttgagattgagtttcatttgattcagcattacaatgttcagtttccatctttgggcactccacctttacactgcattcctcgggtccaccatatacacctgagtgattcgacgttgtcattgtagattcggatgtagatggtgtttcggctgaaaatgatcccttggacatatcatactccctcaccacaccaggaaggttaagtcgagcacaggaaccatacatagcccgagcagctgcatcataagctcgtgcagcatcaactgcagtaggaaacgtccctaaccaaagcctgctccctcgatttggctctctaatctcagcaacccatttcccccaagttctctgcctcacacctctgtaattacaacgcgaattatctgg

SEQ ID NO: 15097 - DNA, 916 bp, Aquilegia formos X Aquilegia pubescens
  Predicted polypeptide sequence is orthologous to G44
atcaatcaacactcttatcacagtactcttcaattcaaaccttcaaatatcttccctcttgagtactcatggcaacaacaacacctgatgaagcttcaactattgatctgataagacaacatcttcttggtgattttgcttctttagaaagttttcttaattctgatttcagtttttgtaattcaaaattacaatctgaaaatgatcaaataaaaccacctgaactattactattacgttctcaatctgaaccaatttattctcaatcaacaacaacaacatctgaatccacaatttcacaacctgaagctaaacacaatttctttcaagtttttcccacttcttcaatttctcaatccaaaattcatgaatcaagttttaataagcgtagaccttcattaaagcttgatgttccatctctgaagccaaagccaattgaacaacaagctcaagtgattgtatcatcaggagaatcagaagagaagaaacattatagaggtgtaagacaaagaccatggggaaaatttgcagcagagataagagatccaagtagaaaaggagctagagtttggttaggaacatttgaaactgcaattgaagcagctaaagcttatgatcgtgcagctttcaagatgcgtggaagtaaagctattcttaatttccctcttgaaattaactcagctgaatttgaaacaacacaaccaattataacaacgaagaagacgacgaacagcaatccaagaaagagaagtagaaatgttgaagtaatcaagattgaagaagaagaagaagtagtggagaagaagatgattaaaaaagagaaattagaagaaacaattgattcaagcagctcatctgttgttgttgttgttactccacctccattgacaccgtcaagttggatgacggcgtggga

SEQ ID NO: 15098 - DNA, 945 bp, Aquilegia formos X Aquilegia pubescens
  Predicted polypeptide sequence is orthologous to G129, G136, G140, G146
tgcaagtgcaactcagttcagttcaaaaacgtcttattcactccattaaaatctctctttccataagtccttttctccccttcttctctcttctcttccaatgcctcatccatcacacacatctattggaaatggatgcttaatcacggattttccgagtctagcaattgcgggtgattccccccaaagaaaaatgggaagaggaaagattgaaattaaaaggatcgaaaacactactaatcgacaagttacattctgtaagcgtcgaaatggattactgaaaaaagcttatgaattatctgttttatgtgaagctgaagtagcccttatcgtcttctctagccgcggtcgcctttatgagtactcaaacaacagtgtcaaaaaaacaattgagaggtacaagaaggcttgcacagactctaccaactctggatctgtttctgaagctaatgcacagttttaccagcaagaagtgacaaaactgcgtaatcagatagccagtttacaaaaccataacaggaacttgttgggagagtctctcagtaatctcaatatcagggacctcaagccaatcgagaaaaagattgagggtggcatcagcaaaatccgagccaaaaagaatgaactgctgtttgctgagatcgagtatatgcagaagagggaactagacttgcagactgacaataagtatctcagggcaatgattgctgcaaacgagagagcccctgaacatatgaacctgatgcctgcaaatgaatatcacgccctgtcttctgcaccctttgattctcggaactttatgcctgcaaacctattggatcacaataacaattattctcgctcagatcaaacgacacttcaacttgggtgatattctgtgaaagcttttgctgcccgctgtctttatctctccctatcttataaatgtagatcaaatctactatc

SEQ ID NO: 15099 - DNA, 907 bp, Aquilegia formos X Aquilegia pubescens
  Predicted polypeptide sequence is orthologous to G131, G135, G155
tacttctttcataatgtttatgcagtcaaaataataactacagagtaactgcaatcacacatacctgcttacaagttacaacaacataccaaggagttcccctgatagctcactcactccttaaagaacaatggggggatactagaaacattccaaatccaaattacaatcaaagcaacaactgcattgtttatcaataggagataactgacgatattttacatttgttagatatagagaagatggtgatgaggggtgcttatatttcccgattttttttatctatagctgtctggatgtgcatgcacattaaaattatctgaccatgctaaagagatcgatctttcttattcttattcgttgacatggcgaagcatccagggtggcatgagcgtggtaggtcgagctggctgaggtcgggttccttcctcttcagccctcgtgcttctcgcttcataattgacaccaatgtttagggagggaagtgtttgtgatataagcatggatgatgagttttggccttgatttggttgctcccaaggcgtctgttgggccagttccttctccttttccttaagcttcttccctagctgattattctgttctgttaatgctctttccttcttctgaagctcagaaatggattcatgcatgagttggttctttcttgctcttatctgcttcagagcagaatcaagctgttgttccaagttctggagttctttaagactcatgttttcaagatcttctccattataatgccgttgatttttctgtaatatctctatcttagccttgagcttaacatattccagagaccagtttccctgtgattccgaatcagttcctgcaagttctctctccgcataagaatatctctcatatcgctcaagaatgttatccatgc

SEQ ID NO: 15100 - DNA, 933 bp, Aquilegia formos X Aquilegia pubescens
  Predicted polypeptide sequence is orthologous to G133
ctcacacttagccattagtttcacggaagtagaaacactttccatttttagaaacatttgcttttgcttttgcttctttcttcttcttcttcttcttcatctctacttcttcaagtttctcttcttcttcttcttcttctttcttctttgttgttgtagtagaagaaagaaaaaaggaaagatgggaagaggaaagattgagatcaagagaatagagaatccaactaatagacaagttacttattcaaagagaagagctggtattttgaagaaagctaaagaacttaatgttctttgtgatgctcaagttgctttaatcatgttttctaccactgataaacttaccgactttgttagccctaatacaacgatgaagaagacttttgatatgtatcaacaagcttctggaaccaatctttggaattctcattatgaaaaaatgcaagaagccttgaagaagcagaaagagaccaacagaaaacttcgtaaagaaatcgggcaaagggttggtggtgaagatctaagtgatctgagtttcgaagaattgtgcggtcttgagcaacatttagagagttctgtaaagattgttgcacaaagaaagtttactcagataactactcagactgaaactttaaagaaaaagataaagagccttgaggaaatgcacaataatctcctgcatgaatatgaagaaagacttgaggaagaatatgcactagcggatcatgaagattgtctgcacttgaaatggcggctaatggtgcttcacatatattcgcatttcgtttgcaaccaagccagccaaatcttcatggtgacggaggatgtggattcgagatctccgactaggatgagtagaattagaggtcacaaaccttttcccatctcgtactatttgtagcgtatatgctatgtggtaggtctaatgtgata

SEQ ID NO: 15101 - DNA, 929 bp, Aquilegia formos X Aquilegia pubescens
  Predicted polypeptide sequence is orthologous to G134
taaatagcattgttgaatgttgatacactctataatctatagtagaaattcacaatctaagattcataacatattaaagtacaccataatcaagagaaactttaaaatcatggatattagggtctcatgtccatgatcatgatgatgaccagaaaaaattattacttccagtttttctgaatagagattaatgacctgcattaatcctcaaaagcaagagctatcatgataaggctcatggtaggtgatactttgtgctatttactctcctgtaaattaggctggattggctgaacacggaaggtgaatggcatctgagcaggatagtcccttcctttttgatgatatccattttccatttctctatcattcccgccaatttccagagaatgcaagtggtaactgaggcgcttgttctcttcctcaagcaatcatttttcctcatcattctccagatatcactctttttgtcacgaactttagaaagaccattttggagggcttcttcaataggaatgagttctttggcattaagggaattgatatcctcacccttcaagtgcctgagttcgatctgcatgttatcattttccttcttgattctatccaattcactactgagatactcatgctttgcatcccacagcttctttcctgaagtcttctgatatttgtccaagatctttatcagcgttgtaggaccaggagggctgatgtactcagacatcttgccagtactagagaaaataactagagcaatctcagcaccacaaagaatatgaatttctctagctttcttcaaaatcccatttcttctctttgaataagtaacctgtctgtttgtagagttttcaattctcttgatctcaatctttcctctccccatgatctgatctagttagttgaactcagttctctgatcaaatctc

SEQ ID NO: 15102 - DNA, 864 bp, Aquilegia formos X Aquilegia pubescens
  Predicted polypeptide sequence is orthologous to G137, G145
cggctatatgccttgttattttattgtcagtacaaattttatttgtattggattcagtctggtacggtagaattgtggcaatcattagaatttgaagcaacaacatatactatcatggctgattaaggacaacctcgctggtaggtatcgctacaagaaaatatatttctgacctcaaaccatccaaccagggatgaaaccattgatgttttgagctggtgctgcaactgtaatctgttctggacccacatggttgtaaccaacatgcaatgttgaattgcatcccaaaggctggaaaaattcctcagattgagcaggttgacggcaatatggaatgttctgttcaccagatgcccatggtagtctaagggcattttctgcaatgcgctcatctagctttcttcttaaagaactgtttgcctcttctaaaacttgctccttcccttgaagatcagaaagctgatcgagcataaattgagtcttggtacacctaatttgttttagcgacatatccagttgatgctcaagttgatcaagctccttagtacttaatgagcccaactcttccccaagaaggttcctctgagattgttgtagaatttcaactcttgcttttagcctcaaatattcttggtagttgttctgtgtttctttggctgatgtgctcgtttccaatgctgcataactggatttttggtacttatcaagtgtcttcaacatgcttgaagtactgcagaactcatagagtttaccacgagtagagaagataatgagagcaacttcagcatcacatagcactgataattcataagctttcttcaataatccatttcttctttttgcaaatgttacttgacgatttat

SEQ ID NO: 15103 - DNA, 881 bp, Aquilegia formos X Aquilegia pubescens
  Predicted polypeptide sequence is orthologous to G137, G145
gattatagcaaaactgcaagtgcttctgcacttataagtgctgaaaatgatgtatgttactacaaccaaagttcatcattcatgctttatcaatttggccccatgtttcatgactgccagtaccacatactggaaaggaagaagtgcttctgcactcatccttagatacacacaccaacgcaaaagcaatacccttgtttgatttcatttgcaactacaatacaagtttctgcaacatagaatgaccaaaatatacttagtaggcatttcttctggcgcgcctaataaaggtcatgcttacaaacttagagcatccatccagggatgaagccattatggctttgggttcgaggcagaacatttgtatggtctggaccttcaggattggatcgtatttgcattgttgaattgcattctaaaggctggaagaatctctctggttgaagggtctgagtctgatggttaaatggagtatgtttatgtcctgcttcccataggagttgaagtggatcgtgactgtctgcagctttttcatccaacttctttttcaacgttttgttagcttctcgcagcatctgttccttcttttgaagctccataagctgatcaaacatgaaatgggtccttgttgatctgattactttaagagatgactccagttgatgctcaatctgatcaagttcctttatacttaatggatccaagtcttcaccaagcagatttctttgacactgttgtagaacttcatactttccttttagcctcacatattcctgatagctactcaactcagtatcatttgcacgtggagtatcttctaacgccccgtagctgcttcttcggtacctctcaagtgtctttaacatgcttgagctgctgca

SEQ ID NO: 15104 - DNA, 851 bp, Aquilegia formos X Aquilegia pubescens
  Predicted polypeptide sequence is orthologous to G137, G145
ataattataggaaattttcaaatcttaatggggaatagaaacttcaaggaataattcaggccatagttcactccgcggtgagatctgagaacatatttctcaaacacttataaaattaatttttatctttaatctctcaaaaacctagctagagctgcttaagtttagaaagaaagtactaagctataccataatgtacatctactgatccacaatcatcatcaacatcctaaatttgaaactaatacagtaattagcaatgaaacattatgaatgttcataaaatcacaaaaaataatccaaaataacaagcaattacgcgcttatttaacctaaaaaaagttaattagctgatctagagttgtacacacagcaaaccctataaaagattttgttattacaatgattatgattaataatatataagtagtttaatagtgagtaactaattaaatctcaaacgtacagatctctctctatatcacagaaaacaagacactttggaaacaaaataaaaactttttcctcaaagctataatcaagaattactagtagatctataaaaaaacaataaacataaaacgacagatcagttcatatagaagaagaagaagaagaagaagaagaagaagaagaagaagaagaagaagaagaagaagagagaaaaaaagaaagagtatatatatatatatagctactaggtagctagctagtagtagtactataccttgaagtactgcagaactcatagagtttaccacgagtagagaagataatgagagcaacttcagcatcacaaagcactgataattcataagctttcttcaataatccatttcttctttttgcaa

SEQ ID NO: 15105 - DNA, 934 bp, Aquilegia formos X Aquilegia pubescens
  Predicted polypeptide sequence is orthologous to G137, G145
agagtgttgaaaagaagaaacagatttgattgtgttttgtttactctagctatctagtttctttctttctttcttcttgtgttacgtttgtttgtgtattaatttaaaaatgggaagaggaagagttgagttgaagagaattgaaaacaaaatcaacagacaagttaccttcgctaaacgtagaaatggtcttttgaagaaagcttatgaactttctgttctttgtgatgctgaagttgctcttattattttctctaatagaggaaaactttatgagttttgcagtagttcaagcatgcttaaaactctcgagaggtaccagaaatgtagctatggaggaccagagcccaatgtatctgcacgggaggcacaggagcatagtagccatcaagaatatctgaggctcaaaggaaaagtagagtccctacaacgtactcaaaggaaccttctgggtgaggatttgggaccattgagtggaaaggagctggagacactcgagaggcagctggactcgtctttgaggcaaatcagatcaactaggacgcagtacatgttagatcagcttactgaccttcagagaagggaacaaatgctcagtgaagcaaacaaaaacttgagaagaaggttggaggaaggtacccaaccaaatcatcatcattgggacccaaacatgcacaatggtgtgacctttgctcggcagcaggctcaggctcagggtgaagggtttttccaccctttagaatgtgaacccacattacagattggatcatatcagaatgaaccaataagtgttgccacagccgggccaagcatgaataattacatgcaagttggttgggttgacatgcagttgaaagctcttccgcgagtggtgtctctcgtaccttaagaggctagctttaagcttattctgacaaagctaggaacagaaatg

SEQ ID NO: 15106 - DNA, 893 bp, Aquilegia formos X Aquilegia pubescens
  Predicted polypeptide sequence is orthologous to G142, G148
gtttgttaaatcttctacttttagaaccaaaaagaaagaaagaattatcacttcatcacttcacttattgtttatttgtgttgtgcaactatatatttattccttctttttaactctctcatctcttcttcacaaattataatagggtctttttttaccaaatccacccttttaatttctttaaatttaccacaccaccattaaatctctataaaaagcaaaataagagtgtgagtttctaactttctatactagttattccttctatctaactagtctctactactacctagctcttaagctttagcttagtagtactgatcgattattgatctctgcttgttgttctctttgtttctggtgatttatcaaagatatatttgataattatgggaagaggaagagtagagttgaagaggattgaaaacaagatcaatcgtcaagttactttctcaaaaagaagaaatggtttgcttaagaaagcttatgaactctctgtcttatgtgatgctgaagttggtctcatcattttctctagccgtggcaagctttatgagttcgctagtgctggtatgagtagaacccttgagcgataccaaagaagctcatataactctcaggatggcactcttgctgttgcagatcgtgaaacacagggctggtaccaagaagtttcaaagctgaaggcaaaatatgaatctttgcagcgctcccaaagacatttgcttggagaagatcttggaccacttagtgtcaaggagttgcataaccttgagaagcagcttgaaggagctcttgcacaagccaggcaaaggaagacacaagtaatgatggaacaaatggaggacctccgcagaaaggagcgtcatcttggagatataaacaagcaactc

SEQ ID NO: 15107 - DNA, 861 bp, Aquilegia formos X Aquilegia pubescens
  Predicted polypeptide sequence is orthologous to G180
gagagagagaagatcaaacatggcggattcgtattggagatatgcttcaagtgctgctactgctccagaaagaggctgtgcttgtttacgtggaaatctgacggaaagcaaatccacatcagattttccggatttttttatttccatttgtcaggtgcttgtttgtgcaatatataaatgagaaaggcagtaaaaatttaataaaacagcaaactacgtcagacattaatacggcttcgagattggcggaaataactggaaagcagaaatcacgctctctcccctctacaatttcacccagttttgtggtccccatattttctactctctccacgtgttggttttgtttttttatttctaattttaacaagcagccaccgatgtaataaaaggaatatttctggaaattattttttagtaattttgtacttttccgtttccataaatattcctggcaaaccagcacagccatagtgtaacttatacagaataagacactagttattcgtcttctgatttgcatcagtttcttcttttactgctcttagtagcactctcttaattggtggttctgatgtatcacagatagtgttccaagagccagttttcctggttacttaagctctgaagcttctttcttatctgcccatcacttgcggagccctaatgatttgcgagctacaccttcagattacttacaaaaagatatattgcaattacgacctggagcgtatggtttagatgactttacgggatttgcaagtcattctgcgtcacgacttggtggactaacacccggggcaacaataaagggatatccaagtctgcctgaagatccagctctcatcagccaaagaagag

SEQ ID NO: 15108 - DNA, 915 bp, Aquilegia formos X Aquilegia pubescens
  Predicted polypeptide sequence is orthologous to G184, G186, G916
aatgaatatggacaacaaagtaatggtggtagcaacaatgatcttgtaagctttgatcaagatggcagaagaattggcagagaagatagcccagaccatggctcccaaggttgggttcctaataaactttcgaaactaaatcctcccaagggtgtggatcaagcatctgaagctactatgaggaaggctcgagtctctgttcgagcaagatcagaagcaccaatgattactgatggatgccaatggcggaaatatggacaaaagatggcaaagggcaatccatgccctcgagcatattataggtgcactatggcaactggttgtcctgttcgcaaacaagttcaacgatgtgctgaggatcgaacaatattgataacaacctacgaaggcaatcacaatcatccattaccaccagcagccatggcaatggcttcaacaacatcagctgcagctagtatgctgctgtcaggatctatgtcaagtgctgatggcttaatgaattcaaatttcctaacaaggactctgctgccctgttcatcaagcatggccacgatatcggcttcagcacccttcccaactgtcacattggaccttactcacagtcccaaccctttgcagttccaaaggccaccaactcaattccaagttccattcatgaacccaaatcaaagcatggggtcttcacaagctcaaccactagcacaagtctttggtcaatcactttacaaccaatcaaaattttctggtcttcaaatgtcacaaggtgtagtagactcgtcacaattctcacagcaagtaccaccatccgcacaacaccaaaatccgcagcagccctcactggcggataccgtgagtgctgcaacagctgctatcactgctgatccaaacttcacagcggcattagcggctgccatc

SEQ ID NO: 15109 - DNA, 813 bp, Aquilegia formos X Aquilegia pubescens
  Predicted polypeptide sequence is orthologous to G207, G227, G230, G242
ctctataaaccacatctcaatacttcctttctcttcacattctcgaaaacaaaattttagggtttttgttaagaaatagggttttttttttttgttttagatctaaaaaaatcaatggcggctacatcatcaacaacatcaagaagagatcttgatcgaatcaaaggaccatggagtcctgaagaagatgatttgttaacgaaattagttgaaagacatggaccaagaaactggtcattgatttcaaaatcaataccaggtagatctggtaaatcatgtcgtcttcgttggtgtaatcaactttcaccacaagttgaacatcgagctttttctgctgaagaagatgaaacaattattcgagcacatgctaagtttggtaacaaatgggctacaattgctagactattatctggtcgaactgataacgctattaagaatcactggaattcaactcttaaaagaaaatgttctttttcaacttctacttcttcaacaacaacttctatgatgatgatgatgaataacgaagacgacgacaacaacaacaatcttgatcgtgatcttaatcgtccatttaagagaagatcttcaagtgttggaactgttattccaatgatgagttcatcttctggatcggatttaagtgattcaagtcttccttcacctgttatttatcgacctgttgctagaactggtgttgttcttccattaaatcgtgaaacttcttcttcaactaataacatcgatccaccgacttcactctgtctttctcttcctggtactactactactgttacaacaacaacaacaaca

SEQ ID NO: 15110 - DNA, 868 bp, Aquilegia formos X Aquilegia pubescens
  Predicted polypeptide sequence is orthologous to G211
aaagcaagttgttcacagttataggaagaaatgaggaatccaagcatggcttcaaaagtgacgtgttcttcttcatccccagcttctggtagcactactagtaagattacaccttgttgtagtaaggagggattgaagagaggaccatggacacctgaagaagatgaggttctgtctgattatattcgaagagaaggtgaagggaggtggagaacacttcctaagcgggctgggctacttcgatgtgggaagagttgtcgtcttcgatggatgaattatcttcgtccttcccttaagcgtggtcaaattgcacctgatgaagaagatcttattcttcgccttcatcgtcttcttggtaacaggtgggctttgatcgcaggaagaatccctggacgtacggacaatgacatcaagaactattggaatactcacctaagcaagaaattgatcagccaaggaattgatccaagaactcacaaacccttaacccctgaatcttcttcatgttttagacctcttgcacccgaacctaaccttaacaacaacaacactaccaaccatcagcgtaactctccaagtatggacgaagttgcttgcggtggaaatgaagattctatcaaaaataatactaatgatcatcttgaggggatcattgaccatcatcagcataataactggcaaaactataatgccctattggctttacaaagaactaccaatgaagaaaatgatgaacatattggttattcgactggggaggatgttttctcatccctattgaattcttgggtttacgatgaggtgtttggttattccatatatggtggttcaatcaacttctctcaatcacgcttcgacgatgaatgca

SEQ ID NO: 15111 - DNA, 916 bp, Aquilegia formos X Aquilegia pubescens
  Predicted polypeptide sequence is orthologous to G214, G680
atataattataaaagacaatgattaagaaaacgaataaaggaagaaactcggcttatatgttgctcagtcacaaacctcttcggagacctccctccaaaactcgttcatattgccagcgcttctattgcgatgattgttaggctcactcgtccaattatttataatctgatcattgaattcatcctttccattggtatgcttctctaacaaatccatctctacctcactgctggatggtgtgttggatccacatgaagaacgatcaacctgttccttggattttcccttatcggcctcctgcaatgcagccaaggacagagatttctgcttgtgacttgcagcttctacttcagcgttgcttgacctagtatttccactcttattacagtctgataatgatagaggcggtagtttagtatctggaacttttgattctaaagccttggagagtcctggatcaagttgttgtccttcacaaggagagaccaagatcctgtgatccgatttctctttttcaatggtatctgtttgagaaggaataattggtgcaaaatttaaacctgtgtgaagaggaagaggacgcataggcaagattccattagctgcccaccatgcagaagccgccattactgtagcgacagcaattgctgaggtacttggagacaagtctccatgtctggactgaaatctttcaaaggagcacaaaggagaatctacaggtgtttccatatttgaaaagggccagaacgatgctgcaaagcttgctgcagcatgggcagctgggttttgtaaaagagtggatacgataagatttgaaaatgttgggtttacaaacatgctgtaactatctcgattggagaacgggttaagcaatgaaggaaagctcgaaagcgattgctgaatggatatgctgct

SEQ ID NO: 15112 - DNA, 890 bp, Aquilegia formos X Aquilegia pubescens
  Predicted polypeptide sequence is orthologous to G256, G666, G668, G932
gtctgatctagctaagaagaaaaaaccaagaggaagaaaaatcaatactctctctcagctctcacacttgatcatcactactactactactactactacatactcatagcttatttttttcctcaagtgaattaagataatgggtagacctccttgctgtgataaagttggtgtgaagaaaggtccttggactcctgaagaagatataatcttggtttcttatattcaagaacatggtcctgggaattggagggctgttcctactaatacaggtttgcttagatgcagtaagagctgcagacttaggtggactaattaccttagacctggaattaaacgcggtaacttcactgatcatgaagagaagatgatcatccaccttcaagcactgttgggaaatagatgggctgccatagcttcatatcttcctcaaagaacagataatgacatcaagaactattggaatacccatttgaaaaagaaactgaagaagcttcaaacaggtttagatggtcagaacagagatgggttttcaagttttcaaccatcaatcactaaaggtcaatgggaaagaaggcttcaaactgatattcacacagccaagaaagctttatgtgatgctttatctcttgatgataccaaaccttccaatagttgtttatctgaattgaaagcatctaatggttattactctctcacaagatcaagtcaaccaagtcaatctagtactacatatgcttcaagtacagaaaacatttcaaggttacttgaaggatggatggctaatgcaccaaaacctgcacaaactaattcagaaacaactcagttttccttcaacaatgtgactggaacagattcttcatcagaggaatgtacaccaactgcaacaa

SEQ ID NO: 15113 - DNA, 962 bp, Aquilegia formos X Aquilegia pubescens
  Predicted polypeptide sequence is orthologous to G263
tataaactgcacatttatgctagctagccaagtttcgaccaattcttttcctatatgcggttggctgtgtaaaagagtcgccgctcttttatccctaaactatctaacctgccaaataatgtggccctagtgcgcattattcttatgtatacacactagttaacacacacatgacctttagttgcagacctttctgctctcaccttgagaagaggatatcttcatccacggtgcatgatagtccattgccatcttcatcttctttgatgaaggtccaccaacgttacctagtaccacatcacgctccgtcttcttctcattcaaccatactccaaacagcttcaaacacttctcttcctgttcttgttctttgttttcatcattatctttgacaacattgtcagtaatctcactgggtccatcaactccttcaagcataacaccactagtctgatcaggtgccacagtgacccggtttgaaagaagagccataagatcttcacactgcttctttgtgcgagctaactctgagctgagtagctcattgtctttcctcagcttttcgttttcatcagatagatttgacagatgtgttgtccctgttgttgcagtctcatccgatgcattatttttagtatcgggtgaggtggtagaaccagacctttggtcgtctccagaatttgattgggacgaagatctgccagtggattttccagctacaacaacctgaggcgtcaacgcatgggtagatttcctacggtggatttcacgcagctgatcaatttctccttttttgaagaattcatgcatgaattcccatcttccaggaacaatctttcggaaaccatacgtgttgagttggcgaacaaagctggagaaattgttgtgtttgaagtaagttggaagcaaattactcgcaaattctgctgatttccaaaccacaaaagctgtacctgtttcat

SEQ ID NO: 15114 - DNA, 969 bp, Aquilegia formos X Aquilegia pubescens
  Predicted polypeptide sequence is orthologous to G264
caagcaatagtaatcagttgtatttctatcatgggcgtattctgatgtattcataattgcttggtgtcatagttagagatatcaacgataataacatatatatattcacaaagctagctggtagtgacatcttacattcttacatggaattgactgcatatcacatagaagctcagagagtgagctgctccgtatcactcgtgcttttccatggctttccatgtcctggcctcctctcttcttgatcgtctacctggttgcctctaaaactagaacttgcttcttcagtatctggagagcctggtctttcagttaagtactgttcccaaaagccatcattcgctggggcctgagcagctgcatgcacttgattactagcaggggcctcgtgcgaagatgaagagatcgcgtcattattggttatatttctattattcccaacatctctgacattattctctttgactgtagcgcaagacctcacctcagtagtaatagtgtcatgatttaactgggaggacttagctgaatactgctcattattggcttgaagtgaagaagaggcaagtgttagattcaaatggcaagggatatgaccatcaccatcttcaatagaagtcaaatcagtatccctcccctgtctagataacaatgaactatttcctaaagaaaacgatgtaccagtatctgacaaatccaatgtttgtggtaccagcataagagtttcagttctcaagtttgcattatgtggatcttcatcagatgttcttgtttgtggactcactccatcttcatcggagctttgtgcagagggggaaagaaaagtagtgtttgatacagctggtgataactcaagtctaagcttattagagaaatcctgctggataacatggcttgaaatagacctgttctgatcgtctatataactagtctctgcaacatcctgaatgtaatcgcccttgggcaatc

SEQ ID NO: 15115 - DNA, 998 bp, Aquilegia formos X Aquilegia pubescens
  Predicted polypeptide sequence is orthologous to G268
cttattcacatgataaacatacaatcaatgttaactatgggcaagatacaagtagattacaggaaagaacaaaaaaaaattgcacatcacacaaaatactttactgggggtagtttgtcccctagcatgacttaatctccaacctctgccaccccttcaaaacatttgtagtttgatttgagagcactatctcttgcaagacaagaggaaaagatgtccaaattgctgtcttttggtttcaaatatttatcatcggagcatatgcttatcacacatcaagaccttccaacttgcatgaggaccttcagaactgtcatggattcctgcttgccatcccatagctgtagctatctctttaagttcatccataatggttactgaatcgcgaatgtaaactcgtccaccaggtctaagcattctatccatttcaagcatgatcgtcgagacgttgcatcttttcttctcaactgtgaagaggccatttgcatgcagcaagtcgtaagtccttggataagtatcaaaaggctcacaccagtcatgcataactcctatcagcccacggtcatatatgacaggcagagtgttaggaccactaacaggaacaacgttcattacccaggaatctaactgaagatcaatcattgctgctgcaaaccctccaagcccggccctcatgtccatcacatttcgtagctgcagtttcttccaatggtaagcacgaacataactttctattatgtcataccaatatttggattctgccttcaacagctcctttctagatatgtaggcatccatttctatgctctggagcctatcacgagggtgatggaggcgctcaggccatgtagtgacgtttgctccatatccattttcaggtagtcgagtgatgcatgctttcaaccccacgtaccagacatcatctggattatcatctccgtcacacagaggaggttgagttccagcatcacgattaacataacagctattattcaaag

SEQ ID NO: 15116 - DNA, 937 bp, Aquilegia formos X Aquilegia pubescens
  Predicted polypeptide sequence is orthologous to G270
aaaaaatgtcgccaacactactcactcctcttcattctcaaaccaaaatcttcactttaattcccaactcacccttctcaatctctcctccacttcattcttccttctcaactcaatctctaacatttccaagaaaacccatttcttcttatccattctcagtttctcttaattccttctacccttcaattcaaactcaaactcaagaagatgatgatgatgatgatgatgaagaagaacatgttattggtgactgtattgtctttgaagaaggtgtatttgaagacccatatgttcaagatgattttgtttataaagaacctattattaagaagaaatcaagagaatatactcaagaagaaaatttagttccagatgaatggattgaagcacaaatggaaattaatataacaaagaaagagaaaaggaaaatagctcaacaaattgagtatggaagtcgacttgagaagaagaataccaaaatcccttcagttaaaactgaagaatacttgacttataaggagtataagatgtcaaagttaaaacctgttgttcttgataaccttgagtttcctttggaagaagaagaagaagaaaaagaggtgggtgtccataaaaattttagtggagaggatagtgaagtgggaagctcttcttcaagtagtagagtaaagccaagaaatcctagagtagctgtttataagggtacattagatgatattacagagttttttaatagcgacgactatgtacctggagagaatggtgggaaaaaatctcaaggacgtcgtaagctcttgtcaaaggaggaaaagttcttttgaataagcgaaccccgaatctggaaaatgcttcctcgggaaaatggctacctcttcacactctagctgcatcagagagttctaccttgtaaatgcattgcttaagcatactgctg

SEQ ID NO: 15117 - DNA, 900 bp, Aquilegia formos X Aquilegia pubescens
  Predicted polypeptide sequence is orthologous to G274
ggggaaaataggaatacataataaatatcgtatgagatctaaacaaaagtattacatcagaaatcagcacgataaataattaataaacatcagaaggaaggttgtccccctttcattcaccctttaacgcgccatgaaaaaacgctcagggtgtacattagaagtagatcaaaaaattatgcttatgcgtgctgtgagacctctgagagcatggctgcctgctgataaaacgatgggacttatattctctctcactgtgaggatgtagaattattgtcaccaacgacccaatattgctttacagcaaccaatatcttctcagggacaagaggaccatcctcgtgatccaccagcttcaagttccatctcataccactagcaatctttttcaccttgattaacacatcgacttcatcgcggaatatgactgctccttctggtcgcaaaatacggtccatctctaaaagaatgtcttctgcgctacatttgtttttgtacaagctaaaaacaccattagcatgaataaggtcataggtccttggataagttgagaaggcttcacaccagtcatgatagatccctattaatcctcgctcaaatataacacctagagtatccttctcagcaatagtaggcatgacattcataacccatagtttggaggattcaattgctgcagcaaaacttcccaatccagcattcatatccaagatgttgcgataccttcccgtgtcaagtataggattgacctttttataagcttttacatgcttcttccataatttgttatcttcgaggtacgattcaacggaaattccagggacagatccactacttattctgggaggtacagcatttagtctttcagggaaaggcttcagctcacctccagcaacttca

SEQ ID NO: 15118 - DNA, 936 bp, Aquilegia formos X Aquilegia pubescens
  Predicted polypeptide sequence is orthologous to G274
tgacagtatgacacagattacagttacaacatcaacaacaataagttataagctcattaatctattactcactggatgtgctattgcttccaccaccaacccaatactgttttacagcaactaatatcttttccggtactaacggtccatcttcatgatctagcatcctagtgtcccatctcatccctttcaccaccttcctcaccttgttcaggacatccacatcatctctaaatataacagctccttcggggcgtaaaatccggtccatctccagaaggatgtcttctaacttgcacttgttcttgtacagactgaacaaaccactagcatgaatgaggtcataggtccttgggtatgttgagaaggcttcacaccagtcatgatatatgccaatcaaacctctttcataaataactcccaaagtatttttctcggcaatattgggaacaacattcatcacccatgattttgatgactcaagagctgctgcaaatcctccaaggcctgcattcatatccatcatattccgatatctcccagaaccaattaatttgttgattcttttataagcatttacatgctttttccacagtctattatcctcttgataagattccactgtgactcctggaacaagtcccttgactactctaggaggcactgctaaaagcctagctggaaatttctttaactctcctccagcaacttcatctggactggtgacttctggataaggggttatacatgtgttcattttcttgtaccagacatcatcatagtcagctggctcacagaaattagtggatttccttttacaggaatcactgttaacctttttcctccagatggctatatctcccttctcatactttttctcccagcaaagactttcagccaattcttcaagtgcattttgctccttctgtagttcct

SEQ ID NO: 15119 - DNA, 922 bp, Aquilegia formos X Aquilegia pubescens
  Predicted polypeptide sequence is orthologous to G275, G837
agtttctaatggtatctaataatttgattatacagaggatctacttcccctaaagatagaaaaggataattgtctttttcctttttccgtttcttagcagtggggatgggcgtaaaaggaaaaaaaataagaatattacaattaccaaaagttgatgatgaaacgccaaatcagaatggacaaaaagttattcaatggcagaaataattgtctctacctcattaggccgccacatagtctttactgcacaaagcaaaccctctttctcctttgaataagacaaacgaatttcccagtgcagagatttgagcatgttctccatctcattgatggtctcagagttgtcgcgtaagatcaattttcctcctggccttaatatcctatcgacctctgcaagcactggcaataagttgcacctcttcttgagtttggagaagagatgatctgcatgaagaaggtcataggatctagggtaggtactaaaggattcacaccagtcgtggtagattccaaataaaccccgttcatagatgatgggaagtgtgtctggtgaatcagtaggaacaacattcatgacccacactttcaagtctttcaaagcagcagcaaagcctccatatacggatcgcatatccataacattcctcactgaagaccagctaattcccatgccattcagatatgaattggcaataacatgcttccagtgttcataatctgccgaaaaatcttctggtgctgcttttccatagactccaacctgagtactcttcaaccagtatggtggtttatccaacctctgcggccattgttctggccactgagacccaggctctgaggcatctacaggcactttatgcatacatgcctgcaacagcacattccaggctgcatttggatcatcagaatctttgcagtgagg

SEQ ID NO: 15120 - DNA, 904 bp, Aquilegia formos X Aquilegia pubescens
  Predicted polypeptide sequence is orthologous to G275, G837
gccttctttcttcacctatattatcttctctctcttaaacaatacaacacaacaacaacaagaagaagaagaagagaaaagcttgtttcagatctatcgattcttcattaaaaccaaatcaatcaggtagaccctttaggggtatttgcatgtaaagaaataatatggcatttggaaaaaatgccagaatggacagtaggaggcaatcctcctcctactgttccactgtcactgtcgttgtgtttgtcgctctttgtttagttggtgtttggatgatgacttcttcatctgtagtccctgctcaaaatgtagaagtttcttctcaattggataacaaatcagaggtcaaacagcaagtggctgagactgacactcgccaatttgaagataatccaggagatttgccagaagatgcaactaaaggtgacagcagcagcaccaactccaaaactagtgcttctcaggatgacaataattccaaattccaacaaaatgaaaaggtatcagaacaaacaaatgaaaatattaatgaagaaaatcaggaagagaagtcggagaataaaaagcctgagtcggaagatgatttgcagaagaacaatgatgtggatggcaagactgatggtggggaatcaaatgaaggtggaacagctgcgtcagatgatggtgaagcaagaaaagagggtgaagaatcaaatgataccaagcaggaggagagttcaggtgaaacaaagcacgatgataaatcggagggtcagatagaggagaaggttgaggaaaaccaggaaaagaagtctgaaagtgaaaatacaattgaaaataagtccggaaatgaggtatatcctgatggaggccaagcagatattcttaatgagaccaccactcagaatggggcattttcaactca

SEQ ID NO: 15121 - DNA, 842 bp, Aquilegia formos X Aquilegia pubescens
  Predicted polypeptide sequence is orthologous to G280
agtggaactctctaaaaacaaacaaatcctataaagaagaaagaaaaaaccttgccatcatcaactgcttccatactttacatccccaattacagaaacatgaaacacccaaacttaaaaacaccaacaagtcaacaactactaaactcaacaacaaacagacagatcagatagattcaggtaaacaaactaactcaaagataaactaaaatcagcctaggcttcctcaatcacacccaactgctgcaaattggggcttaaccttaggtggtctaccgcgaggcctaggtaatccagtcatcggcacagtggtggtagtttccgtttccgtttccgttgccgttgctgtagattctttgtcagctcctgaatctttctttgggggacgaccacgacctctaccagtaccagaagtagtgactttgagaggagcaacagtaacagagagaggatctctctgcttaggaggacgacctcgacctcttggtggagcagttggatcagctgttgctgcagctggagtagttgaagaagcagaagcagcagcagcagcagtcttggctttaggaggacgacctcgacctcttttgggtggagcattagggtttggacgcatatagttgttcttgaccaaaacaagctcaccgttgtctttcatctggttaagactgtcagtaataagtgtggtatgagattcaggtagatctccataagtagattcgatatatttcgaaattgccgacttgtttgaaccatctttatcatccaaagagtcaattgctgctagtatcatctgtatatttaatagacaaaattaaaacaaacccacatcaagatagatc

SEQ ID NO: 15122 - DNA, 876 bp, Aquilegia formos X Aquilegia pubescens
  Predicted polypeptide sequence is orthologous to G291
gttttatttcagaaaaaaaaaaatccccaaattggtaattaatcaatcaatcaatggattcattagcagcatcagcagaacaagcattgaagagatgggaacttgaaaacaacataacagatgcaatttactttatgatgaagcaaatcatgctaaaatacaacaacagaaaccatggacaacagatcctcattacttcaaacgtgttaaaatatctgcacttgctttattgaaaatggttgttcatgctagatctggtggtactattgaaataatgggtcttatgcaaggtaaagttgatggaaacactattattgttatggatgcttttgctttacctgttgaaggtactgaaactagggttaatgctcaagctgatgcttatgagtatatggttgattactcacaaactaataaacaggctgggagattggagaatgttgttggttggtatcattcacatcctggttatggatgttggctttcgggtattgattgttcgacacaaatgcttaatcagcaatttcaggaaccgtttttagctgttgttattgatcctactagaactgtttctgctgggaaagttgagattggggcttttagaacttatcctgaagggtataagcctccttctgagcctgtttctgagtatcagactattcctcttaataagattgaagattttggtgtacattgtaaacagtattactcattggatgttacttatttcaagtcttctcttgacaaccacctcttggatctgctttggaataaatactgggtgaatactttatcttcatcaccattgttggccaatcgagattatgtagctgggcagatttcagatcttgctgagaagttggagcaagcagaaac

SEQ ID NO: 15123 - DNA, 898 bp, Aquilegia formos X Aquilegia pubescens
  Predicted polypeptide sequence is orthologous to G307, G308, G309
acaaactatttaggtctgcaaaatacaatacacattgacatattaagctatccttgagctgaggaaaattcagaaagggcattaaaaagtggaaaaagaaaaagaaggtaaaacataaaatgaaagggtgttgagagctcagagaagcactttgaactttccagtgctggtgggtcttccttctcagttctctttcacaacctctcaactcaatctgaaaccactcaaatcaacaagaatctggtttggttttggttggattgctaacttggcaaagggactaggttaagactcattgaaataattcaactgaactcaactaaatcggcaacaggtccaagtttccaggccgaagtagctatgagtggacgagtatgccaacccagcattaaacaaccttgattttcctccaccctgtaccctgccacaccaccaaacaaagacaacaacatactcgcttgcttaaacgcattcgatccaaggtgaactggattaaatccagctgatcccattctaattcgccattgactcaatgtttcatgtcgttcaactctttccaatccttcacaagcaaccacattacaaatctgttttcccaaatacacttcagacatcatttgatcttcactagtactaccaccaccaccaccaccaccttccaatgagtcaaacagagttgagtaataatgtaacgattctgtaaaccgatccaagaacactgatccattatgatttgcttcttgttcaacaattgtcacaattttcggcttcatacgtctaattgaattcaatactctttcaattgcacctggtctagccaacaatctatgcaactcaaatactgaattaaccgcaacagcttcacccgatcgaagattgagcatttcagcattaatat

SEQ ID NO: 15124 - DNA, 906 bp, Aquilegia formos X Aquilegia pubescens
  Predicted polypeptide sequence is orthologous to G307, G308, G309
aatacatatctgattatcaacctctaattaaaactataaattacaataacaacataactagactagaaaaacaaaacctggtaaattaaaaaaaaaaggaaaaacagcaagacagagagagagaacatgaaaacttttggtggttggtgcagattctccagtttccaactcagaatcatcagaaatcagataagcagcactccaaagactgaaagtggtctgctactagtggttgttttggtcggctagacaggtagtttaataaactcagtgattgaactcagttacactccgatttaatacttgaaccaatttgccatgctgaagaagcaacgagtggacgagtatgccaaccaagtaacaaacatccattgttttcttcaacattatatccactaccagcatcaaacatagtcaataatgagttaacttgtctaaatgtattagatccaagatgactcaatgaaaacccagccgattccaatcgattcctccactgattcaaacactcatgtctttcagttcgatcaacaccttcacaagaaacaatattacaaatctgccgtccaaaatacatctccgacataattaaatcttgattgctaagtggtgataaaggatatccttctagtgaatcagacagagatgagtaataatgtaaagcttcagtgaatcgatcaatgaaatttggtccattgtgatttgcttcttgttccacaattgtaataatctttggtttcatatctttgattgaacttaaaaccttgttaagtgcaccagattgagctagtaattgatgtaattcgaatactgaattcaccgcaacagtttcgccatgtcgaagatcaaacatagatgcatcaagatcagctaatgaatttgcaacaaaacctctatattcaaatt

SEQ ID NO: 15125 - DNA, 927 bp, Aquilegia formos X Aquilegia pubescens
  Predicted polypeptide sequence is orthologous to G307, G308, G309
gagaaagcagagctcttcccccaagcctatccctcagtcccattatgttcagtttctgcacctattaaagtttttcttttaggaatttcttcaaacacttttcctaccattaaagaaaaaagaaaaaagaaatgaagagaactcttcaccatcatcaagaaaacggtggaggaggtaataatagcggtgctggcggtggtggtgaacctgctgctgcttctgcttctgctgcaggttattcaatggagactactggtaatagtttagtagatttaggtaaaactaagatgatgtgttgggaagaagatcaagattgttttcaacaacaacaagatgcaggtgatgatgagttattagctatgatgggttacaacgtgaaatatacagagatggctgatgttgctcaaaagattgaacaacttgagatgaagatgatgaactgttcatcatcagctcaagaagataatgtttttgtttctcatcttggttctgaaactgttcattttaatccttctgatatgtctacttggcttgaaaatatgctttctgaagtgggtgaacttactcttcctccaaatttcgatacttgttctttaaatgatattttaaataattctactactactactactactaacaaatctccctttcaatcaatcgttgatgaaaacctttttattcctccagctgaatcttcttctactactattaatgtttccaatctcatcatcgatcctcctcagatctacactgaagaacccaattctttactgtcagattatgatctcggtgtaattccaggtgaagctgccatttatggtacttgtagtggtagtaatggagaaagagaaaataaaagaattaaacatgaagaaatattacttcctcctgcctcttctcctgtctctgccattgttaatgctcctc

SEQ ID NO: 15126 - DNA, 807 bp, Aquilegia formos X Aquilegia pubescens
  Predicted polypeptide sequence is orthologous to G324
aatatctatacattccacattaacttcacattaatcttccagctccagctccagaattgtatgtcaggaaaatgcactatttggtgacataatggtggcagaacactgttaacaccaccatgccgtcctttaaaagcagcaggacaactttaaaaagtattaacaccaacagaagtagcaaaacaccataacagaagataattggacaatttatattctacacatgtacaaatttagtatcttcgtcctccagcagtcgataaaaggactcgacttggtttcttccctttcttcccaacaagtgcatccatcttttgggtttccccgctttctgaggatctagaagtggatatgatattggcaaatgacatagtaaccacacttcttggacctgatgcttcacctctctcttctgtggtacttgaaacattggtagattcctcagctttcaacaacggagaatcatgtgcagaagcaaaaccaagccgtgctacatctgaaaaccgcttcctttcactggtcataggaggagttgatggcaagggagcattgcctaaagcttcgaactcatccatggagaaggacttctggatagaagaatacccaaaattgtaagagatgggcatagtatggatcaaagcggcttccgccctgattttctcttgttgctccttctttatgaagcgcttcctctgattttctcgcttcttaatttcatccataaatggtagtagtgcatcagaaggcaatacctcgctcatatctatttcacatagttgaaatgaagttgtcaacgagaagtgactt

SEQ ID NO: 15127 - DNA, 877 bp, Aquilegia formos X Aquilegia pubescens
  Predicted polypeptide sequence is orthologous to G324
agactgctgaaagccccttgaaacaaacctcccccaaatcttcttaaaactttcatgtccatctcgcctatacacgctcaaagatctgcatcatcatcatcatcgtcttcatctttaactctttcttcaaaccctacttccaatcatggattcctccttcaaccttcttcttcacaacaacaacaactcgttgcttcctcctctggatctcttccgatctctgtctccgatcacccggtaccaatttctgatgcaacggtctcatccgcagcagataccggtggatttactaacaaggtgacagatacgaggaggccaaatggtcagaaaagtactcgtcgccaatacaatggcaaccatttccaaaatcactcttctggtcgagggaggacatcctaccaattgcgaaatgatcaggttgaatctgcccaacaagctggacaactctcagaagctcttgattatccacaaaatcaaccaacatccagtgctgcacactcaacaacgagaaaaaaccagtctacgaatgcgaatcacttgttgaattttcgttatgatcgcatatctcgttcccaatctagaattcctcctcctccaagaaggcagcagaagataaggccttacaataaagatctatttcttcaggcaaactacagatttgttttactggattctggaaactattcagttgagtcaatcgacgcagataagatgctacaatggggaagatgtcgtctgtgtaaggtactccacaccacatcctgtgcagtgtcctatttgcttggaaactcctctctgtccgcagataacctcgtgtggtcatattttttgttttccttgtattcttcgatacttgtcgatgggtgatgaggatcat

SEQ ID NO: 15128 - DNA, 931 bp, Aquilegia formos X Aquilegia pubescens
  Predicted polypeptide sequence is orthologous to G326, G1337
gcaaaggaggaggaggagaattcaaattcgaatctcaatcggaactcagcttctttcttgtacccaaatgttccttgtgctcaaatcccacaaacttcttctaaaaaaggacagaatccaagttgtgggaaacataaacagcttatattaaagcaattacttcaactatttaagcgagatctgaaccgagatgctgaagatttgagcccaggaacgcccactcaacaagggagtgcagaaggtattgatttgcaaaagggagtttgtgtcggagatttaatggatgccaatcagatgatgcagcagcaattaccgtatacttccctgcttatgtctagtgtcgagactgatcacaaaggaaatgtgcgtctattggaagatcatcatctctggggatgtaatcctccaagcagtgagtccagtcagatatgggatttcaacctagggagatcaagggatcatgaagcacctaaccaacttgaagatgggtacagtacaaacagtgaaggatttatgatacagacgtacactgattttaccaaaaagactccctcagaaacaacaaaagtgctagaagatgtttacgggattaattgctccacaacaggccaccatatgaaatcagattataacacttcaaagaagcctgcatcttccagaagaacactaacatcagaaagcaacaacttaaacttacctggagccgatatcaattacatggaacagcctctcctgcttagaggtgaaaatgcaagaactacaactaaggtagacatggagttgttagctcagaatagaggcaatgccatgttacgctacaaggagaaaaagagaactcgacgatttgataagcatattcgatatgaatcaagaaaagcgagggctgatactaggaagcgagtgaaaggtcgattcgtcaaggctagcgaaa

SEQ ID NO: 15129 - DNA, 949 bp, Aquilegia formos X Aquilegia pubescens
  Predicted polypeptide sequence is orthologous to G328, G2436, G2443
gtcagaaacagattgttacttagttaattaagtctgaacatgatgaagaaagaaatgaggtcaggtagtggtggtggtgggtggtctcgtgtctgcgactcatgccgggctgcagcctgtgcagtcttctgccgggctgattcagcatacttatgcaccggttgtgatgcgcgtatgcacggtgccaaccagctagtatcacggcatgagcgtgtctgggtgtgtgaggcgtgtgagagtgcgcctgcagcttttacctgtaaagctgatgctgcatctctctgtactacctgtgatgccgacatacattcggctaaccctctggcgcgtcgtcaccaccgagttccaatactgccaatttcagggtgtctgtatggaccttcggctaattacccgagtaggccattagggtctgtagctgatatggaggatggtttcttgacctcagaagtcggtgaggagttagaagaagatgacgacgaaacatcatcttggttgttacttaaccctgttaaccctgttaagaacagcaacccgagcaacgggttcttgtttggtggagaagatgagtatttggattttgaggagtacaattcatgtactgagaaccagtaccaggatcagtataaacaacagcagcaacaacagcagaacagtttcagtattcagcataaccaagttaaaaatgatggaaatgatagtgttgtgcctgttcagtatgggagtatggatcagcatcaccaccagcataatcttcatctggagatggaccatgaggcctcatcaaaacctggattcaactttaccgcttcgcttactcacagtgtctctatgtcgtctatggatgctagcattgtaccagattctacaatgagtgaaacttcaaacatgcactcaagaactcctaaaggaacaatcgatctattttcagtcctccccttcaaatgca

SEQ ID NO: 15130 - DNA, 924 bp, Aquilegia formos X Aquilegia pubescens
  Predicted polypeptide sequence is orthologous to G343
tgaaaaggaaaaaataaaaaaaataaaagataacctagctagctaactagactgagaatatgaatttctcctaaaagctataattacaaatgaaggctggaaagaaaagcacaaaactagtgctactgcatgtactagctagctagctaatttggagtagaaggaactgacattctcatctccataactttcttgtgagaatttgaatgcttgtaactcacaaaagtaggacttttggctggcctatactcgggcaacaacctgcccgacttaaacctcactccacatgcattacaaagtgttttgggacccaaaggtccagccctccattgtggggtcctttgtgaaaggcaatgggtgcacctccttggctgaccatgactactctctatgctactactgcccaacaaattgtccttattattatcaccaccacccatcatcatcatcttctcctcctcttcatttatttcttcttcttcttcttcatcatctccactacttgtattattatccattttcttgggtaaaataagctcactatcagctaaccaatatgcttgatgaagcaatggagggtctgaagatatcacatgaaatggttggatttttttgtgtaaatgatgatgagggccaggggtgtttgttattgatgagcttcttcttcttttgcttctagctttccctgggattgaaaacttttggatttgtagtgatggtagagttttctgaaaattttcaataggttttgggattatttgtgttattgtagtagtagtagtagttggttttggttttgggttattggcttggtcaagggtagttgttggtgcagctggtatacaatttccagtacttgataagcaatcctccacaaaagctgaaagccattctaagctaacatcaccttcagtattttgaata

SEQ ID NO: 15131 - DNA, 915 bp, Aquilegia formos X Aquilegia pubescens
  Predicted polypeptide sequence is orthologous to G343
aacagagatgttactggctttaaacatattctgcagtgtttcacgtgtaaggccactcttcacactaaaacaaatcactcccctttgtctctctatctctatctctcttactgtatttatttccagacaaaacagtacatagacggagaaattggatagaattgagcaagaaacaacaagaacataggataaacggataaggagcctagagaactgaagtaactgatctgataacaatctatgacacgtgtggaagttcatacatcagcaaaccttgaagtcatggtgattatggaagaactcatggtggcagttgttactcttattgtcttccattacaacttccttttgtcttctaagctccaaaactttccgatgtgagttggaatgctgagttaacacaaatgttggactcgctgctggtcgatactcaggaacgagtctacccgatttgtaccttactccacatgcgttgcatagagtttttggtcccattggtcctgttctccactgtggtgtcttctctgatgcacagtgtgtgcatttacgccctcttactgataaggaagatgatgatgaagaagatggagaagaggaggattctctttgtttattgggtttagtgctagtagttgtagtagtaataattgggataaacttactgatggctggactgtcagattccggcaaggaagtccagctgtgacgagtcacagctgctttagaccgcttgcttctggtcttacctggaactgacactgtgttggtggtaaaattggtgatggggaagtgagatgaggagtcgtccacgaagttgatagccattctaactctgctacatcatcacttgggacacagagatcatgagagaaattaggggtagtttcagctgtagcagtggagaaatggtttgaa

SEQ ID NO: 15132 - DNA, 952 bp, Aquilegia formos X Aquilegia pubescens
  Predicted polypeptide sequence is orthologous to G363
gtaaggatattcatttatctgggattttaaactacaatttgtgcaattacggtgatattggccaataattcttctgattggattaataaccgttcaaactttaggctaatgtagccaattggttttcttccgaagagacccatatttatccttagctgcattcctgcatgaggttttctacatctgctatgaacattcagcctgatatgaattttctcgcggctttcaactttgaaaaacataacttgcatgtctcaggatgggtcaagttgttctgatattttgataaccacctataaattagtcatgttggtggtccatttgattttaccagtggatgtggccactgacaatcaagcatctgcatatataaattattgtgtttgtatataaaaatagccactcctctaatttgggtgaacttggccttctgatcacaagtttcagattgcgaagaagcgatgaaaacaccaaactctgattttcaggaagagtctctgtctgaaggggaatcagatgttagcagccaggtcgcttctaatatatcaatccaagaaatctcctcagatgctccaatagataccactacaacctcctcctgtcttacggatctactgaatcctgcccctggatcgatttcccttgaccttagcttaagctttaaggtgggtgatggagagtttggaggaaggaaagaaccgatgggaatctcgttatctagcacaagtgagagtagcagtgaagctgtgcgtacttcagcaccatctgtcccaagaattttctcttgcaactactgtcatcgcaagtttttcagctcacaagctttgggtggccatcaaaatgcacataaaagggagaggacacttgcgaagcgagcgatgcggatgggtatcttttcagataggtatgctagcctagcttctctgccactccatggatcgacatgtcgttc

SEQ ID NO: 15133 - DNA, 945 bp, Aquilegia formos X Aquilegia pubescens
  Predicted polypeptide sequence is orthologous to G374
aaataaatgtactggtactgtaaaaactgagttgagctcttaatattactaaagttacacagaacataattctgtaggataacaaaaacagacaaattaaccaaattgcactagaaaataattttaccaaatggggagaaggttgttcatgtcgtagttgttgagtcataatatatatcagccgcagaagtatctatatcattgaggcccaactcttcattttgctcccacgacctctcgtaatcctcaaattttagttgatggtcatcttcgatggcatcagtaatcggcgagacaaaagatcctgccaagccatcatcaagtattaaagtccatggctcctcgacatctaaaagcttgctcaacctcgatttgaagtctttccatttgattttattaaactcatcagtactatctccaaaattgaacccatgcactttatcaagattttcaccaatttgagtaatcaatccctcaattgttgtaaccatcccacctaacgtaccactcgttaattccaaatccagctccggcactgtcacactagcattatctgacttgatcacatcacgactcaaatcctccttattctgcacaagaacagttattttttttccttttgcaggagtttgaccaccagccttcaactcagaactccgataaccacaagcatcacaagaagatgccataacaattacctcttgaaaatatggaatcttagtaacatacattctagtttcacttcgaacaccacaagttccacaagtggatggaaaagtcatcacttcttctggtgcagaatacctaaacaaggaattagcaaaatcctcagtattaccctgagcaatcgacctctgaaatgccgcagctccaacactcccatgaggaacatgtttagttcctccatcaccatcaccactctgtgcctcgacctgaaaccccaaa

SEQ ID NO: 15134 - DNA, 905 bp, Aquilegia formos X Aquilegia pubescens
  Predicted polypeptide sequence is orthologous to G375
aaaccctacaaccttgagcactcttacacccaacaaccaaaagagccaaaaagaaaaagaaaacataaaaacacatggagtgaatgcatgctccctccattcaaactcctttttggtaagtcaagaaaaatggaaggccattctcacaacaagaaacatgaaaacctatcctaatacagaattatattaagtagtagctggaataattagtctagactagtggatttgttgttgaagatccataaccattcatcaatccgttccacgatcccataccgttataatatgcaaatgattcttttccaacctcggagcaaccttggtcttgccagtcaagggacaaaagctgcttgtttggcttcatttcaattgcatttggatcctcacttccatcaaaaggaagcattagtctttggcaagtatccattatattcccattggtaccattgaaggagatgccgtaatgagagaactggtcatggaaattagatgtgagctcatgattagcatgacttaaaccacttacaagacccaaatcagtggacatgaaatcatggtttctatgatttcccattaagttgccaaacttgctttccatgaactcaaactgtctatggttctcaagcatagagttatacttgttttccagaaaattactgttgccaagatcaccattattggcgagaaaagtgttgaggtgagacaattgtacctcatgaggaaacgaaagttgtaaatcagtcccatcatgcgatgatgaactaagttgtggattaagggattgatcatcagatgatttcttaacactcaccctcttgttctttctacaaccaccacccacagggatgttccttaaagaccctccttttgtccaataccttctacaagtcttgcaaaagtacctt

SEQ ID NO: 15135 - DNA, 941 bp, Aquilegia formos X Aquilegia pubescens
  Predicted polypeptide sequence is orthologous to G375
gcctgcaggaaggatgattcaagaattatttggtggtgcaggactacttggtgcaggagagaggaaattttccttccatggtgcagttttggaaggattaccttcttcttcatctttaccttcttttcctcctccttcatctactactactactaccacaacaaccaccactactaccactcccactccttgtccagaaaatttgagatgtccaagatgtgactctcctaacactaagtttttctactacaacaactacaatcttactcagccgcgctacttttgtaagacctgcagacgatactggactaaaggaggtgcactccggaatgttccaattggtggtggttgtcgaaaaaacaaaagcactcttgtatcaacctctgctggaaaatcaactgctgggaaggcaaaaccggtgtcatcggatgtggttaagttgaaccttggaagtgtgtttgagcaagaacaatcacccaacccaattctatggggttcaccacagaattctcaacttttagccttattgagagcaactccaaaccctaaccctaattctagttccatatcaaattttgttgatttcaagaatgaggggcatatgattggatctcaggtttcttcagatcagtcagctgcagtaactggtgcattaaatgcaaaaaccttaggcctagatcctatggatcaagttccaattggtttatacagctctttcttcagaaacaatcaacaacaacaacttcaacatcagcagcataatcaacaccaccagcaacaacaacaacaacaacaacaacaacaaaacatgtcattacatgctgatctgcaaaacacagggattcaagaattttatcaaagcttaaggcatctgtgaactactatcctgatcactcatcagcagcaatgaacaatgtcaatacttccatgtcatcttcagc

SEQ ID NO: 15136 - DNA, 896 bp, Aquilegia formos X Aquilegia pubescens
  Predicted polypeptide sequence is orthologous to G375
aatcacgatttcaatatgtatacaagaagatgcattacatacaataagttctgtcgttctgatgaattgtgcatatcatatctgcatctacatgcttaactaccctcacaaacactaaaactgcataattcagaaaaggaaaagtagatataaataagccatgcgtgaattcttctttctgtcttgaattcatctcgaggatgcctggtgcactggacagtgaagtcactttcacattagaaagctcaaagctagaaatgtcaaataaaaatataaatgctatgtatcaatagccaataggagtcacttcatgtaggataaaaagtctacattgatgtattttttcccgaagatctatagccatccatcatgttgctccatgatccaaggctatctagacgaccaatggaatctctttcgatctcagaacaaccatgttcttgccagtcaagagacaaggacttctttggcttcaattcagttgcatttggatcttgatcactttcaaatgaaagcattggtctttggttagtctccatggaaaacccattattctcattaagagagattccaaatgttgaacaaagttcatggaaattatgtgtaaacccataactagcaccaacatctcctaagccacccacaagactcaagtcatttggccccatgaaatcatggcttctaatattccctaatattgcatcaaacttactctctgtgaattcaacatgtctgctagagttctctgtcactgcattgtttcccctctccatgaaattgatattttcaactccataaccagagttgccaaagaaattgtttagatgtgataactgtgaaagatgcaagtcggtttcgtcatgtgagagtgatgagcttgaagaatagtgatgatg

SEQ ID NO: 15137 - DNA, 827 bp, Aquilegia formos X Aquilegia pubescens
  Predicted polypeptide sequence is orthologous to G383, G1917
atctttcttccctgaacctcctgatttcaagtacatacacacaacacactctacctccatttatacaacaacccttgtcttcaaattttcaatttattctacaaatagttttcattccatgtgaaaaataaacaaataggtatttgagtgttatataaagagatgtctaagtgcagtagtagcattcaagctcaaggcaatactaataaccgagtggccgattctgcttgttcttgtaatttgttttttaacaactctttgtcaatggtgttccctagcactcctcctcatcatacctttgatgaaccaatcacctgttcttctcctgttgattgcactctctctttaggcaccccatcaacacgtcaatccacctgcaacaatgatgttaaaaagtctggtaacaacaacaacaacaattccttcaggtcaaacctttgttggagtgcatttcaaactactaagaaggcaacctcgccatctgcactaccaccaccaccaacaggtgcagttgggtgcataaataacaacagcatttcaaatggtggtactggtgatgcacttcttgctcgtaggtgtgctaactgtgacactacttctacacctctttggagaaatggacctagaggtcccaagtcactatgtaatgcttgtggaattcgttataagaaagaagaaagaagagcaaccaccacatcaccacaaacaaacaatggagtcaataacagtggtactggtactgcaacacaaccgccccacctgatgagccaccatgcaacatggacccaccatcaccctggagcatcacagaaaggtagttggcaacg

SEQ ID NO: 15138 - DNA, 856 bp, Aquilegia formos X Aquilegia pubescens
  Predicted polypeptide sequence is orthologous to G386, G707
ataatttctgtgcaggggtttgtgcatctacaattcacaaatggaacaaactcagtgttggaaatgtcgatgaagatgttagagttatgaccagaaagagcatcgatgaccctggtgaaccaccaggtgttgtcttgagtgcagcaacatcagtttggctgcctgtgtctccacaaaagctttttgatttcttacgtgatgaagggctcagaagtgagtgggacatactttcaaatggtggacctatgcaggaaatgacccacattgccaaaggccgtgatcaaggcaactgtgtttctcttcttcgtgctagtgccatgaactccggtcagagtagcatgctgatacttcaagaaacgtgcatagatgctgcaggatcacttgtggtgtatgctccagtggatataccggcaatgcatgttgtgatgagtggtggagattcagcttatgtggcattgcttccatcgggatttgcaattgtgccagatggaccaggagatggtaggtccaatcaacccagcaatagtaacagcaacaacaacaacaatggtagctctcagagtggtggtggaggtggtgggtccctattgacggtggcttttcagatattggtgaatagtctaccaacagccaagctcacggttgaatcagtggaaacggttaataatctgatctcatgcaccgtacagaaaatcaaagccgcccttcactgcgaaagttgatccaagtgggcctagtgaagacaataatcatgactttttttttgttttgttttgcttttattttggtcttttaagttatagttctataagttaaaagctcaagtgaaagacaatagagaaaaaaatggaaaggg

SEQ ID NO: 15139 - DNA, 910 bp, Aquilegia formos X Aquilegia pubescens
  Predicted polypeptide sequence is orthologous to G390, G391, G438
gtgagtttagaacccatgagggttgctaaggtactcaaagatcgcccatcttggttccgtgattgtcgttgccttgaggttgtaactgtacttcctacaagaaatgatggaactatagagcttatatacatgcagacttatgcacctacgacgatggtagcggcaagagacttttggttgctgagatatacaaccggtttggaagatgggagccttgtgatatgtgagagatctttgaacactacaactggtggccctgtgggtccagctgctccaagttttgtaagagctgagatgcttcccagtggatatctgattcgaccttgcgatggtagcagctctataataaacattgttgatcatgtggatttagatgcgaggagtgtgccggaagttcttaggccattatatgattctccacaaattcttgctcagagaagtacaatcgcagcattacgacacttacgccagattgcacaagagtcaagcggtgaagcacagtatggtggaggtcgtcaacccgctgtattgaggacatttagtcagagaatgtgcaggggtttcaatgatgctgttaatggttttgcggatgatgggtggtcactgctggcgaatgatggagtggaagatgttactgtttcaataaactcctcccctaacaaacttattggtctccaaggagggaatgctttagctataagaggtggggtaatatgcgcaaagacatcaatgctgctacaggatgtcccccctgcattgcttgttcgctttctgagggagcatcgttctgaatgggcagactctggaattgatgcttacgctgctgcatcgctaaagctaggccttgtgcaatacctaatgcaagacgctgcttctcgagtggccatgtcatcttacctctttctcatac

SEQ ID NO: 15140 - DNA, 916 bp, Aquilegia formos X Aquilegia pubescens
  Predicted polypeptide sequence is orthologous to G390, G391, G438
cgctacgacaacttaggcagattgctctagaggcttctcaatcaacggttactggatggggcagacgtcctgcagctctacgagcacttagccagaggctgagtaggggtttcaatgaagctcttaatggtttcaccgatgatgggtggtcccctatgggaagcgatggtatggatgatgttaccatccttgttaactcatctcctggcaagatgagtggtgttaatattgcctatggcaatggctttccagcagttaccagtggcattctttgtgcgaaggcctcaatgctgttacagaacgtgccaccaccaattcttctcaggtttctgcgagagcaccgatcagaatgggctgacagtaatattgatgcttattcggctgccgctctcaaatctggtccttgcattttaccagggtcccgggttggtgggtttgggggccaggttatccttccgttggcccatacaattgagcatgaagagttcttggaggttatcaaactcgaaagcattggccattgtcaggaagatacacttatgtctagagacatgttccttctgcaactctgtagtggggtggatgagaatgctgttggcacctgcgctgaacttgtctttgctcccattgattcgtcttttgctgatgaggcacctctcctgccttctggtttccgcattatccctcttgactttggagtggatgcctccagcccaaatcgtaccttagatcttgcttctgcattagaaatcgggccagctggaaataaagtgcctggtgattattctggtagttgcgggagcatgagatcagtgatgaccattgcttttcagtttgcctttgagagtcacttgcaagaaaatgttgcatccatggctcgccaatatctccgtagcattatatcatctgtttcaga

SEQ ID NO: 15141 - DNA, 967 bp, Aquilegia formos X Aquilegia pubescens
  Predicted polypeptide sequence is orthologous to G409
tttatatgttactaataacagttacaccctgcaggcgatatataataaccatcttataatgcatagcaatcccattattcaacttacacaaccttcacaacaaagagagtactatatcacaaagtttgaaacatctataattaagcccagtcccaccaacccaatgtctcactctcctggtggttctgctctggtgcagctggaaagacatctgagaaatagctccggctgtcgtcactaatgtcatcttcttctgactggactccatctactgggcctatgcattgaccatagtcatcgccagggaaataggaatcaacactgtcaacaagctgtcgacattcctcatcaaccacagcacttaccccactgccagagctcaagcgatcctcaaccttaacattaaattgcatcgtagttacatcaacattttcttcagtggagagtggtgggtcagatatctgatttaactccatcccagctccctccttgacctgcaacttcccagttaaggaaaccacctcagatttgagcttctcattctctttaacaatgtcatcgtaatcagaacgaagggaatcataagaagctttaagaagatcataatctctctctagttgcttagtcttgcaacgagctcgtctattctgaaaccaaactgcaacttgtctcggttgcaacccaagcttcttagcaagctgggtcttacgatctggttccagcttgttctctgtctcaaagctcttctccaatagatgaacctgctcagaagtaagacgacgtttcttttcaggtagctgttcatcataaaactcctcttcaattagttcatctgatgaactataaaaaggacgtcttttcaaagaatcttccatattaatgaatgatcttgaacctcgaagaacgggatctccactccctaaaagcaacatgttcccatggcaggaaccatcaaagaaaagacggg

SEQ ID NO: 15142 - DNA, 957 bp, Aquilegia formos X Aquilegia pubescens
  Predicted polypeptide sequence is orthologous to G409
taacgttttccattatcttcttcattttcttctccgttaactttaacagtggtaatcaccaattcatcttcttctgagtgatgggtgtgagtttccgttggtctcatacttctctcatcactgagattcttgttacaagctttttccgtcacaaagtctactgaaacttctgtcctttagttcttaaactcgttttaaaaaaaaaatatgattgtttgaagttttcccgggaattcaaattctactactaaaaaagctgtaagcttttaaaaagcttactatggcgagtaggaaggtttatagtgcttctaatgtccctgttttacttcaaaatgatgggatttcttgttctaatggagcttttgaagctctcttgatgcccaactccacttcttgtttcaatggtaagagatccatggttaacttcgaagatgcttgtcgaggaaacacacaaggaatgtccttttaccatacacgtgatcaagaagaaaatggagatgatgacttggatgattgtttccgtcaacctgaaaagaagaggcgcctatctgttgatcaggtccagtttttggagaagagttttgaggtggagaataaactcgaacctgagagaaaagttcaacttgcaaaggacctaggcttgcagcctcgacaggttgcaatatggtttcaaaaccgccgagccaggtggaagacaaaacagttggaaaaggactatgatgctctaaaagctagttatgacagcctcaagagcaactacgagaacctcctcaaggagaaggagcaacttaaagctgaggtttctagcctcacagacaagcagttccacaaagagaatgtgagtgaaaattcagaaacatcgaaacccatggaaccatctcaaccactggctcagcccgattcagtccctgaaacaaaaacatccaccattatatgtaagcacgagatctcagctct

SEQ ID NO: 15143 - DNA, 858 bp, Aquilegia formos X Aquilegia pubescens
  Predicted polypeptide sequence is orthologous to G416
aatattaatgatatctgttctataagcaatacaaatttacagtaagcaatctaaagttctaaactaacatattgtatctctgatttcattcttcaatgtatatcagcgttactaacataaacattaacataaacatttgagacgtcgtaatggggcaacaatgtaaaaaaagccatcagtgtttatgctttatgtttttcccttgcataattttctggtgttgaatcttgaccaaggaatgagatcacatcttttctcttagctctgcaactggaatgtatacggcagactgttcgttcatatggggtccatctgatacattactatgattgtcatctatactaagcaataccttcttcatcttttcaagcttctcctcaagacggcaaattctctccaactcaatcatgtatagctgctgctccttagtggagcatgtgcgcttgatcctctttacttgtgcagattttctttttacactgcccatttccttctctacgctcactgcttttcttaactgtacactcacctcatttgcagtagcggatggtgcaacagcagacactttctcttgtacttcccttgagggtgtggttgtcaatttacggtttttacttctatggacactcgaaactttggatctttggactgctgttcctgttgagaccaaataatggttttcctttgatgttaatacgtcagcactttgcatcttgccacctccaggggattgttcagtcttttctgcctttctaatttttaaagctgtataccgagcattcttgaaccacttgttgatcttctcaattgcaatacccaattgcttcgagagactctccctgaccactcttgatggta

SEQ ID NO: 15144 - DNA, 923 bp, Aquilegia formos X Aquilegia pubescens
  Predicted polypeptide sequence is orthologous to G418, G965
ctctagcacaaaaggcaatgtcacggcattttcgatgtttgaaggatgctattacaacacaattgaaacaaacttgtgaacttcttggtgagaaagatagtgctggggtatcaggagtaactaaaggagaaacaccaagattaaagttacttgaacaaagtttaaggcaacaaagagcttttcatcaaatgggtatgatggaacaagaagcttggagacctcaaagaggtttacctgaacgttctgtcaacattttaagagcttggctttttgaacattttcttcatccgtatccaagtgatgcagataaacatttgttagcaagacagactggtttatcaagaaatcaggtttcaaattggttcattaatgccagggttcggttgtggaaacctatggttgaagagatgtatcaacaagaagccaaagaagaagatgctgatgaggatgaaagagaatccaaccaaacaaacagcaatactgcacaaacaccaatgcctacaacagcagcaacaacaacaacaactcaaccagtatcaacagctgctacaataccaacaacaacatcatcagcaactactacagtagcaggcaaaagatcccaaatcaatgacttagataatgacccttcactcaatgccatcaatacccaatgcttctcggaaaatcaagtaatgcaagccaatctcaccaccaccaccaccaccaccaccacatcacatgctgatgtgtcttcttatgggacacttcattctgatgtgtcgcatttcgacccctcctgtcatgtgagtagcattattgcagatgattataggaccacatctggaaatgccgaaatggcatcgacgttagtaagatttgggaccacgatgggtgatgtgtcgcttacattgggtcttcgacatgctggaaatttgcctgag

SEQ ID NO: 15145 - DNA, 982 bp, Aquilegia formos X Aquilegia pubescens
  Predicted polypeptide sequence is orthologous to G418, G965
tgaaatttaatatacaccactaattaaatttatcaatctagctagctagctaaacataatgctatgtttctcatcaatataatttctaaaattttgtggaggaaaaatctaatgccagagattccacatttcatatttcagctgctttcaaagtccaccgaaaactgattattttcgggtaggtttccggagtgttgaaggcccagagtaagtgagacatcacctgtggtggttccaaatcttataagttttgaatcatcaggatctgcatgatctgcaccagttgtggtcccatagtcagcaacaaccatgctgccacgtctgcgtgtgtcatcgactgccacttggtggaaacgtcttagcatggttggtgacaagtcattgtaggagctgttggtagtggtggtggtgatttgatttgcttggttttccgagaagcattgtctattgattgcatttagtgaagagtcattttcgaaagcatcggatcgcctgcctctggctgttgttggttgggctgttgttgttgttgttgtagtagtagtagtagtagaaggcgttggtgtttgtgcagagctgttgctttggtccttttctactctttctctctcttctccattttcctcctcttcttctttgctttcttggttgtacatttcttctaccatgggtttccacaaccgaaccctggcattaatgaaccaatttgatacctgattccttgataaaccagtctgtcttgccaacaagtgcttatctgcatcacttgggtacggatgaagaaaatgctcaaagagccaagctcttaaaatggtgacagaacgctcaggcaaacctctttgaggtctccaagcttcttggtccattattcccatttgatggaatgctctttgttgtcttagactttgatcaagcaatttaagtcttggtgtctctccttttgttataccagacgatccagctccaccttctttttccccaa

SEQ ID NO: 15146 - DNA, 911 bp, Aquilegia formos X Aquilegia pubescens
  Predicted polypeptide sequence is orthologous to G427
gtaacattagttacattaatatatgaaaaaaaaacaaagcaaaaaccttctaatgaaggatgaaaaacccaaaatagaaccctacatatatcagtatatcacattctgcactttctaagccacatttctattctaatgtcaccaatgtttggttaatagccacctttcaaaagcttacataactgctagctaactgcattcagtatcaatcctttgtggtcatttggagcaaaatactgatcaaatggtctaccttttgcgtttagactttaacgctgtcactgactgagagttactatgccaatttcgctttctttgattgatgaaccaattgttaatttgcttcagctgcaatcctgtctcctcaacaagtttcgccttatcatcttcagttggataaggccactttgagtgttgctgccaccaagttttcaatacagaggttgtgtcgccaggcaactttcctgcccttctctttcttagtatctcctcccttacatcttcaattcttgatctaaacccctgtttaagttcaatttttaattcttgtcttacacgctccatgagtgacctttcagattctgtaggaagtaatggtccaaatcccaacatgtcatgtccatctgcaccggattgatccatagagcaatccaattgcaagtcatcctcgtcatctgacattgttgcaccagtcccctcacttagacttactccagtgagagcctgaaaagactgttcaatttcacgacaacccatgacagcttccacagcatgtactcttacatgttgttgtagttgttctttaaaagaacacagtactaacaaatattgtcccaagaaatgatcaagatcttgcttctcatggggagaaagaacatgatgttggtggtgatgttgtgaagcataaaacc

SEQ ID NO: 15147 - DNA, 891 bp, Aquilegia formos X Aquilegia pubescens
  Predicted polypeptide sequence is orthologous to G427
tcaccattttatattctaaaatatgaagctcttaatgatattacggtaatacggttcatacattctatgcattggtatatctccaccggtccccgccaaatggcactgcgtttaaagtaggcgaaaatagtagtccgcagttatgtatagcattttggttgctcctcagaagcaaagaatatggtccatgtgaaaccacttctttgtaatgcagcctgattctgtaacttctatgcactatctgtactgatgtttaattggcttcccagactgaagttctcgctggagtttgaatctaaatgtgtccatctacatgaagcgctcgctactattttcacctgcattacttctcttgcgtttgctctttagaactgaggatgagggattgctatgccagttcctctttctctggttgatgaaccaattattaatctgctttaattgcaagccagtttcctgcaccagccttgccttgtcttcctcagttggatatggccacttagaatgcgattgccaccaagcctttaagtgtgaagtggtgtcccctgggagtttccctgctcttctcttgcgaagaatttcctctcttatatcaacaatcttctctttgtatccttgtttcaactcatgcttcagttcttgcctcacacgctccatcaaggacctctctgtctcagtcggaacgaggggtccaaaccccatactgtctggtccctctaagcttccatcatacaagtttgtgtcactatcttggtcatcatcgtcatctgacattgttgccccagtgccttccccaggagagacacctgttagactctgtagagattgctcaagctcccagcaagccatcactgcttccattgcatgcacacggacatgctgttgaagttg

SEQ ID NO: 15148 - DNA, 880 bp, Aquilegia formos X Aquilegia pubescens
  Predicted polypeptide sequence is orthologous to G428, G1594
cacattgttatggatagttgtacatatttgcagaaggtttgaattccaaagacaatataaaagcccaagttagatacatgtacagttacagttcatcgtttcctcctgggttgtcataaaacattgatccacctccgccacttaccccttcaatgacagcaaagcgcatgtcttcagatggcctccaatggcgctttctctggttgatgaaccagttattaagctgcttctggtccagtccagtcatttccgcaagcttagacttgtcctcttccgtgggatacggccatctatagtgagagttccaccagtccagtaatgtagttctcgcatccttaggcagctttcctttctttcttttcttcaagaagtctttcttgagactactaagatagccactatatttccgcataagcatatcttttaactcttggtccccagatcggagacttgaagattcttggctctccaatgattccttctccccacagcttagctcctcttctgaagacccaaccgtttcatcagattgatcatagtttccagatatggtagtagtagacattcctttacaaatatgattaagttgtgtttcaatcttgctcaagaatgttgctgcttcgtcaaatgactttgttaactcttctttataaccaaccaatatcttacaataagattccatgaactcatcaagctcgggatcatctccaatctcactattaaaactattgctacttggcctactttctcggctaatttcttcaaaaagtgatgcaacttctggtggcgcaccgatctgtacatagattaaaactagttagaaaatagataaacaaaagtagagttttatgtgttaagaaagagagaatgaagtaacctt

SEQ ID NO: 15149 - DNA, 1004 bp, Aquilegia formos X Aquilegia pubescens
  Predicted polypeptide sequence is orthologous to G431
ggggataatggtcacaatgaaacaaacatacatggctcatatctagtagaacaattgatacatatatagtacactcgctagtaagacttagggaatgtgtcgccagtgctattgacttgtacacttcttaaagcaaagaggatgtgcaatccatagcaaaagggtttcctaacacattgtccatgtagtaatgtgggtgtgccgcatccattacaacaaattgcatatcttctgatggcttccagtgccgctttctttgattgatgaaccaattgtttatctgcttttgatccagtcctgtcgattctgcaagtgctaacttctgtgattccgatgggtatggccatttgtagtgcttgctccaccagtccaacagctgctgcctagcttcttttggcaatttccctttctttcttttcttcataaattcctgcttgagactacccaaataaccgctatatttccgtagcagttgtcctttcagttctctatcctctgctagaggatcaatggcactgtcaattccatcgacctcttcctcggatgatccgttccggtcaaaagcatcaccacaaacagaatctgaagaaccaacagtaagagctttaaattgagactcaattcttgaaagaaaaagcatagcttctttaaatggttttgaaagctcttgttcatacttaataagcatctcacaataagcttccataaactgatcaagtcctggatcttctcctaagtttcttcttcctactctactcatagcttcttcagaagcacaagcttcttctaatcttgtaataacttcaggtgttgctccaaccttttgacaattgatataacaagctaagagccttggataatgaggatgagaaatgatcttagctctaagattgctttcattgttgttgttggtggtggtggtgtttgatgaaggaagtggaagaaataagttatttgtttgtgcattagaactagtattattattagtagtagttgatgaagta

SEQ ID NO: 15150 - DNA, 879 bp, Aquilegia formos X Aquilegia pubescens
  Predicted polypeptide sequence is orthologous to G431
aacacagaacccctcttcatcaggtatatagactatagtagacgtgaatttgatactgatcttaattgtttaaccataaatgaatgcttatttaacttgtttataggtgatataagtataattattagttatatgttttttaaccctggcattgtattcagcacgactgtttttttgtttttttttggtgaattccatccttgtattaatacaaattgctcatttagccaaaataaatgaaacgatcaaaatgatctaagactgtacctggtctttacttgctttatatattttctgtttctctgatgtaattaattgtggttattgcttgctaattttaattttactagaaatcctttgagctctttctaagatatactctttcaagtggaaatgcaaactgacagaaaaaaagtgttgtgaccaaactgcaaaaacgtgcaaagtataatgaccaaaatgaacattttatcttatatgttcctagtattttgacttcagtagggtcttgaattgaattaaggattggtagctattcatgtccagacaattacatgcatcaatatgttgttttagctatgatgcccttattaagggttcaatgtgccttagtacctgaattgcattatttaagtttcttatcagatgacatgtcatcaggatatcatgaggttgcggatctaaatggactttctgaagattatggtgatgcaaatgataattacgtagatcctcgagcagaagacagagaactgaaggttaagcttttgcgcaagtacagcgggtatttgggtggacttaagcaggaatttatgaaaaagaaaaagaaaggaaaacttccgaaagaagcaaggcaacaattggtggattggtggagta

SEQ ID NO: 15151 - DNA, 1027 bp, Aquilegia formos X Aquilegia pubescens
  Predicted polypeptide sequence is orthologous to G440, G864, G1421, G1750
catttcttcaaataatcttcaacacctaaagatgaagacttgaaatcttcattataacaaggaaaatctccaaaatctccaaaatcatctctcattaaattgttgtttggtatactgaaatcaccaaacaaatcatcaagtggagctctaaaatcgaatatatcgttcaaaaacggtgtatccaacggcaaaaactcatctccgaaatgatttgataaacaatttgtttcatcttgaaattcttctgagtctttaggggttttggtgttttggggttttgcttcttcttcttctactactacttcttgtttatttgaagaagaagaagatgaagaacgatatcgaagaacagaagttggtgatgagatattgtgagattcttctgatgaatcataaccagaaactgaagtagtaaggtttatctcaggtttaatactagtcttttctttcttcactcttaccttttcttccttcttcacttcttcttgttgttcttcttgttgagaaccaaagttgattaaagcatctggtcctcttaacttgatagcagcattatcataaacccttgcagcttcttcagcagtatcaaatgtaccaagccacaatcgaacacgacgagcaggatctcgaatctcagcagcccatttaccccaaggacgttgtcgaacaccacgatacttcttctttccatcaccaactcttgatcgtttgttgttgttgttgttgttgttgatggttttgttttctgccaaaactttcttggatctgatctttagaccaccatttgattcttgaataacacttgaagaacaaggttcaacattgatttcatttatatatctcttaacacgacaacgacttaaaaaagtatggtcttcttcatcacttgaagaatcagttgcgttgttatcagttacagagaatcgaacaactttaggaccaagaatagttgatgaagagagagatcaatgtttggtggtggcttcttcttgttgatggtggttgatgtttaacaactttctttatc

SEQ ID NO: 15152 - DNA, 928 bp, Aquilegia formos X Aquilegia pubescens
  Predicted polypeptide sequence is orthologous to G446
gtctattaatagagggcctgaaatgctccaaaacaccatcacattatataagatttctctcaaagaccattaacttacatcattctacgtgttatagcatgtaaataaaaattacggctctaactattacaggcgcttctacatttcgactctgttagctcactacatttacgggtaagctcatcctaatcattaataccctctggtagttgcttccctaaagcaatgtcactgtagcaacccatcttcactcatctgctgaacttcagaaggtgataaaattctgatgcatcggacacatgtaacaaactcttcccatggatcatcaccaacgagaagaacatcattctcataatctacataaacaagtctccactctgaacctcttgggtcatcgagaacaccttcaagaccaaacatgcaaccaattgcagagcgcagctcctcatagccgttaaatcgggtaacatcaatagatctcccaacagatcccattttctggacctttgtatatgttctgagaggtggagaaacttgtttccatgggccttgctggaagaggctgctctcatcgaaatcaacattgcttgaagaagtacctccagaattgtcttgaatctcttgcagcgagaaaccttgagaatcagccaggcttgcagtggtgatctgagactgaacatcttggcttgaactaaagcctccaactaagaactcgggatttttgaagttaacatttccaaatgaagaaaatctatttaaaacaccgctcgaaacagaaggatcaacaactgcgcttccactattgattgcttcaaaattaagagcatcatatatcccgctgtggcccttgctctcctcggaagcatcccttagtccacatgaattagagacactttgaagggtacttgaatcttggagagggcattga

SEQ ID NO: 15153 - DNA, 906 bp, Aquilegia formos X Aquilegia pubescens
  Predicted polypeptide sequence is orthologous to G446
caaaaaaatacattttgcttttcttttcttctcacttctaacttgttatctctaataagaaaaaaaagtgaatttctttttctgcaggaatgaacaggaatttgaacagagagattccagagataatgcttttgatgatgattgcagagatgatacagaagaagagaagaagtgttgttatggtttttagatgaaggggaggaagacaaagaagagcagagttattagagagatgggtcctcatttattaaggctgcaaaaaaaatgagtggaactgcaccgacagacataagaaggaaattgcaaaattcaccaactgttgggaattcctagtatgctggattagaggaaactttaccatattatggatcaaccaagccaataaacatgcaaaacaatttggagagaccttgaaaattctcagcaaaagtcaggcggcctctatcttaatccatcattcttatccaattgacattatggataatgatatcttcagtaactcgctagatattgctaatcggaatcctttaggtattgatgggatgttttcgcacatgtactcgggttcacttgttcagccagatccctatgaccttaacagccgaacccaagcaatggctgcgcttcctattctctcaacattccatggggagccaacaaatgacctgaatattgaagatgttaatgctatggaaaacacagaagcatcattttctagaaataggccactaagtagacaggttcttggagattcttctgttggcagttctagttctattgccaactgtaattttcaagactactttttaagaggagaatccctgtccgctacttccattgctcaccttttgtcggcaaacaccaatctgcatgggaatatccgtggaataaatgtttcaacagctt

SEQ ID NO: 15154 - DNA, 948 bp, Aquilegia formos X Aquilegia pubescens
  Predicted polypeptide sequence is orthologous to G450
atgataagaatctaacattttgttaggatcattattacaaaataaaaataaaaatgcacaagacttagttttgacacttcaaaagacaaacaaatagataaacatactaatacgaggtcatagcaaacccccttgacaatcttaataatgttcaagcaggaggatcggtcttttacttttgaatcccacaatagctggtcagctcgagtcttcttgtcccctttgacgttgaagtttagcacttcatttgagtttcaatctgctaatcgtactcgccaatattgaatcatatattacctgagctttattttgtgtggtcgtcttcatgaattcattaatatctctgatttgaacaatctgcaggacactctcatcatgaataccaaccaaaatcgacaaatatgctaagaggtacaccaggaacttgcagttcttagtttgaatggctgtaaagaatgacgaatcaaatatccttgcatatttccatgtcattcttctcttattctctgaaagattatctccctcaaaagtcctaattacatttttcatatatctaaaaggaattacatacatcgtaccagtcaaaagctgaccaaaattttcaattgtaacctccaatgctctctggacttccacaaagagtgtataggcatgcatgccagtaaatcgaagatgttcctcatataacatttctctaagttcacgagccaatggagtttcattgtgaaggtatatcattccagccattccatacttaaacagggaatttgatcggaacttatcagaaatagcttctaaggactcttgtgaaggattataccaggtaagtggaaatttaaaatgataaaagtcctcaagctggagttgaggtaaggcaatgccctgaggtaattgttgacagatttggtgaataacctaagcaaggaggcacaaacataactgacagaa

SEQ ID NO: 15155 - DNA, 955 bp, Aquilegia formos X Aquilegia pubescens
  Predicted polypeptide sequence is orthologous to G450, G456
agaaatccaacaagcaaagcaagaggaagaggaagagaattgaaataattagtgtgtgacgaagttcgttgtaatggaagtttgtcgaaaaatgatgaatttcgaagagacggagttacgtcttggattacctggtggtggaagtgaagctgagagtggaaagagtactggaaagcgaggattttccgagactattgatttgaagctgaacaatcttccttctaaggatggagagatggatccaagtgacaataaggtgaaaaactcaccacctaaagaaaaaaaccttcttcctactaatgatccagccaagccacccgccgccaaggcacaggtggtaggttggccacccgttcgatcattccgcaagaacatcttgtccgtccagaagagcaacactcaagaggagaaaggaatgagcagtgcagcctttgttaaggttagcatggatggtgcaccttacctacgtaaggtagacttgaagatgtacaagagttaccaagatctctctgatgccttgggcaaaatgtttagttccttcacaattggtaactgtggagcacaaggaatgaaagatttcatgaatgagagcaagttgatggatcttctgaacggaactgagtacgtacctacttatgaagacaaagacggtgactggatgctagttggtgatgtgccatgggagatgtttgtggattcatgcaagcgcttgcgcataatgaaaggatcagaagctattggacttgcaccaagagctgtggaaaaatgcaagaacagaagctaaagtggtaatcaccagtacagtctgttcaataatattcaagcacacagtatcgatgaagggtgaccgacagcgaatgtgcgttagatcaattgagcagagtgtctggatgtgtctgtactatggttttctttatatatatagatataaacaaaatggggacattgttttatg

SEQ ID NO: 15156 - DNA, 340 bp, Aquilegia formos X Aquilegia pubescens
  Predicted polypeptide sequence is orthologous to G450, G456
gcgcttgcgtataatgaaaggatcagaagcaattggacttgccccaagagctgttgagaaatgcaagaacaggagctgaagctgaaatcaccacagcatctcctaatttgttattgtattgtagatgtcaagatgacaacaatgaaaccagatggattgagcaggatgatacgtagggtgtgttttgtattatgattgacacaagatatataggaaaatatgggatgtttgtacgtaatttagtagaaacaataagagttagtaatggtcaagcttgtttattatcaatggctaggttgatttaatattgtatccatgttggtttgacatttttgctttt

SEQ ID NO: 15157 - DNA, 995 bp, Aquilegia formos X Aquilegia pubescens
  Predicted polypeptide sequence is orthologous to G451
tttgcatttacatacacctctaaaatacaaagcaaaacaaaaaacaatttaatttaacctcaacactttctttctcttttctgtttttgaatctcctaatctaattctttatgagagagattcaaaacccccttagtttcttgaaaaaaaaaaaacccaagctagttgagacatctcttctcttaatttctcataatatatatcttagctagctagggtctttcttatacaccataccccaaacctctagcttctgaccctttcatgattctcagccttttgcaagaagaaatgaacatattccatggtacatctccaaccaacatccaatctccatctttatcttcatatgtaggtgcatgttcagatccattatagccttctctttctgaataagtaccaatagtgattttaaacatgttttctaatgcctttagaagttctaaataaccattatagactttaagatcaatcttccttaagtaaggtgctccatccatgctaactttcacataaattcctgatgtctcagcttcatccttctttgcttggaaactatttttcctataggatctaattggtggccatccaacaacttgttgtttagcagctggtgcagtttcctcatgaccacctcttgcatcagatacactagaattgttttctgatccacactgttgatcatttccaatatcagccaatgctcttttgttgctcttaacaattggttgtgatggtgatggtgtttgtgtactttgtttatccaatatatctgatccaggcaaacctaagcgaagattaagatcactttcatacttcatcttgctttccattaatcaatcttctcaaaccttcaaacaattaactgtagttgtatcccttttatgatatgataacaaactttccaatccaaatatcaacttctacgtaagtttccgatatgtctccgtgaaattcttgtatattccggtgagtttacacagtgtagatgaaac

SEQ ID NO: 15158 - DNA, 826 bp, Aquilegia formos X Aquilegia pubescens
  Predicted polypeptide sequence is orthologous to G464
ctcccatatttacagtataagaaaacaggcattcagttaggtatgtgtgtcactacagattgaaggaaccaaaaaatgacattcgtacgctgaaaataaagatggaactcccagagaatgggtgaaaaccaacaaaaaacaagcaatcgtattggtaggcagatctttttcttcacaaatgcttcaatctctctacttttccataaaactttcttttaaactgtggtatatgtatcttacccagcgtatgtcacgacaagatagttgaccaagctagataggtttgtttctttgtctgtcattgttgccatcatatcttggagcaagtccattagcctcagatgccctcatgattcgtagcctcttcacagtattcaggaacatcccccatggaacgtctccaacaagcatccagtctccatccttgtcctcataagtgagtacaaattcagatgatcctcccaaaagtttggaagcctttttagcttcagcaccatattctttttcctcgctagatctgatgaaattagtagtgggtctgtagaacatatcttccaatgtttgggcaagagtctcatagcaggcatgagaatttagatccaccttcctcccaattggtactccatccatattcaccttcacgaactgagatttcccaagatgatcttttttcaagacagtgccattgttctttctatcatcagtattcttctttgtaatttctttatttttacagttctcgataaccattttatcttcttcaacagatgaattcttattctgattgaccaagctgttaatcctgtaagtcctaattggtggccat

SEQ ID NO: 15159 - DNA, 853 bp, Aquilegia formos X Aquilegia pubescens
  Predicted polypeptide sequence is orthologous to G470
ggaaactggatgatgcctttgctctcatcaccccactcagagactcttcatcatcctagagggataagaccacaaccttcttattttcaacaacatgaggtttcaaaatccaaaactaatggaaactgcaagctctttggaatccccctcaacgttaaccctgtggtaccagaaccagcagcaccacatggaaatgttccgtatgagccagaaaaccatatcacttctgctttgcctccccaaaaggcgctggattctgaccaccaatcagagcaatcaaaggcctcaaagtcaacagatacagctgttttgggcaatgagcaagagaaatctactccaggatgtcaacaacaacgtagagatgttaagagcaagcttcagggtggttcaacaagaagttgcacgaaggttcacaagcaggggattgcattggggaggtctgtggaccttacaaagtttagtggatatgatgaactgcttactgaactagaccagatgtttgattttgatggtgaattaatggctcacagtaaaatctggcaagttgtttatactgataatgaaggtgatatgatgcttgtgggagatgacccttggcaggaattttgtagcatggtccgcaagatcttcatttacacaagggaagaagtccagaagatgacccctggggctttgaacgctcgggctgaagacaatccaacgaatgcggaggaaagaacgggtgaacaagaaactagttgtgcagcagcagctagtcccgagaattgttaggttatctcacatggtattctgaagacgcactggcaagtagagcataaatttggtacttgaactctgctacatattcgaagat

SEQ ID NO: 15160 - DNA, 905 bp, Aquilegia formos X Aquilegia pubescens
  Predicted polypeptide sequence is orthologous to G470
gtgccggcaacccccgacacaagagttggtggctaaggatttgcatggaattgagtggaaatttcgacacatttttcgcggtcaaccaaggagacaccttcttcaaagtggttggagtgtctttgtgagttctaaaaggcttgttgcaggggatgcttttatttttctaagaggtgaaaatggggagcttcgtgtcggggttagacgtgctttgaggcagcagagcaatgttccatcttctgtcatatccagtcacagcatgcacctcggtgtactcgcaacagcctggcacgctgtttccacaggaaccatgttcactgtgtattacaaacctagaacaagccctgctgagttcattgttccttatgatcaatacatggagtccgtaaagaatacatactcaatagggatgaggtttaagatgagatttgaaggtgaagaagctccagaacagagattcacaggaacaatagttggcatgggagatgctgattccaataggtggcatgactcgaaatggagatgtctaaaggtgcgatgggatgaaacatcttctgttcctcgtcctgagagagtttctccatggaaaatagaacctgctatggctcctgcactgaatactcttccaatttcccgtcccaagaggccccgagcagtggctgcatcccctgattcctctgttctcacaaaagaaggttcgtccaaaattaccatagacagcgcatcagtaaatgggttttcgagggtcttgcaaggtcaagaaacctcgaccttgaaaaactccctttccgagaataatgagtcagagtctgttcaaaggcctgttacatggcctccatcacaggatgatgggaaaattgatatggtatgtggtcaaaacagatatggaacagaaaattgggcac

SEQ ID NO: 15161 - DNA, 1030 bp, Aquilegia formos X Aquilegia pubescens
  Predicted polypeptide sequence is orthologous to G477
tacaaacagtttaacctatcagattcctgtatgtcaagttcatggttgtcatatggaccttagcagctcaaaggagtatcacagaagacacaaagtttgcgagattcactcgaaaactgccaaagtcatcgtcaatggcattgagcagagattttgtcagcagtgtagcaggtttcatttgctggttgaatttgatgatggtaagcgtagctgccgtaaacgcctagcagggcataatgagcgccgtaggaagcctcaactggacagtcactctggtagaaatggaaagctgcatttaccatataatggtagcaggttggtgggaacttctttacccatgaggacatccttaacaagctccactatgtttcctagaggcatagtgcatcctgtgaaacatgaaagcagtaactggttctctcgagttaaattagaagacgaggaattttataatcattactcaatgacgcctgtaataaatgagcatttgcttcaaaaacctcaatatggggtggagaaacattactcagtgcatggacatggtatcaatactgcccgcactggcagtttctttgagaaaagtacctggtacccacacaatttgcctgactcagattctgactcccaatttgtgttgcgggctgcatcttcatgcagggaagacatcacagcctataatactgcatcgtctcaaggagtatctggagtctcagactctagtagtgctctctctcttctgtcatctcaatcacaaaattcgtcaactcattccgcagggattcctatgagtcaacctccactcattcaaggcaataatatccattacaacctggatcagttccctcaaaaaatttatggatatagctcacagtcttcaacaagtcttttgtcaaataggtattcatcgtccatgggaatatggccaattaggacccatggtagcttctgaaaacaattctgtcatctttgacatagacactggtggcatatttcaggttcagagtgtgaacaacagggtctatatctcatg

SEQ ID NO: 15162 - DNA, 949 bp, Aquilegia formos X Aquilegia pubescens
  Predicted polypeptide sequence is orthologous to G478
tctttggatggagagaagatgaacaatatttctactggtgttagtgagaattggaacaacaacaacagcaacacttccatggtatcatatgttgggttacaaaacaacaattataagcaattatgggattgggagaccaacccttacaatccaaacacttctactactagtactagtaccaatgggaacaacaacaaccacaaccctttcattaccaactcaaccaacatttttgattgtagtcatctttctactttaccatcttcatcttttcatggaaatctcaatttcatcccatcttcccaattttctgaagaatacccttcagttgatttcttgaaaaaagaaggtgataatgccgaagaattcactatggatatgaacaactactacaatggcaatggtggtagaattggcttaaatctaggccatagaacttatttttcttctagagaaactgcgttgatcgaccgcctttttagaaggcctagaggattttatcaagcaaatcaaattccaagatgtcaagctgaaggttgtaagattgatctatcaaatgctaagcattatcatagaaggcataaagtatgtgagtttcactccaaggccactaaagttgtagctggtggactagaacaacgtttctgccaacaatgtagcaggtttcatgtgttggcagagtttgatcaggccaaaaggagttgcagaaaacgcttggctgatcacaaccgacgcagaaggaagcctcaactcggtcaatcaacaactgatgactcagtagtagtactacctgctgctgctgctgctggagctatcaaggctagtgaaaatgcatatccacaggtgggtccatcagcttcaatatcaagatcagatcataaagagacatcactttcttcatcaactactaccactgtaccattgacaatgtccacagcttctagtgcaa

SEQ ID NO: 15163 - DNA, 953 bp, Aquilegia formos X Aquilegia pubescens
  Predicted polypeptide sequence is orthologous to G489, G714
atacttttgaatggtttaatggtgaatggatttgcccagatacataagagcaccctgccatatcttttctgctcccattaaacagttaagaggatggagattgtggccggaacctgcttcccctataaacagttagctcctcattttgttcatcaccctgtggtatctgagaattatagctgtttagctgcaactggttcgcgcctgtcagtgaaatttccacagcatcagaggggcgaggtagagctctccgtctactctctctgaggtactcgccaaaatcagagctgttcagctgcaaatgattcgtgcccgtcagagaaatttccactgcctcagatggtcgaggttgagcatcccttgtactctctacgaggaactccccaatattagaactactgttcagctggacatgattagagcctgtcagagaaatttgcacggcatctgaagctcgaggtagagctcctcgtctacgctctccgatgtactcgccagaaaaataattattgaagcggttaaaatccagcatttgaaactgcatcacattagactgccatcctcccctccgttgtccagtgacttcatcttcagcacagttttgctggacctgatttggtcctatcactggaaaaggctcttgcgaaggttccacgcctttctcttcatttcctccaccagtaacttcatcctcttcatatggcttttgaacagcgtcaatgagaaaatcaagagcctgaatattgcttataacccttgagacatcactcctttgcagtgtttgccttttattactttcagtatgcagccaggagcgaagtgagagctctaaaataaaaaactcacaagctttcgcaatgaccactggggcatcagcactaaccatcttaacatggtcatcagatttcatagctttcctgattctagataatggaagctggtggtttgtgaga

SEQ ID NO: 15164 - DNA, 905 bp, Aquilegia formos X Aquilegia pubescens
  Predicted polypeptide sequence is orthologous to G489, G714
tccatatcattagaatagataatatgaactttcactgaatagaaaactaactggcagatactactattgacatataagttcaacacttacattgtcctcgaaaagctaacattatctccttactcaagaatctgagtgttcttgttcttgttgtagttgttgttgttgctgttgctgctgctgctgttgtgatgcctgcggccacatctgctgagccatgtaagggcgaggctgttgcgcatacaaggcctgatctatcacaggtttacccataatcatcccaggagttccaacctgtggtgaatgttgagggatataatagtaaggatgtggatccacagcacctccaactggaattgcccctcctcttggaattgatgcaagcacctcatctttcagatcctcccggggaacaatgtcaaccaggaaatcaaagatatcagtcctagtgatcgcagcggcaatgtcattcttctggagtgtcctacgcttgttttcttctgtatgattccatgaacgaagtgtcagctccaatatgaacatctcgcaggccctagcaaatataactggagcctctgctgcaatcatcctgacatcctcatctgctttcatgatcttcttgatcctagccaatggaagactgtggttcttaaagtcagttgtctgctcaatttcttggtattgatttgcccagaaagtctgaagttgctgctgcaattgctgctgctgctggtggtgaatctgttgataagcaagttggtgttgcgctagctgagctggggatgtagaataacctgcaggctggccagggggtgtaatggaccccacagatgtcacaattgggccagaagtatcccccatcatttggttaggctgatatggatttgcaacatacgacatttgcg

SEQ ID NO: 15165 - DNA, 960 bp, Aquilegia formos X Aquilegia pubescens
  Predicted polypeptide sequence is orthologous to G489, G714
ctgtaatttgcagttattatctcaatctcaatctcaatctcaattttaattttgccaaacaaacccttatttattacttcttcttcatcttcgttcttcacttcttctgtaattctcttacgaagaaccataaaagtaatagaagcaaataatattttcttgagcttagcccataacagaatggatcagcatggtcatggacagcccccagtcatgggggttgtcagcaatgcagctcaaatgccatatggtgcggctccatatcaacctaatcaaatgattgttggcaacccccctggttcggttgcctcatcaggagtaactattcagagtactggtagcccgcaggtttcaatgcctctcaggctcaactccaacagaatcaacttgcctatcagcacatccacctgcagcaacagcaacaactgcaacaacaacttcagagcttttgggcaaaccagtaccaggaaattgagcagacaattgactttaagaaccacagcctgccattggcaaggattaagaaaattatgaaagcagatgaagatgtaaggatgatctctgcagaggctcctgttatatttgccagggcctgtgagatgttcatcttggagttaactctccgatcatggaaccacacagaggagaacaaacgaaggacgctccaaaaaaatgacattgctgcggcaatcacaaggactgatatctttgacttcctggttgacatcgtgccaagagaggatctgaaagatgaggtacttgcatcaatcccaagaggaggtgctgtgccggtaggaggtccagctgacccactcccttattactatatgccacctcagcatcctcaacaggttggtagtccagggatgatcatgggtaaacctgtggtggatcaagctctgtacggtcaacaggctcgcccgtacatgcctcccgcagatgtggcctcagccacaacag

SEQ ID NO: 15166 - DNA, 897 bp, Aquilegia formos X Aquilegia pubescens
  Predicted polypeptide sequence is orthologous to G502, G519
gaatcctcacaacaagcatcacagcaaaaaaagaaaaccaacaacagcaacaaaaccaaacccacacaaagaggagaaatgaagggtggagatttagatttacctcctggatttagatttcatccaacggatgaggaacttgtgatgcactacttatgtcgtaaatgtgcttctttatccatttctgtttcaattattgcagaaattgatctatacaagtatgatccatggcagctaccaggtactgtacttatttgatttttttaacaagtttgagctttagatgcttatcgatctcatatgcaaccgtttataaatttaaaattgaaattttaaagttagatttctattgttttaattgcaggaatggctgtatatggtgaaaaagagtggtacttcttctcgccaagggaccgaaagtatccaaatggttcaagaccgaatagagcagctggatctggttattggaaggcgaccggagcagataaaccgattggaaatccgaaaccaatagctataaagaaagctttggtgttttatgctggaaaagcacctaaaggagtgaaaactaattggatcatgcatgaatatcgacttgcagggatagatagatcagcaagaaagaaaaacaacgcaagggtaagtttttcagattaaattgaccattttaaccttataattgaaaaatatcagttggtccatatagtcttttgatctgaacttttttctcatgataaggataaactagtacaattatagaatttttgagtcacagttgaaatgttgtgttgatggtgaatcttgtgggctcaaattgagattgacattcctcgtcatgatgtagaattatttccactaatatctttatttagtctaaatatgtttcaaatgccgtca

SEQ ID NO: 15167 - DNA, 916 bp, Aquilegia formos X Aquilegia pubescens
  Predicted polypeptide sequence is orthologous to G504, G1425
agagtgtgttaaacaagacttagagaattaaaaccacaattatataatatgatggagagtactgattcatcatctggttcacagcaacctcagctaccaccaggataccgattccacccaaccgatgaagaacttgtcgttcactaccttaagaagaagattgcttctgatcctcttcctgtttctattatagctgaagttgatctttataagtttgatccatgggaactaccaggcaaggcaacttttggggatcaagagtggtatttctttagtccaagagataggaaataccctaatggagcaaggcctaatcgagctgcaacttctggttactggaaagcgacaggaactgataagcctatcttaacagcaggtggtactcaaaagatcggagttaagaaggcgcttgtgttctaccgtgggaaacctcctaaaggaatcaaatcaaattggatcatgcatgagtatagactcatagataacactggtatcatgaagcctcctggaaccaagaagaactcttcaaggcttgatgactgggttttatgccggatctataaaaagaacaactcgcaaagatcaatagagtgtgataaagatgttgccatcgataacgggttttcaatcatggatcgccagcataacttgcaagcgcaggcagccaaggctacaaattgtgggttatatcttgaaaacaatgagactttctttgaaggactcttatcagacagtgtcaacaacaataacaccctatctcacttagcctcttccagctcaaagcctgacgtttcaattatggttccaccaagcgcatccactatgcttccgcttcgacgcactcttcaatccccttactggaatgaggcaggtagtgagtcatcagataagagattccagaccaatcagagcagca

SEQ ID NO: 15168 - DNA, 957 bp, Aquilegia formos X Aquilegia pubescens
  Predicted polypeptide sequence is orthologous to G505
ttagaacatacatattaagtagcatagatatgcatttctttagtcagaaatgcttacaaaagttgcatacacatacaaccatagctagaaggttaaaacacttgcaacactgatacaaagatagaaacacacataataaccctaataagctaataataccaaagtcttaaggtcatcaccatacccttcacatagctagcaaaacatcttgaaactgataccatacatctcagtatgtccacatacaatcaagctcagtaggacccaaagtcattctgttcctctcaaccttctgatgatgattctgatcatgatgatggcctaccatccagttacttgcagagttacaaataccaccaatatcttcatgatgactagaaatagactgctgcataggtgcaactccagagaaaaagaaaggaaactgcagattctcttgtaaagatctcaaactagataaccctgacattccatcatttctaccaaactgatgatgctgctgctgcattgatgcagcatcaacaggatttggagcagcatttgtattaaaagtaaatgtgtgttgctgttggttaaaatttggtgcagcagcagtggagaaacagggcacgtgctcccttgaagtcttactatcataagagcaactatcaactgtagtaggaccagaataaggagatgaatccaacagtggtggtagtgatgttgatgatggtgatccaacatctgtaaataaactggtcccacttcctagtctagttttcttactccctgtaccactagatccaccaccagctataatccctccactcttttgaaacacccttgaaatcacccattcatccttagagcttctggaaagataatggtaagaaagtttgccttcaagtctatattcatgcataacccagttacttttttcaccttttggtgctctacctctatagaaaaccaaagttt

SEQ ID NO: 15169 - DNA, 903 bp, Aquilegia formos X Aquilegia pubescens
  Predicted polypeptide sequence is orthologous to G525
ctttcttctttcttattaaaccttaaaaacctttcttctaaacctcttcatattatctatttgagtttttttgttaaggttttagagatttagtggtatttgattcataccctcttcttaatttagcttgttttattgtgttcaagattcaaattagctagtggttttttattcaacttttgtgagaaaaacaaggttgaaggtattagttttgaaaaagatggagaacatttctaacttacaaggtaaaggagatgaacagatggatttgcctccaggttttagatttcatccaactgatgaagagcttatcactcactatctttctaagaaggttactgatagttgttttaatgcaagagcaattggtgaagttgatttaaacaagtgtgagccttgggatttaccatggagagctaaaatgggagaaaaagaatggtatttcttctgtgtaagagatagaaaatatccaactggtttaaggactaatagagctactgatgctggttactggaaagctacagggaaagataaagagatttatagagcaaaaacactggttggaatgaagaaaactctggttttctatagaggaagagcacctaaaggtgaaaagactaattgggttatgcatgaatacagactagaaggaaaattttctctctacaatctccccaaaacagctaagaacgaatgggtactttgcagaatatttcaaaagagttcaggtgggaagaaaatacatattcctggtctgacaagattgagttccttcgacgatgaattaggtccgtcgcttttaccaccattaatggatccttctccttacagctctaagaacaaacctattgttacttctgaggtaacaacaaatcacgtgacctgcttctccaattctatgga

SEQ ID NO: 15170 - DNA, 982 bp, Aquilegia formos X Aquilegia pubescens
  Predicted polypeptide sequence is orthologous to G536
ctgctattgcccccagaggggcagagctacaataagtttatgcaacacttattgcttacaatatgaaccacataccagagcactgattaaaacagccttagtagaagaaacatactgatttcaacacaactccattatgaatgaaatgtaataacgaagccttgaactagttcaagaataatacaagtacggccaacataccattcaaatcccaatttcaacttaactaattaaagtacacaaagccaacgaaatctatattatagtaggaaatacaatatccatttgagatgaatcaatcaaatctatcttcaccttactcaggtttaggagcttccttgatctcatccccagcatcatccgtaatatcagaggtccacaatgtcagattgtcacgcaaaagttgcataatcaatgtactgtctttgtaggactcctctcccaatgtatccagctctgaaatagcttcatcaaaagcctgctttgccaaactgcaagcacggtctggtgagttcaatatttcgtaatagaacacagaaaagttaagtgcaagtcccaatcttattggatgagtaggaggtagctctgctacagcaatatcctgagcagacttataagccaacaatgtactctcagcagcttcctttctatctgcacctgtcttgaactcggccaaatacctatggtaatcacccttcatctttaaataaaacacctttgactcagccgcagtagcagaaggaacaagatgtgaatcaagaagatttaaaatcccatcacaaatcttactaagctcagtctcaatctttcccctatactccttaataacaaggacatgctcttcatttccacgattctcttctttttgttcaattgaagaaataatcctccatgatgctcttcttgctccaataacattcttataagcaacagaaagcagatttctttcctcgacagtcaattcttctacatctacagtttt

SEQ ID NO: 15171 - DNA, 998 bp, Aquilegia formos X Aquilegia pubescens
  Predicted polypeptide sequence is orthologous to G536
acacaccatatgtctcatctgacagatgtttctaactaatcaacattaaaattcaaagcacctacgagtttgaaacattctgaaaaatatgaaacaaggtacattttgaaccataaaacagcacagctaatactctctgcagggagcaaaccaatgaaattgcattcatgcggaatacgaatggagaccgacacttccctcctagagaatgatagccgtcagcatataccaccatcactacacctcgtccaattgatcctgcatatcagaagtccagagagtgaggttgtccctcaagagttgcatgatgagagtgctgtccttgtaggactcttcccccaaagtgtcaagctcagctatggcttcctcaaatgcctgcttagccatgctgcacgccttctcagatgaattgagaatctcatagtagaacacagagtaattgagtgctagccccaaacgaataggatgagttggagccagatcagcaagcgcaacatcctgagcagccttgtaagaaagcatagtatcttcagcagcatctttcctttcagcaccagttttaaactcagcaagataacgatgataatcccctttcatcttataataaaacactttagattcacttgtagtagcagaaggaatcaaatgagcatctaacaacttcaaaacaccagcacaaacattagtgagttccgattcaactttagatctataatccttaaccaaaaccacatgttcatcattctttcttccttcttctttctgttcaatcgatgaaacaatacgccaagcagcacgaagagatccaataacattcttataagcaacagaaagtaaatttctttcttcaacagatagttcattcacagatgctgatccaacaacaagtttttccataaaactcaccatttcttcatatcgctctgcttgttcagcaagttttgctaagtaaacatattgttctctgcttagatttccttctgttatcgacgccatta

SEQ ID NO: 15172 - DNA, 866 bp, Aquilegia formos X Aquilegia pubescens
  Predicted polypeptide sequence is orthologous to G536
aaaccttcctacattcataaatgataatctgttgacctgtttgaacataaaagaaagcactctggatggattttcatagtttcccgctctatcgatcatcaaatttcttcacccaagaccatctaaaaccttttaattatgtcttggaagagttgcatgagctctatgattcccttgtacagtctcccaccagatgactcagcaccttcagcctcttcaaaagtcttagtatcaatatcaaacacttgtaagctcaactgctccagataagccatagatgtcgagggtacaagtggctttagaatgctcaaaaggtcatgatatatatccttgagctcagtttcgatcttactcttaaacttctttatggttgaaacatttccatttataatattctgtctgctcagctgaacagaaatgatattccaagaagtccacttaacctctatcacattctcgtaagcaacaaacaataggttgcattcctctttggttggctctgtaacattctctactattgccttaagtaaccccaccatttcttcatatcgattagcttgctcagccaacttggccagataaacattttcctggcgtgagaactgtgatgccatctttgctatgtcaatttttgcacctttaaactcatcaagactcgtataataatgaatgcctaagctaagataaaagtaatcagaatatatgtagcttatggactctttagacaagtccggggttacgaattgtgagtcgagaagttcaaaatcccatcagagaaaatgataatatcactttgcaacttagtcccagatgcaagaacaggagaagacagattacggatatagattttttcacattctggagtc

SEQ ID NO: 15173 - DNA, 969 bp, Aquilegia formos X Aquilegia pubescens
  Predicted polypeptide sequence is orthologous to G536
atttctatagtagttatgtaataagaacttcctaatgcaccatgctgtcattgaggagttaaatgtactagcatgcagctagagcacttgcactatcaaaacaacaccgaccccgtcgaaacatcaaaccacaatgataataacagctaagatagtgttaatacaatacaagagaaagtaacattaaattccacgaaaaagatctaagattaggcagaggctacaaatccttcacttcatatctgcactcagcacgctaaaaaggtctgtccagttcactctgcatcttcacctcctccagctttggcagaaatgtccatcttctgggcttcttctccatcttctgggatgtcagaagtccacaatgtgaggttgtccctcaggagttgcatgattaaagtgctatccttatacgattcttcactcagggtatccagctcagaaatagcctcatcaaaagcctgttttgcaagatggcatgccctttcaggcgagttcataatctcataataaaagactgagaaattcaatgccaaacccaatcgaattgggtgtgtaggtgataaatcagcttcagcagcactggaggccaactcataagcctttagcgactgatcagcagcctctttcctgtcattaccagtcttgaactctgccaaataacggaaataatcacctttcattttgtagtaaaacacattagattcaccagcagtagaagcaggaatgagatgttcatcaatcacagtcataatatcattacagatactggaaagttctgattcaaccttatgcctatactccttaatccttttcgcattctgatcatttcctttcccttcttctttctgttcaattgaagacaaaatcctccacgaagctcttcttgctccaaccacattcttataaccaacagaaagcagatttcgttcttcaacagttaattcaacatcaagtttcgcaacattc

SEQ ID NO: 15174 - DNA, 958 bp, Aquilegia formos X Aquilegia pubescens
  Predicted polypeptide sequence is orthologous to G536
tcctcctcgaactttcaaatctctttctctctctcgcaactgaacatattctctctctaatggaaaccgaaaccctaaccagagaacaatatgtctatctagctaagcttgctgaacaagcagaaagatatgaagagatggtttcattcatggaaaagcttgtagttggatcttcatcagtagatgaactaactgtagaagaaagaaatcttctttctgttgcttataagaacgtaattggatctcttcgtgctgcttggcgtattgtttcatcaattgaacaaaaagaagaaggtcgaaagaatgaagaacatgtttcacttgttaaagtttatagatctaaagttgaatctgaacttacagatgtttgtgctggaattttgaaattaatggataatcatttaattccatctgcaacaactagtgaatctaaagtgttttatttgaagatgaaaggtgattatcatcgttatcttgctgaatttaaatctggtgttgaaagaaaagaagctgctgaagaaactatgcttgcttacaaagctgctcaggatgttgctattgcggatcttgctccaacacatcctattcgattgggtctagctcttaatttctctgtgttttactatgaaatactcaattcatcggagaaagcttgtagtatggccaaagaggcttttgaggaagccattgccgagctggatacattagggtgaagagtcatacaaggacagcactctcattatgcaactcctaagggacaatctcactctttggacttctgatatggatcagttggatgacgcttaggttattcttcaccttgagggaggtggggctggaatgtcatttgttatcattatgcttaaatcaatttgctccccatagtgagcaacaaccgagtttgctaatactcaaatgaacttgctttcaaatgttaaagaatacctttcagtgggtt

SEQ ID NO: 15175 - DNA, 900 bp, Aquilegia formos X Aquilegia pubescens
  Predicted polypeptide sequence is orthologous to G536
aacattaaaaaacacatcaaatttaagaatcacagactcacaaaaccctgtaccttaaagggctgggaaaccaatgcagttcttaaaattcatagtaactgaggaatcaacgccaagcacatgttgctatagataaataaaggaaactaacaccctaatctgaaacaaactgaaattatgactgctcatcctcacgctttggtgcttccttgatctcgtccgttccatcatcctgcatgtcagaagtccacaaagtgaggttatcacgaaggagctgcattatcaaagtgctatccttgtaggattcctctcccagggtgtccaactccgcaatggcttcatcaaatgcctgttttgcaagactacaagcacgatcgggagaattcaagatctcataataaaacacagagaaattaagagccagtcctagccggatcgggtgtgttggtgccaactcagcagttgcaatatcctgagccgatttgtaagccgaaagagtgctttcagcagcctctttacgttcagcaccagtcttaaactcagcaagataacgatgataatcacctttcatcttcaaataaaagaccttagaatcaccagcagaagcagatggaatgagtctagtatcaagaagacgaagaataccatcacagatcgaagtaagttcagtttcaatcttagatctataatcacgaatagcagcaacatgatcttcattaccacgactttcttctttctgttcaattgaagaaataattctccatgaagcacgacgagcaccaataacattcttataagcaacagaaagaagatttcgttcttcaacagttagttcttcagcttcaacagatgctgttactttttccataaattcaaccatttcttcatatcgttcagctt

SEQ ID NO: 15176 - DNA, 918 bp, Aquilegia formos X Aquilegia pubescens
  Predicted polypeptide sequence is orthologous to G536
tcggcatcatagatccaattcatgccaagccactagatcaatcataataagattacatggttctgatacaatcattaattccatataaagataagacattgtcgagctagctagaaagaatagagtcttaacaagctcaacatcaacataagatcaatctcttttaagacagaagactaatcagaagcacataaaagtaaaagataaaaaaaacctcggcacctctaatgaagactgtaagagtaattagaacaggtgatactaaatactcatggggacaaaggcaccaagaaccttctcctattataaaaacgaatgaaggagaagtgacaccctaatttggaaaaggaataacttaactaatgttcatcctcgcccttgggtgcttccttgatttcgtccggcccatcatcctgcatgtctgaggtccacaaagtgaggttatctcgtagaagctgcattatcaatgtgctgtccttgtatgactcctcgcctagggtatccagttctgcaattgcttcatcaaatgcctgttttgcaagattgcaagctcggtcaggcgaattcaggatctcataataaaacacagagaaattcagagccaatcctagcctaattggatgtgttggagcaagttctgcggttgcaatatcctgagcagatttataagcagaaagagtactttcagcagcctctttacgttcagcaccagtcttaaactcagcaagataacgatgataatcacctttcattttgagataaaagactttggaatcaccagaagaagccgaagaatgagtctagtatcaagaagacgaagaataccatcacagatcgaagaaagttcagtctcaatcttagatctataatcacgaatgatagaaacatgatcttcattaccacgaccttcttcttttt

SEQ ID NO: 15177 - DNA, 900 bp, Aquilegia formos X Aquilegia pubescens
  Predicted polypeptide sequence is orthologous to G549
ttcctgacgagaaaaaaaaaaccccaaaaagtaaatctttaggactctgatttagtacaataacatatcttcctcccactcataaattgctactactactactacgtactagagagtcatggtacttggggatctagactagatcagaatgaagctgagtttgaagtagaggcaacattgttgcgttgagcatggcagagcttacggagctttgtaggtacataccaaatagaaaggcgagggtgatcattaaaaatgcagtcaatatcatagtgatgatcacttgcaaatttcacaagcggttcatagcatgcctgcctccatgccccaacattttctcctcggtctttgaaagctttcctcagtgcattagatgcttcctcatctaggcagtgcagagcataacagtgaacataatgtcgtattttaggcttgttgatatgagttgcaccagcctgaattgcatgtcgatacacctgatttgtcaccttggttgggcatttttcacctctatccttagcaatgttttgaacttgaatcaagtactggctacattcttcatagagatgaaacaagtaatcaagaccattcttttttcctcgagcaactccacctggttcagtcacaacaaatggatgctctctttgtctatgacgaccacaaccacgttcacctgcagcatcctcctcatcatcttcatcatcatagttttcatctccgctattcctcgcctttctagaccgttgcgctttgtttttcttcttccttttctcaccagcagagaccatatcccatgtacctcctccactcccagctgcttccttcattactggttcctctgataaacctccttgagagagtgcgtcaagagggttagtggtgttatcaacatgaccccag

SEQ ID NO: 15178 - DNA, 847 bp, Aquilegia formos X Aquilegia pubescens
  Predicted polypeptide sequence is orthologous to G558, G578, G629, G1198, G1806
cagaaacacttgcttccaccaactaatctagctctggcattcaaacagggcctactacaacttatataatttataacaaacagtgcctactacaacttacagtgactattgttctaaaggtgatcactaaattaaacatacaacaccttggtgactagattttgctgctgttacaacttacaggagattagaacttgtgctactatcgtgctttccatagacatttgacagcttttcagaacagcgtcgagttcaagctggagttgcaagccggaccaagatactcattgtggttcagtgactcttgaatgctacctgccatttccttaaatacgttcagacaaaataaacaaatggccctctcactcccttggacgtgccaaccacagagaactaagtgcacggagccgagaaaaatagtctgtaatagcaagaagagcacgtgcagattgccgggttgtcaatattcgatgcatttgttgcagtgtttgttgcctcaggttgtcagcctggtgaaggaatccctcgagagtttcaagcttccccatggccatggccatctgacccatatagttcgccacgttccctgatgttcccgatgtgccaggagaaccactagctaatgtctcagccagagattgttgcaaagcttccataccctgtgacaatgcatcctccgcctgttgagatgattgctgcagctcgcagattcccattagctgttgctctgtcagaggctccaaatgatttacaagaagcttcagtagctctgatgaacggaaaccaccaagccagagaaacacctttctgcagtgtcttccacatgccagatagcatatggatacat

SEQ ID NO: 15179 - DNA, 758 bp, Aquilegia formos X Aquilegia pubescens
  Predicted polypeptide sequence is orthologous to G558, G578, G629, G1198, G1806
aattttgattatataacaaacagcaatacatgcatattatttcaactacagcttcaaacataactaaattacagcacctaatttgaccacataatgactgttacatgtaagaggtgaaatggcatatttatgatcacaataccaccatggggtcctagaacggtcaaacagattggcacacttccaaaactgggaagcatacactgaccatggaggatgaaactattgctgtgtaatcatctgatccatcatctcttgaattgttaggaaattacacttacagggcctctcattcttttggtcgggccaaccatagagaactaagagcacggagcctagaaaaataatcatgtatagcaaggagagcacgcgctgactggcgggttgtcaaaatccggtgcatttgttgaagtgtttgctgccgcagattatcagcctggcgaaggaaaccctccagagttccaagctttcccatagccattgccatctggcccatgtagtttgccacattcccagatgaccccgaggggccaagagaaccactggccaacgtctcagccaatgactgctgtaatgcctccattccctgtgataaggcatcctcagcctgttgggatgactgctgcaagttgcagatgcccactaattgctgctcagtaagaggctccaattggttcaccagaagcttgaggagttcagatgagcgaaagccaccaagccacatgaaacacctctctgctggagttttccacataccc

SEQ ID NO: 15180 - DNA, 961 bp, Aquilegia formos X Aquilegia pubescens
  Predicted polypeptide sequence is orthologous to G558, G578, G629, G1198, G1806
gtaaattgcaaatgacatttcattgatttacatgtacaagatctcatctctagctttccatgcatcttcattttctcctttcaatagcttgaaaacatctgatggccatgaaatggtgatgaaaatgcaaagttgatcatttgtagtttgtttcattctcttgatcaataatttgaaaaatggctctgttgatgttgaaccatttgtaaatcagatgttgtctgacatgagttatcatcgctgatcatgtgttctcgtggtcgtgatgcccacaacgaactgagtgcacgtaatctgttgtagtactcaccaattgccagaaaacaccgtgctgcctgtcgaactgtcaatattcggcgtaactgatgaagggtttgttgtcttaaattatcagcctgatgaacaaagccttcaagattggagagtttccctagagcaagagccatctgacccatgtaatcgtcaacattggatccatcgcatagggacccagtagcaatggtatcggccaaagattgatggagctgctcaaggccttgggacagagcatcttctgcttgttgtgaggattgttgtaggttacatattcccattaactgctgctcagttaatgggtctaactgaggcatcaatatcttgatgagttcagacggacgaaaaccacccatccagaggaaacaacgttcagctggagtgatccacattccagtgatgagatggaaaacatcggatttagctgcaattcccttaagtcgaaaaatttcatcatagtgagacagatatccatctgttatcatccttagatcaccatcagataggtgagcttgcaatgcagtccgcagctctgacatgtgcctatgatcatcttctaaccatcttgcatattccatgtcaagatagcagcatctgagctgagacttccacctgcaccacctcctgctagaataatccctgagatctg

SEQ ID NO: 15181 - DNA, 953 bp, Aquilegia formos X Aquilegia pubescens
  Predicted polypeptide sequence is orthologous to G561, G562
ttattaagatctgactgcgaaatctgctaaatagtttacaaaccttaatattcagtcacaagacattgctacatattcagcttaccacacatgtagcaacagaacaaagccggaagacacatagctactacataataatgtcttaactctcagaaacatgtggaatcaaatagaccacagataattacattctgaagttgaaatacaagagttttatctaggtaatattatgttggcagctccaaataggtgcaaagagtttgttatctcatgttagacgttgtcttaactaacctacctaagttgacgatttgagtaatttcaagctaataatgttccagaattacgaaaatgggtgtgacatatgagactgcttaaaacagatttgttgctcattagcctgcagccacagcatcggccctggggctcgatttcaaaagctgatgaagctttgcgccagaattcttattttcatgagcaccattctccaggtgatggttcaaagtaacagagtcagagttatgcaccctagatagaaagttctcagtactgacaggaacaggggtcagcacttctgccttgttagaaacggctttttctgccagtcctgattgtgcatcgttcagtctctccattagtgcagtgttttctatcctcagtttctctgaattttcagccaatcgattcatttcagatctaagggccaggttctcggcattcagtgattcaactttcaaagcaagctcctcactctccgcctgcttccttaatcgcgaccttcttgcagattctctgttagattgtttccttttctctcgttttagtgcccgctcgtccttcatccagagttcagaaggcaaatgatcacgagctggcatcgctgtgtcagttgtaggagggacagacacagcagtggcctttcttttccctgtggaggaaactatcagttctaa

SEQ ID NO: 15182 - DNA, 937 bp, Aquilegia formos X Aquilegia pubescens
  Predicted polypeptide sequence is orthologous to G583
tgttagacaaccaaggaggagaaactaataaaagctactccaaggcattatacatctcacaaaaggtgtctcgcctgcaagcctatggctgtgatttatttaagagtacagataacagaaatcttgatacaaggcaagttcctgagctaggtagaattgttactccagtctactaatgagtgcagctttcagactctcttcggtcctcaatccctcaggaaccctggcaacaatatcctgtagcatcaggtccttgacactggctacactcgcgtgctggacttgcaagtctaggtctctaagtgcatccatcaattttgcagatggatggttcatattctgacattggactcttatcattgcatctggtccatgaattctcacctctacttccatctttagtaaacctgcagattcggaatcagaccttggatagtgatcatcaaccatgccatgttgatgatgatccttgctattcaatttttctatttttattttcttggaatatttatggacttgcgcctctaagttatcaatcttggccttgagctcattgatgtaggacactgcgtctcctagcaaagatgctttgtccatccttgacacattagggaccacagctctgagagcgtaaaaccgatgattaagcttctccctccgctgtcgctcagcctcaacatggttcatcggtgcatctcttccattcccaggccttcttcctcttttctttggcttcctcttttctagagccagtgcaacaaaaggaccatcagagttggagtgctctgaatccaatgaagaggatagcccggtctttgcaacttccttccttgtctctgcttcatgttcttgttgaacatgtttgtgtactccggtggttatgccaatatctgcaaaagagaggtttcgatccagaaatggaagtaaaccacctggg

SEQ ID NO: 15183 - DNA, 886 bp, Aquilegia formos X Aquilegia pubescens
  Predicted polypeptide sequence is orthologous to G584, G1136
attatcatctaaattctgagctaaattcaggcagaactacaaagccatcaacaactattaacacattcgaacctaaacaacaaccttataaccacccctactttatctcaaaacttattaatcctatatacagagacaataaattaatacaaaaagaggttttttacagcataccgttacagcccgggaacccttcatccaaaagaagatggcgctcttcatcctcttctttgcttttattaaccacctcaatcgctacttcctcaaccagtacaaactatagatatttcgatctgcgtgaggtgttaaacatcccagcttcaacattgtgcaacaatttttggacaattgtatatatagcaatgcaatcaccttgtttcaaaaattctagatgccaaagcagccctgagctgctcaggagtgtaaatccgactagacattttcacatttgtctgttgtaccattagatccttcaccactgacacagtagcataaatcacctccaagtctagatctttcatagcggccattattcgagctgctgggtgattattcttgttgcactgaattcttatcatagcttcccaacccattatctttacatcaatttctgcctctgctgacttctttccatgttgatctatggtccttagatctctatcagactgtaactgtggcagtggaactggtcgaggttctttgctggctagttctttcttcaaggaatccacttcagcttccaacccatccttatctgactctgcagtttggagtttagttctgagctcattgatgtaagaaattgcgtcaccaagtagagaagctttgtccatcttcgaaacattaggaacaacagccctaagggcatagaatctctggttaagct

SEQ ID NO: 15184 - DNA, 940 bp, Aquilegia formos X Aquilegia pubescens
  Predicted polypeptide sequence is orthologous to G585
caaactagcaattacttttgagttgttgctagctaggttgctaataaactagtaatctataatggttgttatgcttggaaaccaacttggaaagatgcttgctgcatctgttagaagtattcagtggagttatgctattttttggtcaccatcaactaaacaagaaggggttctggagtggagtgatggttacttcaatgtagataaggtggatttgaagaagagtgagaaattgagggaaatgtacgagcgtttgtccctaggcgagaccaaggaacaagctaaaatcgcttcaactacttctttgtcacctgaagatctctcagatgtggaatggtactatgtagtttgcatgtcttttgcatttgcacctggagaggggttgccaggaagagcatttttgaatggtgaacatatctggctatgcaatgctcaacatgccgatagcaaaatcttccatcgctctctcctagctaagagtgcatctattcagactgttgtatgtttccctgtgtcgggcggtgtggttgagcttggtgtaacccatatggtcatcgaggacattggtctagtacaacaaatgaaagctttcttcttggacttttcaaaggatagctgctcagagaaattcatgtcaagcccaccgaacgatgaggatgatgaaagccttgcctgtgataatgatcatgacgcagataacactcagaagagaacacgatcgaaatcagggttaagggatgcagacatatccatgccaggttttatatttatcttgacctcttctagcttggtagctagtaactaaaagaactcttaaatttgtcatatatatgtgactacaccagcaacttttacaattcatctattatcagcttatgtatcaatgaaaccagtggttatctattaaacttgtgcatctttcagcccaagtatgggttaa

SEQ ID NO: 15185 - DNA, 820 bp, Aquilegia formos X Aquilegia pubescens
  Predicted polypeptide sequence is orthologous to G585
gaagctaagtatggtgattacagggaagtagtcaataaactgcaatacagtacaattatctactacagggtagtagagcaaactggcctatcttattctagaatcataacattctaatacagttcttatcagtatttctctcctacaaggatcggggtgatttgatttttttgagtgccttttcttttcatttaaaattaccaacaaggctcccttccaatagctccaaaccacaaaacttcaacatgactaactgatactatgagactaaggattttattttattttttcctcatctgatgcgatatacttactggtgcactaggagaaaaaacactaggatgtggtggacccaacaacttccagaactgctgatttgattttctctgccgtaataagtccagttcccctgaacttggagttgagagttagggagagaatcccatcagaagtagatgatttaactgagtgagcatccagttgaagattgcttatcacatccataatttctagaagcaaacattctctccaaggaacatgcatttcaattgtagcctccttctcttctatgcagacagagatatctactgctaagccatcacttggtgaaacccagctgagttcagggtccatctcagcgacgtcacaagccttcctcttgcttaaaggaggttttttgccattagcagtttcattgtcgaaataattatcagatgctctctcggctatatctgtgcatttctttcttcctcttgattccaactcttctacccttctctcaagatctttcaggtactctattgtatcaccaaggacagat

SEQ ID NO: 15186 - DNA, 939 bp, Aquilegia formos X Aquilegia pubescens
  Predicted polypeptide sequence is orthologous to G590
gcctaattaagtagatgctaaacaaaccttaatattgttatttcttgggtcccatttgattgttgattactttacagatgttatcaatgaggaatggatttagtttgcatcctatgtacctgcctggagtattacagcctctgcagatgcctcaggtacgtgtgggatttgatgaaggaaatggattgccacctcatatgaacattggaagggacacactgcctgtaaacccagaaccatcaactcaaacatcctttggtctatccaaccattgcgcaacctcaaaccagccagtggtaatccccaatatgacaaatattactccttcagaaacttcatatggcttggattcttcacttcagagtcaccagggttcgtttcagctgtcttcaacttctgaggtaggcaaggtacattcatttggatgctgtttatcagggtaattagtaacactcattttacttgtgctgtgaaggagatctacagggaacagatgctacgtcaacaacaattttatgttagtcaatcttcacataacccatcaggagataataagatgaaatcgattgctacaggatctctgccttttgatgtgcaagcttcggggttggaacatcccaactgtatggaagcatctatcttgcacagagagagatcagagagcatgcttccaaaggatgttaataatagccagacttttatgcagcaatttcatagtttacagacaggactaagtttacccaaggacaatcctgcaagataggcaaagaactaataaattttcgtgggtctagccttcaagatgtgattaactaattcagactgtttactgggggtctgggacaactttcgcaactcgactaatcccaggggtgactaggacagctttcgcaattcagactggttttgacataacaccatagtcactctcctcagctt

SEQ ID NO: 15187 - DNA, 920 bp, Aquilegia formos X Aquilegia pubescens
  Predicted polypeptide sequence is orthologous to G591, G793
gagaaaaataaatcaagcactttacaaaaaacacaacccactcaaaaccgagtagtgcaaccttccaacacaacttttttaagcgaccaacaactatccaatatccatttcaattcccttttcagtttccttctaatacattaatcatgtctatgtacccatcttcccctttaaaaatgccccaccctccactatccaaaagaagggtccccaccggaaagtgttctggctatccaccactatcccacaccacatcaggagtacctatgattatttttctaggcatcacattacaacctatttgacgaaaaaaatgaaaggcagaacgaataatatggcatctgactttgattgcaatgctgaggggagttgactaagtctgacgtggggggaacaaatggaaggtgggatagttgtgagtttggagttgttcatgggcacgtccaattgtctgtatccttttcattttatgaaggtgcattaggttcgggtttgatcattgtggaggcatcgggtggttggtcgtggtatattgcagaggcaagtgaaatgggcatgatgcaaagtgctttagattggaggaattgcatggcagctccaacatcttcttccatgagctttgctacttgatgttctgtgccatctgtagaccatttctcccatgctggctgattactgccaccttcactggctccgccctcagctgatgaaagtggaatgtcagccacaagctgtgctactgcaccagctcctcccagtctgctcatgctcaaaaccttgacctggagccttagaaatttaacataatcaacaatttcatcaagcatagctgccctatcagtcttgttggaactaggaaccagttcctgtagtgccttcattctttcagctattctttctctacgtaacctctctgcaat

SEQ ID NO: 15188 - DNA, 883 bp, Aquilegia formos X Aquilegia pubescens
  Predicted polypeptide sequence is orthologous to G592
gaagtacatttggaagatttgctatacaacatttttatactaggagaaaacctctgattgcctatagggttttggattttaatcatctccatacccacatcagtaacccctacttacattcttctaactaaaagctagagaagtcagctttgctctcactttctctttattccatcctttttcttccttatttttctgtacagaaacatatcaacctctaggattttagtatggtttctgcttactggaacacgtacaagtcgctcgattatcattaagtttcttgacctgtttttggagctctttaatgtactccacagccaaatctaacatgtctgcggtgtttgtttgcttgtccatgtttggaacaagttcttgtagctttctcattctttcactgattcgagttcgtctaaccctctccgcgatacttcgtgggtgagtagcacaaccccgctttgctcgaattttacaaggaacagaatcctggaattgaaggatggcagccatctccactgacgtttttggcaaactaaaatggtgggtcaaattgcgagtttgatttccagcctctggattctcaggctctgacgagtttaaaccagaatgcatctttgtgtccgcatctctgaatcttttaaggcttgtgaaattctccagtgcagagtcttcccaagagttgagagggaagttgggagggtattgattgctaacattgctgttgcccacacttccaccatctccagcacatgttccaatgctttcacttccaacttcagagataggagacattaaccctgaagaagaaggtggcccggatgggtagttcatctgattcttcaacctcctagttgatgcagcttcattagtactatttccagct

SEQ ID NO: 15189 - DNA, 965 bp, Aquilegia formos X Aquilegia pubescens
  Predicted polypeptide sequence is orthologous to G594, G1496
attcattaaaaaaaaaaaaaaaaaaaaatttaaacagcgcacattagcaagaattatcacagtttgatcaaatatgctacactgcgcagcagataccatgactgttttagaaagacaacaagctcggcaaaaatggcaacaagtcccactactacaacaacaacaacaacaacagcagcatcaacaaagctattttagtgatacccatttcaatttattaccaaattcttcttcttcttcacaacaatttcatattatgatgaatgatgattcagtgattagagattttgtgaatcgttcaattaaattggacccaagtttggataataatgggtggcaggattttgggaaatacccagtttctggaaatggatttggtgttaatggagttgatttggttgattattcactttctagaacatctagttgtccaccggcagatgtggtggtggaagcaaaaggtggtgaagttgtggtggcggagaagttaggtggtaaagttgggaaagaaagctttaagaagagaaaagcacagaactcaaaggttgtagcagaggaagttattagagacaagagaatgaaaggggattcagaagaagagtctaaagttactgaagtgaataacagcaacagcagtactagcaataataacaacaaagaaacttctggggattcagtgaaagagaattcaaaggcatctggagcacaaaaacaagattacattcatgttcgagcacgtcgtgggcaagctaccgacagtcatagcttagctgaaagagtaagaagagaaaagattagtgagagaatgaaatatcttcaagatttagttccaggatgtaacaagatcactgggcaaggctggaatgttagatgaaatcattaattatgttcaatcactacaaagacaagtcgagttcttgtcaatgaagcttgctgctgttaatcctagacttgactttaacatc

SEQ ID NO: 15190 - DNA, 951 bp, Aquilegia formos X Aquilegia pubescens
  Predicted polypeptide sequence is orthologous to G597
ataaattctccagaaacagaagaagaccaaaaaccttttcccgcttaattcctaaaaccccccccttttttcatggtcatggagaataataatacccaacaagaaacaagtttaccaacaacatcatctcatgaccatcatcatcatcatcatcttccttcttcttcttcttcttccataatcacacctacaccaattcctttaaattctcatcacaccccaccactatttacacccacaaaccaagaacaacaaccacaacaacaacctgttcaagttcagcctatttcttttgattcagtaatcacttcgttttctttatctagacctaatattaatattaataataataataataatgattattccaattctatttacaaccctaccattactactaatggtggatcttcttcttcatcttcaattaaaccttgtggtagttttaatatggttaatactagtgaacctgttaagaggaaaagaggtagacctagaaagtattctggtcctgatggtggtgttgtattagcattgtctcctctttcttctgctgctgctgcggcgactgcggcagcaccacattctaaaaatggacctaatgagtctagttataagccgagaagtcgtgttcggcccactggctcggggaagaagcagaaattggatgcccttagttctgctggtcgaggttttacggcacatgttatcattgttaaagctggtgaggatgttgcatccaaaatcatggccttttcacaacaaggcccagatacagtttgtattctttcagcaaatggtgcagttggcaatgtcacacttcgccagcctgcaacatatggtggcactgtatcatatgagggtcgtttcgaaatcatctctttatcagctcttttttgctcatggagagtggtggacccgcagcagactggtggtatgagtgtgtcactg

SEQ ID NO: 15191 - DNA, 953 bp, Aquilegia formos X Aquilegia pubescens
  Predicted polypeptide sequence is orthologous to G597
gaacaaatgaagcctaaaacatttctaatatacaactcacacacaggctacaaggaaaggtgtcaatcctcactgggaaatctaataagttgacctcaactctttaagcaaaaaaaagttctaactaaaactagtttcttccgattgattacaacagcagtattttaggctgcacctatagcacaagttggagagatgtcattcgtctatttccatggcaaattggccatgtcttgtgcattgctgttattgcaggctcctgtgctttggttaagtggactacctggaccaccagaggactcactcatggtcccttgtgaaggtgggctgccagttcccacccctccaccaaactgcacaagtttaggtattgcagaaggatctgagtgattcaacttgggctctttgccatccgctttaaaactacccacaaccacctgaacaggagatgctgctgttagaagtccagccaccccaccaccaaaaacacgaccatcaggaccagctaatgtcacactcaatccacctgttctgatgcgctgtccaccactctctgaaagcgaaaatgaaccagaaagcgacaggatctcaaatcgcccctcataagttactgtgccaccagatgttgctgcttggcgtaatgctacattagatatagcaccatttgctgaaagaatacagacagctcgtggaccatgctgagaaaatgacattatcttcgataatacatcctccccatctttaactgttataacatgagctgttaatccattttccaatgaacccaaagtagccatttcttgttttttcacagaaccatgtggtcttcccctaccccttttcatagataatgataaagatgcagtatcacttgacgatggagagaacccaccatcactatcacacaccaccacaccactgctttcgtcactagtgtttgtggtgctggtgtc

SEQ ID NO: 15192 - DNA, 964 bp, Aquilegia formos X Aquilegia pubescens
  Predicted polypeptide sequence is orthologous to G598
tgtttacctacctactagatgactacagaaagtaaacaatgtttctaacttatataagcatacatgtccacacactagcatcataatacaacaaaaattgtccaaactgttacatgtaaaaatcttaatcttttgaatctgaccatcaccttttctagagctagtagcccagtagtaaccaccactccttaaccaacaataccactcaaacaaactgtacatgacaagaactaatcctcaaaagctcaagacacaactaatagcacactttgaaaaacccagcggcacttagcactcaagttcttaatgctaaaatgctaagtgaaatcatctaatacatataaatccacccttgaagtgaaaaaaatataagggtaatataattatattagccaaaaagcaatatctaattaagtagagatgagatcatataccacccgttgtggaggtggaaggatatcgatcttcaacctcactaatccatcgcagaaaaacttttttgacaacgtgatcagatgtggtttcacgcggttgtcataaggttggaaaagaattcacctctacaactggtggtagatgatctaacctcctaactaattactattagatgtgggtgcggttagaagaaggagcgcttggtaggaggtcttccaagggtcctcatcaagttggctatctctagaacccgagcaacctttgtacctctcttggcttcagctgatgctcttttttcctctgcctttctatgtgcttttgcgacatcgttctgcattttctcaagagctttagctcttttctcttcaagtttcctctcaactttcttcatccaagttgtggccttctgcacctcttcaccctcccagccatgaataactgcatcttctctcttgaaccgattgttaatctttgatatctttgctgtctgccatgcatatatcttcgattcagtctctctttcttcact

SEQ ID NO: 15193 - DNA, 893 bp, Aquilegia formos X Aquilegia pubescens
  Predicted polypeptide sequence is orthologous to G600, G2768
gcgaggatttgggaggggtggtgggtttgaacggaaaacacctccgcaaggttacatctgtcatagatgtgaggtgcctggacattttattcagcattgccctacgaatggtgatcctaattacgacaaaaagagggtgaaaaatccaactggcattccaaggtcaatgttggaggcaaatccagagggtgcatatgcattgcctggtggtgcagttgctatgttgaagccaaatgaggctgcttttgatagagaagttgaaggttatcttccactcggtcagttggtgaacttccaccagagcttcactgtcctctgtgcaaagaagtaatgaaagacgctgtgctgacaagcaaatgctgttttagtagtttttgtgataaatgtatcagaaattgcattatatcaaaatcgatgtgtgtttgtggtgcaacaaacatacttgcggatgaccttttgcctaataagactgtcagggatactatcaaccgcattttggagtcaaataatagtagtgcagataatgctggaagtgcagtacatattcaagagtcttctcgttgtgagcatcccaaagtcccttcacctactatttcggctacctccaagggtggacaaatgccaccatctccgaagaaagatactcttgatctgaaggaggccactaatagtggacaacctgtggttaatgcccctaagcagtctttggagacaggaagacctttgaaagctgttgatctatctgaagtgacacgtgagtcgatgtttgagaaggaccaaagttgcaaggtggagttgtacatgctgaagaggaagtgcagcagaagctgtctaccagcgagccaggaaagaaaagaaaagaagaaatgcctttccctgcaaatgcagcagag

SEQ ID NO: 15194 - DNA, 944 bp, Aquilegia formos X Aquilegia pubescens
  Predicted polypeptide sequence is orthologous to G605, G1944
gaaattttgatgcatggaagggagagaagtaatgagttcaggtggaattacagtgatgggtgcagatgctccatcaaactatcatgtagcagcaagaagtaatgaaaaccctaatcagattggtggatcaacagctgtagctacatctgtgagtgtagctataggtagtggtagtggtagtgggactagtggaattggaggaacaacttctttgaagaagaagagaggtagaccaaggaagtatggaccagatggtacagtttcattagctttatctccgatgccgatttcatcttcagcaccggcatcatcaccggtattacagacatcatcagcagcagcagcagcacccttgacaggggagttttcgactgagaaacggggtagagggcggccagctggttcggtgaacaagcaacaacagaaagtggaggtggtggagaatttagggaattgggtatcttgctccgttggtgcaaatttcatgcctcatgtcatcactgttgctgcaggcgaggatgtaacgatgaagattatatcattttcgcaacaagggcctcgagcaatttgtgttctttcagcaaatggtgtaatttcgaatgttacacttcgtcagccagattcatcagggggtactttaacatacgagggccgttttgaaattctttcgttgtctgggtctttcatgccctcagagagtggaggaacaaggagtcgatctggtgggatgagtgtttctttggcaagccctgatggtcgtgttgttggaggaggagttgcacgtctcttagtagctgccactcctgtgcaggttgtggttggcagttttcttccctgcactcaacaagaacagaagccaaagaagcaaaaacctgaatcaacatcagctgctgcaccaactgcggcagttcctatttctagtgctgagatggaggaaggctaca

SEQ ID NO: 15195 - DNA, 926 bp, Aquilegia formos X Aquilegia pubescens
  Predicted polypeptide sequence is orthologous to G618, G2057
gaacaagaacaagacaacccagaagaagaagaggaagaacaacatcaacaacaaacacaacaacaagctcatcaacaacaacaacaacaagcacaagcacagcagcaagcacaacaacttgggtattatggattacaacagcacttccatcaacaagcacaagcacaacaacagcagcagcaacttttctatgtaagaggagaagaagggtcttcattagcattagattcacacttaccaaagaaaagatcttacttacctctttcagaagaacagaggagaaacatcgaatatgcaagatttggggaaaaaatggaagacactcagcatccccaacaacaaactacttcaagattgggattgttaaagagcagtgtaggtggaggagagattgtggaagttcaaggaggccacattgttcgatctaccggaagaaaagatcgacacagcaaagtctgcaccgcaaagggtccaagagatcgaagagttcgactttcagctcatacagctatccagttttacgatgttcaagaccgccttggctacgatcgaccaagcaaagctgtcgattggcttatcaagaaggcaaaggctgctatagatgagcttgcagagctccctccatggcgtcctactgccactaatacttccaatgctgggcaatcctcggaacaaggccaagaagaggagaatcagaatcaggccgatgcttttggtagttctagtaagagaccaatggaagttgaacaagatgcttctggttatggcttccagcagcaacatttgaacaataatcctagtagcagttctggtttccttccaccttctttagattccgatgccattgctgacaccattaagtctttctttcccattgctgctgctacatcatcatcttcaatccattttcaaaattaccctcctga

SEQ ID NO: 15196 - DNA, 886 bp, Aquilegia formos X Aquilegia pubescens
  Predicted polypeptide sequence is orthologous to G638
cttcaacaacaatggagatgaatgatcatcatcagtatggtttaccggatttacgacacttacttgcaggtagaactcattttccaaacttcccacaacagtatcaaactcaccggaatcttacaaacaccccgcattacgatttctcaatgttaagtagttctcaagttgttcatgatactcctcatgttaacttctcagctgattctactacaactacaactaataactctacttctcctacaaacaacaacacaattaccacaactacccctcctcttacaaccaccactactactactactacaactactaattctttatgtggcggatttgagaatatggaaggctgttttggggctgatggaggaaatggtagatggccaagacaagaaactttaacacttcttgagatcagatctcgtcttgattctaagtttaaagaagctaatcaaaaagggcctttgtgggatgaaatttcaagaataatggcagaggaacatggatatcaaaggactgggaagaaatgtagagagaagtttgagaacttgtacaagtactacaaaaagaccaaggaaggcaaagctggaagacaagatgggaagcattataggttttttcgccaacttgaagctctttatggagacagtactaataataccccagtttcaggagcatcagaaaccaattttattggaaatactattaggtttcagaacacaagcaacaccaccaccactcatgttaacaatcatgaaggtttgcaaggtcataataaacttatgagtgagagccttagcatctctaattcctcatttttcgacacttcttcatccgaagatggtgataatgatggaacagccatgggccttcatggagaactact

SEQ ID NO: 15197 - DNA, 990 bp, Aquilegia formos X Aquilegia pubescens
  Predicted polypeptide sequence is orthologous to G643
aactatgccagacttgtcaaagactaactccggtgcatagtaaaatacataacaactgtaatccttgaaattcattttcttaacatgaattttgaataacagtaactatggttacctagaaacaacaggcataaagaatgaaatgagaagactactacagcagcacgagtcggcttattcgtactgtcatagtctacgggatgttaatgatatgcccaaattgaggcagagacccatctgatgcccaaaatagagaaaatccatcaacaataaccatgatcagaatatgaatctacaagcaatcacatgaaccaacatcttaaggttccatttcccatcctggcggagtttgtttactgcaactagagccattctgacattctctgacctggatggggaatcatcatccatcttggactaaatcagatagcttgtcaatagtgccaacaagacttccaaggactttgatcagctcctttccttgccacctcctgaattctgcctggatctccccaggtcccttcaaatcactgtagctgttgcattctgtgtccccttttaaaatagcatgtacacggtctgcttgttcacgcaatttaatagccatttgctgctcctcctcattcttgctttcctgaggacctcgacaacgtctttttttcttcgaaccagtatcctttgcaacattgaaatctggatcactattatcagaatcagcaagcaattgttcctcttgagctttaacattgtcatcaacaaataaaaaaagttgtttctcaaaagatttaggaaggccaagttctaatttactatcattatctaaaaaccaataagaaatcccagattgagattcccaatctttaattctttgatattcatcaagtaataaatcccattgtcttcgacattgattcaaagatctaacaacacccaaactattacaattactagatacaagattccatttctgataagatgacatagatttca

SEQ ID NO: 15198 - DNA, 858 bp, Aquilegia formos X Aquilegia pubescens
  Predicted polypeptide sequence is orthologous to G651
tttaatatgaatatggcttatagtaagcaaagtttcaaagtgaaacatatcaatgaactttaggtttgcaacaattgagatttattctcaggaacaaaaaaaaaaaccccgaaaattcaagagctgaaagggaaaaattgctactaagaggctgtaagcagtaaaggaactgttacctctatagctcataatctttaagtccttaaagaattaatgaaatagtatccaccaccatgtctgtacactcctgcaatacctgcatcttcaaggtaactcagctacattccggttcttcagttaaagaccagtcccactgcttgctcatgctggtggttgttcccaaaccaccacgggttgaaaccaatgtgcacattagtttcttcttcaaccggagctgggagattaagatcaagaagatcgcgaatctcaggaagctgttgctgaattacaagtgtctggtttcctctagcttcagaagcctcaagcacatgagaccttttgtgcccacctaaagcttgtccagaagcaaagactttgaagcaaacagggcactcatgcttgctcttcttggatggcgacagataaatagtttcagcacaacttggaacttctctctcaattgggctttcagtactacaagacttcattagcttactttcagctttagaatcaggagaagcattgacctcaatgctggtctcaatgctctcagttttcgacgcgaaacatcctttcattctcttgtggctcgctcgatgacccccgagagcttggtaagagtgaaaggtcttgttgcacgatgtgcattcatatttgcttttgcttggggaatccatagtatcacacttcagcttctta

SEQ ID NO: 15199 - DNA, 903 bp, Aquilegia formos X Aquilegia pubescens
  Predicted polypeptide sequence is orthologous to G652, G1335
ggtaacagttaaagttatccctccaaaaatacaggcttttgagaaaagagagaaaaacaaaagatgttaaccatttcatactacattgccttgtcaggagttgaaacattttcctactaaatatcttttccttccacgatagttagccagcacttccccttcagttgaaccttctaccaccatcaccaacttccatttccaaattgacaatcccttcccaaaatgtacattgccaccacagtagtaacattcaacaaaacctccatctacgttgcttccaataccttcggagtatcagactctcagtaagtttggcaaccatcaccactggtgccacttcccgtatgagaatagttcggcacagaatatcctgtcccatgacgatcagaagaataggcactgctaccatactcgttccagccatcactacgacgttctctcccaacaatataactgcaatcgtttgctcttctaatagtactccgaggaaaggaactttcaagacatctaatattgacagccatctttattccacacaccccaattttaatctcaaactctacaacatctcctttggcgagggagctttggtaatccttggatgccaatgaaaagcgattgaagaacagcgtatcgcctcccctgtcaggagcaatggatccataactcttcttggtgttgatccacttcacaactccggtcaacctagatgcctgcatgatcgcttgataggggagtgtatttgaatcacaattcaagggctgcgaacgagtgattgctggatgcttgggaggtacatttgagaaagtagtcttatgtttatttgattctggcaaacttgctagtttttcttgcttggaacatctttgttttctccatttttcctccttgtcagatgaatgg

SEQ ID NO: 15200 - DNA, 916 bp, Aquilegia formos X Aquilegia pubescens
  Predicted polypeptide sequence is orthologous to G653
gaagatccgagataaatgtgatttaaatagctcgttgattacgcgagttcattctttctcacatttttctgggagagataataagatttattattaataagaactcccatttggatttgaaatttcttttttttcttctgtgttcccagcaccaaaagtttgcttgattaatattccaagccttctgggttccttttgtgtattcagaacattaaactctttgtcaaccaaaacaaaaggaaaaaatgtcattcactgggactttgcagaagtgtaatgcttgtgacaagactgtctatgtggttgatttattgtctgcagatggaattccctatcataagtcctgcttcaaatgcagccactgcaaaggaactcttgtgatgagcaactattcatctatggatggggtactctactgcaagactcattttgagcaactcttcaaggagacaggcagcttcactaagaattttcagagcgctccaaagactgagaatcaagagctgtcaagggctcctagcaagctctctgctatgttttctgggactcaggataagtgtgctacttgcaataaaacagcttatccattggagaaggtgactgtggagggggaatcgtaccataaatcttgtttcaggtgtgctcatgggtgggtgctttcttacaccttcatcttatgctgctttggatggaatcctctattgcaagcaccattttgctcagttgttcaaagagaagggaagctacaatcatttgctcaagttacttcaatgaggcgtaatgctgcagcagttccagaacctacaccacaaccagaaccggaaacatcaagcgaaccagtcacagaaccagcaccagaagcagaccagacacagaccagtcataagtgtggcataatcgttgccattatttcttt

SEQ ID NO: 15201 - DNA, 898 bp, Aquilegia formos X Aquilegia pubescens
  Predicted polypeptide sequence is orthologous to G653
agagttaacttgcaaacaaagagaagctgaaaaagagaaaggggaatcaagtttgcctattccccatgagataaaaaggggaatgaattgaaaacaaacaaacaacaaaaacagtcttcatcaatgaaggagcagcgaaattgtaaaaaaaaaaaaaaaaaaaacaggtattggatgataaattaatttctctggtgatagaattgaagtatcaggcatcatctggcacagtggctgcagctgcggctgtggcagtgcctggagaacgcttgatagaagcacacttgataaggtggttgtagctccctttctccttgaaaagctgggagaaatgatgtttgcaatacaaaatgccgtcaagtgctgcatagtttgaaggggatagtgagcagccaccatgagagcacttgaaacacgacttgtgataggcctggttctccacagtaaccttctccaggggatatgccgttttaccacaagtagcacacttttcttgtgttccagaaaacataccagcagctttgctaggtgaccttgtcatttgtggagttaacttctccaccgactttgctaccggtgactggaagtttttgttaaaattcccagattccttgaagagctgctcaaagtggggcctgcagtacaggacgccttccattgaggaataattgctcagctttaacgttcctttgcagtgactacacttgaaacaagccttatgataagaaactccatcagcagataactgatccatcacataaacagtcttatcacaagccttacatttctcctgagtaccgatgaacgacatagctgtccgatcggtatcttctcgatctcaacagatccaagctttcaacaaacaaactagtttcttcttctcatttctgaataataa

SEQ ID NO: 15202 - DNA, 887 bp, Aquilegia formos X Aquilegia pubescens
  Predicted polypeptide sequence is orthologous to G675
tcaattagctacttattagctagtatccaattccaagcaagaaatgggaagatctccttgttgtgatgaaaatggtcttaagaaaggaccttggacacctgaagaagatcacaagcttgttcaatacattcaaaaacatggtcatggaagctggagagctctccctaaacttgctggtcttaatagatgtgggaagagttgtagattgagatggacaaattatttgagacctgatattaagagaggaaaattctcgcaagaagaagaacaaactattcttaatcttcattccttcctaggcaacaagtggtcggcgattgcgacacaccttcctggtcggacggataatgaaattaagaacttttggaatactcatttaaagaagaagctgattcaaatgggtttcacccaatgacacatcgtccaagaaccgacatattttcaagcttatctcacctcatagctctggctaaccttaaagatgttatggaccatcacccttgggaagaacatgctgtgagactacaagcagaagctgctcaagtggctaaactgcagtacatacagtaccttcttcagtcttcttctccagtgccaactggctcaaccaatttaactggccttacagatattgaggccttcaatctgttgaattcaatgaaagaacaacagaatatttcgaacctctcatcgcagctggagagtcccaactcaggttctcttggacttgccactacacaatcctttgatagttctatttccttctctcatttgccagatttacaactacaagtcccatgcagtttccagacatctttgagtagcgactttggacaagtactaactctgtactatttagtcaagaagaagctacacctacatctcca

SEQ ID NO: 15203 - DNA, 930 bp, Aquilegia formos X Aquilegia pubescens
  Predicted polypeptide sequence is orthologous to G720
ttgcagagtaaaaccattcatgccacaagcccaaaggccctgcagaatcaacaactgcggtttttcttgtaaatttctctatggcctgaaaaaggatgcctagagcaaatcaagtatggtttgcactgctgatgatttattagggtggaaggattttccaaaaggactaaaagtccttctacttaaagaagacggcatttctgatacagaaataaaatcaaagcttgaagaaatggactatatcgtttctacacttttcaatttggatgatgctttaatggaaatttcaaacaagcctggaagcttccatgttgctattgtagaggttagcacaaacaatcaacacgaatgtttcaagtttctagaaaccgcgagagatttacccactattatgatttcaaacatccaatgtcttagcaccatgatgaaatgcatcgctgtgagtttcctgaccccgtccctcttcctatacatatggtaccaattctgatcgagttctaatacattttagcttggtgcggctgaattccttcaacaaccactgtccgaagacaaactcaggaatatatggcagcatgttgttcataaggcctttaatgctaaagaaagtgacctcaccaaatcattgaagcccatcaaagacactgtcgtatccatgcttcagctcccacgagaaacaaatgacactgaggattacaatttgttggaaacagagaattctgcccaatcccgggaatgcgagaatgagcaatcaacagtcagtgataagttcccagctccttcaaccccacagttgaaacaaggatgccgattttcagatgacaggactgccaagaccatactaacttcttggtagacaaagcacatagaggcatcgaagagaatcaaaatctgtcgatacgacttgcaactatttggttgctgaaacta

SEQ ID NO: 15204 - DNA, 972 bp, Aquilegia formos X Aquilegia pubescens
  Predicted polypeptide sequence is orthologous to G729, G730, G1040
tcttcttcttcaaactattttacatgcttcgagtaattaaattaacagttgagaagggttagttctttcgaaggttcaacatagtccatttgccagctttgccttccaagggtgaactcaaggttaggcaacatatgtgaagatgccaaagagcttacatacaacttgtcactttcattgggacacaccaccaacgggtctggcctatatacttccttggttggtttatctgacgattctttggattggaagtgaacacgagttgtttgattctccttagacaatgggctccaggcatttctttccactcctccttgctcgaacccaggagatacaggtagtggtggtcctggtggtgatggtggtggttgtagaggtagtgtttgatgaatagaatgagatggattgatatcagctttctcacaagatagtccaccttccacttcaagaacatctgtcctctgattcaaacccatttctgtctgcccttgacctggtcctttgtcagtgctcttcactgttctatacatctgtaagtgactcttcacatgagctagtgttagatccttcacattcattagttccaaaactgatttgggtgttgctctttcatgaccaccaagaagctccacagcatgaacaaaatgggcatggagtgtagtagtccatctcattcttggagctctaacacttcttttacctccattacccattctagaatttctcttaaactctttaccaaacatttgggggtgatgaagatgatgaagataatgaagattcctttgtaatgatattggtgaaggatcaaatctttccatttcaatccctaaacttaatttaggctcaactccatttcgatgataacacttctcaaggttcaataaaccttgttcatgacttatatcacttccactactacttgcagagcttctatcaccacaaatcactctcctcattgctgaatcaaaa

SEQ ID NO: 15205 - DNA, 966 bp, Aquilegia formos X Aquilegia pubescens
  Predicted polypeptide sequence is orthologous to G735
aaatcaaataaggatccaatagtccaacaaagactataaacatagactatgcagtatctttcaataaaatgttcagcatttgattgaactcaaagccatcaaaatcaataatatgataatatctttaaacttggctttgtctgttgccaccgtccattgcttggggagtttctggatcccatgctgcatcccactgtacagggccagatgaagttgttcccccccggatccgcttctgcaaatgttccaagctggccactcgaagcatagatggtgttcgccccatcttgttgctcccagtggaattctgcacttcttcaatttggggaattggagggatgtccgccaaacagttgtttgctccatgatcatttagctgattattagaagcctgctgatagaagtgttgcttaggattttcttgaactggaacagaagcatctgcagatgtgtcagatgggcttccatcgaatggcatacccatgttggatatttcagacatggcttggaagactggattgaacccagtcattctcttgacagcgtcttcagccatcttgacctttgctctcagtgtttcaacatctgctttcaaaattctattgtcaacggctgcttcagtatacttcgtatttatgtcagtgaaacgctttaataatgaagagttctcgactcttaattgtgctacctgtgtctcaagctcacttaaatgtgcttgttttcttctcctagagcgtctagctgactctctatttgacagcattctccgtacgcgtttcacatcagcaggatccatgttgtctgtaatttcggtttctccttcaaggtcttcatcatctgactgttcccttgatgatgcgctggttgttggcttgatttggccccctgactttttctgagtagcaaataatgctggaatgccaagtggtgcaacaagagtcttatctgcctcgctggagaaaccag

SEQ ID NO: 15206 - DNA, 936 bp, Aquilegia formos X Aquilegia pubescens
  Predicted polypeptide sequence is orthologous to G744
tttactttcgcaatggggacactttaatttcatacattaaaattcagttacaaatatgttctatgttacagtaaatatatgtacgtatatataccaataattgtacagtatcaaagtgggtctgctcaaccaagtgtgtatgtacctgctcataacactttctgtacacaaaacgagggcctatactttctccctgcaaacagggcaagagctacgtctgacaagccacttgtcaacacaagttaaatgaaacacgtggtggcaccgacgcaaactcctcacaatttctccgacttcaaaatcctgcaaacatattgcgcaacacgtgctgccacccaaaccttccttgttttcatctgtaatcacatgatgaggtagtttccttattgactccccagacaaacctctagatatgacttcatcataggcagcatacatcccttcgtaacttatgttggcaatgctaacctgccaatggtagtctgttaatactgtaggtacaagttgctcagtgactaaccgtccacggagaagctcttctatgaagtctgccatggatggcgagcttcgagaactagatctctctgaacaccagtatgcacgggaagcctccaagacctccacacagaggacagctccagcaacagctcccagtccagctccacgaaggacgccgctgtcagaagcgcgaccagctaatgcaccagttactgcaccagtgaaaccaccagctaaagcaaacaagcctgtaagagctccagaaagcaaagcaagaatcaatctaggaagataacaatacataaaactactactttgtccatgatgttcaaatcctccattactccactacttgtagtttgtgaaccagatgaagaagaagaagaagaaaagaagaagatctcttatactcgtattacttattctcttcgatgagat

SEQ ID NO: 15207 - DNA, 887 bp, Aquilegia formos X Aquilegia pubescens
  Predicted polypeptide sequence is orthologous to G748, G1900
cgaagatgaagtaaacgacgataacacacacattcaaagaaagaaagaaagaaagaaagaaagagagaaataaacagagcaaagcaaagctacttgcaagtagcaatttcttcgatcgaaaaacgccgattttatcggatttttgagtttcatttagatcgagagagagagagtgagtaagagagagaagcaaaaatgtcgggaactaaagacccggcgattaagttgtttgggaagacgattcctttgccttcaaacgaggagattcatggtgatagaggtggtggtgaaggtgatggtgatgttgtgatagaagaaagttctgatttttcttcaattgatgagaagaaattaaagcaagaaggagaagaattaacagaagaagatgaggacccctcaagtaaaagacccactgatattaaagtgcaagaagggtcacaaccactggtttcagaagagttggcagatgctacatcttccgggaataacgagaaccccaaaacgccctcatatgaaaatgaagtgggtgtgacaaaagatgacaggaacgaggaagaacagagtgacaccagtagctcacaagagaagagcatcctgaaaaaacctgacaagatacttccttgtccccgctgtaacagcatggacactaagttttgctactacaataactacaatgttaaccaaccacgacatttctgcaagaattgccagagatattggaccgctggtgggacaatgagaaatgtgcctgttgggggctggtcgtcgaaaaaataagaattctgtttctcattaccgacacataacagtttctgaagctcttcaagcacctcgtcctgatgctccgaatgggaattcaccaccctacagtgaaacccaacggcact

SEQ ID NO: 15208 - DNA, 903 bp, Aquilegia formos X Aquilegia pubescens
  Predicted polypeptide sequence is orthologous to G760
taaaggcagaaagcaaatgtatacttgtctatggtttccttgtccaccacatcaatcatcactgtggtaactaaaacatcctcaatcaaatgtttaggttcataaataaatactagtgtgtaagaaaagacctccacttcatggaatcatcttatctggtataaataatacttccatgtttgcagctcatggaaaggaagctcagaaaccagaagaacatcaagtagaacccactgcgcaaaatcattgctggggccttgctcgactgcgtatcgcccatccatccaaaggacagtccaatggtcaccctgtttgccaacatcttctcaccgccaataactggtgtttcacttatgtggtgtattgttgcggtaacatgaactgaactggtagagcgtgctgcagagttctgtccacaagaagcctctttcgtcggaatctcagcagcatacgcactaggagcagcgatatcacccaagatgtcatggatctgttgagcaatgctccaccgtttgtattgaacatctgcatcttctgcaacctttgcaacttctggtttttgctctgaagaggaagcaccttcgtccccaggtaattctggagattcttggagtgtagggaacgcttgcattttctcctctgtgaagattaattggtccagataaggatcttcaaaatctaaaaattctgaaggatttagagccatgaggtttgagtcagtgtcagcggcatcaaagaagttaaggtattcaccaaacatatcgcaagggttctcatcagcctccgatgcgtttagatcattaactgacagaccctgacgagcatctgagtatgtaggctccccatcaaatgggccctcggaaaggttgttatcatcagcagtattcaagagctcagacaatg

SEQ ID NO: 15209 - DNA, 920 bp, Aquilegia formos X Aquilegia pubescens
  Predicted polypeptide sequence is orthologous to G773, G1412
aaaacttatagtacaatactacaatcaaacataatttcccatgtgctacatgtgctacactgagaattttctagctttctacacctaggttgtaccaagaaaattgtagtattccttccataacattcttcaactttctaaagtgcaaacccctaaaatattccaaaaaatggctgatatttacagctataccattgaccatctttttcattgcccaaactcaaaccgcccagatacagggttggtaatgtatctaaaagcgaatggatcatacgagtctgaaaacggctgagtcaacccaaaagaatgctgctgagtcaaaaccgtgttaggtacacatttttgttctattccaccaaatccactactctctacttcttcctcttggcaaagctgtggtactactgaagagtagtaaatatcatttcctcctggccgttggatttgaatgtttgaattgaattcttgttgtaaatttcccatgctgttgctgttgttgttccaatcgaatttaccagatgaattcacattttgaatattgaatttctcatcttgttgtaatgatttgagtgaattcattcgaggtagaacgaaagaacgatcatttatttctgggagtgattcaagaacatcgtcgaagtaagaagaagaagatgatgaagatccattgctaatttctcctgttgttgtacttgaagtgggtttttgagctccagagcttttcttataaattctacacaaaacccaatcatccaatcgtgaacttccagtctttcttgttgattcagaaagtcgatattcatgcataatccaattggttttaattcctttaggagcttttccaacataaaaaaccaaagcttttttaataccaactttacgaccttcagttgttataatcttatcagttccagtagctt

SEQ ID NO: 15210 - DNA, 965 bp, Aquilegia formos X Aquilegia pubescens
  Predicted polypeptide sequence is orthologous to G782
ctattatgttggaaataaatagactatgataacggcatcattgtctgttgttggtaaaatgtaaagatgtattacattaaatgactagcataaatctggttagatcaattatgaacttctctccaatacagaacaaactaaaatacatcttgatgaagatgttctatctcataggatgcatacatcgctctacccactactttacaggagaggaagcccaatcatgtttggaattcatctggaacgatctcaatatagcacaagtacactgtatcaggttggaagaaaacctgatggttctttaattgttaacctttggaccacctacactgctggaagagctgtcctgtagaccttgagatgaacacctgctagagcagctctgctctgctgcactggtttgcttctgtgactgtttttctttcctctcttctgatgataattcctgctctgcagtagatccaggagtcttcagttccaagtcagttgctacatcattggagccaacgtttccttcagtatggcttcctttatgaggatccgatgacttacttttgtggtcttgtttgctcaaagtgtgggacctactgcttgcctgctgatgtggagatgcataataagtgcatggtcgttccatctggggattaccaggagcagaataaggtataaaagtcgaacaagggtttggaatggccccagggttttgagaaggaaaaaaagggaatggttgcatagatggatgcatgggaatcggagctgtaggaacaggaacaggcatggcaaaaggatatgaaggtggtcccatcataactgcaggatccatagcagaccacgggaacattaccctgagtctttgctggtactgtacattaagattgtcgatatctgattttattgaggccttctcttccctaagctcgttcttctcctgtgtcaactctcgagattcttctgacagtgttgca

SEQ ID NO: 15211 - DNA, 935 bp, Aquilegia formos X Aquilegia pubescens
  Predicted polypeptide sequence is orthologous to G783
ttcaattcagttttaaaggaagtgggattgattttgttttgtgtatgaaattgaatcttggagtatatgaaataaggcataaactaacatggtttcagaaatttctactcagttggttaatgatgttaatgttggtgcagataaattgattggacatggaaggtctttttccaataaaaagaagcatgtaaaagttccaaagaaaatccacaaggctgaaagggagaaactaaaacgcgactatttgaatgagctctttcttgagctagacaatgctcttgagccaaatcggcagaacaatgggaaggcttcaatattgggtgatgctactagattactacgggaattgctttctcaggttgaaactctcaaaagggagaatgtggctctggtgtccgaatctcactatgtcactgttgagaaaaatgaattgaaagatgagaatgctgttcttgaagctcagattgaggaattacatactcaattaaaagaaaagtctccaaatgacctgacttggaatccagctactaccaaatcacagaatgccaacctgacatcgtcattatttcaggaccctttgaagttgcctgtagcagaccctacattgcaggcaccacctgttgttggtcctgtccttgttatccccctccatcatgactttcaagcacttccacaacctgaaactgcacaagttcctttaaaagctccatcaaatgtaaaaagacctcatgctcggtatcccactccatcagattcatggccttcccatctccttggagagcagcctaaacgaacagatgaaaagtagcttgggtaggagtagcactggcaatgggaaagagtaatcacaggctatgcgtaagcatgtatttgtctagaaaatttgagaactgtcatgttcagcagttatatagtgtttgaatgatccctatcaa

SEQ ID NO: 15212 - DNA, 894 bp, Aquilegia formos X Aquilegia pubescens
  Predicted polypeptide sequence is orthologous to G789, G1494
gagctgttatggcgtaatgggcaggtggttcagcaaagccaagcacaacacataggaaaccaggtgcggtgcataacgaactaggacataaaaagaagcctgatcatcctgctagggatgttgattccttcatgaatttgagcaatttgattgaagaagatgagactgaatcatggatccaatatccgcttgatgattcattgagtggggacttttgtgctagtttcttttacgacttggcaaactcccatccaattgagaaggagaagacaatcaagcattttggaacttcagaggaatccaatgttctcaccaccaatagtgttttgaaatcacagcaacatatgtttagacagcctaataatataagttttgccgagaattctacccagcaagatccttttggaagacttgaacggattgaaaattttcctcatttttcaaggccaatcaaggccgaaataggtacatcaaatgtgccgctcagagggacagaatcaggcttgatgactggaggagacgtcggtgaatcctcagtgatgacaattgggtcaagtcactgtggcagtaaccaaatgacaaatgaggctgatcgaagtaatgcagttggttcaacaggcatgtgtggaggccccaataaggatactagtcgaaaggtggttccccagtgtgagagagggctcacagagactcttgaaaccactatcacttcatcctctggtggatctggggggagttacatagggacagacaaacaatcaactagcacccagaggcacaaaagaaagggcgagatgctgatgaatctgagtgccaaagtgaggatgcgagtttgagtctgcagagcaatagatactcaacgatcacgtctacccgcagagtcgtgcagctgag

SEQ ID NO: 15213 - DNA, 942 bp, Aquilegia formos X Aquilegia pubescens
  Predicted polypeptide sequence is orthologous to G791
cccattttcataatatcatggtagaggtggttccaaaagatgtcaatctccaataactaatgttacaagctttgcttattagcatttacaagtgaacattgcaaacaaacaatcaaatggaagttcctgggtcacaaaataaccatctaatccagtctttagtttaacaatcaacagagtcatgaacaataacaaaaaacaatagatgatcaatagaaagccatactaaatcactgaagcgtgccaatttaggcaactgggggccgaagcacatgatcctgtgaagtatcaactgcggcaggtggcatgaattgccacattgcaactccagggtagccgacaaatggcatgagcttgttgccaggtacttgaccatgtgcagcatatgcggctgggatagcagaagggtggggtaggaagctaggttgagaactcattgctttcacttgctgttccagcttctctttctctgctttcagcctttgcttctcatcacgaagctcattcttctcagacttcaactccttaatcttctcctgaagatcctcatttgagtccttcagcttctgggattcactgcgcaactgggtgaccatccggacagcatcactaagtatagcagccttgtccattttaggtggtcttccaggctctaagatagagcccagttcaagaaacctttcatttagcctatcccttcgcattttctctctacaagctttagacccagaggctccacatgcttcagacctcccccgcttttttgagccagtttccttgaggccttccgcatccacaaaggagctatcaatttccacacttacaccattagaagtattcaaaggttgagcagaccactgaaacgcagaaaccggagtcggaaattcagcaataggaactgaaatttcatcaatcaaaccataatccataaccaatcgagtt

SEQ ID NO: 15214 - DNA, 868 bp, Aquilegia formos X Aquilegia pubescens
  Predicted polypeptide sequence is orthologous to G801
ctctctctctcaggttacaaaaatacgttcacacggcggcggcggagaagaggagagagaaaaaaataaataaaaagacatcctcaaccccagcacagcatgtccaacaataataataataataataatacagatggcgttactaacggagttaataacggcggaggagcacttatggactccaccactcaaagacaacaacagagtaacggcgtcggcggcgcattagcagttaaaaaacctccatcaaaagaccgtcacagtaaagttgacggacgtggacgtcgtattcgtatgccgatcatctgtgcagctagagtatttcagttgactcgagaacttggtcataaatccgacggtcagactattgaatggcttcttcgtcaagctgagccatcaattattgccgccactggtactggtaccactccagctagtttctctgccgtttctttatctgttagaggttcatctagtccatctatttcagcttctcttgatcacaaaccagcttctcataataataataataataataattctcctaccgctattacccctactatgttgggtgccactcctttcttacttggcaaacgtcttcgttccgacgatgactccgatgaaggtgctgccgttgcagcttctgcagctgcagctgccaatggtttttgggctttacctgctcgagctgattttggccaagtttggagttttgctgctgcacctgaaatggttgttcctatgcctacagtggcttcacaacaacaacagcaacagcaacaatctatggcagcaagatttggacaccaacaacagtctatggggagaaggttcagctgcacgtcttggcaactattttcctatt

SEQ ID NO: 15215 - DNA, 905 bp, Aquilegia formos X Aquilegia pubescens
  Predicted polypeptide sequence is orthologous to G805
ctctcaaatcctacagctttccttctaaagttctaactccacacaaaattgagtaaaacatacatgaagaaatcaaaccacagtgtttttttgttttcataagtgacattcactttcatatattcaatctaaaaccaaaagaagaagaaaaaggaagaacttcaagcccaaatgacttatcaaatgaactactaattaattaagaatgatgattatttgtatcatgcccttcattcccaccatggtgggaatgtgacccacttgcctgaggctcatgatcatcagaagatccagctccggcacctggaaatggtcgataagcgtttagagctgcaagcattcccaaatgaccctcatttgtaccaccaccaccaccattgccaccaccaataccaccaacacccaattgttgactagataaaagagccataggtgttggaaaattcataaaatgtagtccacttgacatagaccctctatacatattaggattagtaactgatggaaatgtccatattggatcaccactcataacaccacctccttggttattatggtttggattaaccatccaaaatgttgctggaagttgagtattatgacttgctggtattgaactagaacttgattgtaccaagtaattaccaatttgatgttgttgagctgatgtttcttgttcttgttcatgtcgacgttttctccctatagtacttgcttctgatgaatccaacatatctagacatgatggttcagtagaacttgattcctgcttagtttgtaacatattgtttaaagtattggaatgaaaattgaatggcatagaagaagggttgttattgtctgatgaatataatatacgatgttgtgattcatcgatgatgtttcgttcccattcacttcttctt

SEQ ID NO: 15216 - DNA, 759 bp, Aquilegia formos X Aquilegia pubescens
  Predicted polypeptide sequence is orthologous to G831, G1202
tctttaaaggttggaacagaactaaagaagatactacaggccgagcaagcaacaattgaatcgacagcaaagagtttatgctggaagaagtttattgagaagggtgatatagcaatttggcagaaacccactaatcacattcattgcaaaattaataggaagattatcagaaatccaccattctgtcaaaatcaagatcccgacaaggcatggtatactaatttggagacatgcttaactccactgccaaatgcatttgacataaaagaaactgctggaggggaattggcgaaatggcctgagagattgacagcaaccccacctagaattctaagtagaagtgttgaggggattacagagaatacgttcaaggaagatatgaagctatgggagaagagagtagcctattataagtctgtaaacaatcaattaggacaaaaagtttatcgcaacgtgctagacatgaatgcgcatttaggaggatttgcagctgcactgtccaatcagccattgtgggtcatgaatgttgtcccgactgaagcaaagctcaataccctgggagtcatatatgaacgtggactgattggaacataccaaaactggtgtgaggctatgtctacttatcctcgaacatatgattttatacacgctgattcagtgtttagtctctatgacaacagatgtgaaatggaagatattctgttggaaatggacagaatattgagacctgaagcgcagtaatctttagagatgatgtag

SEQ ID NO: 15217 - DNA, 921 bp, Aquilegia formos X Aquilegia pubescens
  Predicted polypeptide sequence is orthologous to G849
atattaaacaaggccattaaacattacactaaaatttaccagagaataatacaacagaattgatctgatcaactttctctattgttttatctaacaaatttgcatggaagaatcaatttgaatcaaattaaaatggaatcaaaagaacagatatgcctgatgtgtggcgtgagaccaatagcttatggatgctcttattccttcgtcatttacaaatgccaaccccagcctgaggaaagaaaacctggctaaaaatcatggtaagtgtgagaatattacaccaacttttttttttttttttttcttgtcattatttttttcttttttcatccttttccttttccttgttactttttacataataagatcagtgatgttgctatcttcaagtccagctcacccgaaaaaagtctaggtgagaaggcacatctcggtctgcggcttgacctgttgcttggcttgctgttgagaccagtaagcgtgagcagctaaaaccctgtccaaaagctcctgaggaacgggctcaccccttctctgttgaggagagatccttgccgtatgtaccaatgttttccatttatccttcaagtccacgtatgtccgatgctttgcattatcaaatgcacgtaacttaacatcacgccatcttccagttccaagcttttctacagcctgaacaagtgcttctacttcagaaacagagaagggcctcctaatccggcgttgagcaagttccgtacgcctagattttcggttcaaaggaaccacagccaatgcctccacgctcattgctggaacagcaatcagggctcgtgaatcagatggtgttttatctattgacatgccagtgggagtgggaactgaatcgtgatcgctctccatataattagtcaaattatttgttgtgaggttgagggaagc

SEQ ID NO: 15218 - DNA, 796 bp, Aquilegia formos X Aquilegia pubescens
  Predicted polypeptide sequence is orthologous to G852
ctacctaacaaaccccacaatctataattttctagtattaaagattcataaaaattgtcaactttctttgattttttgtgtttgttatcttgtatgttaatggtcaaagtctaataatcttcatcctttgctctctaaaactaaaagtcatcttttaggttttctttcacttgggtatctttcaatttgcagaatagctctcaaagggatatatgatctatcttcactggtttctctctatgtttgccttttctatcagtttctgcagtataaggttcacataacaaaaatttggggtgcagtggatggtgttaatagtttctatatctcaagggacctaaataagatttgcttatacgagcatctaccctcaacaacgagtaaggcaatagactacaatgtctttgatcagttcagcagatctatctgccacctcatatggtgagcctaaactctacaagctcaaaaaaggcaatgaaaactctggactatccactcaaattatcagctcagataaacggattttcaagtatggacctgaatcaaactgccgtgagagttacaaccaacattacttctctgattcctccacagaagatttcccttcatcaaggatggagtttatctccccatctatttctggaagtccaggagctatattccgtcctcaaggttctgcttcataccagttgatcgctggctctgattctatcagctcaggtaactcatatagctcttttgtgtcaacaagacatcccaatgcctatcgacccgattctgccgcaaaatactttga

SEQ ID NO: 15219 - DNA, 976 bp, Aquilegia formos X Aquilegia pubescens
  Predicted polypeptide sequence is orthologous to G852, G2633
ttcgccatcaactgaggcatttatgtaactctatgaactgaggtgggaatttgttgtaagctagaagaatattctaaacaaggatacagcagttccaaaacaatgatacataaaaaccatgaaccctagcaattaaaaaaaaaatctagattacttaaacctacattcatgaggcccaccaagtttactattgagtacttaaaaacctatcgttgtactttctcaatgccaggcagaagccgaaaccaagtttctatccttccagcccaacaacatggcaccgtccttctccactagcgtgtagtgttctgagtaacatctgagcagaccccggatgacatggttgacatgagaactcaatgggaatggctggaaccctgccattgtgaacctggatttccactttcctagcaattcatgtctctccaccctctcttttccctcacaagctatgacatttaccatgtccctagccaggcactgctgctcaacactgatccgctccttgctgtccctcggcatggtcacatcaattgactcaaacatagctgagtagaaatccaaagcctcagcaaatcttgtcacaaaaggtgtggtgttagtatttgattcctgttcaataagagtgaccaccttgggtgacaatgacctgatcattctcagcatctcatctcgtggattattcacatcaatgctctcatctggggtatggtggagctgcagtgggaagttcacagccaaagcctccccaggcctaacatcaagcatttcacgtgttacatccgatgcaaaagctggcactgcgtgaaattcgattggaatgttgaacttcttggacatggctgctaacctctctcctactgcctgcaaactgcctccacgagcgtacttagatactgggtcatctatcccagtgatgcgcataaatggtggaccacttgttcttgcagctaatgcttctatcagagtcatccac

SEQ ID NO: 15220 - DNA, 875 bp, Aquilegia formos X Aquilegia pubescens
  Predicted polypeptide sequence is orthologous to G852, G2633
caagttccaagttcctaactgatagttgcagctcactagaagttgaaaataattggtctgactttaaggaaaaggatgatggattaacaaattcattgtgatcaaggccttcgaattaaaataattcaactgaatgttacagaagttgcgaaccatttaaacattgctagctccagtgcagttctcagttttggtcagagggtgtgtctgtagcaaagttataatggcattattctggcttctcagtgacattcttgcttgaacaagtaaaatagccttcaatgcaatcttctaggaatccggaggaattgggtgggcctcacaatttgtattatcatcatatgcaagggggatcctattgcttgccttcaaattaccagactctagaccacagcctatcatctgatgactgcagccaggtgacccgttatggcagtcagagttctcatgaaaattactgcactttagaatcatcctcatcgtctagtagttacacagtttatcactccccatctaccattagtgtctcatctaatgggagccctccctcacaaaaagactctcagtcgtacccatcagacccatatcactccccagataatattcacggatctccaataagtgcgtcctgcatcacagatgatgttgatgatctgagaaataagctaagagagttagaaactatgatgctggggcctgattcagatattgtggacagcttagatagcactttccagaatgagaataaccaatcctcatctgaaccagagcagtggaaacaaatgatggaagttatcccaagaggggacttgaaacaggtgatcattgcctgtggaaaagctgtatctgatggtgatgtgatggctgcacttggt

SEQ ID NO: 15221 - DNA, 949 bp, Aquilegia formos X Aquilegia pubescens
  Predicted polypeptide sequence is orthologous to G852, G2633
aactactgcaatcttcaaacaacatccagtccctgttgccaaataactggttcaacatggtaggaaatcagtagttcttgcttatatcaaagaaactctaggaaaatcactccaacacaatcctgtgcaccctgcgatgcacaatatatatatatatatatatatttacatattttattttgtaaaacaatactaaaaattaagagaaacaggttcactccataatcatttatcgccaggccgatgcaacaatcaagatcttctcttcccaaccgaagtgcagtgcacccccctcttctttcactttgtacctgtcacagtactgtttaaggagtgctctgattgtgccatttacgtgtgtactcaatggatatggtttaaaacctgccattgtcatcctcgccctccatttcccagctacctcgtacctttctattctatcttcaccttcacatgctacaatgttgacgatgtctcgtgccaggcactgtctctcaacattcatccggtctgggcttcccctgggcaaagttgcatccaatgactcaaacacagcagagtagtagttataagcttccacaaaccttgggaggaatggggcagtgtttgtattgacgtcctgttcaaccacagtaaccagcttaggttttaggctcttgaccattcggaggagttgatctctttggttcactgttgaaacactctcatctggcatgtgatgaagctgaaatgcaaagttgacaactagcgcttcattgggtcggcactccagcattgatggggtgacatcctctgttttgacagctaaagcacaaaactcaaacggcactccaaaccctcagcgagcttctctagccgctgcccaatgactttcagacacaacagtacgttgcactgtctcaggtcatcgactcagtatctatgtgggaggctactgtcgagatgcaga

SEQ ID NO: 15222 - DNA, 953 bp, Aquilegia formos X Aquilegia pubescens
  Predicted polypeptide sequence is orthologous to G852, G2633
aaattgctgagtacatgagacatggtcattgaacaaaggtttaaaaaaaatattttatatgaaatctttgagaaaatcacctgtggcacgtgccccagttaacttacatgtagctccgccactgttgctctcctcaaatcttcttcttactttctcaagtgtctatcacaagtttgacttttgctggaaatttgttatgtaaggtcgacttctccaggactttcaaggacgccaagggcaaaattttatccattcctccagtagtcaaagtgacaaccagcaacgtttctcatctccaagcacaagaggtgactaaagctcggttcatccatccaagatagagagccccatctttttcttccagtctatacttctctgaataattctccaacagatttctgatggttgcattgaccaccgagctcaacgggtatggagtaaatccggccattctgaaacgggctttccactttccaagaacctcatgccgctccactctctctgcaccctcacatgctatgatattaaccacttcccgggccaagcagtgctgctcaacattaattctttccttgtgttctctcggaaggcgcacatcaattgactcaaatacagctgaataataattcagtgtttcgaggaatcgtgggaagaatgctgcggtattggtattagattcttgctctacaagtgtcaccaccttgggagacaagctcttgaccaatctcaacagtcgatccctgtggttagcagtgcttacactttcatctggcatgtgatgcaacatcaacgcaaaattaacagccagagcctcaccaggtctaacaccgagagtttcgagctcaacctcacagccagacatggccccagcatggaactcaaaaggcactttgaaggactcagcaagctttgatagtctctgccccacaatatgaagccctccatcacgggca

SEQ ID NO: 15223 - DNA, 960 bp, Aquilegia formos X Aquilegia pubescens
  Predicted polypeptide sequence is orthologous to G852, G2633
atatatatggttttggaatatacacaatcttaccaactgattgttttacgtagaaataaaaccaaaagctacatttaaactactacaattacctcagatcagtgcctatggagaccacaagacaaacattatttagggacacaatcttcatatccaggcagaagaggaaaccaaagctttgtttttccagccaagatagagagccccgttcctctcctcaagtctatagtactcgcagtaattctccaacagatccttgatcgtggaatttaccacagagctcaatgggtatggcgtgaacccagccattgcgaaccttaccctccacttcccaagaagctcatgtcgctccaccctttcaggcccctcacaggcaatgatattaacaatatcgcgtgcgagacagtgctgttcaacattgatccgctccttgtgctcccttgggaggtcacatctatagactcaaacattgatgtataatagctgagcgtctcaataaatcgctgtaagaaaggtgctgtattggtgttggattcttgctctaccagggttactaccttgggtcctaaactcttgaccaatctcagcaatcgatcacggtggttttctgtgctcacactttcatctggcatgtggtggagcatgaaagggaaattcacagcaatagtttccccacgccgaatcgcaagatttcctagttgaactgcacaaccagacatagcagcagcattgaactcaaagggcacattacatgattcagcaagctttgatagcctttgccccactatgttgagtcctccacctcgagcataagcagattgagaatcatcaataccagtaatccggacataggggccccaccagggcgagcacaagagcctggatagagacaccactggctgccctgtgcatctggaaatcaattatgtgaattctgctttcgtccttcacagcctctgc

SEQ ID NO: 15224 - DNA, 946 bp, Aquilegia formos X Aquilegia pubescens
  Predicted polypeptide sequence is orthologous to G861, G1140
gagaaatacagatagaaagagtctttgtcttgctatataaagtagttttcttcattaaattcaacacttttgaaccacttcttactccattctcattggtgtgttttcagagcttttgattcgtcagcaactatcacccaatcagtttggtaacaaaagcaataacatccaatagacaaatacccatctctctctattagggtttggtgttggtcactaaatttggaaaaatgccgctcattttggggcttttttggttgatttattgaacacaccaaaatatctgttgggtttagaaagataagtttcttaattagtgatatattggtttggtttggttctggtttttgttctttgtgcaaagagggtttttattgattttggaaagtggaattttgattttggacaagatggtgagggaaaaaatccagaccaagaagattgacaatactactgcaagacaagtgactttttctaagagaagaagagggttattaaagaaagctcatgaactttctattctttgtgatgctgaagttgctctcatcatcttctctgctactggcaagctttttgagtattctagctcaagtatgggtgagattcttgaaaggcaaagtttgcactcaaagaaccttcaaaagcttgaccaaccatctcttgagttgcagctagagaataacaactatgctagattgagcaaggaaattgccgagaagagccatcaattaaggcaaatgagggggagaagagctgcgagaattaaatattgaagagctgcaacagttagaaaaatcacttgaaacaggcctgagtcgtgtgcttgaaactaagagtgataaaataatgaaagaaatcagtactcttcatacaaagggaatgctactgatggaagagaatgaacgattagaaaacaagtggtagatatgtccagtgaacaaggaaa

SEQ ID NO: 15225 - DNA, 892 bp, Aquilegia formos X Aquilegia pubescens
  Predicted polypeptide sequence is orthologous to G865
aacataaaatagaaagaatgtcgcaactaacacttccataaaggctaaacccacacatatattgataaagaaataaattggaagagagtaataacccttaactcatacaatgatcaccagccaaataaacttgcatgacttccttgtgcttgacatcttgatatattactctcttgggtgtcttctattcttatttgatctgccctgctcagaatgtttaggactagaagaagctcccccagaccttagatactgttgttgttgagatgtttctgaagacatcgatgaaggtgacaacattgttgaagaagttggtggtgaaagaaactgttgttgattataaaaaattggcgtcccatactgctggaaatcttcattattacttctaagaagttgtgcatattgaagaaggtctggatatgcatcttgagagagaggttgatgaggtggtggaacaactgggtggggtgcaccctccatgacagtactgtttgtctcttgagcgcctgtgtagtatctcagctcagttctcccttgaactctttcagggaaattaagtttggctttggttcctttgaatctgagagcagcatcatcataagctatggctgcagcctcggctgtatcgaatgtgccaagccagactcgagctgccttcttcgggtcacgaatctcagctgcccatttgccccatggtctctgccttacacctctataatgtcttctcgtttgggccccttggtcttgaacctgttgtgatggatcattttgcattaagacaggatggacatttgaagggttgtcttgacctgtgccaatgacatgagaaagtgcggataccatggcattcatgtcttgctcagaacgaggggaggcaccatacccttctgtg

SEQ ID NO: 15226 - DNA, 918 bp, Aquilegia formos X Aquilegia pubescens
  Predicted polypeptide sequence is orthologous to G866, G883
atatacacatcacatcacatcagcttcagacttcagtagaactttaatctaggcatctagcggttacaaataattctaacaaaaaaattaattaaataaaacattttattatttagatttctctcttcttcttcttctcaattgatgaggaatcaagaaccatcccaacttttccaactgtatctaatgcttgtggatgacggtgttcaccttcataagttactatcagcatcgttggatcatcttgtgctctttcaacatgttttcttgctggacatcctctcattgtactgcacttataataacctcgtgggaaaggtgatcccttgataggtttttgaccatattttctccatgaatattcatctgcaggaatatcagccatctttgaactaattgctggaactctaattgtatttttcacacgagatttccttcttttagagcaatgacaacggcttcctgaaacagtgtatttagcagagaggtcattttcatggcaccttttccggcaagatgaaccaagaggtggttttccggcagacatcgtcggagccggaggtgcaaacagaggttttccgttagagacagtaccttctccagtaattgaagacataaaagaagaactaccagaagtagagatcggaggtgatatagtactataactatttttactaaactgacttgttgaaacttcactcaaattaggactagatgagttaactagatttggtttagtgaaatcaaaagtaacattttgctgttgttgttgtgattgaggatgaaagaagattttttgttgttgttgttgttgaaggtggtggtggtgttgttgtgtttgtggttttggagttggtgttagagataagatttgcggaatttcagaagtagattgaggtgaagatgatgatgaaggag

SEQ ID NO: 15227 - DNA, 885 bp, Aquilegia formos X Aquilegia pubescens
  Predicted polypeptide sequence is orthologous to G878, G884
acccttgttacatgtatgacttaatcacaaacaacataagctaacttagattacagagcaaaaccatcaggtattaaataagacaactgattttcctcatcggttttgtttatcctcttgattgccgcagaacgaaaagcttcaaaaggaacccataacctaaataatatggcacagatatagaaaacaaatttacacattttgcctgctatgcttgaaattttacatttcacaccagctaaaatgcagaaactaagtgacctgttcctctttaaatctctgaagagatacagcctgttgatcaccgcctccaaaatccatattcttatttatcaaggtatgcttcacacctacagcattttgtggttttatctgtgataaattactgtgggctgtattatgactactgtttttagctgcaggtacatcgtgattgtgttttccctcgtatgtggtaatcacagctttggcgtctgtcgaagctctttcaacatgcttacgaacattacatccttgactagtgcatttgtaatagctccttggatgaggattccctttaacaactttttgcccatacttccgccacctatagccatcatccaaaagatcaacctcacttgttgtctgcacaataatccttggttctgttactgccctgtgggaagaagccggctcagataccctgacccctgtatttcttcttttgggatcaggttgaccttcatcctctgcatctactctggtttcagcatcacccacttcctcaccatcgcttgagccagataactgttcttgtgttgcttggcttgattcctgatccctcctggactttgaaagagcagctgcagtttcatttgatctgcccaaattcccactatgatcctg

SEQ ID NO: 15228 - DNA, 883 bp, Aquilegia formos X Aquilegia pubescens
  Predicted polypeptide sequence is orthologous to G896
agggtttcttatcaaccacatagcggcatagcctaccaatgtagtgtttccagtaaaacaatctggataagtaaatgctgaacaccagcttctaatcaccacgggcgtctatacctccacccagacaaatagaaaataaacaataattcgcacaaaccacaaaagctcatccaaataaagatatacagaagaataaaggtgaagcttctcatatgagcaccttgtcactgtacaaataaggctgaaataagctctgggaaaaaaggttgttgctggtaaaaatattattatagggaaaacggctttgtgtagacatcaaatggttcacatgctgttaactgtggctcctgtctcaaacccccaccgctgcctcctgtcaaaagcatggtcaaaagtgaattcacaggaccaccacctccaacttcatttcctgtattacggatggtagttcgcatagcattcagtatgctcccatatgtagccccctgtccatgctcaaatgcttggataaaacagaacgtcatggcacctgttgaagtgatctttgatagagccgaggtatcagcagaagtttgatcatcatcacaaccactgaatgaaatagcttccccaccgtttgttcctttccacacacccgatcgagggcgatggtcctcccagacatagtgtccactcctgttcattctgcagagaaaaggtaaatctaatatagtgccactgtgacaagcatctattattgcgtgaagtttgaccccacgaggaagaggtttgacaattgttgtattaatctcgtcatcaacaatcattccctgagtttcaaagtccaaaggacacagagtttcgtcatatccatccacctcatcaccattataatttctctgcc

SEQ ID NO: 15229 - DNA, 902 bp, Aquilegia formos X Aquilegia pubescens
  Predicted polypeptide sequence is orthologous to G896
tcacagaatgtcatgttcttattatttagcatagcgttatggtaatattattacaaaatgaattgtttcttgtaaatgtcaaacatttccgaagatgacagttgagtttcctgggacaggccattgaagagaactttctttaagaaggatgagatggggccattgcaacgtattcctgcattagcctcgcgtattgcaactcgcatagcaataagcaaagaaccatatgtgagtccaggagagctttgtgctgcttggatgaaactgtaggtcattgcacctgtcatagtgttgcctgagagtgctgatgtatctgcagaagtctgatgatcatcacaagcactaaaagacagggccagaccaccacttgtacctttataagtgcctgatcgagggatgtgattctcccacgagtaatagccatttttgttcatcctgcacagataaggaagatcaagaattgttccactgtggcatgcatccatgatggcatgaagtgttgtccctttcggaagaggcctaactatagtagcattgatctcatcatcaaggatcatcccctcagtctcataatcaagtggacatagagtctcatcgaaaccgtcaatttcatcaccattaatatttggttgttgtgagccatggccggagtaatggaacaccaatgagtcccctggttggcagccttgaactagccacttcaatgcatttcgaatgttttgtctcgtgggaattcgataggggtctcgctcattctctgtaagtatgagtatggagtcatgaggaaaaccaagcttctccacaagaaagtatctcatgcagttaacgtcatttatgctccccttgagttcatatctcttggatctataacacaatccgcacagaagagctctcctcttccc

SEQ ID NO: 15230 - DNA, 928 bp, Aquilegia formos X Aquilegia pubescens
  Predicted polypeptide sequence is orthologous to G898
ataatgtctcgatcaattttgttaaattagggaacattcatgttcaatacaaaaactgaacaggatgagatgagaacaaaatggggcagttttcattaagtccactaacaataaaagacaaccatttcttttctaagtataacagaccaagggtcaatccaatcaactggtggtgggaaggtagaccctgattatgtctttcattgtgagctttcgcctgcaagtagggcatttattctgtgcacttatcgctgccttgatacacttcttacagaatatgtgaccacattttgttgatgcctcctcaaccaaagggcccatgcaaacagggcaactgaaggtgggctcttttggtggcttgatgactgtctcttgagacttagtcacagtttctttctttgcattgctgttgctttctaaatctatgtaatgctcacagtcgataactgtctgatttggtggaactcttctccgcatgttgtagctgttcagagatagcctagtgatatcttcctctgagtttcctggatgagaccgtgaaacttgattacgcactagagatacattatggctccttctgctcttcttcctagcttcagcaaattgggttggagatgatattacaacttcatcatcaattgcctcaacatctattgtggcaggaatttgagaacccgatcctccagtattggtgccttcacgcccttgtggtgtttgagaacctgaccctccactaccacttcctcctccacgaccttggacaactgtatgagttggctgtggagtattctcctccaaagtctcacctggaggaacattgagatccactagtagcaacttcctcctcctgttataccctctcagtggacgagtcacctctggcgtgctcatgatattcaatttctagcttagattctactcccagacc

SEQ ID NO: 15231 - DNA, 916 bp, Aquilegia formos X Aquilegia pubescens
  Predicted polypeptide sequence is orthologous to G921
cattgtttgtaatattcaatcaatttatatacaaaggttttgaaaaactctgtatgtcctagtttctgaacctttactgaattacaaaatgggtgtctttgcattcccatggttctaaaacaaaacaaaacaaaatacaattaattggatgtctctttgtcagataggaacaatttgtcaccatttttcggccggtgaagtttgaagaattcttcctgaaatggctgctgcaagtgctgctttgaaactaggatcttttgataaggaagacgccatttgttcaaccaaaaattgtttgtatgctggtgactgatctatttcttgagtagtaggtttcttggtttcatgacttaatccaggttgagtaagatcaagtgttatggaagggcctgacgatccaaccgaagcagaacaaggaatggatttaagtgttacacccaaagttgcctcggcttgagaaggatgtgggtggttgtgttcaccctcgtatgtcgctacaaggatagatcgatcttctacgcttctttgcaccttctttttgacagggcagctgggggcaaaagagcacttgaaataagctctaggacatggattatctcttgtgactttctgaccatatttcctccattggtatccatctttaaatatctgtgattcgataacagggttgttcagtatcagcttattatagaattatatacaacagtactacatgtagtatatatgatgaggtataacttaaaatgagatgtgtgaaagaacttacaagctggtctcagatggatcggtccttatataggctttcgatgtttgcgatttgtgttcaattcttggtttcttacttgactcttcatcactagagctactttccatgctaccatcactctatgagattgctattatcctcactgtcagc

SEQ ID NO: 15232 - DNA, 960 bp, Aquilegia formos X Aquilegia pubescens
  Predicted polypeptide sequence is orthologous to G926, G2632
ggactttgttttcttgttcttctgatctcttctctctcatctcatctcatctcatgtctgtttgaaagatttgtccttcaatttggcttcaacacctgttaagtacacatatgaggtttaggtgttgatggttaagcaattaagttggaatcatgtgttcaaatcctgaaacaacaaatccagttgaagttgatcatagtaatagtaattctcaaccttggtggaaaagtaaggggtataatgctgcgccttcacttgaattaggtgatcctgcatcgaaaacttcacttgaatcatcaccggatagttgcatggtgacaaaagagggaaaaacgcaaggtgatggtggtttaaatggcagtgatactgtttgcaaagacgttgtaacttcggccttgccacagtcagggttggagggaaatcagggccctggacaccggcatctacagcagcttgcatctattgcacctccaacaggggttgaatacctagtctcacagactcagcctgaacttgttggccactcaattgcttgtgcagcatatccatatcctgatccatattatggggggttgttgactgcctatggagccccaactctggtaaatcctcaattacttggaatgcaccatactagaatgccgttgcctctcgaaatggcagaggatcctgtgtatgtcaacccgaagcagtataatggaataatgaggcgaagacagtcacgagccaaagccgagatcgaaaggaaactaattaaagttaggaagccgtatcttcatgaatctcggcaccaacatgctctgagaaggcaaaggggttgtggaggtcgttttgtcaacacaaagaagcgtaatgatggaacacagcaaacacccgaaaatggcacaggatctgcttctgtggctccaaatacaaagccatcaactccaccagggttctgcagtgaccaatcagtttact

SEQ ID NO: 15233 - DNA, 977 bp, Aquilegia formos X Aquilegia pubescens
  Predicted polypeptide sequence is orthologous to G929, G2344
gtcgtggtagagaaaagagaaatctcacttcgaagaagtagttgcagaaatcgattcgagaggtgtaacacatttttgagctcgggagaagtgtttgaaggtctatgtattactgtgcatgttttaaatgggtatttcggtagcagcatgatgtgggatatcagctacagttattcaaactgagttttttgtatcagatatacctagattccgctgcttcttgttctggacttctgatagcagtaggatagatttgctgtttagtcatagccatgtcgtcatctgttgaggattactcatccaattctgataatagtcgagctgatggacagcaccagcattctgaatcacaaactcaatctcaatcccaatccccagccagtggaactgttcactctaacctggcaccattctcggctgaatatatgatgcctcctcatcttgaagttggccatgctgtggtaaggctttaaaaggcaccgccagcttatccctatccagacccttactacaggagcattttcaatccctatggtgcacaacccatgattcaccctcacttgatggggatccaagccgcagttccattgccatcagatgctgtggaagaaccagtgtatgtcaacgcaaagcaatatcatggtatcctacgacgccgtcagtctcgtgctaaagcagaatcagaaaataaaatgctcaagtgtcgtaaagtgcggacttgctcaacccccgaatctcaaaatatcaagccttacctgcatgaatctcgacatttgcacgcattgagaagagctagggggtgtggggggtcggtttcttaatgtaaagccagatgagaatgaagagaacaactcagcctcgcatgatagcacacagcgtgatactggagattctaataaacaaaattcttcctctgagaaatcatcctgaatccttagtagagattgtcatactaggacacagaagtaatgcagacc

SEQ ID NO: 15234 - DNA, 901 bp, Aquilegia formos X Aquilegia pubescens
  Predicted polypeptide sequence is orthologous to G938
acggagttttgccaacaccaaggtgtctacataaccttttctagagcaagatcagaccagataaccacataaccacttcaattctgaacctgcaatgaaagctactactagaattcctagagtctcaacaatgaaaggaaacaagtctctatcagctttaagattgatgattagtacaacaactaacaccaggatgatatccacctgataaagcagaattgtgcaaggacatacctccttccggataatacagactgagctccagatagccatcccattttttataggaaccaccccatattgtcttgcttaggcaacgctcctgcagcataatcaacagaggacaagttgaagggagatccatatctactgaactcggcagtaatgtcattagggttcgcttccatcagtggatcaaaggccttacactgatcaaacacattatcatctctattgaacattgtctggttcatgggcacattagtttcttcaaacatgttattccccattgcggtcccatggtcatagaagttggtgaattgaacttttggctgctcacaactctgatcttcagtaaccccaagatttccaggatttgaaccctggttgcactgcagattggtatcataaaatgacataagatcaccgatcattttctgtccatcttctgggagagtaattccagctaagttaaaggatggttggtgttggtttgtcgacacaggaactggcttagattgcgggaacggcaaggaaaagacttggggtttgtcttcctcgatgtgaaacggggttgtgattcctgatcccgcagagatagttccatacggacaatccaattggtgattgttccttttcgtcctgtctagaaacccaaggcggcaattactgtatgggcact

SEQ ID NO: 15235 - DNA, 906 bp, Aquilegia formos X Aquilegia pubescens
  Predicted polypeptide sequence is orthologous to G962
ctgttttgcagctaccatatacatatatatgacaatactccagatcgaccttaaataaatagtactagctacttcaattcgttactactactaattactgcaagttcattattagtttatggcaattgcagcaaccatgagccaaaacaacgacgacaaggataaccacgaccacgatatggtcatgcctggcttccgttttcacccaaccgaggaagaactcattgaattctatctccgccgtaaggttgagggcaagcgctttaatgtggagcttattactttcctggatctatatcgctatgacccttgggagcttccagcattagctgccattggagagaaagaatggttcttctatgtgccacgagaccgaaaatatcgtaacggagatcgccctaaccgggtgacaacatctggctactggaaggctactggtgcagacagaatgatccgaaatgataacttgagatccattgggcttaagaagacactagtcttctattccgggaaagcacctaaaggcatcagaaccagttggatcatgaatgagtaccgtttacctcagcaagacactgatagataccaaaaggcagaaatttcgctttgtcgagtctacaagagacctggagtagaagaccacgccagagttcccggctcctctcattcttctgcaccatcttcatcaagaggaactcagccggataaaagacagcagaacctgatcacttatggaatttcaagctttcaagcatacgatagcaacaactcacccgcaactactactactactactactgagatggaaaagctgaatgaagcagatgcaagcagtactagcaatgataccggaactgctcttgggatggccaatgtttctccaatgatcagttccgcagtattgtc

SEQ ID NO: 15236 - DNA, 963 bp, Aquilegia formos X Aquilegia pubescens
  Predicted polypeptide sequence is orthologous to G979
aaagaagaacaaagaaccattcttgggatcaatagagtagcaaacaaagtgaccatatacataacattatacagtgttgcatcaaatgatctttttctattaacattccaaattatctggaaataatatcacacggaagattatcagcctagcctataacatataatgttttcccaactatatcctcccccacacattagtattccagtacaggactcatcaccattagcaggagtgttcagtttgaatttgtgtcacgggggaaactaacatacaagtaatacaacaatgcagtgagttggcttccaattttaacttctgcatgtggggagtaggcttccaaatgtgtcccgagtcttgttcctggaagaattctgcaatgtacccaactcacttttcgcatatcacatttcaactacaagggtgacatcaggatgcagatgatgcatactaattccttaactattgatgtgactgcagaatgctcattgtgtcataacagcacatccttttttgcatgtcccattagccatctgggtctaaactcgccaaacataagcattcagactgttttcagcttcaaattgaatgaagaacatccagtcagatgagacaatctgctctctttaaatgctacgtcttagcattcacgtgcaacactgagcagagcagagcttgtcaaatttagcttagttgcaaaccagtcatgtcctaatccttcttcatcaagggaccagggcgctatttctagccttctacagggacatctggttcccaagtagctcgcatgactttagggggagcataggactagcagaatcatgcggtcaccatcatgtaacaatctttggacattcacattttctatacatgaacaatactcgggatgactttttgaagtaatctatatgatggacttgacgtttgatcaccatcacatggaagacatgcaagttcattctc

SEQ ID NO: 15237 - DNA, 908 bp, Aquilegia formos X Aquilegia pubescens
  Predicted polypeptide sequence is orthologous to G979, G2106, G2131
aatacattctgcaaatcaaaagatccaaatttaaaagctacctattctttctattggcatttcaaatcattcataatcattcagaatagatacagagaagtgagacaaaaaaaataagaggatacagaactcactcagagacaggaagaaagaaccctttttcgccggcaccctatcattttccagcacattctaaccttcccataacaccctcaccttctcctttaaaacttaaaggagaaaccccaccattggagaacagacatatccttgtagtttaatggcgaagatatcacagcagaatcagaagatcactgtaaataacattaaaactaatgatgagactataaccaaagtgaagagaaagcgaaagagcgttccaagagactctcctcctcaacgcagctcaatatttcgaggagtcacaaggcatcgatggacaggtcgatatgaagctcatctctgggataagagttgttggaatgagtcgcagaagaagaaaggaagacaagtctatcttggtgcttataacgacgaagaggctgcagcacatacatatgatttggcagcactaaagtattggggacctgaaaccatccttaacttcccggtatcaacttaccaaggggagctagaggaaatggagagtcagtcaagagaagaatatattggatcattgagaaggaagagtagtggattttctcgtggagtttcgaaatacagaggtgttgcaagacatcatcacaatggaagatgggaagctcgaattggcagagtatttggcaacaaatatctctatcttggaacttatgcaactcaagaagaagctgcaacagcatatgacatggcagcaattgagtaccgtggactcaatgcagttaccaactttgacctcagccgttacatca

SEQ ID NO: 15238 - DNA, 913 bp, Aquilegia formos X Aquilegia pubescens
  Predicted polypeptide sequence is orthologous to G987
gttttcaatctctctcttcgaggtaacgttttcactctctttcttactttcttcttcaatcttctctgaatcatcgaaaacaagcttgtaatgaatcgatttctagcttctttaagctaagaatctcaagttctatttgatttgatttcagtagaaagagttgatttgtttgtttgtttttgttgttaagatttatcgattcaacacgaacaacatcttcatcttcatcttatcttgtttgactttatgaaaacttttttattgtttatcgaattgatttgagtgctttctttaggattgaaattgattagggtttaaagaggttttgtgggaaaatagatggttatggattcacgttacagaggatatagtgattcaatgaatggattgaaatttaatggtggtgtatctcttccaaatcaaaatattatgaatgtttttaaactagaagaaacttctttagatcataattatgtcgatctacctcgtgttccacctgatcgtgattatcatctaaatcaaaatggtgtttttccatcttcaagtgttagtcatgaggaagattcatctgaagattgtgatttctctgatactgtacttaagtacataagtcagatgcttatggaagaagatatggaagagaagagttgtatgtttcaggaatcttcagctattcaagctgctgagaaaccgttttatgagatacttggagaaaagtatccaccatctccaaatcgacatccacttgatcataatgtggaaagttcggtggataattcttctggtaatttcagtcagtataacagtagcagcagtactagtagtaatagtaatccagtagataaaactgggtttcgatctggcgagtataagtcaactcagtacaatcatttccagctgattatactttcag

SEQ ID NO: 15239 - DNA, 923 bp, Aquilegia formos X Aquilegia pubescens
  Predicted polypeptide sequence is orthologous to G989
atcatgattcaaagcttactaccacgatccacccataaccatgaaaaaatccaaacgacttaatcgagatgaatcacaacaagtacaagaacaagaactaatagttgttgaagattatcaaagatcaaagaaacgtacttcattcgaacctgaaactgttcttgttgatgaagttgaagttgaagttgaagttgaaaatcaagtagaagaaattgaaacaattgtatcatcatcatcatcatcatcaagaagaaatgaattttctcatccatgtgaatcaaatggtttaagattattaggtttattacttcagtgtgcagaagcagtagctatggataatctaaataaagctacaaatctattacctgaaatttctgaaatttcttcaccatttggttcttcaattgaacgtgttgctgcttatttcattgaagcacttcgatctcgaattataacttcatttcttggtacgtattctccaattacaatcaaatctttaaccttaattcaaaatcaaaagatttgtaaagcacttcaatcttataattctatttctcctttgattaaattttctcaatatactgcaaatcaagctattttccaagctttagaaggtgaagatcgttttcatgttattgatcttgatataatgcaaggtcttcaatggccaggattatttcatattcttcattctagatcgaaaaaaattcaatctattcgaattactggcgttggatcttcttttgagttactcgaggcaactggtcgtagacttaccgattttgcgagttcattcggtttaccttttgagtttattcctttagaagtaaaattgggaatattattgatctgagtcaactcgctcccagacaaaatgaagctactgtggttcattggatgcaccattgtttgtacgacatcac

SEQ ID NO: 15240 - DNA, 970 bp, Aquilegia formos X Aquilegia pubescens
  Predicted polypeptide sequence is orthologous to G1020
gatagagattacattagaagcagaactagcagaagcttcttgtaaggtgaaaaaacaacatcaagaagaagaaagaaagaagaagaaactcttccctctctttcttctactaagttgcaaaaaacaaggattttgtgacatatatgtacatctgttcttccttctgctgattactcttctgtcatttttttctttaaaagaaaataaaattaactaaaaataaaaattgaaatttcaataaggagccgatggatgatagatctgtaaaatcttgaaacgaacagataaatccaattaagccacttccggtgcaggagggaagttaagatcaaaatcaagaactctccttggagggctaggatgattataatcaacaacagatgatgaatctgaatcactttgaacaccactctgattattattgttattaatcatgctgtgatgctgctgttgttgttgatgaagaaaattagtagccgatggatcgaatcgaagacggctttgctgttgttgatgatattgatgttgttgattcatcatcatcttatcagacctcacaatcgcatcaaagtaaaacaaaggatgtgctgcattagttggcaaaacaccaacttgatgtggatgacgctgatgatgttgattaaaaggaaatctaacggttccagcaccaccaccacgatgcatcagatctagatctagtggtggtggaccaccaacaacagccgatggtggtggtgcttcacggctagatgattcaacagtactactctggctagggctttgattattactatgattaatattattattgagaatctcgaggttgaggtggttgtggttgttgttttcagatgaagatggaattgggaaattagttttcgctttagcacctcgaaattctcttgcagcagcatcataagctcttgctgcttcttcagccgtatcaaatgttcctaaccaaacacgactt

SEQ ID NO: 15241 - DNA, 761 bp, Aquilegia formos X Aquilegia pubescens
  Predicted polypeptide sequence is orthologous to G1033
gattcaacaacacatctctctctctctctttctctctctctctctcttcttcttctttgcaccacacaacacaaaccctaaccctaaagatttcagtatgaaagctgggaaaggaaaggctagtacgactaaaaagaatgatagcaagctttctgtaaaaaaagctgcagcagggaaaaagcctgcaggaaaggcagcgaaagatccaaacaagcctaagaggcctgctagtgctttctttgttttcatggaagattttaggaaaacttacaaggagaaacatcctaccaacaaatctgtctcagttgttggtaaggctggtggtgataaatggaagtctatgtctgatgctgagaaagctccctttgtagctaaagcagagaagaggaaggttgaatacaacaaagtcttgcaggcttacaacaagaaactggccgaaggaaacgatgaagaagatgaagaggagtctgataagtccaagtctgagatcaacgacgaggatgattcagagggtagtgaggaggaggatgatgaagagtagattgggaaaagctgaggagatggaggcataagagatgtgcagttgccatcttctaaattgacaatgttgaattatcaaggaaatagttgttttttcgtttttttttttaatttgggggaaaaaatatttggaagcttgttgaagctcaaattactcttgtacttaaatctctactccatcatcatcatcatgttttaatgactaataggtcgttttcttt

SEQ ID NO: 15242 - DNA, 922 bp, Aquilegia formos X Aquilegia pubescens
  Predicted polypeptide sequence is orthologous to G1037
aaataagcaacttgcacaaataaacaatagataaatgcaactgaaattacaagataatacacactcatggcgagccatttaatgttgctacacttttttttttctttttctttttcagttagtagctaccaaagtttcacatacatgttctcactgggtacacattgcatccaatatctccatccattaacatagcatcctgttgctcccttttgatcattgcgttcatcatgtcttccaaggaaccagaattactgttcacgaacccactttgtgacttagcttgatccatctggtagtctcctttaaacctcattgtcgactctgttggtgaattttcgtaccccatctgctgcatgagaaattggttgctggaattcgattggctgatcagaggtgaatcaatttttctggtcgctactgtgttttcttgacctaaattctggccaaagggacccatagcaccctgtataggtactgacgaattcacagaattatataaaagatttgtgttgttcgtataatcacgcctgttatcttccctattttgctgcatatagtttgtattcaagcctaccctattaccaatgcttccaaaactggaggctttcaggttatcatgctgaacattgatgccaactgagccaccttggcattgtggatctcttcttgaattgtgcagagatgaagacaacacactggtggaggaagcgtcaagtgagttgttcctcccattcgaggcaatcgaagaaaaattatctctcatatgactagtaatcatatcagcattatcaaagggtcgcccaatggaaagggatttgaagaaaacccagttaaggaacagcaccttgccagttgtcagcacatctacatgatcaggcaatgagttgagacgcagcacaatgtcaaaggtctgggttat

SEQ ID NO: 15243 - DNA, 883 bp, Aquilegia formos X Aquilegia pubescens
  Predicted polypeptide sequence is orthologous to G1043
tgattacaaactatatgccctgttgatcacgtacaacatatacgtctaaccctacatccctatcataatttacaacaaaattttctatactgatttgacatgcatcataccctcctcatcaaaactgaacacatcatcaaaatcaatagatcccaatactaagtctaattccagtttttctgaacttgtagtacatgaataagcccctgaaatcacatctccatgatcggaacctgacattgtcgttggtccagatgaatccaatgcacttaactctggggatagaatgaattgattagatgatgacaactgcctgtcggtgcttggtttgtaattttgttcatattccaatttaaaggagggaaaggaagagaatataggatgataatcttgtgtactagaagtaacagtggagtttgattcaaagttgaagacactattagagtttggaggaggggatgtaggatctaggataagttgaggtggctttaatggatcagtgcaggtatgatgtcccatgtatgtagtctgatacataggtgggtcttcatcagtcttctggacttgtttggtggcctggcatccttgatcaaatttgtgggtgcacctgaagtagttccttggatgattggtgttaagaatctctttttgcccatattttcgccaagcataaccatcttcagttggcttggagcttattctagcccatgtatttggggattttcttctcttgtaccctcctctccgatctttcacagccggaattttccttttatcattggaatcaacactcttcaagtcatcagaaaagggtgaactagcttgagtagtcataggactgttacaaacatctcctccggtcatctcaccggaatctaatatt

SEQ ID NO: 15244 - DNA, 891 bp, Aquilegia formos X Aquilegia pubescens
  Predicted polypeptide sequence is orthologous to G1048
gttcgtcatctactacaactttatttccaagtgctgaagttcaaaaaacggaatgacgggtggagggtaaaaccatacattatatggaacaaacaactcatgcagcaactgcaccattacagatcatatttttcatctttgatctagaagccttgcacctcttactcttgaaaaaaagtcttaatgttcctaatcctatgctcttactttttgctcttcctagagccacgagatccacgactttttggttctccacgtttaccagcaggtctgctggtagttgcacacggagcatttctggagagaacaggcccaggatgcccaggaaccatagcagggaacccaacagcagggattccaaaaagagtacggcagactcctgcttggttcttgaagcactaaaggccttctcctgtaactgaaaatgtagagcatgattctcagcggcgcaacactggagcaaccgctgcaatctgatgcattcagcttccagatatttgctcttgacctccaaatccttaacatacatctttttcctctctcttgacctcacagcggcatctctattcctcatttgcctcttgcgcttcttggtattgggatcatcgtcctctttgtcctccaaagaagcagagtcagtagttgtaatagtcttttccttttctaaagaggccttttcctggtggtcgtttagttcattgtcttggtcgtcgtcgtcatcatcatcttggaaagaaacttgggattcaggagttgaagtctgagggtcattcaaaatcaaaactggtgtcccaagggtagtaacaacttggttggaggaggaattggatggggaataattggtgttaagaccaggaggaggaggaggagagggaggaacatcatcatcga

SEQ ID NO: 15245 - DNA, 1000 bp, Aquilegia formos X Aquilegia pubescens
  Predicted polypeptide sequence is orthologous to G1062
caaagttatctctttctctctctctctctctctctctttatctgaaaagttgaacaccttttccttctctctctgtaacctctctttgttctttcttcttttcattactctcaatctggtttgctttgtttccccttttttttttttctaaaaataaaacacttttgaaacaaacctctcagaaaaaatgcttccaaggaataataataataatggagttctttggatgcaagaagaagaagaaggtggtgaagtaggagtaggagatggggtttcatggagaaacaatggagtagtattagaaaacaaagaagatatgatgaatagtggtggtggagtgagttcactatctactttcaaatctttacttgaagaagattggtatttaaatactactagtactactactactaataataataataataacaactctatgcaaaacccatctcaccatcaagattttcaaactatgcaaaaccccatttctggagagaatttacttttgcaacaacttgattcttcttcatcttgttcaccttcttctgttttttctcttgacccttcacaagtacattctttcttaccatctaataaatctagtctatcttcacttctcaatgttgtttgtaataacaataacccttttgagaatggttttgatttgggttttgaaccagggtttcttatgggtaatcatcatgcttctacttctcctgttttaatgaataggggaaatgggttgttgactgaattcaatgatttgaactctcaggaacatatgggtagtcatgatttatcttcaaattctcaatttgttaatacccatttgttaccgttgagtgataatagtggaactagtttcaatcctattggttttgggggttttgagagttctgcaaattctttgtttctgaataggcctaagtcttaagacctcttgatagctttcctcctcttggagcacaacctactcttttcaaaagagagctgctcttcg

SEQ ID NO: 15246 - DNA, 930 bp, Aquilegia formos X Aquilegia pubescens
  Predicted polypeptide sequence is orthologous to G1064
aatacacacaacagcatcatatcacacttgtatgtatgatcttaggaatcatgatgacttgtgtcgtcttcatgttcatttcccctaccctgatgagattcagatgcaccggtgcccatgagcggtcgatatgcattcagtgcagccagcatgcctaaatgttccgtcgtcccactgccacccatacctgagcccatttgttggcttggcaatagagccaatggagtaggaagattcatgaaatgtagtccacttgaaccagaccctctatacacattcgtgttattaactgggggaaatgtccatattggatcaccactcatcacttggttattaggattcggatttggattcgtaaccatccaaaacgtagtcggaatttgactatgacttgccgcaaccggaagtgcacctgagcttgattgcaacaagtagttccccatttgttgttgtaaatttgctgtatcttgctgatcttgcctagaactctttcttcccatacttccatctgtatctcccatatccaaacattgatcacgcaattcttgcttagcttgtaagattgaattcaaattatttgactgaaaattaagtaggttggatgaattctcggacgagaatccaacacttgggtacataattcttcgttgtgattcttcgatatttctttcccattcacttctcatccttaattgtggtgtcacaaaatttggattgaaatatgtagaccttaactgtgatggtgcagacatactagagcccgaactacgaagcgaaatgtttaaagacgtaaaatttgcaggaattgtaccagtcccagttgccgcgatcactgctggctcagcttgttgaagtagccattcaatcgtctcaccatcggatttatgaccaagttctctagtcattgaaaactctagcagcacatgtagc

SEQ ID NO: 15247 - DNA, 945 bp, Aquilegia formos X Aquilegia pubescens
  Predicted polypeptide sequence is orthologous to G1064
acttgaagcaaattggaaacctaaaacatcatccaatccccacaaaatgtccccctagggagagaaaaacaaagactgcttaaagaaacagcaatacaatacatattagattaacagaaaataaaaataaaaatagatcattggagctatcaccaactttgacccaattagaacaggcatcttaaacagtgggtcccaccacgtgtcattatcttgtgagggcccaataagtttctgatatcaaaagatgaccgtttgattatttcttcttatagatattggatggtttttatatataaaatcaagaggttttgcgcggtgtttatcaaaactgtcttgctattaattttgtgaaagagtagagttgtggggggggtttagttgttgttaatttcttcaaacactctgtggttattttctcaaaaaagtcaaactggttctctatccatggatttggttcataaacaagaacttgaagaagatgaagatggaggattcactgacttgagaatcaacggtgttgggaacgaagaaatgtttggaaataatggaagtgaagctgaagaagatgataacttatatgcagatgaacaaacacatggaaaaactggtatgtgtttgaagaaagaacccacagaaacaggtcaagtatatcaagaccatgaacagcagcaacaacaacaacaacacatgggagtattaccagtaataccgattccgatgcagcagatgcaggtaagaaaaccaacaacacaagcaagaagagcatcaacaaaagatagacacacaaaagttgaagaagaggaagaagattcgtatgccagcaacatgtgcagcaagaatctttcaataactagagaacttggtcataatctgatggtgaactattagatggtacttgacatgctgaccagctatattgcagcacagacagacagtcagcat

SEQ ID NO: 15248 - DNA, 850 bp, Aquilegia formos X Aquilegia pubescens
  Predicted polypeptide sequence is orthologous to G1079
caaaaatttccctaggtagacatattcataactttcttgtttacatttttatcattcatttgtgctgaaatgatttatttttccactttgtattctttatagaaaaagtgcactttatttttctctctcatctgttgaagacaatagcagcttcttcttactgcaatgtcagaagtattacagagagatcatcagcttcattaaaaaccatggttttctctttctactgatcttcttcttcaaaacccactttgcattgcaaacatgggttgtgtttcatcaaagaagattgataaagaagaaagagtacagatttgtaaagaaagaaaaaggttaatgaaacaactgttactacttaaaactcaatttgcttctgctcaaatgatttatttacaagctttgaagaacactggtattactcttcgtcaatttactgattctgaatgtattgatgttgacatgttatcttctgatgatgagggtgaagagggttatgatgatggtagtgaagagggttttttgccttgttcacctccaccacttcctcctcctccaccccctttaccttcttttagtcctgatcacagcgacatcgaagaagacgataatggggaggtagtggtggtagtgttagatgaagaagagattagtgatactaggtctatttcacctgtaacaccatttccacatacaagttcatcttggggtatttgggattctatggctattgaagaagaaaattgggctgaaacaaataccgaatttgagaaggaggaagagaaagtgattactgatatcattttgcatcctttatttgagaaaacattgggggttaatagttcatcaatgg

SEQ ID NO: 15249 - DNA, 939 bp, Aquilegia formos X Aquilegia pubescens
  Predicted polypeptide sequence is orthologous to G1089
tataccttgcacataaattaaatcagttccatttttcttctatttaacaacaaaccaataattacagccgaattgccaactcataatctccctttacacggtataaattttggtaaagagagactataaatcaggaattttaattcctgaaacaaaaacagaaggcaaacaaaatatctgcagataataaacaattagttgactaggctacaaagagccgcctataaataaacttgtctcagcgagctgcttcgacatcacctaatatacaagattactgatacttaaggttctaaaatacctcttctagtgtccattttctgcactgcaataatcatgttgggagtcctctatgaaggaaggtttcccaatcttctcttcatgtattctgttttcactgcattgcaccaactcatcgtacatttttaaagatgccttcgagaactctgtaagtgactcgaaaatagaagaaaatcctgtctgaaatccatttaatgtgatacgctgtgtttcctgcatgtaattgtggtgcttctctttctccttctctagtcttatcctaaatgcgtccaacaggtccttcctttctgtcaaatagtccgcgtgattctgtatttcaagctggccttcctgttctgaaagcttggaaaccaaaagtctattttcggttctctgaaaagcatgaactttcctatcaagttcttttgcgaggccctcaatcttcctcttctggtgctgctcctctccttgctgaccccacaaagccctgacatccttggtaaagcttttcattgaataagctactgatttatctggcaacttctcgagtgaggcaaaccagtcatgacagatcacaagcaatgggggtccagttactcgataaggggggctgaagaccttcccctagagcaaaattcaacctcagggacaatgaacttg

SEQ ID NO: 15250 - DNA, 973 bp, Aquilegia formos X Aquilegia pubescens
  Predicted polypeptide sequence is orthologous to G1108, G2394
tcatctgacatacattctgccatgcacacataccttgcgttacacagtacatccttaacgtatctaatcaaatcaaattttctattaggtttatttgatagtacaaacattccataactgtttcagaaaagaaaaatgaagtacggacattatgaaataaagctcgtgcaccagcagattatgaagtagtctctgagatgactagcagccaaatgaactgaacgaattccttctacaaacaagcttctgtttatataagacattgtcacaagtttgatctcatcgaaaaccatctcatgttaactgttaacacaaggatccatcaaattgtgtacccctttaaattaacagttccatcagagttctgcagccaaatcgaagcaaaccgtatatattttgtaatcactcttaatttaaaactgttcacttttgctaccatgtatattaacagcatgaaacctgctgtccattgctgcaagtgaaccgcctggtggggagggagtggtgctgtggtggggaactaaataattttaaagatcaacgtttccctcagataagctagaagagtattgggcagcatcagaccgattcaacattctctttaccacctcaacacttcaggctagcgaaagtcagactggcttatatatatatacacaggagctttaagacattctcactaaaacacagtgctcccatacgctgacccacctgctgattcgcttccaacccccctttcaccttgccgatggctggagtttgctgcagatggtgagccctcgttgttctccccaacctcacacttgcagagtggacataatgcgttaatctttagccatttgtccacacactccatgtggaaaaaatgattgcatggcagctccctcagctcatcgttgtcggcatactttgccaaacaaatgcaacaaacagcatcttctcctgagattacacgctctttttcagttccagc

SEQ ID NO: 15251 - DNA, 983 bp, Aquilegia formos X Aquilegia pubescens
  Predicted polypeptide sequence is orthologous to G1129
tttataaataatatttacagtgcacagacaaagagaatgggaaggttaaatacagtattctgcattcatggatcggtgtcactacgttacaaatatacacataaacatatactatatactccaaaaaagaattgtgcctgctatttctcgaggcaaactccaccactaatctatggattcaaacagtcaaatctccatcttgagattgctagctgctaggttcccgttaaatggttcggatgaaaaagcagttgatcttccttgatgacggaaccctgtattgtaaaggctttgcaaatcattttcccaagcagaaggtggttgagcttgagagaaggacgaggagtccaggaattctcctggcattgaaacaggggtacttgtggttctctcaagaggcatttcagcgagatttatatccatattcaatccaccacatgaaagtacttgctgcaccgcgttcaactgctgatagcaggttggattcaacacttccgataacatcccaattgttggataactgtccgctgtagactgaaacatctctttggcgaagaagttatcgatgttgctgtcaacctgaggactaacagtagctaacttcatcgacaaaaactctacttgtctttgaagagattgaacatagttaataatttcatcaagcattccagcctttccgatgatcttattacatcccgggactaaatcttgcagatatctcattctttcactaatcttttcccttcttactctttcagctaagctatggctatcagtagcttggccacgacgcgctcgaacatgaatgtattctgttttctgaacttctgatacttttgaattctctttcgaaatatctccacaagtttctctattgttgttcttattattatgaatttgttcattgatctttgatgcaacttcttccacttcccctttgatcttcttctcattaatattctctgttccaacactctttatca

SEQ ID NO: 15252 - DNA, 924 bp, Aquilegia formos X Aquilegia pubescens
  Predicted polypeptide sequence is orthologous to G1133, G1137
gactgccctagcaaatggacctcaagggtggttctatggcttaccccgttatcgccaggccttaacacacattcctgactgtgctcccaaggagctcaatgctcacccagaaggatacaatggggatatcacttcagaagcagcatcaaggccacctgaaaagaaatttattgtttttgatcactctggaaatcaaacaagattgatttatagtcctggcactgattatcccaatcagtgccctgttgttcagaacccaatagcattcgacaatcacagcctccaaatagaggaatggaggattaagaatggccttttgtatggaggcagccccgtttctttcaatggaattgatgagaagagggaatatattgaaactgtggaggaaagtgaaatgcatgaagatactgaggagctaaatgcactactgtattctgatgaagaagatgaatgggattgtgaatgtgatgaagaagttagcacaggtcattcccccagcaaaatgaccagccacattaagccagaaaaaaatgcaagtgctgaagaagttgctagctctggtggctgccatcctaaaaggaagagattacatgatgaagagtatagtgcatcctcacttgtggacactgcaagttcagggaaacctagtggatcatcggagtctgaggatgatgcagaatctagttgtggggggagcagatttgattcattaccagtcaacaaacgtttgaaaagggaaaaaatccgtgagactgttaacatattgcaagacatcattccaggtggaaaggacatggatgcgatttatgtgttggatgaagcaatccaatatttgaggtcccttaaactcaaagccaaatccaatatttgaggtcccttaaattcaaagccaaatctttcggagaaagtttagactaagcagca

SEQ ID NO: 15253 - DNA, 922 bp, Aquilegia formos X Aquilegia pubescens
  Predicted polypeptide sequence is orthologous to G1146
tatattaatctgcaatataaaactagttcttcgaaagttcagatattgaagtttcaacaacggcagacattaaagagtttaaaaaataaaacatatctttcacattatccctgatgatgagaagcgggtgtgcctctccatttacttaagtaccagcatgcttccacagacgaacaaattccaaaatatggcagatatatgtatcaactacagaacttgttagaattgccactttttttttctctggaatttccacgaccatgttcttcagaaaagctgtggtgtcttttccgcataactacaaagaaaacaagggggagatttttcttcttcaataaaagaatatgccttccataaagcaggacaaaactgaactggccttcactgacacccaattctatgcggcttgaaactagttgatctcctgaacaaaatcaacagctcccaaatcattactgaatgaactgcaccattccaagaatcatgtaaagatcttgaatcaactcttgctgatgggtttcgctgataccagattaccagacctctgtatttttgttacctctggccagtccatgcacgccaccccatgttgtattgaaggactagaatcttcaccaaatggggatgagtaacatcaacatcaaaataatagggactgtccgtcaccattggaattttaagaagtgcatccaatagaatgtgtttcaaccaccagcctttcacgttggtctttagagccattttcatggtactccttgctcaatgacctgtatctccatacaaagtgtttcttcaaaatacgagaaatatttttcaattgcaatatctcgtaatgaatctgagcatgtcgatgaccaggttctgctgcagtgatgtcaactactaacgtcatataaaagaatctctctcatgatgtcatttt

SEQ ID NO: 15254 - DNA, 877 bp, Aquilegia formos X Aquilegia pubescens
  Predicted polypeptide sequence is orthologous to G1146
tttgaaatcacggtaccatgagttgcatgaccaaagtccagcgcaaagaactggacttactaattgttattttgccagacaataatggttctctttatggtgatttgaaacgaatatgtgagacagatcttggtcttgtttcacagtgttgtttaacaaagcatgtttttaggatgagtaagcagtatatggcaaatgtagctcttaagattaatgtgaaggttggtggaaggaacacagtgcttgttgatgcgttgtcaaggcgcatacctttggttagtgatcgacctactatcatttttggtgctgatgttactcatcctcatcctggagaggactcaagcccgtcaattgcagctgttgtcgcttctcaagattggccagaagttactaaatatgctggtttggtatgtgctcaagcccatcgccaagaactcattcaagatctttacaaaacctggcatgatcctgttaaaggaactatgcatgggggcatggtgaaggaacttttgatatccttccgcagagcaactggacagaagcctgagcgcattatcttttacagggatggggtcagcgagggacagttttaccaggtcttgctgtatgagctggatgcaattagaaaggcatgtgcctccctggagccgaattaccagccacctgttacttttgttgtggttcagaagcgtcaccacacacgactatttgcgaacaaccatgcagatcgtcgtgcagtggacaaaagtggcaacattttgccaggaacggtggtagactcaaagatctgtcatccgacagagtttgacttttatctttgcagtcacgctgggatacagggcactagtcgtccagcccattatcatgttctctggga

SEQ ID NO: 15255 - DNA, 997 bp, Aquilegia formos X Aquilegia pubescens
  Predicted polypeptide sequence is orthologous to G1146
tactaatttactatagtctggaataaaaaatcacacttgaaactccacaatcaacaagaaaataaaccgattacaaatccacaggttccagggaagaatccttaaagagatcttcttacaaaaccaagagcttctaataaagctcattcttaacaaaataacacaatgttcaaatcatttcacaaagatggaaagttgttggacagtaatatcaatttaagggctttgagcacacacacagctttatttcatttctccagacacagctcaccattaacaataaaatgttaagttcttcagattgtcacaaaggggcggaagttgtttaacttgggcatctgcaacttggtgaatcttgctgtctctgactgagctttcttcagaaaatgagccctcctcaaagtagaatcgtgcacgaaaagcagccagatgagcataatatgctggtgacacataggagaccgaacgtgtgcaccttgcatatatgtaacacaggttattggtgagggtttgaagttgatctgccgtgaactgattatcatcacatagaacatggtaatgagcaggacggctcgtggcctgaataccagcatggctacacaagtagaagttgaattgtgttgggtggcagatatctgaatccaccacagttccaggatatatatttccgctcctgtctacagacgagaaatcatcatggttccagggaaataacttggtatgatgtcgtttttggaccaccacaaatgttataggaggcacaacagattccttgaattcattcctccatgcctcccgaattgcttctagctcatactcgcggacttgattaaattgtccgtcactaacaccatccctgtagaatatgatcctttcacgcctccgctgattgttcttctcaaaagcgtgaaaatgttccttggccattctttccagatctaggatcttttcctcacgaccaagttgtgctgacagtataggaatataatttgtgaca

SEQ ID NO: 15256 - DNA, 972 bp, Aquilegia formos X Aquilegia pubescens
  Predicted polypeptide sequence is orthologous to G1146
atagcatgcagagtcatacttgggtggtgaatgtatagcagaacatgagttgggacaaaaccaataaaaactggtatctgaacaagtatttccctctgccacatctagcagtcaaaactaataaaaacggatatctgaacaagtatttccctcttagccacatctagcagtaaaacatgactttcttcacattatctttgagtgccgggagggctctcactgctccatttccaccaggggccctagtagtgcggccaccaacacctgaaccaccacgaccacctgctgcaccactagataaggaaccactatcagaggcatcaggctccatgtaaaaacgtgcacggaaagctgccaaatgagcgtagtatgctggggggactatagaaacagaacgggtgcaccttgcatacgtataacagaggttattcgtgagtgactggagtccatcggcagtaaagttgttctcatcccataatacatgataatgggcaggacggcttgtgccctgtattccagcatggctacacaaataaaagtcaaattcagttggatggcaaatcttggagtccaccaccgtacctggtaatatatttccgctcctatcaattgtgcgccggtcagcatgattattagcaaacaaccttgtatgatggcgcttttgaacaacgacaaatgtcaccctgggctgataatttggctccagagaagcacatgccttacgaatcgcatccagttcatatagcaagacttgataaaattgtccttcactgactccatccctgtagaatatgattcgtgaaggttttcgtccagtagctttatgaaaagatctcaaaagatccttgatcatgcctcctgtcattgtaccttttgcggatcgttccagactttatacagatcttggatcattcctggcgatgagcttgagcacaaaccaaaccagcatactttgtgacctcagccatcttg

SEQ ID NO: 15257 - DNA, 943 bp, Aquilegia formos X Aquilegia pubescens
  Predicted polypeptide sequence is orthologous to G1146
tgagcatatacacaacaagagatacatcaattgatagtggacaatgatttactaggaacattaactccacaagttctatttttaacagtaaaacattactctcttcacattgtccttcactgcgggtaacggcctcacaccaacctcccctgctccccgtgtagcacgcacagatggttggctaccacccgttgagttgttttcttgtaagtctggctccatgtaaaatctagctcgaaatgctgctaagtgtgcataataagcgggtggaacaactgagacagagcgcgtacaccttgcatacgtgtaacacaaattgtttgtcagggattgaattccgtcagctgtaaagtggttttcgtcccataaaacatggtaatgagcaggtctgcttgtgccctgtatcccagcatggctgcagagataaaaatcaaactcagtcggatgacatatttttgagtcaaccacagttccaggtaaaatattcccgctcttgtcaatactgctgcggtccttgtggttattagcaaacaatctagtatgatgtcttttctgtactatgacaaaagtcactggtggttggtaatttggttctaaagaagcacaagccttcctaattgcatctaactcatagagtaggacttgataaaattgcccttcacttacaccatccctgtagaatataatcctttgcggtttttgacccgttgcctttcgaaatgaaatcaaaagatcccttatcatcccaccactaacagtgccgcgcacaggatcgtgccaggtcttgaacaagtcttgtatgagttcctgtctgtgagcttgggcacaaactaaaccagcatattttgtgacctcaggccagtcctgagaagcaactacagccgcaattgaagggcttgaatcttctccattctcccggtgggtgacatctgctccaaatata

SEQ ID NO: 15258 - DNA, 918 bp, Aquilegia formos X Aquilegia pubescens
  Predicted polypeptide sequence is orthologous to G1190
attaaattcagaagctgtaattgtttaactcataatcatcaatacaaattttcggcctacagaagatttcacagaaacaatgaaatgaacaaagaaaaaatttaaccaacatggacatcacctatatgtaaataaagaatatatttatggtgcaactggaaattaatgaactgtattattcagtaaactaatcttaaatcgacggcaagctctaattttcttgggatccttgacttccttggggaaaaatagatctctctgcacctcgaaaactgtatgggacaaccccttgacaaaggaacttttatctactttctgaagatgaaatttcttcctgtataactgtttcatcatagactcttgttagaagagtaccagagtttcttttggcagatcaggaccttttccttctctacaccatattcagtctcttctttgcggcaactccacctcatctctttggcaattgttgaaatggcatcgacgaaataactagattcacggattattgtgtacccattaggacgaagaatacgatccatctccaggagaacatagttcatatcgcatctgtgactttcagcagtaaagagaccatcaagatgcaggagatcgtatgttcgaggatatgttgaaaaggcctcacaccaatcatggtatgttccaatcaaccctctgtcatagaccacaggtagtgtattagcagcataggaagatacaacgttcataacccaaaggggatcattgactactgctgcagcaaagcctccatacattgtattcatatccatcacgttacgtattttctcagtcccaatagctggaagcaagctcttatagtgcttcaaccgcacgctccatttactatcatcatgcttaaaggcatttgagctcccactaggagtataagaaatgcgt

SEQ ID NO: 15259 - DNA, 930 bp, Aquilegia formos X Aquilegia pubescens
  Predicted polypeptide sequence is orthologous to G1206
atttccagaagcacttaataaatggtgagccagttattgttcatgatgtactcaacactacatctggattgagctgggagccaatggtaatgtggcgtgcattgcgtgagtacaatcccaagggttcctatttaaatgtgacagctattgattgccacgatttgtgtcagtgtgaaatcaatattcgtacatttttcagagggtattcagatggttgcttttggcctaagatgctcaaagtaaaagactggcctccatctgattcttttgaggagcgtttgccacgccatggtgcggacttcatcgctgccttgccttttcaggtgtacacaaatccaaagtctggatttcttaatctttctgtgaagctgccagaagaatctctgaagccagacttagggccaaagacatatattgcctatggaattgccgaagagctaggctgtggggactctgtaaccaaacttcactgtgatgtttctgattcggtctatgttttgatgcatactacggaagtgaccctaacacatcagcagcttgatagtataaaattgctaaaggaggatctccatgcccaagatcgagaagaacatggtggtactgttcataatcgtcagaaattccaaaagaaaggcctgttaccatcaaaagaaatttttcagtccacaacggttggaaaatcttctgcatgcaagttgcagaggccccagaaagtaggaggaggagctctgtgggatattttccgcagaaaagatattccaaagctccaggaataccttaaaaagcactttaaggagttcaggcacttttacgctgatcctgtggagcgggagttgaaccatgggactttcgtgcaaaaacttggagaggcagtcttcattccagccggatgtccttatcaaattagaaatctaaattcatgtttacagg

SEQ ID NO: 15260 - DNA, 938 bp, Aquilegia formos X Aquilegia pubescens
  Predicted polypeptide sequence is orthologous to G1255
aaattaggcataactcattccagatctaaatacaggaacaagcaaaaacttggtgagaactctacacgaacgaattacatgcagttttacacgtaactttacaagaacaaagtaaattgttacatgcaatattacaattataattattattctgaaatcaatcttcttcttcttgagttcaaaagggaaaagaagaagatccaccaccacaccctactgcaaaagatgtcctcttaacaaaccgtcctttcattctaggccttttctctgcattcaacttccttacttcgtaccttatcttcttcgaaaacaaccttgttctgcgcttttctctgtaccttgatactcttgcctccctccctccatcacctcccattgccacgtgtcctcccatacttcccatatctccgtacatctgatgtgcctcagcaggatatgtacccaaactgtcgggccagcagtcgttggggttgaattgaggccgatcaccgttcatccacggtgaaccctgactagcccacgcagcgatcactgcatcataatcaagcctcaaagaaatcttttcctcccctttataaccataatttatggtcatattcaccttctcttcttcctcctcgcctgtagtaggcgagtcacaatcgaaattcaagtccaatgtctctctcgacaagtctaggtctgaaccaaattgatgacatgctaccatatttttcacatcttcttcatcctcttcaagcttcaccttgtcactatgatgatcataataaatttcttctttagtatccaaaagtcccaatccttccatgcagaacgagtcctcgtctaggcctctaccgagcaaggtttcaacatctgcagcaaatcagcgagatccatatcagatggcagtagcccaggtaagttctcaaatccactgtgccatcatgtccataatc

SEQ ID NO: 15261 - DNA, 890 bp, Aquilegia formos X Aquilegia pubescens
  Predicted polypeptide sequence is orthologous to G1267
ttcatattaaaccccccctcttctcttccaactacttctaactccaattctctctctctcttgccggcatcaattttctatctacatgttcaaaatcacttaaagaagaagaagaagaagaaccaagattatcaatcaatcagatcaaactcatggatggtagattcaacaactcatgtactaccaacaacaatcaagaagattcagaaaacacatcagataatagtggggaagagttactgccatcttcttcgtctatcggcatgatttctgattcaaagataacttcaacttcttcacaaaaaagaagtagacgtgctctacagaaaagagtagtttctgtaccaatagctgacgtggaaggatctaggatcaaaggtgacggagctccaccgtacgattcttgggcttggagaaaatacggacaaaagcccattaaaggttctccttatccaagaggttattatcggtgtagtagctcaaagggatgtccagcaagaaaacaggtagaaagaagtcgagtggaccccactatgatggtgataacttacgcatgtgatcacaatcactccggtcagcctattagaaaccctagctccaccgcttcaaccacctccacaatcgcctccgtcaccgtttcaattactccaaaatccgaacctggagtagaagaacaagaaccacaacaacaacaacaagaatcggcgatatttacaacaactcagaccgaatcggaacaagacaagtttactgatttagtaataaagaggaactggagaagaaaatgattttgtttggtttttctgacgtggcatccacgtcagacaatacattattagaaagtccgatttatttcgggaagtagcaacagtaacaaaggagatgatggt

SEQ ID NO: 15262 - DNA, 954 bp, Aquilegia formos X Aquilegia pubescens
  Predicted polypeptide sequence is orthologous to G1272
cagcctctccatcagtgatgggaacatgaccagagtacatatgactgtttgaattagaaacaacagggaggcatacaaaattggactcccaagtcttaacagaaaaacatagaacttcgaactttctcatgaagattggactcccaagtcctaacagaaaaacatagaacttcgaactttctcatgaagcctagggagctgtgcaacagggacaggtcctgcagatgtgatcccatgagaggatgatgaatcagaagatgaatcgtcaaacttgatgaactgccccatctgtgcagcagcaaggtgagcatagcagataggtgccacaattgaaatagcagttgtgctgcgctgatacacataggaaagcgagtgcacaagattctgcaattcatcagcagagaagccaatctcatcaagcaagacatggtagtgtgctggacgggatgtcccaattgctccattgtgagcacacatgtaaaagtcatagttcctaggatgcacaatctgcgtatctaccacagttccaggaggaacattgtttgggtcgttggattggaaaagctttgtgtgatggttcttttgagccacaatcaatgtaatcttcggaattctggtataacctaaatgctcaactgccttaacgatttgctccagctcaatgttcagaacttgaggaaactgagactcgcttactccatccctgaagattatgatctgctcaggcttgcgtccttgacttgacttgtaaaactcaaccagtaattcccttataatgccatcatcctccccatttggtagaagtttgaacaaagaatcaatcatctccacctttggtgattgggttcttacagatgccctgtatcttgagatcagcggccaagatcttgaaccaacaacagcagcaatagatggaacatctgattgaccaggagacccatgagatacatccat

SEQ ID NO: 15263 - DNA, 932 bp, Aquilegia formos X Aquilegia pubescens
  Predicted polypeptide sequence is orthologous to G1272
cttatcaactcatttcacgagagagaaacaagcttgttgattgaatctgtcttcttctcgccgcaatgaaaaaaccctagaaatcgatctgtgcatctattcaactataatatggagaaattagtatctgaagaaacaggagtaacacgacctcctcctgcccctaatttaccactatatgcgatggcagaaaataactttgcttatgatggtgagaaagccttgtacacaaggggtgcaataccccaaaaacaaatggagtttactgtgaaacgttttgggagccctggtgctgcaaaaataccaatgggactagtagctctaactttcaaaggatttgaaatagaaaacactggagatgcacttggactagtaattgatattatcttgagacaacaagcagctaaaaggtgttttcttgttcagaagtcctttcatgatgatgtcagggacatggttgatgtcggaggagcgactgcttgccgtggttttcactctagattccgtactactcagggtggattatcattaaatatggatgtctcttccaccatgatcttaactcttggtcctgtgtttacaaacccaaatttggaggaccctcgacatattgattggggaaaggccaaggaaatgctgaagaatatgagagtgaaggctagacatagcagcatggaattcaagatcattggaatcagtgagaaagcttgcagtcatcaatactttcccatgaaaatgaggagtgaagatggttctacagaagaaattgttgacatcattgaatatgagtgctttgtcaagaatcggaagattggactggataattctgcatacattccaaagtgtcccaattatcttcccttggagctctgtttcatagtttcattgcggcaatacacaaaagctttgtctagtatgcagagagcatcctt

SEQ ID NO: 15264 - DNA, 221 bp, Aquilegia formos X Aquilegia pubescens
  Predicted polypeptide sequence is orthologous to G1272
tttagctgcctgttgcctcaatataatatcgattactctaagtgcgtctccagtcttatctgcttcgagtcccttcagagctaaaacaattggtcttatcggtatttttgcggagaaactgatctcaacattgaaggttttggactgaaaagatcgctttgctctcttaaaaccagtttcaccgcgactctcagtcaaactaggactcccattacgtttca

SEQ ID NO: 15265 - DNA, 981 bp, Aquilegia formos X Aquilegia pubescens
  Predicted polypeptide sequence is orthologous to G1272
tgaagggcaaactgtgttgtctggaactaagctaagcctaagtactgcttcaaaataacaaatattgttttgacaagaactagttcaaaatgctttcaaaattttctatatacactcaagtaaattatagccaggtccataaccttaacagaagaacatggaagtcctcacattctcatgaagcctagggagctctggaacattgacaggacctgcagaagtaatcccaggcaaggatgatgaatcggaagacagatcctcaaactttatgaactgtccaatctgtgcggcagcaaggtgagcgtaacagataggtgccacgattgagatggcagtcgtgctgcgttaatatacataggaaagagaatgcacaaggttttgcaaatcatcaggagaaaagccaatctcgtcaagcaggacatggtaatgagctgggcgggaggttccaatcattccattctgtgcgcacatgtaaaagtcataattccttgaatgcacaattcgagtatccaccacagttccaggaggaacattgtttgggtcatttgcttgaaaaagcttcgtgtggtggttcttttgagccacaatcaatgtaaactttggaagcttagtgacacctaaaagctcaagtgcctttatgatttgctccagttcaatgttgagaacttggttgaattgagactcgccaactccatccctaaagattataatctgttcaggcttgcgtcctcgacttgactcataaaattcaaccagtagttcttttataatgccatcatcctttccatttggtagaagcttgaacaaggaatcaatcatctcaccttcggagattgtgtccttactgatgccctgtatcttgatattagtggccaagatctcgaaccaacaacagcggcatggatggcatgtctgattgaccaggtgacatgggatacgtccatccccagatcatgttggatgtcctagagtgagagtttc

SEQ ID NO: 15266 - DNA, 958 bp, Aquilegia formos X Aquilegia pubescens
  Predicted polypeptide sequence is orthologous to G1289
aagaccgaactaaagaacctattgtcgaaaaaattctacgtgagttaaagaagaaaaattatgtagtacgtttctatgaataacaccatataagtaaccataaaggatatgaacaacctccgccaaaatgatcctattatatactttttccgtgtgcaggtcgccagaaacctttcctgccaacaagaaactgaccttgatagaaagtagtttcccaatgcagcgatctcaatagaggggtcagcttagtaatggtttctatgtcatcttggaggagaagccatccacctggtcttaatatccgatccatctcaactgctacatcaataatgtcacacctttttgtatgatctctgaagaggtaattggcatgcagtagatcataagttcgagggtatgtattcaaagcctcacaccagtcatgataaattcctatcaacccccggtcaaaaataacagagagagtatcaggtacattgattggtacaacattcattacccaaagaggctgatcaaccagtgctgctgcgaatcctccataaccagcattcatatccattacattccgaatgcttgaccagttgatagcaagaccatccaagtaaacttcggatacaagctgagaccaccttttcgtatccgaataatatgtttcttcggcactcgattccatccctagactatggggtttactgtgaagcctttcaggccaagaggcaggccagtcaagctcaatcgagctaagttttggaagacaatttccaagtggtacataccatgagttatttttcctgtccactttatcacacaaaggagggctattttctttccgtccttcatagcaagcgtttgagacaggcttctgatatatcacaagacctattccagatgaatccatggtttttgctactgccttccaacatatagattctgtcaaagccaccatagcattccagac

SEQ ID NO: 15267 - DNA, 930 bp, Aquilegia formos X Aquilegia pubescens
  Predicted polypeptide sequence is orthologous to G1313
tgagtagcatattcccctttacgagggcagattattctacaactgtcattctgaggaaaaaagaaaagattctgcattaagttttttaccttaccatgtcctggttccatatatctgcattgtattatgtgggaagcatggcattccacaactaacacacagaaacaaatcaaccgcaaatttggtgaattatgataccctaacatgtcatccttactgacctctttatcaaggacacaccaagtctaaatgccaacattaaacaaatcttcggcatgaattcaggggagttcagacatttgacagactgctggcaagttattccagaaataagaaccaccgccccatccttgatttgacgatgcagcaggaatttgcttgtaatcgccatagaaatcttctccaataaatgttgatatggcatcagcaagaactgattggtccttagcacattcagaacgctgctcaaaccacgccccatcaagcaaagcatcaggccttggaaagctcaactggggggttatttgcctcccttcgtctggagtggtaacatgctcgattggttcttgcttaacttcagatccacacaaggctctgtcagcaggagtttcatccaatgaacttccgctagcaggagtgcattcactaaaaactgatgcggcagaacggcccaaaggagagatgggatcaccatattcttcccattcagcctcacaaacatttagtgccgaactgtccactatatcacctggtgtgactacacatgaatttgaactcttctcagatgattgattctttgcactacttaacgtctgagattcatgaagtaatgcatccaacacgccactgtttcgtggggaaacacagtcagattgcactggcctagtcggagaaggagattgtataaaggcatcaacagaatcgagagat

SEQ ID NO: 15268 - DNA, 907 bp, Aquilegia formos X Aquilegia pubescens
  Predicted polypeptide sequence is orthologous to G1328
taaatgcaacatcaaaaaatattttcccatgaaatactgtatatcaaaagaccttttctcttcaatgtgtattactactgtcatagagtgagacttgtttccaccctccatcaacaactgacaacacatcactactactacaactattacaataattaacagcttaatactccttaaaatcactaaataattagtacttccatctccttctttcttgtgttctgatcaaactgtaatagtgttgtataattaacaaaatgtatccattttaccctttcttgtagtataccaaaatctgaatttaatctgaccttccaattagtccccatcttcaatatgcacatcaaaatagacaaaaataagtcatcaaatcaatctcaacccttaaatggtctcgcgatcggtccaaattttgattgataataatatccatcaattgttgtatcaagaacacatggatgaaactcagtcttcatatcccttgccttcaagcaaatctcacatgtagtagcaatactttcagaagacctacgtataccattaccagcaccgtatccgtattcatagttatttgaaatatccgtattatacggatacgtagaattatacggcattaaacaattttctttctgcatctgcatttgcaacaaattttcgtaatttcgtaaccctaatctcaaaccattatgattataataaggtgatgaagaagcattgaagccaaattgcaatggaattgcaggtgaatcacgtcgaagaagaagtttttgttgagaagaatcagttgatgatgatgatgatgatgataagaatctcttctgagttgtgaagtaatcttctacttcatcttcttgacgaaattttccagcttttgcaccttttcttgagatttataagaataagaatg

SEQ ID NO: 15269 - DNA, 876 bp, Aquilegia formos X Aquilegia pubescens
  Predicted polypeptide sequence is orthologous to G1330, G2423
tacatgatcaatgatcaataatgaaaaaaataatgaaattggaacactacaaaccaaattaataaacaaagaaatccaatattaaacaataattcccagtattaatctttagccctttactgtcatccaaatccccattttgtcctaggtatatatatatatatatatatatatatatatatatatatcatcttcccgccttctttctccattaattaccatgcatcaactgttgctgtaaaaaccataagtcctcaacattccaagaattctcaactatgtcttcaccaccaccaaaccacatgttgttctgctgttgctgatgttgatcactaccctggcatgctaactcttggttaaagtaaccagatagattagtctgggaatctggataattcatatgggcattttgggtattttgataattgttgttattagcctgaaatgtatagtagtctctcatgtctgaagccattgaatctgatgaagcacctgtgctagagttctcaggagtgaaacttgagttaataaaggcaccccttcccacgggtagaatctgagtggccgttgtcagttcttggttattgtagctgctgttgttgctactgttattattgttgtaactgctgttgctgttgttgttgttgttgttgtagaggtggtgatgagatgtggtggtggtgttgctaccagttgcagaagaggttgctgcggcagcttgaatcctttccaccaatcttggcatccatagataacgcatagtatctttgaattgtttgctgttaacgtcgcatttgagttgttttgcgtgcttttgaactcttgttctccaatagttcttaatctcgttatctgttcttcctggcaagtgttgcg

SEQ ID NO: 15270 - DNA, 908 bp, Aquilegia formos X Aquilegia pubescens
  Predicted polypeptide sequence is orthologous to G1341
gaggctgctacttccagccattgttctacaatcgaaagactctatgcttgggagaagaaactatttgaggaggtcaagaatgccgagagtatcaaaatagaacatgagaagagggtagaacaactgaggaagcaagagctaaaaggggctgattacataaagattgataagagcaagaaagaaattgagaagttagactcaatgatgcaagtggcaactcaagctatagaaaccacatcatctgaaatcataagagtgagggaaatagagctatttccacaactccttgaactagtcaaagggttgacgggcatgtggagaagcatgtatgagtgccaccaggtccaaacccatatagttgagcagctcagattcctcaacactattccatctactgatcccacctctgaaatccatcgtcaatcaactcttcagctcgagctcgaggtccaacagtggcatcttgcgttctgcgatcttgtcaaatcccagagagattacatacagtctctaactggctggctccgcctcagtttgttccagtttaacaatgagcaactaagcaaagccagacaaaattctgcaatctattccctatgtgaagaatggcagctagcacttgacagggttccagacaaggtggcctctgaggggatcaagggcctattaactgtaatccatgccattgtagttcaacaggcagatgagtataagcaaaagaagaaatcagaggctgcatttaaggagctagaaaagaaagttgttgagcttcgatctttggaatgtaaatacggaccatatgcaacagctgaaagttatgggtctaggaagatcaaaaatccagttgcagagaagcaagcaaatgttgacatattgagggtaaaggcagaggaggaaaagaccaaaca

SEQ ID NO: 15271 - DNA, 921 bp, Aquilegia formos X Aquilegia pubescens
  Predicted polypeptide sequence is orthologous to G1380
ccgattcccatctaaaccttataccttcacctcacgtctcaaactcccttcacctcatatccaatatccaatttgtttcatagattcatcaaattcgcttgattttgattatcttttagacaaacatattccgatctgatagtatttgtttttgtttagatcatatctaaatcaagatatcaagatgcctccaagaggaagaggatccgttgttgcggcggcaaccaccacagcagccgccgcaacaatggatgcagcagcagcaaagaatcaatctaaagaagtgaaatttagaggtgttaggaagagaccatggggaagatatgcagcagaaatcagagatccatggaagaaaactcgtgtttggcttgggactttcgattcggcagaagatgcagctagagcttatgatgcagctgctcgatctcttcgtggtcctaaagccagaactaatttcacttctccaccaacaaattttcctcatcatcatctaggatttcaacaacaacaacaaaatttcaatgatcctcaatataatcatcatcaacatcgatttcttcatcaagaacaagaacatcaagatcaattgattcaggttgttcaaagacctacttctagcagtcatagcagcactattgaatcttttactggaactgggggaactagggtttcttctgtggcggcgatatctgctccgaggcgaagagaacatcctccagttcttccggatgattgtcatagtcaatgtgattcttcatcttcagttattgatggggatagagataatggggatatggatattgcttcgtcttctttcaataaacctcctcgacctttcgatctcaatttcccacctttggatgatgctgatattactagtgatgatttccagagtactgctttatgcctgtgataagttat

SEQ ID NO: 15272 - DNA, 919 bp, Aquilegia formos X Aquilegia pubescens
  Predicted polypeptide sequence is orthologous to G1382
gctcaactttctcctatggccaaaagtataaacttatctaacaaggatttccatatactatttcaatatagataatatctatacacaagcctccatcttacaaggtcaatgtaatatacagcaacaaacagcattcagatggagtacgagctggatcagttgatacaacagcagctctaagatagaaagccacaacagcaagagtgttatgacctcaacacagcaaatccctgtataccatgacgtacttcccagatatattattgttcgcgaaaccacaggaaaattttatggccgcatcattaatcttcccacattttgttgatatggattagaagaatggtttaatggccgagtttcaaagctaaagctttcacccacgacttgccttgatccaaactgatctgtgccattgccttgccttgatccatactgatctgtgccattaccttgtcttgatccatactgatctgtgccattaccttgccttgatccatactgatctgtgccattactggaatatgcttgaatcatcctactagaaccaggatcagtaatataggagtaactacggagaggttctacatccattgcttgctgcatctcatttgatctattctctgggctcgagctgattccaacacctaaatcaagactaatagtgtcaatttcctctgatctggtcctcaacatgctatttggagctgtatgatatagtgtgggaccggctgtatcatgagcactagtcctcgcagcaggtacatcatgattatgctttccctcgtatgtggttatgactgcttttggatcgtgtgatgccctctctacgtgttttctaactggacaaccagcatttgtgcatttgtagtaactcctcggattgggatttcctttcaccactttctgcccatattttcgc

SEQ ID NO: 15273 - DNA, 952 bp, Aquilegia formos X Aquilegia pubescens
  Predicted polypeptide sequence is orthologous to G1382
cagaattggcatctctcagatagatatccaaattccaaacaagcctacattatcagggtaatgcggccctcgtaaatatctacatggatcttatttgttacaattcattggaacaatttcccaagccattattaactctccaagttttctgtgttgttcggataaaccaattgagtcgaagatggagtgtcaaagcttaagccttgatctgcatccagatctagctcatcattatgtgccaaaactggggcaggctcaatcatcttattcctatccagatctgtaatggtggattgactttctataggttccacatcaattatttcttccctctcacaaattctattttcaagactcaagccattcacgactccagcatctatcccatttgcgataagttctccggatctggtttttaatgtgtcatttaaaccgtccgcactgctaacgagacctgttgtatcatgcgtagttatccttgccagaggtaaatcgtggttatgttttccctcatatgttgttataactgcctttggattatttgctgctctctctacatgcttcttaacttggcatccaccatttgaacatctgtagtaattccttgggttagagttgcctttcactattttccgtccatatttttgccaacggtacccatcatccaccacatcaacctcacttagagtttcaacaacaacacgaggttccctgggagttctaataactggagtaagatcgacatcacctacgtctttcttccttcttttagattccatgtcgatatcatcctcaacctcattgccacgtttcaatttttcggccgtagtatcgaaattttcaacacttcgtgtgactggagtgagcttggggattcgacttgggttggtacaagcacatgtttggacaggtccatttgatggattatcacctgagccgtcagaaattctat

SEQ ID NO: 15274 - DNA, 938 bp, Aquilegia formos X Aquilegia pubescens
  Predicted polypeptide sequence is orthologous to G1435, G2741
tatatgaggattttatctattattgggaggaacatgatggcgaggcccaatcgaattgaatttattaacacaccaatctctttgctgctccctatacatattataatgatgctgatcgaacccctgataggtggcagatggtggattaccaactggtattccgatatgactagcaccatgagccacaccaagaacaggcataggcatcaaaggatgatggccataaggcattggatgcggcactgcaggtgatgggattgctctgattgactcatttaagcttggtggaacaggtgtagacgcaaagagctgatccgaaggcgatggaccctcattcgacaaaccctgcattctgttcaaatacaatctatatttctgaagatgactagcgacattttctctcgtaagtccttctacattcataagctgcataattgtttttggtacagcattcttaatccccaaatgcgcaacaacatcaacaaatctcttatgtaattgaggagtccaaactaatcgagggcgtttcaatgcacgcgcagtttgatcatcattagaattatctacaccttcttctatcaaattctccattccttcttggtgttgcatcaacacagatttccgtttctcagatccatctttttgttcattttgaaacttatattgattatcatgttcatcagattcaatttcaatctcattttcttctctttcaacaacaacagaatccttaccagtaccaccaacacttccatcttcaccaaatgaaaataaagacttgaaattactagataaaaacccttgatttgatttacgcaaactcgaaaatgttttctgtgatgctcgattaacatcaatcaaagttctagatggctctggagttatactgaaagcagaagctaattcacgagaaattaaagattgagataatggtgtta

SEQ ID NO: 15275 - DNA, 935 bp, Aquilegia formos X Aquilegia pubescens
  Predicted polypeptide sequence is orthologous to G1435, G2741
caaccatcattaatgttaaacaaggattcctcaggaacaacactgagggacaatcaataagatttgatcatatcagtatcacaaattcacaatacatatgcaattgtacaaacacaaacagtaagcatgatgagtacacatttcaagaagaaaaaaagttggagggggaagcctgcaagaagatgaacggctgggttggaacatctaaacgatgagagtaatagaaaatccactgtcttccttaattggtgcatacaagaacaagcaaaaaggccaaaataacctgaatcctgtactggtgagagtcatatagaatccaccgtcttcattaattgctacaaacaagaccaaacaaaaaggccaaataacctccatcgtagatctttccttgacatggagtgaaagaaagtggaaacaagaaagccatggatctgtctaccaaggtgtggatcttcttttatgtgtatccatgaaagcacatttaacgttcttatccaacatgcaagtttacatagtttccaggccaattcccttgatgctccctattcatgctgtagggatgataatcaaacccggtataggatccaactggcatcccatgagaagtaccagcagctggcattgacggcgcaggtgccccatatggcaccgaagcaggaggcaggtttctgttcccactcgactcacgcaagctctgcggaacaggagccgaggcaaaaagttgatcattagaagatttcccttcattgatcctcttcaagtacaatctatacttctgtaaatgactagcaacattttctcgcgttaagccctcaacattcatcaattgcataatagtttttcggcacagcattatcaatccctaaatgcgcaacaacttccacaaacctcttatgaagctgaggagtccataccaatcttggtcttttcaaagc

SEQ ID NO: 15276 - DNA, 931 bp, Aquilegia formos X Aquilegia pubescens
  Predicted polypeptide sequence is orthologous to G1451
agcaataccaagccatttgctgcagctgctttgcaggatattagaaatggggatccattgaaacagcagtttctgcaatttcagcagccttttcaataccttcaacagtcatctggacctaaccctctgcttcagcagcaacttatgcaacagacacttccacagcagatgctgaatgagcaggcgcaaaatttagctgagaaccagccccggcacctcctgcagcagcaattgcagcaacaactgcagcaatcacttagtggccagcagaagcagcaggcccaacaacagcaacaacaaacttatcaagaggcattccaaatgtcaaacaaccaattccagcagcagcaacaatctatacctgctccgttatgccaaaaaacagatttcactgattccaatgttaccttctcagcatccctaaatccttctagtatacagaatatgctgggttcattgtgccctggtgggagtggaaaccttctcaacttcccaagaatgagtgagtccatgctaagtgattcgcagcaacaacaacaatggggacaaaagtttccttactcgcaaggaaatgcttttgaagggtcagcatctcttccatcttatcttgggaaggacggtgctgtagaagcggacaatggagatgcccaatcccatacactttttggtgttaacattgactcttccccacttctgctctccagtgtcattcccagcttaggtacctctgcaattgatgctgatgtgtccacaacgccctttggagcttctgggtttcagaattctctttatggctgcatggatgattcatctgatttgcttcacggtgcagggcaaggtgaccctccgactagaacctttgttatgtttacaaatcatgatcagttgggaggtcactagacatcggcaggttcagtagctatcgtgagct

SEQ ID NO: 15277 - DNA, 920 bp, Aquilegia formos X Aquilegia pubescens
  Predicted polypeptide sequence is orthologous to G1451
tcggtgacaaagtcgagctcatcttcccaataatttagcatatgagagtagtcatttgatttctgtgtctcacacaacctcatcttcaagggatttaaagtgtcatctatattaggattcttaataattcctatattttcacaacataatagatatagttacaacttacaagatatatataagcgtcatgcatcacttctgtgggaagaagatacaaaaccgatgggtcaagatggttcattgttgtatctcaaaaaaggtccttttttacccttccttttctacccgacttcacattctttcaatagttgagagaactcactgatgtacttctaggacttagatttcttgagtcctcgcagttcacatagctgttgtagctaccaccagaaagcctctgcctcggattcagaagctcaagaccttgtttccccatcttctgcacttcttggggcgagagtatcttgatgcaccagacgctgtttacaaattcctgccaggggtcatcgccgagaagaagaacgtcattctcccggtcgacgaatacaagctgccagcctgatcttaaggggtcctccaactggcctgtgaggccaaacatgcactcaagctcactgcgtagctcctggtagccactgaacttagtaatgtccaatgacctcccaaaggaccccgacttgtaaaccttaacaaaggttctgattggttggtttacttgcccctcattctctggggactgaagaaaggacgactcatctaagcaacttgaggttgccatgtttgagtgaagtggaaagttggtcccttcttggtcctctgagtattctctttggggaagtggtgataatggcacattttgaggtgatatgttagtttgttgttgaccaaattgttccacctgaggcatcagatactgggtt

SEQ ID NO: 15278 - DNA, 881 bp, Aquilegia formos X Aquilegia pubescens
  Predicted polypeptide sequence is orthologous to G1474
cacatgaattgtacagttctacttcaccttaggccgatcaccgagcctcagttcaagatctatctcctccatggaacttgagtagcttagtccaaatacttcagcttggatatgatattgtctatcaactgatttaggtttgaggaagaaaggcaaggaggttgcatcaatctttcttctcttgttactaattacctcatcatcatcttcaccagatcgcgtcttcctagtccgagaagctatcaaattcaagctcacatctgaatcagtcttatgataatcagcaccacaaaccccgagtcctaattcttgtgctctcaattctctctccccttcaagcttggaatcagatagactaacaaccttaactgcgattgagttggtgtgtgtatcttgggcagataataaggatcctactatttgatggttctgaactgtagtggaagaataagaaggagaaatcaccaaggtcttatcaagattgcacttctctagtgtagatggaattgaaaccctagaagcagttaggtttgagttagggctaaaatccaaactacaaacttgagaagtatattgatgaacccctaatgaagtagagggattttgatgctgtagtgtagtttcactatgaggatttggtgattgcttaagtctagctctatccctcctgtgtacattcatgtgaccaccaagagcttgagctgacctgaattctcttcgacaaaagctacaagaataagatcttggaggccatatacaaccaccatgaggtccagctgaatcttctgcaaaagcttgttcttcccatgaatcgttgtaactagtcctcgcagacgcttgaacatgctgagacttctcagttagtttccttctcatccaca

SEQ ID NO: 15279 - DNA, 956 bp, Aquilegia formos X Aquilegia pubescens
  Predicted polypeptide sequence is orthologous to G1480
tcaattacctgcaaaatactgcaaacatttcacgtgtctgtaggacctatcttggcaatgacactaagatatgataagacagctcataacagatgaactctcaaaaatacttatttatttggctaagaacttcccacgtgtcgtccgtgggttcgtcaataacctgatttcctttccctgtatagatagatagaataaacaagggcaactctttctctccataactctctctactctctttacactactacttttctttcaaaccaaaaagaaatgaagatcgatgaaggaaatgggaaagtttttgcagcaagttggagtttatcagcaaaaccttgcgattcttgtaaatcatcttcagctttactgttttgccgagctgactcagcttttctttgtatcggttgcgattcaaagattcatacagcaaataaacttgcttcacgacatgaacgagtctggatgtgtgaagtttgtgaacaagcttcagctagtgtcacgtgcaaagctgatgctgctgctctttgtgtcacgtgcgatcgagatattcactcagcgaatccactcgctcgtcgtcatgaacgttttccggttgttccgttttatgaatcagctgcttctgctattaaatctaacgccgttaatcttcttgtacctgatgaatctgaacataataatgaagatctcgatgaagatgatgatgatgaagaagatgatgatgatcatcaaatcaacaacaataacaagaatcatcaccatgctgtcaccggaggagttgttgttacttgtcgtgaagaagctgaagctgcttcttggttacttccaaaccctaatcataataataaactaatggaaacacctgatttgaactgtgctgatcagtattcttctctgatgttgatccatatcttgatcttgattattcatcaccgttaactggtagatatcataacagt

SEQ ID NO: 15280 - DNA, 805 bp, Aquilegia formos X Aquilegia pubescens
  Predicted polypeptide sequence is orthologous to G1482, G1888
cttgtgagagagaccaggatggatagctatactaaaagttgctaactcaatgcgccagttgtggagcttctgccacctttgcgcccccaccattgcccatactaatttggaaattctctcaacttcaagatctttccaatcaatccccatatctatttttttaatacccttataataaagttagtatttgcttcaaattgaatattgcattatgggctcttttcttttcttagagatgagatgagatgagatgagaatgagatgagcttttccgcttccttcttgctttagagaaataataaacagtttgtaatagtaatactactataataaattctcatactagctaccaaaccaagaaatgaagatccagtgtgatgtttgtaataaagaagaagctttagttttctgttcagcagatgaagctgccctttgtaatggatgtgatcatagagttcatcatgctaataaactagctagcaaacaccatcgtttctctcttcttaatccagcaaacaaagatgcccctcgttgtgatgtttgtcaggaaagaagagcttttttgttctgtagagaagacagagcaatactctgtagagaatgtgatattccaattcacacagcaaatgaacatactcagaaacataatagatttcttcttactggtgttaagcttgcttcttgtaatcccacatcttcatctaatggttgtgatgattttcaaaaggtcaacaacaaatctcagtcattcataaagtctactccaccaccaccaacttctattgaaaatagtagtactactcat

SEQ ID NO: 15281 - DNA, 603 bp, Aquilegia formos X Aquilegia pubescens
  Predicted polypeptide sequence is orthologous to G1482, G1888
ctaaaaatattttaaaacctaagattgggaatgctcttacaaatggaaagaataaacccagattcagatctgagaaactgtaaatacaaaacttcccaaagaagaaaccaagcacacaagcgaaaaaaataaaaacataagataacatacaaaagtagtaaaaacaagaaaatcaagatttggggttggtgttcaactgttgagtgttgattcaattcatttcatttggctaccaaaaggacctgcctctcttatttgatggaggactaattgaaggaactgtaaaaccatgatcactccatctcttgttgttcatcttgattgggattacatctttgatttccttgaaaatcccagtctttttctcattgattgtgtgtgatggatgatcacaaggatttggagcttgaggtacccacatacacaaatcatcagaagaaaaacttcccagattggtttcaacttcagcatcaagaaaaggcatcaaatcatcattcttacagaaaccatgaggagcaactgaagatgaatccagaaagtcttcaacatgccatccaggcaaagtttctatcaagtactctgctatactacttgtagaaccat

SEQ ID NO: 15282 - DNA, 985 bp, Aquilegia formos X Aquilegia pubescens
  Predicted polypeptide sequence is orthologous to G1483
ataaatacaaacagatagatgaaacctaaaatgagaacaccaccttgcaagatggccaaagctcagaaccctcatacactgaaaggaatacatacaacacttgagacaagggatgttttttccttgtgatgctgtcagccacagttactatcgcctttggcgctttgagagagcgtcaggttggtatcgttggaagttttgaggagaggagcagcacatatcaggaacaaacactgaattgtcagatggtgagttccgaaagctttttggccaaaacagacctgatgctgtaggtggggaaggtatctctggcactatccatggaacctctggcaccttacctgaatactcgtctaaatcaaagtcttcatttgcaccttttggagttagggaaaagtcgttgtcccctagctttccgctgtcagccttggaagatccatgctccatgaacacatagctgttactaaaatctgttagcccaagaaggtcgtctaagggccactcgggaatactttcactcgtacttcctccagagaatgacagtttaggcactggtacaactccaaccacttgacgagacaatgcttcattattttcaccatttatcggcattgaactacctcgtactgattgagaaactttagctgcaggacttttaacagagtttgatgcctgctttgtagaagaaccaactggttcagtcgcttcaagccccactttaactccagtaagcagaaacctctggtgaccagatacgtaggcgtttgccgtgtgtatggaaacatcacatttccgacagagcaaagctcgatcttccagacaaaagaagtagccgacagtgtcctgacaaatatcacatttgggcatctgtgatgaataattggaaagaggaactctttgatgtttacttgctaacttattagcagcatgaactttctcatcacaagcccaacataaagcagcttcatctgcacaacaaagaaca

SEQ ID NO: 15283 - DNA, 876 bp, Aquilegia formos X Aquilegia pubescens
  Predicted polypeptide sequence is orthologous to G1488
acacaaactcataaagacatgatacgagtttaatacaagcaaatgaattttctaatttaccaaaattgcattaagaattctacatgaaaaaaaaattaaagaaatttaaccgatcagcttcgcctttttttggggagttttgttttaccggatgatgaaaatacctacacttgggaaaatttaaggaaaaaattactgaaactccactcacgagttttgaaactaaacctgggattaagtctatttttttttttgggggggggggggatgggtcatctaattagatcatctgggcaaaatctgacccggtttgatgatggatcaaatagtcatcaacaccaccaccagaaacatcaaacaaggcattcgggtacaaaaactgttcttgttgacaactctgcatttccttctgcctacgaagttccatcaccttacgatgtgaattggaatgcttagcaagcacaaatgtaggactagaagcgggtcgatattcgggaacaagtcgacccgatttataacggaccccacatgcattacaaagagtttttggacctaatggccctgttctccactgaggagtcttgtcggtggcacaatgtaaacatctccggccatcaccatgctcggaaatctctttctttttataaacttttgtcgttttcttaccggaattcgatgagatatcagattcggatgaagatgctgttgttgtggttgttgttgctgttgtcgtcggagataaaacaagcaaacgtgaagaccaattacatggagctactctagacctcttacttcgagcttttccaggaactgaaacttcgctttgaaatatcggatgatgataatgatgattgttgtttcggtcgtttcggtttg

SEQ ID NO: 15284 - DNA, 963 bp, Aquilegia formos X Aquilegia pubescens
  Predicted polypeptide sequence is orthologous to G1493
tcatcaatgcttgattttcagaagaaacatactatggatgtacctggcaatggttttcctgtaggcatcaccacaggggtatctggtcttcaatcgacaggagtgtttcaggatagaggaagcttggaagtaaaaggacccagaagccttcctactggttacgtgatctttgatgagcatccacagcacaaaagccaggagtggggtttgcagaatgtggatttaacttttgaagcatctcaacgccccaaacccctacagggcaatattaccttctctccaccagttttagctcatcaaggtttgtggtccagtcaaaggggtgggccgaatgggaatgtatctattgttggcaacacactagtttctttaagtgaagggaatcagctaggaacttcagaaagctttgtgcaacggggtaacagcctcccaatggacagttcattcagggtcaaggctgaaagtatgggtgatttgaactctgacaacatatttgctgccaaaacctttgatcaggatgatctcatgagtgcaattctcaaacagcaaggtggtggacagcttgaaaatgattttaactttgatggctatccaatagatgatattccggtgtagaagccctggtgatttccccatgataatgtttcttatgtcctggagtactaacgcccattctcatgacaggaaccacagtagctcaatatcactgtgggcattgctttctttctgtatatcccatgctgatggttcagctgtaaatttcataatatcaaaccacatgcaagtaggtattggttcttaacgttatccggtggggcttcaacatcctggaatattgagaatcatgtgaggtccgactgcatgatatgcaaaggcatatatgcaatttttgatgtcttctggtagctcaagttaacgagaaatgtctaattctaagaaattggttgattgtttgattagatg

SEQ ID NO: 15285 - DNA, 872 bp, Aquilegia formos X Aquilegia pubescens
  Predicted polypeptide sequence is orthologous to G1506
gccggtattgtgtaatgcatgcggatcaagatggaggacaaagggtacacttgccaattatactcctatacattctcgtacttttgcacctcctgattttggagactcaaagcaatcccgacaggataaattaccaccctcaacaaagtctaagagctggtacataaaagttcataatgaaagtaaaatggaagatgaacagtcatctgcagaatattactcatattcgacatattttgaggatgattcgagcaataaatccagttcaggatctgccatatcagtttctgagagctgtgttcagttggggagcacatatgggaatgaaatatcaggcccattccaatcaagtttctgtgactttcagattccttcaagaaagagaacaaggatgagacgccatagtccgtctcctgttgagaagctcagacaagaccttgtcactattttacagcagcaagattcatcttattgttctgacttttcagaagaggttctgcttttcgagagagaagatttgtcattatcttctgagataggtcacgggagtgttcttcttaagcctccagtttcttccaaagaagaggagtcagaggcaagctcacacataataggaaatggggtttcttccttaaatgatctgtatatgggagtgtcatgttggtctggacgatcccataataatgaaataagttcacgtcaattgggaaaggccaaagtgatccaggaaacatggaataccaatgagtttaaagagaacaaagtaaagaaacttgtttctacagatagatctttgaagagcacattttctggtgatccggatgacatacgaaataaatattcttctcagatatgcgtgaatgacaaatctt

SEQ ID NO: 15286 - DNA, 918 bp, Aquilegia formos X Aquilegia pubescens
  Predicted polypeptide sequence is orthologous to G1506
ctagacatcaccatcgctttctgcattttaagataaataatattacatcttttttgtcagcctatacaaaaaaccaccaactttctatgatgccaagtttgatacaggtcagcatacttcaaacagtagaaggggcaaaaaaccattcaccaaactgcagttacatagactagcgtgttcggcatgcaaagcaaatggatttaagcccccactcacggagcctgatcgatcaatgtaagctcttggccatttatgatcaaccagtgtcaggcaaggtgagagtaaattgtactactactagtacttgcttgctgggagctaaaactcgatgttgggtatagcagctctgcctgtgggaatgatccattggagggtacatccagaagcagatcttgatcagaagtctcatcgttgaattgcaaatagtccagcataagggagctcttgtccggagcaaagccaaataagcttcttggactgaagcaagagccttcatggtcaagtacgtcctttgtctcatagctgggttttgtaacagtcctcttgggacttttcatcatggcctgcagttcttgcggattttggccattgcggggtctctttacatgtaacatcttcgatcctgttgcaagttccttggctcctgttttttgtttattcttcacgtcctttaataggttgtagtgttcaatccagtttgattttgtcaaattgactaatgcaagcttcttcagagttttgaactcatcagcatcaacttctgaaagagatcgatcaaagaccccttctgcaagtagcttctggaaagaagataggttctccgcaaatagaagctatcaaacatgcttttaaggctctcaggaagtctgaaagtatccacagaaggtagatacttcatcaattgtagttgttcttcgt

SEQ ID NO: 15287 - DNA, 943 bp, Aquilegia formos X Aquilegia pubescens
  Predicted polypeptide sequence is orthologous to G1519
gctttattgcttgatattcccaacacattacttgggcaaatgcagatgcattgtcaatctcgtgctattagaaatctgaatgatatatacaaattaaacttgaatgggttacaggagtacgacacagaggacattctggtttttcgttgcaccactccataatgcagttccagcagaagacatgaccacaagttgtagctgttggatgctgccgtgtactaagacaaagtgtgcatttgctgataccaccaactccttgtgcctcggaaagactagtttgatcagaggcccagttccctctgtcaagactagtattggtagtaatcagattaccttcctcgttcaaaacaggcaatcctcgtgctcctgatgcctggtgggatccaagcgatgactgatgaactgaacttgcaatggatgataaattgctgcgtctcaaaccttcagcggtgatgatgcataattggattaaaaggaaaactcccagtaattgatatctgggccgttgattcaaaggctttccgatgaacatatagcgaatacctgcagctcgttttgatatatgataatatagaccttcaaagtaaaaaaacatgaggttggtacgaagaactaattgcaacatctcacgagcataaggaagaatatttggccatttttgcactgcaagcaaccacattcggtagaatttctgcttcaacctagtaaaaactgagaatgatccacttgatggaggcaaagataacctcccagtactaactaaagattgaacttggttttctccatcagtatcgtcaccatagatctcactggagtgtgaatcagaaagcatgataccacgtgcagccactcgagaactgattctttctgcaatataaggacagcagtttggtatacaatgaagagagcacgtcttgctggtgtagaggaagcccatatgtac

SEQ ID NO: 15288 - DNA, 903 bp, Aquilegia formos X Aquilegia pubescens
  Predicted polypeptide sequence is orthologous to G1521
tcaacacaaatacgataccattatcaacacaaatatgataccattaccaacacaaagccttcacttgcgcaacggctctgtccacaatggtgacattttccatgaatatttgtaccattccttcctctgcaggtgctccaccagattgatgttgatagtacagccaaactttcccacccaaagtaccttctattttcctttcgaccattacttcagaacctctccaacccgtctcccttggatcagtcgcataatctcagttcttgtagacctcaagtgtttccacacctcaccctggcaaagcaatgatgttccagagtttcctcagctgcattacagagtgcacaaactgcggacattgccctttgggtttgaaagaaacatttcttttctgctcactctcggcactcgtattcaacgacagagtcatatgtagccatttcgaatgagctcccagcaaaacatctcaactcatgccaaaacctatcagatcggtcatgtaagaatggtcgtaactgtcgtacaaacatatcctcaccagctgaacatactggcgagtcattgaacttctcatcaaggcttgacataaaaagcgatgtggctaaatgaacaattactaacggatctgagtcatgaagaatggcctgcaattcccttgttatccatggttctattcgctgttgcatccttgttttaacaacctgattcctcactatgtcttgttcctgaaaactattggaaggaagactggaagaggaactgctcgcaatccttgatcatatacattagctcgccattgaagaactctttgcgcaattccctcttcatgtttctgcccaaatgatctcctccatggcaattctctacaatgctggctcacaggttgccgccgtacttcattaa

SEQ ID NO: 15289 - DNA, 925 bp, Aquilegia formos X Aquilegia pubescens
  Predicted polypeptide sequence is orthologous to G1526
tgtgattggcttacaacaacaagaaatagggttctgcaccaataaatctcaatattacaacatcttgatatcttcttctttgtgagtcccagatcccagatggtttcttcagttcttgctggctgcctctttacaactttcaacttgcaagccggtgacagtggctttacacatcttggttgcctttggagatgaaggaaaccccttatggttaacattttcgtgttttagaggtattcaatgcacctcaagcgtcctaccagtccaaaatctgcaggtttacttgttaatttgccaataccaaaatatacacagctctagcttcggcagtcaggacggaacatatccatgtgattgaattcttcaggtgctgcagtccaaagaaatcagctgtatgaagctgatttctgcttacacaactgacaggctctggcttgagcaagtaactttcatgatctcttacctttttagtacacaacaaacaccatcaactgtgctcttataattttaggtaaagagcatcttcagttcctctatgcgtgcagaacggacttcttgatctgttagggcaccagatatcaatcgttgtttgcgagcctgcactgcctccattctctcttcaactgttcccttcacaatgaaccgtgtaatcgataccctcttagtttgaccaatacgatgaattcgcatcactgcctgttcctcaaccgctggattccaccatggatccttgtaagtgggatctgcaaaaggtccagaaaggcagtccactgactaaaaacgatgcttttggatcccgatgagcgaagtttttctagttcctggagaagaactgcaactttggaagactctaccagttcttctcacatcaatccggatcgactatcactagagcagtataagtctgcttgtatagtttctacaa

SEQ ID NO: 15290 - DNA, 885 bp, Aquilegia formos X Aquilegia pubescens
  Predicted polypeptide sequence is orthologous to G1539
ctggtcaaaatgcagtatatggcattggcaatcttattcacattcacatcacttcatatatttacttccccacgtttgcacttacatgatctatccattataccacaaaaacattgaaaaagggttcccaatttccaataacaacaaaaactagactaacctactagactaccaccttacactacaggagaacatatagacttgcattgggtaagtttccatgttaagcccttcaaaggaattcaaaaaactgtttgggactgcaattagtattaactgtttcaatgcaagctagttcacttgccttctgaacagctacatttggaccactttcgacgccactgttccgagcaggaaagagttgaagagtatgtgattcttcatgtttatcaacattttcactctggggttctttagaaatgttcaaatattgattgtttataattgctggattcattagtgttcctagaactgctgcagatgttgttgttgatgtggtggtatacattggagttgttgtgggagaagaacaagatagctgcatcatttgccacatggcatgtctatcaaccaaccttctttgttgtacttgttgtgcctcttcaaattgaattctttctgatatttctgctgctctttctgctctttgcattgaaacagaatcctgtgtaactgtactaaagttagtagtgaaaccccagtgtttggcttgttgttcatgaacttcaaaatttgtcctacttgaccctgattctttgttttctatgctttcgacacttccttgttgatgttcttcttctgcagatttggatcgtcttcggcgcttttgtctctcccttgctttgtgattttgaaaccaataaaacacattctttccttcaattt

SEQ ID NO: 15291 - DNA, 948 bp, Aquilegia formos X Aquilegia pubescens
  Predicted polypeptide sequence is orthologous to G1554
ccaaatcaaataaagaaatgggtgaacttagtttagatttgaaaccaacaacaacaataacaacatcatcttcttcaaccataacaacaaactatatccctgaatcgattcatgtttttttaggagaagtttctttaattggtaacgtttctgagaagttatcaaaggcagatgaatttattcaaaggttagaagaagaaatgaataagatcgatgcttttaaacgtgagctacctttatgtatggttcttttgaatgatgctattgatttattgaagcgtgaagtaatgcagtggaaaaaatcaggatcttcttctgcttctgtaatgatggaaaattttgtaccttcaaagactaattcttcatctgagattgatcttagagataagaagaactggatgagttctgctcagctatggactagtaatggttactcttctaaaactgatgatgagaagccaaaatcaatagtagatgagatggttaaaaaggatgatggatctgctattacaactgagaccaatttaccaagaaatggaggtggaggtgcatttgtaccatttaaaggatttactgggtttttgacatcaacaaggatggaagagaaagaaagagaaattcatcaactagaagcaagtctttctcttctaactcccggagttaggaaaccaagaactgaaccaacttcttgtttgatgaattcaaaaactactggtggtagcagaggacttccaacttcttcagctgagaagactcaaacaaatttacatctgcctcttcaatcacagcctccaaggaagcaaaggaggtgttggtcagctgatttacatcgtagattcctcaatgctcttcaacaacttggaggttctcaagctgcaactccaaaacagattagagaactgatgaaggtagatggtcttacaaatgatgaagtcaaaagtcatcttc

SEQ ID NO: 15292 - DNA, 855 bp, Aquilegia formos X Aquilegia pubescens
  Predicted polypeptide sequence is orthologous to G1641
aaatctgaagcacaatatcctcctaattccttctacagatcactacaaactacctcaaaaatctatcaaagtattcacaaaaaaaaaaaaaaacatgaaaaaaagcattgaaacagcaatagagcaatcaatctgaacaaaacaagactcaatattgcaatcttttgagaactcaagttactgttgacttagcctcgtgggtgacattgtgaggattgcatttgaaaaaatgtattgtggggtccaaactgagatgcatgaataatccctctatgaagatcttgacctccttccattttcatcccgtacgaattaacaccaaacgaaggtggcacaaacatgtttgcgcttgttgaattaaataccatgtttgatccgtcgtgaggctgattccaatcaaacagtgctctgggtgtgccacttaactcagaatgttgttgaagcatggtttgatccataggaggagatgtactattgtctggtgatgtaggtctgttatctgtgagacttacagttgtgatatcgtgaatgctggatcgtcttttatcttttcctcctgaaagttgccttataaagtatttttgagcatggctagctacctgagttggtgtccgagtgatcacaaaatttctagagatatttctccagtctcctttgccatactttttaagccccagtaagaacaacttatgttcttcttcagtccatggaacccctttcttcctttcttgatcagaaggtctacctgaagaacctcgctttccatttgagtcaaaggactgtgcaaatgttcgattgctcgcccagtccaatgtgaaagagagtagtatatccaggaattggaatcaatccagc

SEQ ID NO: 15293 - DNA, 915 bp, Aquilegia formos X Aquilegia pubescens
  Predicted polypeptide sequence is orthologous to G1667
acaagatttcaaccatttagtttcatacacatgggtgttaacaagtcccaatgcaatataaaaccatttgtatttaaaaactaaacattgtgatctgcaattagattcaacaaaagcagcagctactttccttagtggtagtaactactaactagtaagtaaaggatttggaaatgatgataacatcaaccaacgttttagctctttgtaagttggcgtcctgatgtccaagaatacacctcaggcggcaagctaccattggtgagcaaatttggtggcattccatacaagtttgacatgtctgcatgctggaaatggtgatggttgttctggaaatgctgattatgaacctcttcatcatctagaggaagacggtcaaaagttgcattcatgaaggatgcagccatgatcacaacaggacctgcagcaatcaaagcacccacaacacttccacctactacttgtccctgagctcctgctaagtaaattgtgagacctgtcataccaggaggtgctggtgggggtaagactgatcctagcaaagaaagaatctcaaaccgcccatggagggtcacaatagcaccagaggaagaaggttgcctaaggctaacattcatcacatacccagtcccactaagaatgcaaatacccctttgtttccgcctagcaaaatttgcaatgctctcactgacatcacaacctgagcttacctccatagcatgggcacggaaggcattggcactgtctcgagtgataattagaggtggctttggcttgttctttgagccagctggtctaccacgaggacgctttatggactctccctctgcccccatacctgctgatgttgctcttggatttggtactaccccttttgtgccaaaacaaggaccctggttattgatcttgtcctcg

SEQ ID NO: 15294 - DNA, 907 bp, Aquilegia formos X Aquilegia pubescens
  Predicted polypeptide sequence is orthologous to G1782
aaaatattacgtagatttgaaccatatcatatcaaatcaaatgaaacaaaaattcagtataaaccctgtactatatagagaaagcacagaagtcaaaacctgcctgaaattcaaatttggtgatgccgataattgcgaagaattgtaaatcaagtacaaagaccacacatgaaatgtcattatacctcctttcaccaatgctggcttgttgacaatggttgtacaagtacctcttaaagacttattttcagtttccagttctttcctccaacaagtggcaaaaaccttccaaccaatttcttattatgaagctttcactgaaaactctattcacagtagatagttcatagttgcacccgcccaaaaaccaaacttctacctttataaatgttgtacaaattatcagctcttcattaaccagagaactccaacccaaggaacacttaacaacatccgccaggaaagagaatatccaaaactttgattgtgaatcagataccttggcatcatttcagctcctttgaagcatctcatctttaaaccaatccaaaactctgattatgaagcagatatctcggcatcgcttcagctcctttgccgcatctcatcatcaaaccaagtaaccttcttccctttgccgcatctcatcttccaaccaaataacctttttgaactcctttaatcaagagggactataacatttgcacctctttagacttgtttttgtgatatcaagaacatccagtccagcagagaccctcaaaaagtgctaaaacacaactccgccataactacatgttacacttttggaagtattacaatgcaatatctcacttttgactgatttacaacatgtacactcttttgaacataacccactcaagtcgacacataaaccaagtgggca

SEQ ID NO: 15295 - DNA, 899 bp, Aquilegia formos X Aquilegia pubescens
  Predicted polypeptide sequence is orthologous to G1793
caactcatctccatctatcttcctcgtttgatcgaaattttctaacgttcaagaattcaaaccgctcgatatccatcgaaaactgatgcaggacatgagtttgttgaattagtgagtactcaattggttggttggttggttggtataatgacgactttagttccagagagcgaaaatgttttgatacagaaaggaagttctgaggaagattcaagttcgaaagatgattcaaagtcaattttggagaaagagtcatgtagcagtgagagtccaataagcaatgatattctaagtggaggaggtgaagggattcctgaaactaatactactacaataagtgttggcgaaagtcctgcaactgtaagcagtatgactataacactggctgaagctcctgttagtaataacaatgggagagtaggtgaagcacctacaagcagcaataatgttataagggttccaccggagaaaaggtcgctttataaatttggtcaaaggacttcgaactttcgtggagttacaagacatagatggactgggaagtatgaagctcatctttgggataactctactgtgagtgaaggtcgcaagcgtaaaggaaagcaagtgtatctaggtggatatgaaactgaagagaaagcagcacagatatatgaccttgcagctttgaagtattggggcgcaaatgcaaatacgaaattgaactttccaatttctaattatgaggaacaactggaagagatgaagaatatgtcgcgagaggagtatgtcaattctcttagaaggaatagcatttgctttacaagaggctgttctatctaccgaggagtgacaagacaaaatgttgggcggcgttggcaagctcgaattggccgagttgcacgtggtaaagacatcta

SEQ ID NO: 15296 - DNA, 937 bp, Aquilegia formos X Aquilegia pubescens
  Predicted polypeptide sequence is orthologous to G1835
atcaaaattcaaacacatttcagatttcctaacaacaaatgaactacaaaaagaattcccctaagctgccatacaaaatccaatacctacctaacactcctaagcactaaccttcttacttctagcattttcactctattcctttttagtctcttcttccttttctctacttgctacacatctattgcttctatctcatttggtccatctctgtacaaataaccaaagaaccaagaaatgaaagaacagccagatcgaaagagaggaaaagctcatagcctaacacattggtctgtgccttcacatgtatgcatcccatagcctgttacctggcacaaactctgttacggctgcttcgtcatcctcatcatcgtttgccatctttgagccagtggtgcctctcatttctaatactttcttatgggaattggaatgtagctttggaacaaaagttgggcttgctgcaggtcgatattcaggaaaaagccggcccgacttgtagcggacaccacaggcattgcaaagggtcttcggccccaaagggcctgctctccactgaggagtctttgttatctcacaatgcaggcatttcctaacagccatgggtagtggcagaactgattgctccattgaactagaagtgggggccaaccttttcttcttcctcttcttctgttcggtagatggaggttttgaaagtttggtcgacggattggactctgcaaaattctcaaactctgaaactgattcaagagaagaggacatagggctggggtcagtaactgatgatgtgggggaaacaagtgaaatgactggccgatgattgaaggttgtagggcgtggacgtttagtccgagcacggccagggacaacagtctcagggctaattggcattgttcttcctccagagcaggaactgctactttcaagaacagat

SEQ ID NO: 15297 - DNA, 912 bp, Aquilegia formos X Aquilegia pubescens
  Predicted polypeptide sequence is orthologous to G1855
taacgaactcattcctcttacaactggaaaaatcagaactgccattgatactggatgtggagttgcaagttggggtgcatacttgttaaagagagacatccttacaatgtcctttgcgccaagggatacacacgaagcacaggtccagtttgcattagagcgtggtgttccagctatgatcggtatcatggcatcacagaggactccgtacccagcaagagcttttgatatggcccattgttcccgctgtttgattccttggcaaaaattcgatgggatgtacctgattgaagtagacagagtgctaaggcctggtggttattggattttatctggacctccaatcaattggaagaaatactggagaggttgggagagaagccaagaagatctgaaacaagaacaagatgcaattgaggatgttgccaagcatctctgctggaagaaagtgattgagaagaatgatctttcaatatggcagaagcccatcaaccacattgaatgcgtagagaaccggaaggtttatcatacaccacatatctgcaaatcagaaaatgcagatgcagcctggtacaaagaaatggaaacatgcataacccccctgccagaggtaagcaactcagatgaagttgcaggtggagcagttgagaaatggccagaacgtgcatttgccgttcctcctagaataacaagcggctcaatcccaggtatcaccgtggagaatttcaaagaggataatgagctatggaaggaccgtgtgtcacactataaaagaattattagttctcttcctcaaggaagatatcggaacatcatggatatgaacgctcacttagtggattagctgctgctctgatcaaatttcctgtgtgggttatgaatgttgtccctgcccacacaaaccaaaacact

SEQ ID NO: 15298 - DNA, 929 bp, Aquilegia formos X Aquilegia pubescens
  Predicted polypeptide sequence is orthologous to G1863, G2334
tcaagtcagaagaattatacaaaatttccgaaaccaacaatgaagcaaagcaagcagtaaagtttgaaatcctaagaactaaactatttttattcattgacaaaattaagtagttctagagatcagaaggtcaaagtaaaagctcaggtgctaacaccacttaaatctgacacagatcgatgagtggctccacgcaaaacacttgttggcgaagaactagaagctgaatgttgcaatgcctcagcaaggggaccccccattgagctcatctgatgatttccccattcagtaccccagctcaatctgttatgttctcctgttcctatgtctccatctctggaactttgctcatctccatttcctgtcgccaatttcagggaaaagtccgatgatggttggcagtcacctgcaggcaagttttctggtttggcattgatgttaataccatttggttcttgttgagatcttggccagtcatcaaagaaatgccgagtctgcccaccatctgttctgttctcactgtacttgttatcacattggtcctccaaaagtacgatttcctgttttatttctggatatctcgtgttcagtggagttggtgctggcacagaaagagaaaaatggatcccagtagcctctgtggtagaaggtgaagacccaatcaaggtagcagttcttaggccaccactggctgtgggttgggtggagggttccacaggctttcttgaacggtttcggcctcgatgcatgtggcgctcacaatacttctgacccgccaccacatcttttgcacatctccacttcttcccatcagttcttcggcacctacccggctctggatcaacagagtttccccagtacccagttcgcaacatagatggtttataatagctatactgttgaagatgaagaggttgataaagataaca

SEQ ID NO: 15299 - DNA, 947 bp, Aquilegia formos X Aquilegia pubescens
  Predicted polypeptide sequence is orthologous to G1863, G2334
tttgaaacaactcacagcactgtactagaacaataaaacatttgaaaaataacaaaaatcaggtgcaaacaacagaaaaaactggtatctatgggggggagtgagagtatggggtagttcttaaacaaacaaacacaatcaacattacaaagttatgatgactaaaatgttgctaaagttcaggtgctaacactactagtgtcagatgcagttcctcggggcagctcatacaggacgcttgttggtgaagcattagaggtagaagatcgcaatgcctcagcaagtggacctcccatagagctaacctgatggctgctccatcctgttccccaatccagtggtcgctcctctctaccattaccatcgggatattctggtttaactccatttcctgttgacagtttcaaggaaaaatctgaagaaggatgccctggagttgagatggagaggcaagttgtagaagaaccgccatttcccccaactccattggtatcttgatttaatctgggccaatcatcaaagaactggcgaaggagctggccatcagaccttccttcaccacaaaggttgccactctgcatattcagtagtccatttcctgctttgttctctgaggttctctgattcagctgaataagattggtaagagggggagatccagagagagcaaacggagttccactagcatttgttataggcaaagcagcaggaggattgggggttttctggtcaccctctattgcggtgggtgtggcagtttccacaagctttcttgaacgatttcgacctcggtggacatggcgctcacagtacttgtgggcaggcacaacctcccttgagcatctccacttcttgccatcagttcttcggcatctaccaggctctggatcaacagcattcctaccccaatatcctgactgcagcatagttggttgataatgttgata

SEQ ID NO: 15300 - DNA, 934 bp, Aquilegia formos X Aquilegia pubescens
  Predicted polypeptide sequence is orthologous to G1868
ataaaagttacaaacaaagaacatacacgaataaaatcctcaaaaccagatgttagtacaacaacatcagagtcgaagtggcaacctcaagtagttttagcgatcactcaaggtcgagattatagaccatataaaccaaatacaattcacccaaagaaaacggaaataaagctctcagtcctaatagttttcagttagtgagcaaatagagctcattcctctattgtcacaactttcgtctgtgttaccctaataagcttacaagggaagtaaggtggacgaatttacaatagttgggttaagaaaattgtcgcagaagctcttttcttcaagggtctggttagtctcagctcttgggctactgccagtgctgctgttggaaagtgagccaaaagaggtcttttgtaggacacccgttggagatagctccatctgaaggccaccatcccacccttcagtcatgaggttaagggctgataaggtactcttctgatccccagatgcattgttggtgtggttaaggacctctccaagaggtcctcccatggaagactcccaagcgactggtatccagtttacttgtctatgggttggttcatttgggaaactacccacccccaaacccatctgaactggatcaaattcccgtgataatctcagtggggagagagcgagtttgtcatgagttggtaaggaagataagaagtctgaagtcataggaattgaaatagagagctgggtccggtctaattgagtttcttctacttcaggccaggcaattctagatctatcagattggttcttggggcagtcatcaatgaaatggcgaagggggtcgtgcaccctggattcttggctattaagctcacgggtactaccaaagttttcacaatctatataggagcttctttgtgaggtatttagaagcgaaaca

SEQ ID NO: 15301 - DNA, 941 bp, Aquilegia formos X Aquilegia pubescens
  Predicted polypeptide sequence is orthologous to G1868
aggtgtcgccgaactgatgggaagaaatggcgatgctcaagagatgccgttgcagaccaaaagtactgtgagcggcacatgaacagaggccgccatcgttcaagaaagcctgtggaaggccaagtaggccatgctgccaccggaccagccaccacaaaagtggtatcgatggcatcctcgccatcttttgtggcctccggtggtggagcgtccagtaatctcaatgtcgcacaaaagcaggttaaaaacttgccccccagtgcggtggatgcttcatcaaacttacacatgaacaggatctcactgaacaatggaagtgctggtggaagactgtatgattcacaaggtctatccgtgctctcaccagcaacaaatatgaacgccaaggacacttcattctcaatgctgaagcaacatatcccgtgtgaagagtcctctagatcagagtttggactgatatcctcggattcactgctaagtaattcacaaagagggtcctatatagactgtagaaagtttggtagatcccctgaccttaataaccaagaacccagagcacaggatcctgttcgttgcttcattgatgactggcccaagaaccaatctgatagctccatgatttcctggccaggaattgaagagacccaaggagaccgcacccaactctctatatcaatccctatgtcttcagacttctcatcatcatccccctcaccaactcatgagaagctcgctctctcgccgctgaggttatcacgtgagtttgatcctattgagatgggtttaggagtgggtagtttctcagatgaacctacccaaagagaggtaaactggataccaatctcttgggagtcgtccatgggaggtcctctgggagaggttttgaaccacactagtaatgtttctgtgaatcacaagagttcctcgtcaacccttaactc

SEQ ID NO: 15302 - DNA, 932 bp, Aquilegia formos X Aquilegia pubescens
  Predicted polypeptide sequence is orthologous to G1868
ggaaattttaataaaatggcaagagttgatgatgatgatgatttctctactactactggttctgcttctaagacattgttaagggatccttgttcttcttcattacttagatctaataatgttcatcaccaacaaatgcttagcttctcttctccaaaacctgattcatactcatttactaatgatttctatcaccatgctctctctacttatgctagaaatacaggttggggttgtggaagtttgaatacaaatatgcatggaggtttgacaggagctagaggaccattcactccatcacagtggatggagcttgaacatcaggctttaatttacaagtatatcaatgcaaatgttcctgtaccgtcgaatctgctcattcctatcagtaaagcctttaatccatctgccttctcggcgttttctggatcattcagacccaatacattgggatggggctctttccatctgggtttctccggcaacaatgaccctgagcctgggagatgccgccggactgatgggaagaaatggcgatgctcaagggatgccgttgctgaccaaaagtattgcgagcggcacatgaacagagggcgccatcgttcaagaaagcctgtggaaggccagacaggccatgctgctgccggaccagccgccacaaaggtgatggctatgtgttccggtggtggagcatccaacagcctccctgttacgcaacacaaggttgacagcgtgcaatctaatgcagctgattgttcatcacacactcacatgaacaggaaattaccaaacaacagaagtctgggaggtagattgcaggattcacaaggtctgtcagtgctttctccagccgtaaacatgacttgtaaaggacaccccgttctcaaatttgaaacaacatatcccatgcgaagaggccacaaggcaagagt

SEQ ID NO: 15303 - DNA, 889 bp, Aquilegia formos X Aquilegia pubescens
  Predicted polypeptide sequence is orthologous to G1880
gttggcattagattccggatgcagaagttgtttctctttcaccaaaaaccttattggaatcagatcgatacgtttgtgaaatatgcaaccaaggatttcaaagagatcaaaatcttcagatgcatagaagaagacataaggtaccatggaagttattgaaaagagaaacaccagaagtaaagaaaagggtgtttgtttgtccagaaccaagttgtttacatcatgacccatgccatgcacttggtgatcttgttggtattaagaagcattttagaagaaaacatagcaatcacaaacaatgggtttgtgagaaatgttctaaaggttatgctgttcaatctgattataaagcacatctcaagacttgtggcactagaggccattcttgtgattgtggccgtgtcttctccagagtggaaagtttcattgaacatcaagatgcttgcaatgccgggcgtattaggtccgatattcaaacgatgcagccggcttgcttgtcccgaacagcttcgagtcccagtccatcaagcgacaccaacttcagtacagctccatggccaggtttgcgagtagtaaagccgcctgctgagaatatctttctaaacaaccgaaacaatccttccacgccaactgatcaccatcacaatcttgagcttcagcttttaccatctccaaatccattatcgaacgcctcggtgtctcgcaactcagatgaaaatcatgcaactcagttacaactttcgattggatcgtgtgaccatggagataagaatgaagtgagcaagaataaagcaagtaaagctgcagagaaaagctctccaaatggtaaaaacacaacagaagaatcaatgtccatagcctcgaggatgaaagaacaagcacaagagca

SEQ ID NO: 15304 - DNA, 926 bp, Aquilegia formos X Aquilegia pubescens
  Predicted polypeptide sequence is orthologous to G1928
cttattattatgtattacatcttgaaaaaaaaaaaaagagaaaattaaacaaaactaatttacaacagtttcatgacaggcaaaaatgcagaatgtttaggagcaatgtgtctgcaggcagcatataagagaaacaagggtttcaaataattcatgaaagaccaagtttgcttagaagctaaccttgccatggttttttgttttgattttgctgctcatagggattggaagaggccatgcattggtctagttcagctatatttaaaaagtttctatgaggaaatgctcttagacccaagaaatctctagttaacccatcatttccaccaccacggccaccaacaccagcagtactactagcaccaccaccttcaattgttttttgtttctttgaaagatgctcagtagggtttttagcactctttgagttcaacatccctccaaaagcctcttcaaatgaagaaccatcaaacacattctcagaattattgagagaactcatttcttgaagtagagaaggagcagaaagttggcccacactagttttattcccaaaagcagtcaagctgtgcataaacccattttccaacacttcatgtgaagacaaacctaaaccaaaaccagatgtaggagttgtagggttaccagtatttgcagacatgtgagtctgttgtacaggtcttatcaacatgccagatgatgatgatggtgtactcatagttgcacccatttgagcagctttttgaagtaatgctgttgctgacatatgtggagaggatgatggattgtaaggaggaaaggaaggagttggatttaaatttgtgttctgatgatgtggagttgaagaagcttgttgactttgtgaaaattcttgttctaacctattacaaaagattgatgaagatagatcaccaagtgaaggttga

SEQ ID NO: 15305 - DNA, 898 bp, Aquilegia formos X Aquilegia pubescens
  Predicted polypeptide sequence is orthologous to G1928
cttacttagatactctttccctcaccatttttttgagtttctaggaactgggtcatcttgatttgttcatatattagtgtgtgttttcttcacttttcatggtcttctagcaagtaaggtgattaaaaagcaaagatggaaaacagtggttgatgaagggtttggtccagtttgtaccctcttttttccttttttctttgacactcatcttaaataatttaagacaaactgaaactctttactggtagtgctttttttctttttcatagtcctttttgtctttctataaaatggtattgtctttagatcctatgaactgatcttaccactctgatctatatgtgtgactcatgaacaaaccatagaaatcttatcatcatatcatcttccaccaaatattagtacctatgtgatgatgaagaatttgataatccaacaaagcccagttttggatgaaaacttgtctaatttgacttgtacatctgatgaaccaatagcatcttcaggaagtagacctgatgttggaactatgtatccacaacagtcttttgcttcacctcaccagactcaaacttcagcagtcaagaggaagagaaacctcccaggaaacccagacccagatgcagaagtgatagctttatctccaaaaactcttatggcaacaaataggtttttgtgtgaagtttgtaacaaagggtttcaaagagatcagaatcttcaacttcataggagaggacataatctaccatggaagctaaaacaaagaacaagtaaagagattaaaaagagagtttatgtgtgtccagaggtaacttgtgtgcaccatgatccatcaagagcacttggagaccttacaggaatcaagaaacactttagcagaaagcatggggagaagaaa

SEQ ID NO: 15306 - DNA, 1004 bp, Aquilegia formos X Aquilegia pubescens
  Predicted polypeptide sequence is orthologous to G1938
atggtaaaattcatggatctagctcacttgaaaacaaagaaaatgctataagtatgattacaaaatcctacattcttttcacaaacacgctaatagctatataatcactactaatttatgtcctaataccaactaaccataaattgcttacacaatagcgacatgccttcgaaacaaacaacttaacaaccagctcccaaagttccacctcttgttagagtcttggatcaagctatgaagagatagaagtggcataccaatagccaatactcaaatctcctcctcaatttgacatcataattaaaagcaaattctgacaaaagactcatttccactagtcccttttgtaactttcttgaaactcttttcaatccattactttaatgtcttgaaccttgagaatcatcctcatcatcatcatgtggttgctgctgctgctgctgttgttgttgttgttgttgctggtgctgctgttgttgatgcatgacaactcctcttgattgaaccatctgctgataaaactgtaaagcttgaggattcaataccccggtatgcacatcttgagataatcctaattccaatccaggaagttgttaattattaccaacccccatgaatgaatttaaattcattgtacctaaatttgatccaggcatttcgaaaccatgaataccgaatttaggcaaataattcaaaccatcactactcagattcgatgtcggttggcctgaagaaggatgaaaccctggtacataaccactgacagagggccataaacttgttgttactggggatctaaccaaattccaattggtcctactactactggacccaatttcatgtcccaattcactgatctttgtttgtaaaccaactgaaacagaattcccctgttgtgaaactgagctactagattgaactaaagctgaagctggtatagttccagtacctgtagcggcaattattgatggttcagcatgttgtaataaccattgtatagtttc

SEQ ID NO: 15307 - DNA, 825 bp, Aquilegia formos X Aquilegia pubescens
  Predicted polypeptide sequence is orthologous to G1950
tgaattgttagcatatatcattacaatttgaggatgatcacagaaattaccctatcaacctgataccggggttactaatctgctgctagaaactgtaatactgtacttgagctaatatttcagtttttacaacattgaagataaagataaagatgaagacggggctcctctatttaggaggaagtgtgaaatgttatcatatcccattgctttcgccatatatattggggttgcacctctcatactcatggcgttaatattggctcctctgttcaccaacagctcaactgtctcgaagttgcctccctcgactgccaagtgcaatgctgtgtggccttctttatcatggcattccaagtccatcccagactcaatgagcattgaaacaatatgtttgtgtccttttattgccgctgcatggagggccgtcagtccatattgatctttgtaatttggatttgcacctctcttcagcagctgcttgagattgtcaacttcgcctcttcgtgctgttgttagtaccatttctccctgttcaagtatcttgacaacctctttatgccccttatctcgagctatatcaacagctgtacgtccatccttagctgatatcataggatctgctcccatctccataagcaactctaccgtctgacggtctccattcactgcagctgtatacaatgcggtccatccctcatcacacttagcattcatatctgcacctccttccatcaacatcttaacaaactctacatttcctttacttgcagccacatgcaaagctgtctgaccatctctatccctacaatccaaagatcctcc

SEQ ID NO: 15308 - DNA, 925 bp, Aquilegia formos X Aquilegia pubescens
  Predicted polypeptide sequence is orthologous to G1958
acaaattcaaactacaacatctggcaagccaataatattcagaagttcataactaggaagaatatactgaccaagatgaggttaacagcctactcacaagtataaaggagagaaatctcaaattcatcagtcaatttagtctctcaaggtcaaaatcatgttcttcaatatctacctaccatatcttatcagttcaaagccgagttggcagatgatgtagctctatcatctactttggaacgctttgcaggtggagaatgtgaacgagtactctcgctaacatctgctccaacatctccgctgtcctcatggcttgatgccttctgatttcccctatccttctgggagcactctaccagtgtcgccctagactcaaggacttctgttcctacttcaggaaggtcatttacctttgctttcagttcatctttggagggtgactgctgctttaggtcagacaatggggcagaggcctcatccttggtggatgaagacgctttctgtcggtcggcagttgacttgcattgctcctcaaacatcttctggagatattttccttgctcttctattcgcaattgtagatttctttgaatctcaagttgttcatgcagccgtctctgaacttccatttgcatccgcaatgcttcagttatctcaataccagttttcaaatccagagaagagatgtcgtcaatggtagttgcccttttttctgaatttccttcagatggctccggtctgtacctcgctgtcctgtatttctgcagatgactttttacatggtatatagtcaaaccttcaactttcatcagcttcagtacacccttgggagtagctctttcactaccaccaagcttattcacagcttctacgaagctctcatggagttcacgtgtccaccgcatgcgtggctttgttgaggtac

SEQ ID NO: 15309 - DNA, 868 bp, Aquilegia formos X Aquilegia pubescens
  Predicted polypeptide sequence is orthologous to G1958
tttgaggttcatatctacacttcttctttgtgtttcagatggagggtcgctcttccgtgaccatacagagaccatcgaaccaagctggtaacgttggagtgtccggatgtatgtcttcatctttaccggttctgcctctgcctttggaggagaagtatacaaaattttcctactcccagcagatttgctttgaaagagaattgatgtcagaccctgtcgctccatttgacactcccttagcctccactggtgaaaatgttgggcacaaaatttcatcaacttcaggattctgtactgatctccattcctcttctagttcaacccatgcgagccatttgagaaattcaccatttatttcccaagtatcaaataatggagtatcttctccaatagctttttcttctcattcaggaatcatacgttctacaccttcaagtagttgcaacaaaagaaacaacaatgcttcatgcggaaacatcctagaccagaaaagtcaaattgaaaatagtaatggtgcaacagcaagtgaggaacatacctcccaaagtgattggcagcaatgggcagaccagctaataaccgatgatgaaaatttggctgcagactgggatgagcttctccttgacacaaatgctgtggattctgaaccaaagacggcatcccaggcacccaaacaatcttcagttatctctccgcatcaggagcgtactcatcagcagccttctgttcaatctcgagaattagccatggttactagtcccttatccccggtttgtggctcttcaataaagtcacgcatgcggtggacgcctgagcttcatgagtgctttgtacaagctgtcatcagcttggtggaagtgaaagagct

SEQ ID NO: 15310 - DNA, 956 bp, Aquilegia formos X Aquilegia pubescens
  Predicted polypeptide sequence is orthologous to G2035
caattactaaataaccaacaccaccactccactccaccatcaccaccacccaataatcctttctttctttctttctttctttcttttatatattaacaataacaatcaatttcatatccgtgtgagtgtgatccttgtatctcgaaagtaatctcaagagaaaggaaatataattaattcgtacaacaaacaacaacaacaacaacaattgttggttgttatggataccattggcgccaattcttcatcttcatcttcacttcgactcatctctcaccaatctattttctctgcggttcgatctggagacttacacactctgaaacaactattggaaacatcaacatcagcatcaccatctacttcttctgattctcctcttccggttccggtcaataataatactagtatagctgctgctcaactactaatgtgtttacagaatgattccggggaaactgctctttacatcgctgctgacaacaatcttgaatccgtcttctcttatttgcttcacaacttcgctaatcttccttcccttctcatccgctccaaccttgacatgaatccctttcatgttgcttgcaaacgcggtcatttagggatcgtaaaacaacttgagtatctggcctgtactttgtcagacttgtgattcatcaaacactagccccctttacacagctgccgttcaagatcactttgacgtagtgaatgccatactagatgctgatgtcaactctataagaattgtcagaaaaaatgggaaaacttcattgcacactgctgcaaggtatggtctttttcggattgtaaaacaactcttggacagagattcacaaattgcttccgttaaagataaaaaaggccagactgcacttcacatggctgtaaaaggaaggatacttctgtagtagaggaattattgtttgctgattcatcatactcaatgcccgtga

SEQ ID NO: 15311 - DNA, 911 bp, Aquilegia formos X Aquilegia pubescens
  Predicted polypeptide sequence is orthologous to G2116
ccaaatttccgacgtgagcattcatacaacaaaacctgaagaacttcacaagtcagagcacaaacctatggtaataaggaacaacaaatgctacaaattgaatgaaaaaataaggaaatagttgaccaagagaagagcaaaagataatggaaagaatttttgtcagtctatggacaatctagcaaataaaccatgggcattgattatgggtaggtcagcggatgtgaagttaaggactcagttacaaagcactgctgcttccactggcagagatagaagggccttcggatttcacaagatgcgattctctgttgttactactaatatccaacccttgaaatcggcctagtgggtcctgctgcgacatttctgagaaagggtgactgctgcttcctggcggagtatgattcatcatgttagactgagaagaatgaaactgagagaactgcatgttctggtgccttccttgtcctggttgttgcggaagtgagaacattgacgatgtattatacggcatatattgcattcccatgttgaatgcctcactgtgactcactgcttctccagttgcaatcttgagcctctcaacttcctgtttaagtgcttcattcaaagcatcacgtaactgagcttgctgttccatagcttgtaaccgaagctttagttctgtgttctcgctgctcagaccagtcgtatccctctgaaataatgtgagctgtgcagaaagagtagttgcttcagtttgaagagtctgaacttttctctcaagttccaatatatagcgagctttacgctctttggagcgagcagcagactgacgatttgcaagaattcttttggctcgtttaggatctaatgcccaaagttcagcaagtttatcacgagccatagctttcttagcatccataaca

SEQ ID NO: 15312 - DNA, 924 bp, Aquilegia formos X Aquilegia pubescens
  Predicted polypeptide sequence is orthologous to G2140, G2765
atttgctgtgtaacgtttgacccttatttggagttccattctttctttctttctttctttctgtcttacttagtccactgttttctctttcttcttcaatcttgattttcgtagcgaattcatcgtttctgctaatttagtgtcagagattaacacttttaacaagtgggtttttcaaattgagttccaaatcgacctcgaaatgcttcaattcaagacaatcaagaagaaaatgtggatgttttccaattgaaacaacacacttgttttatttaaatctaacatagtagttttgttttgtttgcataatggatgttatgagatcaagagggggacttttgtatgttggtgaagaacaaggaaagaaactacatcttcgtactttatctttcttatggtctgctcaaaccaatcgtcctcctggttttgatcctcgttagtttagtttatttgtttgttcaaagtttgtgttatttgattagttgatttctaaagtacacaataataattatgggttcttcgtttgattggaattctgggattgtttttgacaatgatattaatagtagatttttcgtgcaaaatttgcccctttcacctttggggattaacagtggatcatctcattctcttcctatttcatttccactgccaccttcttcatcttcatcactggttttggatagtgataagggagagcttgttagagctcctgctaaattggggcaaaagggtaagacagaagctaaggcgattgccgctttaaagactcatagtgaggccgaaagaagacgcagagaaaggattaattctcatctcaatacactccggagtcttgtgccctgcacagaaaagatggataacgcttcgttactttgcagaagtgattgataatgtgaaggagctgaagcggaccacaactga

SEQ ID NO: 15313 - DNA, 810 bp, Aquilegia formos X Aquilegia pubescens
  Predicted polypeptide sequence is orthologous to G2140, G2765
ccaaccttaattccctcaatacatctctagcaacctacctttctctcttttatttttcattttattcatagctagggaagacttcaacctttgttctttccctaatacaatatatcccaaggagagaatattcaaaagggaaatattgagaataaggagatagagatgtgtgggaagaaagaagatgatggggattgttcacaaagtattcataccttacaaggttaccaagaacaattttttcttcaacaacagctacaacaacaacaacaacaacaacaacaatataatgatgggtttttgggagcaggaggaggagtagggagaggaggtttactctttcctgaagtttctcctataataccatggagtttccctcaagttcaagccttcaatccagttcatttcacatcaaacccaattcgtgatcatgatccatttcttgttccacctccaacatcatcatatggagctttattcaatagaagagcttcttctttacagtttgcttatgatggttcttcatcagatcatcatcttagaatcttatcatcagacccacttggacaaacaggtcatcatcatcatcatcatcaatctggatccactccctttggacttcaatctgagttgggtaagatgactgctcaagaaatcatggatgctaaagcacttgcagcatctaaaagtcatagtgaagctgagaggagaagaagagaaagaatcaacaaccatcttgctaaattgcgcagcttgctacctagtacaaccaaaacagataagcgtcattgcttgcagaagtgattcaac

SEQ ID NO: 15314 - DNA, 967 bp, Aquilegia formos X Aquilegia pubescens
  Predicted polypeptide sequence is orthologous to G2141
aatttggtatgtctagcaatgaatctggtgaaggtgaattcagcggtggtggccaaggagaacactctattccggaaaatgatggtggtgagccttcctcgtcgaagggcattagcacaaagaaaaggaagagggctgctcagaatgctgaaattgatcaagataagggagcttcacaacactctggtgaggctaaggctgatgataagtctaaagagaagggtggtcagaatattaattcagcgaccaataagtctgctggtaaacatggtaaagatgtctctcaagcttcggatgcccctaaagaagattatatccatattcgagcaagaagaggccaggctacaaacagccatagtcttgcagaaagggttcgaagggaaaaaatcagtgaaaggatgaaatttcttcaagagcttgttccgggttgcagcaaggtcactggcaaggctgtcatgcttgatgagatcattaattatgtgcaatcactgcaacgacaggttgagttcttgtccatgaagctagcaactgttaatccacgactagacttcaacattgaagggatccttggaaaagattcacgaagtggtccatcgacattaggattttcgcctgatatgagtatggtccatccccagatgcatccatctcaacaggctttactccaaacaggaatacccggtgttggaaactcgtcagatgcacttcgtagaaccattaattctcaattggcagccttgaacagtggatacaaagatcttatgcctcagaaccatcaacagattgcgactgggtgggatgacgaactccacaatgttgtacagatgggctttggcaccaatggccctttcaacaatcaagatttaaatggtcctctgccaccaggccatatgaaagttgagctttaaacatcacctttcttctatcaccaaccaagtgaaagcaccttctgtgtttttttgcattg

SEQ ID NO: 15315 - DNA, 915 bp, Aquilegia formos X Aquilegia pubescens
  Predicted polypeptide sequence is orthologous to G2141
cagactggtggtgagatcatgcctcggaatttatcacagtttccagctgattccaacttcattcaacgagcagatagattttcatgttttaatggtggaagtttcagtgatgtagtaaacccctataacatatccaaatcaatgaattcttattccaaggatggagcaatgattcgaggctcatctgaagctctttcacccaatgcattgaagaatgcattaggtgtccaaactcaaacaaaagagaaaactgatgatgtagcgggatttgtaagagccactgatgaaactacgaatgaatgtaaaatgtccaatgagactgaggtcagtggcagcgatcgtcaagtaaaaccatctttgctggagactcctggagaaccttctgcatctaaaggacaaactgtgaagaagaggaaaagaatttgccagggtactgagatcgacagaactgaaggatctccacaacttcaaagtgaaactgctcaagatgacaatgaaactgaacagaaaaatggacagaagagatcaaatgttggtaaaacaactagacatggtaaagagagctctcaaaattcagatgcagccaaggaggattatattcatgttagagcgcgtagaggccaggcaacaaacagccatagtcttgcagagagagtgagaagggaaaagatcagtgaaaggatgaagtttctacaagacctagttcctggttgcaacaaggtcacaggcaaggctgtcatgcttgatgagataattaattatgtacaatcactacaaagacaggttgagtttttgtcgatgaaacttgcaactgtcaatccacgacttgaccttaacattgaagcttgcttgcaaaagaaatcatcagtcacgggtgtcatccatgtttctttctctcagatacaaatatggtca

SEQ ID NO: 15316 - DNA, 955 bp, Aquilegia formos X Aquilegia pubescens
  Predicted polypeptide sequence is orthologous to G2142
tgtcaaagtcaaaacaaactgtgagatcagagcatgtacagtcgatttcgatgggatttcaatgggaaagttcacgcgtccaaagataattcaaaatgaccccaccctgaagaagaatagtagtaggtatacaaataaaaggacctaggaagaaaatatccatactagtttccttgtgccttttgcctcttctgcgtttcgtcagtatcctcaccactgcttccatccctagaatgtgttctggcttgtttagtggtagaaggatttgcatggtccttggcactggatgtcgcagtggttgatctgccaattgctcgctttccaagatcaacttggactgagatgctggcatgtgaaagatccacaccagaactttgaagtgcttgagtcaaattatttaataatccttgagagtaaacactggcaatgctaatagtccccccttccattgtcaaaacctccggttcgttcgatgtttcacttgttggacaatcagttgtccaaggttgattctgccatatggttggaggctgggatgtaatgttttcttcatcagagattggtctttgtattggttggaccatcccatcattgctaccaacaggagtgaaaggatttggttgcaaaggagttggaagtggtacttccttgtttgcatctccttgctggagttccactgttttaaaggcaacacccaagccatgatcagcttctattagattttgtgcatttgcaggcatcgttggcataatactgacgttgttctcgttcacctttccagcaaacattaaccctggaccagagccattctttacgagacgagaattctcaaccataccttcactagtccaataactgtatctccaagggctaacttcgaacgctcttgatttccatgttgggactcatacttgtgtaacttctcatgaagaattgacatactcgataacctcta

SEQ ID NO: 15317 - DNA, 904 bp, Aquilegia formos X Aquilegia pubescens
  Predicted polypeptide sequence is orthologous to G2142
tttgtatgtccacgaaaaccagagagcaaagaatgtacaaccagattgctgctgaccagtagtaacactaataacccctcaatatgagaaaagcaaaagtaaatcaaagaaagaatggtaagaatttattctgtcctgagcctttttcgagcttgatctgagtcctcgccgctactttcaactctggaatgtgccattgctcgattgctacaagggtttccatcatgcttaacaccagatgccatagcgttcagtctgtttgtagctcgtttgccaatatcaacttgcactgagacgctagcttgcgaaagatcaacacctgagctctgtagggcttgtgtcagattattcaataacccttgagagtagacacctgcgaggttaattgtgcccccttcaatagccaggtcttcatgttcattcaaagtgtcacttgcatcagggcactgagtcgtacatggtctgttgggccacaactgggcctgaggctggggcaccatgttctctacctcagatatcgactgctgctgatgttgaacagcaggaacgaaaatgtttggttgcacaggaatgggcataggtccggatttctgagatccttcagcatggtgatccattgtcttataggtagcacttgtgctcataccaggatcaactgggctctgggtagttgctagtatggtaggattgggaatggtgttatcgtcaaactttccagtaaacatcaaagaaggtccactctttaaggtttgggaatgatcagccatactttcactaggcgcatggccatttctccatggtgtcaattttgtgggctcttgattccaaccttggtatgagacttcatacctatttactttttcttgtaggtattgaatgtattcaatgacctctaataagaatg

SEQ ID NO: 15318 - DNA, 931 bp, Aquilegia formos X Aquilegia pubescens
  Predicted polypeptide sequence is orthologous to G2311
aatttaaaactcaagttcaacttagacaaggatctctaaaccaaaactaactcaagagtactgagtcaggatgttctgcatgaatccatcttagggattattcctctttgaaaaaagaactgtacatgagtcagttgttagcaaacacactattgcaacacaaagcaactcaccctactaatctaacaaaccatattattttggtatccatatacaagttctatcagttgcttccgaaggactcctcttcttataataaccttcaacatatgattacctgaatcttaagccatgagcacaatttcaccctgggtacatcgttcataaatattctttgctaactgaagcattgaatctgattcttcaaccatccttgcaaccctttctgcctccttgactgcttctgatgccataaatgccttgttctccgcatcagcaatcatgtaggcagcactgctcgctgcgttttcaatctcctcgagcctgattttattagcgatgcttggtgactgctttgagtgttggtcatccttttgcttttggttggaacctattcttggtccaaacgagccatctttttttatcttatagttgttttgaaccttttcaagtttatcctgtgagacaagtcgtctcaactttgaactcaacaccctcctgaaatttggtggtaccacttgctttgcctcaatgaaattcatgatggcaccaatatctgacccagtcggatcttttaagccagtgattgcatcaaaaatcattgtattgtacttagtttttccttcagctgcactctttgaagaatccatgagagtatctgcaggttcatacagaacaagtgcattggaggtaggggtctttgaattggatgatgggagagctggagttggagttgtggttaaagttgaaattggagttggattttgaactg

SEQ ID NO: 15319 - DNA, 952 bp, Aquilegia formos X Aquilegia pubescens
  Predicted polypeptide sequence is orthologous to G2379
actaacacgctgacagtattacagtgaacaagagtgtgaaaagaaaatccactgcttcaatacagttgatcatttacatgtatatttcgaatatgcatatataacataataacataccaagggatctaatcctttcccagatttctttcggccacgatatgggggctttcaggaaatccactctatccttccaactggaacatgcttgggacctcacagctattgtttcttcccagcaccaggcgcatatttaggacgcttagtcttctcaagctcaagttgagcttccataaacatctgcattctctgaaactcaagatccttagtaaactccatcctctgcctctccaattccataatttgctgctgtttagaactctcaattctctcataaacctctccaaacttaacaatcgcttttgctatttccctaaacgcctccccatcatcatttggcaccgaattcccaataaccccattactcttcctactcctactcctactaccaccaccaccaacaccaatatcaaccatcaaatcttcttcatcttcatcatcatcaccatcaccatcatgagaactcccagtagatccaaatggagaagaattcaatctggatttcgacgaagagccaccagaataaatcacagctgaagaattataatgattatgattaggattagggttagggtttaatttcctaacagaaaaattaactggagaagaagaagaaggatattgaggtaatggtggtggtggtggtggtttaagtttaggagtaataacattaggtgtaccaataagttgatcaagatgagaataaaaaggccatttagaaggtaaaggtttagatctttcaagtttatacttctttttaatagtatcaattcgattcttacattgaacatcagtttttcttggttttttatagaatcttgacgtgaattaacag

SEQ ID NO: 15320 - DNA, 624 bp, Aquilegia formos X Aquilegia pubescens
  Predicted polypeptide sequence is orthologous to G2382
attacaaggccgcgaccctcaatgaaaatccttaaactactgcctgattcatcggttgtgaattatcaatgctgttttcatgcggaagttctgatcattttcctgcacatgcatgtattactcgcttaaattaccaacagaagcattgatctcatcttctccatcgtcatcatcatcatcttcttcttgttgtatttttgctatctcagcttgtgcatgctctaaaatctcccttttttgcaattccaaatctctatgaaactccagtctcatcttctccaattctcgcatctgcttccttttactttcctcaatcttttcataaatctctccaaacttctgaatagaatcagcaagcaacctaaacgaattccgttcatcaccattctctctacctctcacttccttaggtgtaagaccttccgaagactcagaactctgaggactatctctcatctcatccaactcattagcacaattcaaataaacattagtatccataaacacatattcccctgaatccaacccacaagccaatccacattgcctcaaagaagacgacatcaacatatccatcttcttaaaataaacccatttactaatattactaccaccattttcctc

SEQ ID NO: 15321 - DNA, 915 bp, Aquilegia formos X Aquilegia pubescens
  Predicted polypeptide sequence is orthologous to G2404
attccatttctccaaaattgcatccatttgagtacatgcaagaaactgaaaagaagaaactgttgatttctataaagcatgtataggaagggaaccatagaagaattaatgcatgctttccttcagagttgaattctgtacagaataatgaggggacagaaaagactcgggatgtaaaatcctctgcgacgaaaggaagtgtcgagtttctgcggtcttttcagtactgagaagctgcagctaccttgcagacagggcaagtgttcttctgcagaagccactgttttatacaacacatatgatagctatggtcgcactccagcttccccacttcatcatctgttgtgtattcttcctgcaaatttagacatttggaaccttagtttatgggacatacaacaaatgagaaggggagaaagagccagaaagaaagaacgacttataatttaacctacttgacatatgctacatttccaatccatgtcgggggagaaacgtgaggacagagcgcctaataatgcatgcttcgttttcctgaggcagcgtaatatctcatcttctctcaatccagtactcacataaccaattttatcaccgagttcaagcaactcctgtttgtaccagcaaaaatgagaaagaggtaatatgatagaatcgagaggtaacatcaccagtgattgatttgtgtaaaccgtgaaatatggttgcacaaagactgacaagcaaactttcaagtggggagtaaactgcacacctcgtatgacatacgatcaacatcaagacgccaatccctgtgtctatcatagccatctgatcttcctcccatcattagactactttggaacatcatgatctgcaatttcatgaatggagaaaaccaccacattgtcattgttgtttctatattcatataaa

SEQ ID NO: 15322 - DNA, 957 bp, Aquilegia formos X Aquilegia pubescens
  Predicted polypeptide sequence is orthologous to G2456
gggttcccctttttattgctctagcttatttgtagctccactctctctcttttctctctcatctctttctctctgtctttctctgtccctggtgtgtttgttcttcctatcttttgcttctatttcgtgagccaaagcatcaagtcttaagaccagatccaaggagagaagtgtttgctgatccatcagtcaatcagaatatctccagtcaatcaatcaatcaaatcaccaactcatcacaaatcaaatcaaaagacaaaggaatcaacaatacaccaccaacaacaacaacaccaaacaccaacaccaacaaagataaagaagatgtcatcctcttctgctttttctttggaccacctttctccttccgagcagctgtgttatgtccattgcaacttttgtgacactgttcttgcggtgagtgttccttgtagcagcttgtttaagacggtcacggtgcgatgtggtcactgcaccaatcttctttcggtcaatatgcgtggattgcttcttcctactggagctaatcagcttcattttggtcacagtttcttctcccccactcataatcttctggaagagatcccaagtcccccaccaaacctgttgattgatcaatccaatcctaatgatcatctcatgatgccggtcattcgaggtggaactgatgagctaccaaggcaaccagctgctaatagacctccggagaagagacagagagtcccatcagcttacaaccgtttcatcaaggacgagatccaacgtatcaaggcaggaaatccagatataactcacagggaagctttcagtgcagctgcaaagaattgggcccactttccacacatccactttggtctcatgcctgatcagatcactgctgctaagaaagctaatgtgcgccagcaggaaggagatcatgatgttcttatgaaagatgggatctttgctgcagcaatt

SEQ ID NO: 15323 - DNA, 900 bp, Aquilegia formos X Aquilegia pubescens
  Predicted polypeptide sequence is orthologous to G2457, G2459
aaggaatttgacttggttcaagtagctagctagggttatgttaagatctagctctttatacacctgggaacaagtttaagcttttcaacaatcttcactagctagtaactagctagtctcatcaactatccagttcatctgtattaaaaagtctatttgatgttattgtaaatgctatctatcttttttagtattattctttgaaaattttgcagtagtactgtgtgtttattattcctactaacattcttgcacagtcttatttctttgataaaaaattcagacagaaactgcaaagcatgaagatttctagtcaccacactcaccaccacataatgtttatctttccttttggtctatggttcctttcatcatgtcaatatactttctttacctctctctcttctctttctatatctctgaagagaatctcaatagcagatctacaccttgatcatctctctatctctctctctctttaatcatgttcaccttattcatcaatagaagtggttatgaactttgtgggttttgttgcagtcaagtcgttttcttctctctctctccctcctttcttctctgttactatattacttttctttgtagtatttgtttttggtctgttcaaaaaagtcaggcgcaccaaaagcaataagaaatagctgaacatttggtcatcgatctatcattagtttaggagagagagagagcactttgttcttacatacttatttttgtactggaattttgttcaaagagaacattcaaagcttactaattgcaacttctctcttttttctttttttttttctttctaattatgtgtttttggattgcacgtcagtgttccatgcaccagtttgttcaatgtggtgacagttggatgtgggcattgcgcta

SEQ ID NO: 15324 - DNA, 919 bp, Aquilegia formos X Aquilegia pubescens
  Predicted polypeptide sequence is orthologous to G2520
tgaaatctgtcagatgatatatggaaaagaatgaatttctaacatgctgggatggagactgttcagatttttaagtttgagctcatcatataaacagaaacatagctccatgcctgatgaagaaaataatagtggtccttgaaataacctgatagatgggcagaatatatattccacaatgactgaaggagaatacacagtacttcatgcaactccatttgagaaggactttataaacttatgtcgttctttcaaaaccaccaccgacttgcatgtgtagccattctggtgctgatccttggccatattcccttgtagcttgtgagccgaatggtataccagaagcatcaaaaggctgtgcgctaaaatctttcggtgagaatccatcaatggcggggttcattcttgaattaactgcttcaagcttcattgaaaggaactcaacctgacgctgtagtgattggatgtaattaataatctcatcaaggaccatcgctttgccaatgaccttattacatccagggaccaaatcttggagaatcttcatcctttcactgatcttttctctcctagctctttcagctaggctgtggctatcagtagcttggccccttcttgctcgtacgtggatgtagtcttgcttaggtgcctcggaaggttgattgctctgttcggctggcttattacctgcgcccgaacttgcttcaaactcagcttttgaatcaccattttcatttctgagacccgaaactttaaggcgtttaccatcaacatcattcaagtcattgccactgctagtagacataagcttggaagactcatcttcagaaccagttgcatctcttctcttcttcccacttgcatcaccatttcttccactatactcagtaacaacactagaatcatcaatagacatatt

SEQ ID NO: 15325 - DNA, 869 bp, Aquilegia formos X Aquilegia pubescens
  Predicted polypeptide sequence is orthologous to G2550
tcaattctataaaaacaactacagaatcagatgaatataaaaagtaatgcagaagactcacctcatccaacatggatagaagttttgtcaatttattctgtaaatcctgtcgttcaccaggtgatagttcaactgtagagttactagtttgttcttgactgtctgtaggaattccggaagtagaaggtgcagtagtactatcctttgatcctgcatcagtctctctgaagctcttggaaccaaccccttggtgtttaccagcatcatgttgtttcagagcctttcggacattgactacttcatcaagcagttgttgtgttgccttgaggtatttggaattgggaatggtacttgcaaaacctggcagtccatatggagaagtaactaaatgcatctgcttggggtctaaggaaccctgcaggttgttcaatgcttcctgtttgattgcatcatgattgcctccctgaaaaccaggctgataataatctgcatttcttgattgcttatttggagaattttcctcatctctacaagtaccagatccactgccaccttctcctgaaatggtcggatgagaagccaagaaggaagagaggccagcattaggatgtcggaactggaatgaagggacaggaacagcagaggagaactgtgtgctaagactaagggatagtccctgtccctgcatattctgcccaccatctaggactcctaattgtggacgcagaccctggtggggatcctcattaacagtatcacggacaagatcatctctggcaccacttatttgtgcaccaagagattgaatggttgtatgtccaccaattggctgcataaacatttcgtttcttccatctctccatgagttg

SEQ ID NO: 15326 - DNA, 953 bp, Aquilegia formos X Aquilegia pubescens
  Predicted polypeptide sequence is orthologous to G2592, G2713
ctaaagtgagctgttactctgatgctgcagcacagtggtaataagtttacagcaaatgactgcattaacagccactatctcatctcctaacctactgagaaacaacacattttttacctgacacttcttgctgacctttttctattcacaagctaatttggtgtcaaagctgctcaagcagatggcaaaggcctgaaatgcagagagagggtagcggtagtccatagtgaacatgtctttcccaaccttgccaaattgcagtatcaccttatcatgttctggaggggcaggctgtgatggtgttggcgcaccagctggcggttgtgttgcagcaatgagctgaaaattcttgacagaggcaactgttacccgcccacggaaattcaggcaccaacactgtaactgttcgtgccaccttggggccttgttcctcaaaaccaagggtctctccttgccttcttcatcatcatcccgtgtgccaacaatatcagagaaacgagagctactgaattccaccgactggtcaatcgactttgagaaggatatactcctaaatgagtcttccagacaccgagggaggagctcaggctgaccaggaacaatacccccagcatcaagagctgaagcaggaatggagtgcatgctgcagtgcatcctgcgaggtcctcgcgttcccagaacattcagctcatatgtaacttgcgcaatattataactgccagttggcacttttggggatactttcttggagtagaatctacgacttgaccgtcctggtgcggggaccatagcaccagtatatggaggctgagtatcataaattataaattttgttccaaggaaatttgacctcagttttcctatgtatgtgttgcttgatctagatatgttatcagcatccatggaaatcacatactcagtacaagtagttcggcgattcctctttgcagaga

SEQ ID NO: 15327 - DNA, 925 bp, Aquilegia formos X Aquilegia pubescens
  Predicted polypeptide sequence is orthologous to G2592, G2713
aactctaattaacagattaaacataaatacatattacaagaaacttggggcacattgcccattacataacctaatgcctgcacaacttctatactcaaagttaccagcgtactacacaatgagaaatgaagaacatcagggataaaagagcttcaagttaagagcatatatttacaatgagcttttatgtaagaagcaaaaacataatcataatctgtcagaagttcaggtcattcgcacgctggttttgtatcaaagctgctcaggcagattgcaaaggcttggaaggctgagagtgggtaacgataatccatagtgaagatatctttccctattttgccaaattgtagaattactttctcttgctctgctagagaaacattgtgagaaggttcggcagctgctacaagctggaagttcttaacagaggctactgtcacacgtcctctgaaatttaagcaccaacattgtagttgttcatgccatcgaggtgctttatttttcaagataagaggatcctttgcaccctggactggtagtagtgtatctaggcttgtggagcttacatctacttgtgcttccttggatttcggagcagataggatagcaaattgctcttcaagagattgagggaatgttgttggtgtaggggctgtgccaccatcctgaatcgcagaaatcggtatggaattcatgatgcactgcattctcctagggcctcttgcacgtagaacattgagttcataagaaacagaccctatattgtaattaccagctgggactctcggagatacttgcttggaatgtattctccgatttggtcgacaacttgattggcccgcaatgtcatgtggaggttgactgtcataaatagtgaacttcgttcccagaaaattggacctcaatttccatatatgtactacta

SEQ ID NO: 15328 - DNA, 729 bp, Aquilegia formos X Aquilegia pubescens
  Predicted polypeptide sequence is orthologous to G2592, G2713
ctctctactgtttctaatttatccataaacctcaaacatttgttaattttcttttatcttcattctcagggctttcgatctatctaaattttatttaatttagaaaagatttgatagagtgagtttgactgatttgaaagttaggttcaatttctgtttgaagagaaactcatctttgctattcaagtggttggatttttgttgaagaagctttaagtaatcaaagatatgaaggtttgagctgattgatttctatttatttgcatatacatgtgatagatttcaaattggtggatctgttgatgaatctgttattttcgagaagataattatatagtttataatcacaaattaagccaaagtttgagttttttgtttcttttttctatcttagaatgcttgttttgtaatttttgatacgaattagaaggaattgaggttcttttagataagtttatttgagttattataagaaaggtggaaaagaaagggattgatgcctctcaaaagcattattcaagatgtgaggagtgagattggtagcatttcgagaagggggtttgatgtgaaacttggttatggattaagatcaagatcacatcgggtagttcaagatggattggtgccagtagtggttattgatgctttgaagcaaagttgttgggctaatatgcctccagagcttcttatggatgtgctcaagaggatagaggattctgagagtgattg

SEQ ID NO: 15329 - DNA, 928 bp, Aquilegia formos X Aquilegia pubescens
  Predicted polypeptide sequence is orthologous to G2592, G2713
gacatcaatccatttgagagataaaatgaaaaagcctccacccccaatgccatgtctgtgaatagtcaatatgtacacaaacatacaacaacacgtacagagaaaataaagtcaggagcctttataactaaccggtaagtctcaatcattcactcacttgtcttggcacaaaccttccttgtcaagtgcttcttgggacatccaccttgttcctctacagaattggctacttgggtgtttttctttgttcgtcattcacatgcaatcttggtatcaaagctgctgaggcagatggcaaatgcctggaaggctgaaataggatatcggtaatccatcgtgaacaagtcctttcccacttttccaaactgcaggaggaccttgtcgtgctcctgccctgctggtccattctcaggagaagccaccagctggaagttcttcacagaagcaactgtaacccgcccacgaaagttcaaacaccagcactggagctgctcatgccaccttggtgctttgttctttagaaccagcatttcttctttagggttggccaaaggtcctgatgaaaaattctcggaacgtgacgacttggaacgaaaaaatttgagcgatgggagagaatccaagttactaggtctaaattcagtttgtgttgggaccacccctcctggttcaattgcattggcaggaatagcgtccattgtacactgcattctcctaggacccctggaacccaagacattcaactcatattgaacatgagctactggaaaattgccagcacgcactcttggagagacttgcttcaatccaactaacctactggagcgacttttggaaacgctggctccagcgtgaggcggctgaccatcaaatatcacaaatttggtccccaaaaagtttgatctcaacttgccaatgtatgtcccac

SEQ ID NO: 15330 - DNA, 923 bp, Aquilegia formos X Aquilegia pubescens
  Predicted polypeptide sequence is orthologous to G2655
gaagtttaagagctgctaaagagaagagatgagttcttctttttttcatcactttttgaagcagtagtgaaaagcacaactcctttaccaactttctttctttctttctcccacactctttcttcttcttcttctttcaagacttgaagagttgaagtttattagttactagtatttttcatgattctatcttattaaatgttactagaagcatttgtttctgatgatctcaacaagtacttcttaaacaacatgtatgacaatatgtgttctactactactcaacactacatccatagttcaacttctacatcaaatctattcaagaacaatgttgggaatagtggtgggattcttttctctaacaatgagagttttgaagatttaacaccattagattcttcatcttctatgcaattaggaggagggagctttatgaaaactcaagatgatgcatcaaattctactacccctcgaagtcgaaagcggtctagaagaccaagagtatgtaagaataaagaagaagcagaaacccaaagaatgacacacattactgttgaaagaaatcgccggaaacagatgaatgagtaccttgccgtgttacggtctcttatgccggaatcttatacacagaggggtgaccaagcttctatagtaggtggtgctatagaatatgtgaaggaacttgagcaacttctgcagtcgcttgaagctcaaaagcgccaacaaacgcaaaaagaaggaactgatgaaagctcaagcaacttcttccctcctcctttttcgcagttcttctcatgccctcagttctcttggtgtcaaattcccgggtgacaatccatccgagaatcggactgccattgctgatatcgaagtcacattgattgaatctcatgctaatcttcgaattctatcaagaaaga

SEQ ID NO: 15331 - DNA, 932 bp, Aquilegia formos X Aquilegia pubescens
  Predicted polypeptide sequence is orthologous to G2655
tttacttgttcaaaaaccttgtacacaaatgcacacaacataaaactaaatttgaacaaaagatttggtgcactcatttagataagtagatagcatgcttggggtggaaaactgaaaatggattaggatttaggagttatggtaattttcaagtttcaactcaatgcagcagaagtagcagcagcagcaacaccttcttcttcaattctttgtaacatttgatgaacagcagaagcaattccatctactgatttcagttggcaatcttcttcaaccttaacactaaaagaatagagaacaagttgttcaacagtagtaacattaagatgaagaactgaaagatgaaggttttgaaaaccaacaaccatctttaagatctgttttggtcttttctttgaaagtattttgagattagcatgactttcaaccattgttacttcaatatctgcaattgatgatttattctctgccattgattcctttgttgcatttgatgatgaattgttgttttgattacaacttgaagagtattgaggatatgcgaagaaatctgcaaaaggggttgttgttgttgttgttgctgttgctgctgcttctggttgttctttaatttgcttttgtgcttcaagtgattgaagaaattgttcaagctctttcacaaaattaattgctccacctattattgatgcttgatcactcctttgaacataagaagctggcattaaagatcgaagaacagcaagatactcattcatctgttttcttcgattgcgttcaacaacaatgtgggtcattctttgattctcaacttcttctttgttcttattaattctagttcttcttcgctttcgccgcgattagtactagtagtactagtagtatttgcagatgtcttcataagtagagatgattcatcacaaactcttcagatg

SEQ ID NO: 15332 - DNA, 884 bp, Aquilegia formos X Aquilegia pubescens
  Predicted polypeptide sequence is orthologous to G2655
aattaaagtacaagcaagaagctagtgtgtacaatgcatttgcacgagaaaaccagaatttccatgcatttacatgagagtacgaacatctgaagaaaaagtacatcatgactttgatatctcaagtacatatcttatatctagatctaaaatttgtcatgctggtctggaattattgatcatattaattacttaatcaagctggttaaaagttctcttgaatgtagaagatttcctcaacgtgtgcagtttacaagctagctcttgcaatgttgttttcagtagagcaggagatctttccagtccgtcagatatcttgcactcagagtgatgtagtactttgcttccatcgcgacaatgagtagaactaacaagttggagattatgagcttcaagttcatctaatatagctgacaacaacaaagcctgtgaagtacccttaatatctgtcaaagtaacattaactcgatcacctctaacccgaatagcaacagataaagaaggttcaggagcaaccttaatatcacaatcacttgaattcaaaaaatccgatgaattcctgtcggatagtagttgaattgttggtgaaagtgaagtcttattattagacctattcaagggaatggattgtttttgaagtgacccaagttgagctgcagctaatggaatgtatttgatgatttcgtctagaattgaagattgttctttccgaacggtgttgggttgaggaagtaaagaatgtagtgataagaaaagttctctcatagattttctacgctcacgttctgctaatatgcggcgctctcttgcattaattggtgagccagatgaattcctttcggatgatacatcccaatcgttattccattcgactgtcattgttt

SEQ ID NO: 15333 - DNA, 946 bp, Aquilegia formos X Aquilegia pubescens
  Predicted polypeptide sequence is orthologous to G2717
aattattcttccgtaagaaaaacaatcttcgttttgttttcaagttatcgactttgttcttaagcgctctctctctgtgtttatcttaggttcatatgccagtttagaaatcatacttcattcgaaacatttgattcaatagacggcgacaagcttctaaatgggtgctccgaagcaaaaatggacatcagaagaagaagcggcccttaaagctggagtagttaaacatgggtcaggcaaatggagaacaatactgaaagatccagaatacagcagtatcctgtctttgcgttccaatgtggatctcaaggacaagtggagaaacatgagtgtgactgcaaatggatgggggtctcgggaaaaagctaggatggcactcaggaggagtcaacatacctatagaagtgatgaggaatcgtcagaatgtccagatctcgatagcgatgaagaggaagaagaggaagaaattgttggcgctaagcctctcactatttctaatgggatgttgcagattgctagtccaaagcaatcaggctctaggctggaaaatttaattatagaagctattaccagtttgaaggagcctagcgggtctaacaagactaatattgcgatgtatatagaggatcagtacaacacacctccaaacttcaaaaggatcttgtcagcaaaattaaagggtttggccacaaatggaaaattgattaaggtaaaccgaaagtacagaattgcaccaagtgcaattttctcacaagtacgaagaaactctgtgatgcccgtcctgggagggaaggcacaagggagcctgttagagttgagaaagatgatatcaggaatcttatgaaatcccagattgatgcagaacttgcaaagatgcgaactatgagtgtgcaggagctgctgcagctgctgctcgagcagttgctgaagcagaagctgctcatgg

SEQ ID NO: 15334 - DNA, 901 bp, Aquilegia formos X Aquilegia pubescens
  Predicted polypeptide sequence is orthologous to G2747
gtttgataaagttgtcacaccaagtgatgttggtaagcttaatcgacttgttatacccaagcagcacgctgagaagtactttccactggactcaactgccaacgagaaaggactactcttgaattttgaagatagatgtgggaagtcatggcgatttcgatattcttattggaatagcagccagagttatgtaatgacaaaaggatggagtcggtttgtcaaggagaagaagctatatgctggtgacattgtttctttcgaacggggagctggtgaatctgtcaaagataggttatacatcgattggaggcgtcgatctgatgttcaggatcctgggatgttaccgcctctacctcttctccatcccctctctatgcccaggtctgcaccttggggaggactaatgttgccaccaaacatgccaatgcacatgccacgggacgatatggtttggcagcggatgaattatgctcagaatcataatcatttccaaaggactaattacagtggcatcagtgccaatggttacaatgtagtgaactccggatcaagcccaattttttatttaagatcatcagctccatcacaacagattggggtaatccaacaaggtagggatgcgccgacggtattcaattctgtgccagtagtccatggtaaggcatcggcgaagagattcaggctgtttggtgttaacctagaatgtccaatgccagaaaaccctgaataccaatttttggattcggcaacaataaatcatcctacaattggttctcttgctccctcccaaattcccccttccattccacctctccagctaaggctctataacagtgaatcaccaccaagagaacagtctgattcgccaagggaaaacgcgtctatgtcattggatttggac

SEQ ID NO: 15335 - DNA, 887 bp, Aquilegia formos X Aquilegia pubescens
  Predicted polypeptide sequence is orthologous to G2754
tacttcagttataaagattagaacatcaatggttttaaactcgagcaattacatacggcactttaccatcttccatttcatattgctacactagacaacaaaaacaacaacactagaccaatctccatccataaaaaaaacccttctacagtagtttcaaaatgaactttccccaaagttcccaaaaaaaggggtcttcaaatagcttctcatctatccgctcaaaaatcaggtagagacagttagtccacagatcatcaacatcatcctcttctacacaaaaagaaactcgacaacgacagatttgtacaaacaatcaactgttgagtgtcgacagcataccaccagtcttagttggtataaccacctcccatcctggccctttcaagggatatatatcattcaatgctgtgatcttaccatcatcagctgaggtgccattgatcagatcactacgatccaaaacccttcgaagattttcatcgcttatctctgtctgaatcatcttctcctcaggattttcctcatctcgaagcagagccaatagatcctcttcctcaaagacattcaaagaattggacttagtcctttcttgctggaactggcctttcccaatcaccacatgctcaagcctcaacttactgaaagctctcttcaatacgcgacactctactgactgtgctgtagcgagtctatacacatgaactggacgggtttggcctatcctgtggcatctatccatggcctgcaaatccatttgagggttccaatcactatcatacaatatacaggtgtcagctgaagtgagattgatacccaaaccaccagccctagtgctgagaagaaatattcttagattgctgtttacatcattgaactcctggatt

SEQ ID NO: 15336 - DNA, 850 bp, Aquilegia formos X Aquilegia pubescens
  Predicted polypeptide sequence is orthologous to G2763
tcaacgccgtcccttctctctctctgcaactcttcttttttaacttctctctgccctgcccatctaaagaaagaatctctccatcatcgatcgttttcttctaaaagcaatctctctgaattctgaacaaataacagttttcttttccttcttcttcttatcttataaggtttgataagaagattcagatattcgaattagaagaattctgaagattgatcgatctaattcgaaattcgaatcaaatggaaacatcttctactatgattttgaatccagaatcaaattcaacaagcagattgatagaatcaaaaagaaagaaaagaaagaagaatcttcttcaaattcaaaacaaaaaagaaacaacaagatggagaacacaagatgaagaacaaaactattcatcaaaattaatcgaagcacttcgtcaagttcgtcgtaattcttccaccacaacaacaacaacaacaaacgccaccaccaccaccacaactaccacagtttctccaccttccagtcgtattgttcgagaagcagctgatcgagctttagcagtagcagctaaaggaagaacaagatggagtagagcaattctaacaaatcgattaaagttgaaattcaagaagaagaaaccaagaatgataacaggcaagtgtcggtcaaagaaacaacaagaagaaagtatattaaaacttaaaggtaaaaaacaaccggcgttacaaagaaaagttcgtgttcttggacggttagttcctggttgtcagaaactttcatttccagttattctagaagaagcaacagattatatagctgctttagagatgcaagttagaactatgactgctcttac

SEQ ID NO: 15337 - DNA, 948 bp, Aquilegia formos X Aquilegia pubescens
  Predicted polypeptide sequence is orthologous to G2766
cttcgttttgattcagtgacaaacaacatgagaaactgaaactccctaacacacaaatacaccatttgcttccaacggtatttttcacaaatcatacccaatcttaataggttaatctaagttgggttcttgtggaacgtctaattaggactgaacagctcatcagcattcatatatgatgtaattaatcccaaaggaaaagaataagtaaaataaccactactatacaacataaggcttctatcaacgtgcatgattgctatatttgatttggtgagtttcagaaatgaatccggctcaggtggccgctaccttctacatcacctatgccacccttgctttgatgttggaagttcttgatcttcctgtctagccaatgttataaggctggcttgcttgagttgcttccacaagtgcaatgatccagatctttattaagtttctggacttcggtctggaggcctttgatgtgttgtacggccaaatctaacatgtctgctgtgcttgtttgcttgtccatgttaggaacaagctcttgcaatttcctcaacttgtcacttatcctcgtccttctttccctctcggctatacttcttggatgagtagcaaaaccacgcttagcacggatcttgcaaggaacagagtcaggttggatctgcagaagcttctcaacagccgccatctctaatgaggtcctgggtaagctaaactgggagtctacaccactgagcgcagcaacgatgtctccgtcgattgtcttagctcgtttgtttgatggttgagaaaacataatcgtattgccatcatcccatgaccccatttgatacctgccagaaacatacgcctgtcctgcatttcgtacaccatcatcagaactacttccatctccaatactctcactgacttcagatatctgagaaagagaatcctgtctggtgaagctcaatt

SEQ ID NO: 15338 - DNA, 821 bp, Aquilegia formos X Aquilegia pubescens
  Predicted polypeptide sequence is orthologous to G2789
agagacaattggaatgtaagaaagatagcaaattccatcaatcttttcttcttcttcttcttcattttcttcttttgcttctcttccaacttttaccgatcacatggggtaagttgtaggaaacttttctcatgaaatcaaacttaccaagaatacttgaatttgtacatgcttcctcaatcaatcaagcagaacatgaagcatcaaatcatgatcatcaaactgtgaaaacgaagatattaaaagaagaagaagaaaccaagtaattgaaaccctaataatctccaacaacaactcatcaaattctcttcatcagcttgaattcctcaaagggtttcttagcaattactcataggtaatgggaaagtggaaataaggtaggaagaggtgtttcttgtgtgttttgtcaataaggtggacgaccagttgcccaataggcctcactaggtaattggcaagaattgagaaggttgggtggtaagccttgaaagagtggtgcattaggatctgccataagttgctgttgttgttgttgttgttgctgctgctgctgttgctgttgttgaccaaccattcctggggaatcaaggggtcctccactttgcaaagggagtggtggctcctcatcttctagggggagccgctcataggctgcgttaccaaatgacgcagccattattactaccggtcccgatgctaaaagttgtccaacaacgcttccaccgaccacttgcccttgccctccggccaagtaaatcgtcaatccggtggctgatgggggagctggtggtggtagaaatgacccagatagggatagaatt

SEQ ID NO: 15339 - DNA, 968 bp, Aquilegia formos X Aquilegia pubescens
  Predicted polypeptide sequence is orthologous to G2834
acaaataaatcaagtgcttcttagttctgagcatatagattccaattacaaataaaagaaaaggcaatttctaaatcaaattttgagatcctagtttaggttccaaaaatcttgtgatttagaaatcttcggctaaacttgattctttccatttttcaatcctgaaagcatccgaacccgattcagttccagtattctgaacgtagtcactagatccagaaagaaggcaggacaatgaactctcggaaatatcaaatggtggccgggggaactcatagccaccaaagctgcaagtatcaaaatccagtgtagagaagaaagccgcaggatcatcaatgccacctttcatatcaattacattctgaacaccactttcattggaaaaacctgagctgaaattgaatcccgtattttctaaatttgttgcttcaatgctatcctctccattcaatgttccacacgctcccttagtttcttcgacaggaagggcaggagtgtgcccttggaacaaagcaacatgtccaaaaagcttgtcttttcttgagaaggttgtgccacacgagcacagccacttgtcacggccacaatgcttttcatgagttttgagatcagcaagaacagagaacttcttgttgttacatctgctgcaggtatagctcttgtcacaatgagttcgtttgtaatggtttttcacacacaggaaggtctttagtggctgaaatttcttgtgatccttgttgcgcttgcagccagtatatggacatgaatacctttttgctaacattggttctgtgcctggttctttattaggctttgcaagggctgccggagtcttgtattcatccccatggcctctcatgtgcatccttaggtttgcatcccttttgaatcctttaccacagatcaaacagaagtgggtgtgtggagccaatatttcttctttttccaattgcaagacttcatatgaa

SEQ ID NO: 15340 - DNA, 892 bp, Aquilegia formos X Aquilegia pubescens
  Predicted polypeptide sequence is orthologous to G2850
gcttcttgagtgtgtgtgtgtggttgtataaaagagagagaaagggtgagctttctttctttctttctttctttctttcttttcaagactactttaagcatagacatgaaagagtaaagaagaaactgagtaaaaaagttgctaaaagcaagaagggctgtgagtgcacctggactgttagtctgaataaagtgatagattccattagctagttaaattttaattactcatcttgggattttcaagtctttaaagaaatcatcatcatggagtctgcaaatctccatcaccaacatcaactccaccaagatcggttgtctgggtcttcatctttatcaactccatctttctatggtggtgtacataacaactcatcttggaaccaaaacaccctcttgaataatgctggtaacttgaatctaaatgccgatggattcatttcaaactcaagggattcaaggcaaaccaatgtccatgatctagtccctccttctatcgacacatccatgattcaagacctaggttatccaaattgggtcactaataacttcaccaatcagtcagctcattacctacacctcgcaaaaatcaaagaagagttatccgagtctgcaattagttgttcatcgtctagtcctgaagactaccatctaccttccacaagctacattagacatgatcatcgaggggatatacacgatctaaatgaaaatatctttctcaaaaatttctcttctaattgtcaacttaatgagcttcaaggtggatcattgtactctaatagttcccaaagtactcctagctttggaggtctagctacaccaaataggggaaacttcagccagattttccaaccgctaatatttcgaatccaattcgtcatttttaagtt

SEQ ID NO: 15341 - DNA, 922 bp, Aquilegia formos X Aquilegia pubescens
  Predicted polypeptide sequence is orthologous to G2851
tactactagaattgcatatacaagaaagcctcttaagaaagaacaagatatcaaattaagcataattgttctaaattagaaagtttaaggactcagtatcctagttaaagcacctttaatcccaattagaaaattgcatagcatcatgagcaatcagccttatattttagcagattgactgctcatgatgttatatcatttcgtgaagctcggattgtgctgtggactaagactacctatcgaaaacccccaccaagagttggagcccagtaatctgccccattgtcacttccaacttgcagagtacaagaaacaggaacaaggcataaccctctactcttcaagtcctttggttcattttccgaaacctgatccggacctccttttcttttcaggcaattatcattcaacaactgaccagggtcttcaggaaatatacaattcttttctccttgaacagactgttggttttgcctcatgtttcctgatccttgacccaagtaaggggagctcaaagcctcaatttgattctgaaggaatctaatgtagccaatagcttctaacaagacagaagctgtgtcagtctttccaaatggggaaactagctggtgaagtgctgttattctatcacctagtttttcctttcttaccttgaaggttgttggagatgaagaaggttgaatcctagctttcttaaaaggcccaccatttgatgtgctgttacactcagaagactgttcaggttgaggatgtcttccatctggtttgatgtttgagaaatctaagatgttattactgctgaaactggtgacacaagacttaggagaagttgctgccataacatgagaccaatttggccttgtcactgcttggaagtcttcatttccttgattgttgtatacatatgcactctcagagatct

SEQ ID NO: 15342 - DNA, 920 bp, Aquilegia formos X Aquilegia pubescens
  Predicted polypeptide sequence is orthologous to G2854
attcttaatctcaaccatattatcattaccacatagaatagtcttaacccccaaagtttaaacatggttataaaagaaaggtagaggagagaaagatacagagaaacagagaaaaatccactaaaagaacacatgaaagcctcactacgcaggtctattatctatggttcaattcaacagcttcggagaagggggattttgaagccccaaccatactgatcttaaatacatactttcatccattcaaagacctcactcctaccacggccgcttggagatgtatcactgttgctgttgataatttccatatcctgcagcaggataggctccataaccatacatgctaggatcctgtgcagggggggcgtatccataagattcataagcttgattgtagccataatatccagcagccccattccattggttcggatctggctgaggctgtacccagccagcagatgcatcctgcttgtttgaagggctacgcccccatgaaagtctaatgctttgccctcctaacggagttccattcagcatcagtaaagcctcctcagcacaagctctgttagcgaattggacaaatccacagcgctttcctacaggtattttgacatgaaccaattccccaaattgactaaacacttgcctcaagtgatcgtcagtaacatttgaatccaagccaccaacaaatatagttgtattatttggatcatctgaattttgagttgcatcagtattctggtacgaagcctttggaaactgttgctgaccacccatgttctttttgttggtagctggaccaatacgcatgggccttgtggaacagaactggccattcatttcagtcatggcgcgcatttgctcatttccatcagcaaacttcacaaacccatagccctttgagcgcccagttattc

SEQ ID NO: 15343 - DNA, 960 bp, Aquilegia formos X Aquilegia pubescens
  Predicted polypeptide sequence is orthologous to G2964
acccaaccctcctaactcaccgagtcaaaccctagggtttttccctttttcttcttctagggtttaactttttttttttttcctaaacaaatcatatcttagggttttttttttgattttcaagttcaatttatcgaactattgttcgattaattttcaataaatttctctccatggaagctcgtaaaagagggagatcagatgggtttttgaatggcaatggtggtttcaagagaaataagcaagaaatggagaactttccaactggtataggaagcaaatcaaagccatgtacgaagtttttcagtaccgctggttgtccctttggtgagagctgtcacttcctgcactatgttcctggtgggatcaatgcggtggctcatatgacaaacttaggtggcaatcattctcatcctccatcttccagaaacacgatgggtccaccatccagtcacaacggtgcttcccctgcagtcaagacccgcatgtgcaacaagctaaacagtccagaagggtgcaagtttggagataaatgtcactttgcccacaatgagagggaactcggcaagtccacgggtccttcacatgaagatcctcgtgttatgagtggtccgatgtcaggccggtttccaggtaggcatgagccacccccaccaggcatggcagcagcagcaagttttggtgcctctgctactgccaagataagtgtagatgcctcccttgcaggagcaatcattgggaaaggtgggtgtgaattcaaagcagatatgtcgggtcacaggggcgaagctttcgataagagagcatgaatcggatcctaacctgaagaacattgaacttgagggtacctttgatcagataaaacaagccagtgctatggttcgtgagctaattgtcaacattggttctgccatgggccctcctcctagccacactcctgcaacacatcatgctcctgca

SEQ ID NO: 15344 - DNA, 915 bp, Aquilegia formos X Aquilegia pubescens
  Predicted polypeptide sequence is orthologous to G2969
gtaataaaaagaaaaatcaaaacctcacactcacacactatacacaattgcaaagcaaggaagcacagccctaggattaaaaaccaacaattcttcatcatcagatctaaaactggtagtcccaccattacttcctcctcttccaacaactgaatcatacccagttgactcatctttctcaaaaacttcttccacctgatcactaccgattcgacccgccacaactcggcaaactaacatagcccttttcacattcatgaaagcaaattcttcctcgagatcatcaggaattgctaggtgtgctttcaaactactcgacatagtcgaaattccgtccatcttagttgaaaaacccgatcgaataattccacatacactacagtattgttgagaacaaagactagaattaccattttgtcctaaattacataaaaatgtcgcacagtgaaaccttagtagctcatttccatctgcaatgcacctttcatctcttcttcttgcacttatcatcatcgcttttgatttcaccatttctctatattcttcaaattttgcaagtattttcgcgctattatggattttgagaattctatgaatgtttggatttttcttctcttttcgattccaacttgtcataaagattattttcacaatgtttttacctgaatcaccatcgaaaagctcggacacagcgtgtttgacagattgatggttttcaagattttgagttttatggaaaatttctccacatgttggacaaggaaagatatcatttcgaagtggaaatgattgatgatcagcgagagaaatatcagagatagaccgagctcttcgttttcgcgaaggagtggaacccgcaattgtatgatcatctggtgtcgcaacagatgatacaattgaagatcggattgagta

SEQ ID NO: 15345 - DNA, 957 bp, Aquilegia formos X Aquilegia pubescens
  Predicted polypeptide sequence is orthologous to G2981, G2982
cttaattctaatactgtattattacatcaggaatattagggtaaagtaaacaacatgtatgttacatcaaggcattatacgattctagactagaaaatcgtcacataggaatgctttgaaagctttgatagacagacagacttgcccattcttcaattctttcaactggttatcaaaaataactgagatgagagacccttgcatcccaagggacccattacttacacactttttacaaaaaataaaataaaataaaataaagaacttaaaaatgacaaagcttaactattactagtgatcatgcttagaacgagcttttagtattcctggaagaggaggtgatgtgggaggtctacctgaagcagtcgacctaatgggatgttctatctgggactggggcatgctatgaatgctggagctctcacctccagttgcggtagcgttatgggtgtcatcggcatcttgtggtatcttaccaagtctcatagctttaagaacatagttgtcatcatgtagctcaaacggggtgctgttgaagtcaaaatgcaccagctgcatatcttctgatatttctacctcaacggttgcatgaggacgtgtctgaatcagaataaaaggtaaagctacaccgcctgtaggcatttttcctgattcatacatttgttcgtttcgttgtatcaggttttgaagacctacagattgttcctccaattcttgtaaatatgcagcttttttttcaaccctatttttgagtcctatacgttcagactttaactcttcaatatcacttgcactagtgtgaggtaagcctttccactgtatctcttttttatcttttgatataatatccattgccatgagaacattcagagcatcatagactctacgccgtatatttttctcgtagtattgttgcctatctggagagtctggcctactgttaggatctgcgattca

SEQ ID NO: 15346 - DNA, 883 bp, Aquilegia formos X Aquilegia pubescens
  Predicted polypeptide sequence is orthologous to G2989, G2990
cttttctcatcttcttaaaacatacttcagttaatacaacaattagacccaaattaataaaagaagatcagagaaatttaaacaactactacaattaattaagtctacaacaagtacttcgatcccctaatctaaaaaaaaaaaatctaagaagaagaagaagaacaattagtaccaacatgatgatgaacactactattaccatgattctcatgattgttgttgttgttgttgttgttgttgttgatgttgttgggaagaggaggagaactagaagagacagtagtgttgttgttattgttgttgttgtgatgaagaagaagattaggagtaatggcaccattaacatctcttttcccaaaagtatgtttgttgttatgcatccataccttcaaaacacttttaccaacaccaacttcattacaaaaatcttcaactaaactttcatctcttttctgcatcttccaacccaatttttcagaaaaagaatacatcttatctttctgttcttgactaaatttagttctgaatctttttctaccaccatttgaaccagttcccattggactaattactgtaccatcagctgtagtagtttgttgttgttgatgatggttttcaggtttaactgataatccaccagtacttaaagctaataacatttgtggtgcagatgctgggtaataagaagatgaaattggtggtggagataaagatgctgattcatttgttggacttgttggtgcacgaatttgagttggaagttgatgttgaagatgatgatgagggttatggtattcaatcaaatgagttgattgtactacatcttctggatctcttctatgaaaattacagtgacatccacaagctgcacattttaatg

SEQ ID NO: 15347 - DNA, 886 bp, Aquilegia formos X Aquilegia pubescens
  Predicted polypeptide sequence is orthologous to G2993, G2994
gtcattctcttttcacactctttcattaactttctctcatcttcttatcaaaagaaagcctagcctagcatatgcttagtgctacaataatcccattgttttcaaactccatccaagtgctagccatgatcctgtgttctgcaatctcaaggttcatttcttcttgggctaactacacttccaaaacaattagttaaacaaaatcttcttctcattcttcgctaaactccaaatcagtccccaactcccaatgtactttgtgacattcaacttcttatcttagcatctcaaagagttctgatcatcagcttagcttgtttgtgtattaacaaatctgtttttttacttcaatccttgatatttagttttgttttgtgtttggtggggaggagtttagttttccttccatttggaaaaaaaagggaattaatatctagataatgttacaaagattctcagtgtatttagagcaatgggggggactggagagatagaagtagataattgtcaagtcttatcccaagaaacccaggtcacaaacaacaacttgctgtaaatttaatcattataggcatctaattctctttttatctttcttccttcttttggtctcaaaacaaacaacaacaagcaaacaaaagactgagaaaagagttgagacagaggaaggagatggatctttcaagtcatgaaggggatattccaatgccaataacaagttcttatggtggaggacttggacatggccatggtcacatgattcatcatgattcccaatcacttaaccacaaccacaatcacatcataccttcttcagcatctcaagtagtactcccctcaaatggccccattaatccttcaactctggaagatcacatgccttaca

SEQ ID NO: 15348 - DNA, 931 bp, Aquilegia formos X Aquilegia pubescens
  Predicted polypeptide sequence is orthologous to G2998, G2999
tgcaggtggattaacaacaatgctgagagttggggctaaaaccccccacaaaacaagaacattaattttatgtagcttttcttagtatggagtcttgaatcttttgattccatctaccctcagctccattgtaatcccatctattaagctaactacctatctggtataattattgaaagattcagttatgtcttacaattcttccttcttcttcattgagtgcttgttgttgtgcatccagaccttgagaacttgcctcttcacaccaacttcagcacagaactgctggactgctgcctcatcttgcttttgcatcctccatcctaccttctcagcaaattccatcatcttgtctttctgctcctttgagaactttgttcggaatcgcttctttgataagctcccatattgtgacggttgtggtgttgtcccttggccagcattggtgtgaaacatattcatttcctcgcttgaggaatcggttgctgcactaccaccaccaccaccaccaccaaaggtcaccataatgggttgcatcattgcgccggatggaggactagaaggcaaaccaattgggagtttatgatgttgaataggctgaggtataggtggtgctggtaatggaggaggtagaattctacttcgacttccattagccttgctattcggattgtagcaatagtagtaatttgcaccagattgagcctctccatcagactctttcctgtggaaattgcggtgacaatcacacgctgcacatttcagggattctactgtcccttcttcaccaagcataaattctccacaaccatcaacaacttgaccaccaatactggctgcgtggttcttaagacactctcgatatcgaactgaggagacttcatttctagctgtggagtcctgggggttgatcccctacaattggtgcagt

SEQ ID NO: 15349 - DNA, 937 bp, Aquilegia formos X Aquilegia pubescens
  Predicted polypeptide sequence is orthologous to G3055
tattgcttctaagtactaatcatactaaagcttcttcacacgtgagaaagaaaagcaaattcgatcttctaaaccttacaaatgctaatacaatattagaaactatgtattgtttggatgacgaaagccatcctacatttatgttcagggaaaaaaaactagctataaattgaaaaccaagtaaacaagctatgaaatactacttctgatataaaattcattttgctatccaacagtaaaccatcaaacctgtagcatcctgatgaaaaccctactgtttatcaccaacattctcttatttcattgtcaaatcaatgaaatccaattatcgaggagtatcccattcattgtcatcaatccaatcaccgtatatcctactgatcttgtctgggcccttccatttttgaattggcctcaaccccggcctcacatttattcctgaggaccgttgtgagggaactcccatgtgataaacatcagtatgaggagctaatgtggaggatgcaaccacagtctccattggtgtctttgaagaaactccaacctgcttcatatctgaaggaactgatgcaacatctctaccttccacatccacaagccctccaccatatctgtgtagttctcctaatccatgggcaaaatggcacttgcttccgaaagggcaatatcctgtcatttcccacttgttacaaatccttgtcttccagtttgaaggcttctggttcgatccattcacattgtttccatacccattattacccatagttggtcccaaactgatcgcgacactttcccgagcttttgactgttcatcatgaagaaaagtacaattatctccatagggacagccctcctcagtgtagaacttcttgcaatgacgccctttataagacctttgactctcagcacctaaaccagaagagataagacaggggat

SEQ ID NO: 15350 - DNA, 976 bp, Aquilegia formos X Aquilegia pubescens
  Predicted polypeptide sequence is orthologous to G3059
tccatctgcatctccatatccttacaacaacatcaaatctcctccaccttcttctgatccattcatcatcaacgattttgaaaacatcatctacgatccatctttgattaggtactctcgaaatactaaaccttctattgatgtgtttggatcacctacaagacagtatcatcatcatcagaatcagttgttgaaagcaagtttattatcatcatctccttctcgtggcagatctactttgagttctcctttggcttctattgagaatctccttactcctccttctagatctccaactcaacctgtatttggtaagacttctgtgaaagccgaagaagacgtgttagtgatggatggaattctggtcaaatcaccatcatgtcctggtaatagaagtggaatccgtgccaaatcacagttgaattttggatcttttcctggaagtcctaattctaagctgtttaggactgagatttgtccatcttgggaagaaactggtaaatgtgtttacggctctcaatgccagtttgcccacggcaaggaggacccgcgacctcctcgattctcaaccagaaacaagccagagggacagacatataaagcaaacatgctagggggatcatacacatatggtacaaaatgccgttttattcaacatgctgcagcagtgaatgaaggatcatcacctcagaaggtggagcagcgacatggtacaattgactggctaccaactgacgatggcattgcagtttgcttaccatcttatccgactgttgaatctcctacaacggaagctcttggtgcctacatcaattctgttctatttggctcttgtcagaagcacaggttaccagttttcaaagaattttggccagactaaatcatctgccagtgcagctgattctaaaacatacacaattggtataccttcctcaatttacttgcacaaagaatgctggaccactggatgcttatg

SEQ ID NO: 15351 - DNA, 969 bp, Aquilegia formos X Aquilegia pubescens
  Predicted polypeptide sequence is orthologous to G3060
tctattttctccggtcgagaaaagagagagactcagagactcagagactcagagacctcgcgcccgcccttttctttctttctttctttctttctttctctcttcttcttcttctctctctctctctctctctcatctagggtttatctttgtttcaaatttgttgatagggtttatctttccctctctctctctatcttgatttgtgtctgccatccatggacttcggacgtgctcgcaaaagagggaggcctgaagctgggtttaatggtaatgctggtttcaagaagaacaaacaagaaatggactcctttcctggtataggaagcaaatcgaagccatgcaccaagtttttcagcactgctgggtgcccatttggtgagggatgccacttcttgcattatgttcctggtggcataaatactgtggctcagatgaccaacatgggagggaatccagctcttcctcctagaaatgcaatgggtccacctccctttccagatggctcatctcaaactgctaaaaccaggatgtgcaaaaaatttaacagtgctgaagggtgcaagtttggggacaaatgccatttttcccatggtgggagggaaattggcatgccatttgcaccatcgcgtgaagatcctcgtgccatgggccctaacatgggtaggtatgccgggaggcctgagcagcctccaccaggacttgctgctgcagctagtttcggtgcctcagcaactgcaaagatcagtgtggatgcctctctagctggtgcaattattgggaaagaggtgtgaattcaaagcagatatgtcgcatcacagtgctaagctatctatacggagaacgaatcagatcctaacctgagatatgagcttgaagaacatttgatcagattagcagctagtgcaatggtcgtgagctatgtgatatagtctactgcaggctatgagcaacctgctgcacagcacc

SEQ ID NO: 15352 - DNA, 885 bp, Aquilegia formos X Aquilegia pubescens
  Predicted polypeptide sequence is orthologous to G3067
cataaaaccatgtgagggtacacttgaaaaaaaaatgaattcaagaacttttttttttaactcagaggtttacagattacaacaaagcaaggaagtagagctcttggattaagtaaatagagttcttcaatatttgaataaagaccaactttcccagctaatgaatcaaaaccaacttgacctgcaagttcttgaatgttttccaatggtctatgaactctaccagcaatcactctacagactatcaaagctttccttaatgatggattttcctcattaagttcaacagattcaaatgctcttccactagttgatgttgtgaaaacaccaataccatctttaagctcttttttagtagagaaaccatgtcgtataattcgacatacactgcatttttctgatatacacaggtttgaggaaccattcatacctagtggacatactaaacttgttccatagaacctcaatagctcatttccatcggcaaggcaacgcgaatgtttcttaggaagtttgctggctttgttctttaccatctccctgtattcttcaaaccgagcaagcgtcttttgcatgttatggacctttagtactctatcaatacgtgcgcaattgttctctgatttcaaccagcttgttctacaaattatctcgacaattttgcgcgatgagtctccttcagcaagttcagtaactgcatgtttggagagatgatgtgcttctgcagcttcccatttcccaaattgctccccacatttggggcaagtaacaagagaaggcccattcgaatatacagcataagaggctttaaatcttgaagacataccaccatcaccaaatgtagcagaacttccaaatctagagcttttgttaccagagagagga

SEQ ID NO: 15353 - DNA, 931 bp, Aquilegia formos X Aquilegia pubescens
  Predicted polypeptide sequence is orthologous to G3074
ctaatactttgtcagtgatggctaatgagtaataagcagccaggatggtggtacacaactgcacaacccatcggaggtcataatgatctcttcttgttagtattgatgacatcatataatacaattcccagaaaggacactcttcagaatttctacgtgtaaagcacatttcttgcccaaacactggacatatttgttgcccaaacaccggagacattcctaaccccctaaagctcttgatgatattcagtagttcagcatatattcacctactctatatcagagctgagtcaaacctaactgccttctcgcaccactatccttcttcgtcataatcttcatcatcgtcatctaagcttctattaaggtgaacaagctgaagagggtctatggggactttctccatgtctgaatgagaccaccctggatattcttcatgttgcatctcaggggggtcagttgatgagataggggctgctggtactgagacagtggctgctggtactgagacagggggcgctggtactgtgacggttgtatcgccattcacatgcaagtccacatttaaatcaaagttccgcacagctagattcgtactgccacccactggcgttctggcttccgtctcaatgtctacccgcatggggtccatattctgtttgtcatgttgaggagacatatctggatcatcttcacacttcacagattgagcactctggctattcctgccacgtcctcttccacgcccccttccccggcctcttccactgctgctgttgctgcctgcatcatgcagtctgctcctttttgcctcatcgtcagtatcattatcctcatcgtccaatgtttttcttcttttggcaacggatcgatcctcggcggcggcatcggatccacctaaatctgggaccttactgacaatttctctcag

SEQ ID NO: 15354 - DNA, 945 bp, Aquilegia formos X Aquilegia pubescens
  Predicted polypeptide sequence is orthologous to G3091
tatgttaatttacatttacacattgcaaacttcctataatataattcagcattattgcttctccataagagaaagaaacagaagatgatgatggtagagagagaaagagagagagagatataaagaaagaaaagagatgtatgttgtttagaccaatggggtgcctttaaccaatttagggcccaatgaggttgtgtgggtagttgcttgtgacttgtgagagagagagagtgacttaatttgtcttagtttataggatacttttttttttctattaggacccaaagggtgccctatgaggaataccctttcttcttcttgaatttgaaggaggagatggagtggtggagtatataatgtgttgttgttgttgttgtgtaccttgacgcaattcttcttcctcatttgatactcttcttgatatcccttcttcattaatcttgttgttgttgtctaagataaaacttgcatctcctttcctctttattcctacaagcttgcaacccaatgagcagaatctaaagggatctaatagacttctggcacatacttcacatagatgtgatactcctttaccagatttaggctgaggtctttcattgagaaatagaactctagcactgttaatcacataagtttgtaccccactaatatcaagcactttttgaatttcagccactctaaccacatcatgatatgatgacctccttatttgaattacttgatgatctttatgttttgatgaacgacaatagaagcaaaatgcatcaccactacaatctaaacaatacatattgcattcactccttgctgcatctccatgtgttctacatactgagaagaatgctgttgataacaatggttctaaccatggtggaaccaacattgactccattataaacagcaatccttgtacaaggattgctgttggaagatgaaatgtgc

SEQ ID NO: 15355 - DNA, 951 bp, Aquilegia formos X Aquilegia pubescens
  Predicted polypeptide sequence is orthologous to G3091
ctcacacccctcttcatacctctcttttctctctctcttaagaaatcttcaagctggcgattgaaaatcaagaacccactgttaaggaaatcaaacacaagaatagaagaatcatgggagctggaggtcctgatgaagaagatgataataggtggccaccatggctatgtccattactcaaaacccccttttttgttcaatgcaagttccatgctgattctcataaaagtgaatgcaatatgtattgcttagattgtatgaatggggctctttgttcactctgtcttgcttatcacaaagaccatagagccattcagataagaaggtcttcatatcatgatgtgattagagttaatgagattcaaaaggtacttgatattactggtgttcaaacctacattatcaacagtgcaagagttgttttcttgaatgagcgtcctcagcctaggcctggtaaaggagttaccaatacttgtgaagtttgtgaaagaagtcttcttgattcctttaggttctgctctcttggatgcaagattgttggtacatcaaagaacccaaagaagatgaaaagatcaatgggttcagattcagaagaatcatatggtcatagtagcagcagtcatggcaacattgagaaacacaaccacaacctacttcttcaaagcttcactccatcaacaccacctccaactgcagtaaattacagaacagccaaaagaagaaagggaattcctcataggtcccctatggggtggaggacttgtgttagaatactgaaagtatagctagctgttataattactgatatacccctcaagtatatgccaaataccaacaatgcctgctctttatctaatgtattcacccctcaatcgcacacttgagctactacttctcttacagttttaaagatgggccagtgtttggaaatcatgctgctctgaatgtaca

SEQ ID NO: 15356 - DNA, 923 bp, Aquilegia formos X Aquilegia pubescens
  Predicted polypeptide sequence is orthologous to G3094
gtccctttccagtttccccattaccttctctgcaaactacaaagtatattggtatggtaaaagagaaaggacttctggataaattagtaatttaagggacccgtaaaatgtgaaagtgtgaaactattcttgttcctctacaaaattgggagggtttatcttcttttcaaatccctcccccaaatgattaccaaaaataaccagtgaaaagtacattaataccaactatatcccaatttcttctctattttatttcttccgtacagaatcagtaaagaggagacctctgtggattaccctttcgcctattcatcatgatgatagcagcaatttcggatgcagtagaacatgtcggccgatacgaattccgagccgataagctacttcgttttttctttacaatttctgtagttgcagtacaagcaagagttctgcaacaatctactccaccaacaccaccacctccatttgcacttgaaccagatgaagtaagcattgaatcaggtgattcaagaacggaatcaggagtcatttgtccatcatcaataccttctgacaatggaagaaattcacattcatataaatgccttgctattccaccttcagttttaaccaaatgggtaaccttgcaagcgagagaacagaagagattagggtcttgcaagcttctgtcacaaatgatgcaaatgtttccagagcctctaaagggtcttgtctgagatctttggtttatgaaaattactttcgcgctgttggtaatgtaagattgaacatagtcacaatcaataagcttctcacaatcatctagtcttataacatcatgataaacataccttcttatttgtaagagtctgtgagaattatgaggagataagcatgaggacaaatacttacgcaacaatccaagcaaagatattttctca

SEQ ID NO: 15357 - DNA, 926 bp, Aquilegia formos X Aquilegia pubescens
  Predicted polypeptide sequence is orthologous to G3095
ctttctgaaaaaaaaaaaaacctatttgacatgtttatattgaaatgttcatcaaaagggggctcgatggggaatacccttcctccgggagattctatgattgttgataggaggagttgcaggggatatgttgttcccggcttcatcgctggaggtggtgcccttgttgttggtgtaggcatcaaatgagattgagacatgggggacatccattgggaagaatcgattaaaaagcccagtctttggaatctttttgggagtggaagaatcatctgagtagtccaacatgtcgcgaatgtgctttgagccgcggagagtgaatgtgagctctcggtcaccacgtttgattccattcatcttgcatccaagagagcaaaatctgaaggaatcaagaagactacggcaacaaatttcacaagtgttggtgacgcccttgccaggcctaggttgaggcctctcattgagaaagacaatcttggcactgttgatgatgtaggtctgaactgcggagatgtcaatgtatttctgaacctcattcaccctaataacattgtggtaagaagatcttcttatttgaacaatgtgatggtcgttgtgatgaatcaagcagtaagaacagagagcatctcccatgcaatccaaacagtacatgttgcattcactcttgtgtgaatcgccatggaactgacaaggattgaaatatcgagactttaacattggcttcaaccattgaggacctaatacatcagcagcagtatccttgtccttgtctttgtactcctccattgaaactataggacgaccgaccatgagttgatgattggtgttgttgttgacaagcccagcaccaacctggttgttttgttgattctcgatagccagcttgatttaccttttggttttcaatcttaattttaatccaacac

SEQ ID NO: 15358 - DNA, 1033 bp, Aquilegia formos X Aquilegia pubescens
  Predicted polypeptide sequence is orthologous to G3967
aattattgtatctgaaacaactcaaagtcagacttccagtagggtaaacaagaatgtatatccatttctacttcattacatacaaaactaatataatgatcaaaacaaaaatacagtgatcaacattagaatacaagtagaatattacaaagagcctcatctcatctccgctggttaccgatccacttttggttcgaaggcctagaaggacggtaatgacactatgacttcatatccacttttgcgttttgctgtgatgtccactcttatgaattagaaacctatgcaaattcaatggcaaaatatcataccgcataggccagtgaggtgatctcagatcaaaatggtacatcctaaatccttggcagcggcatcaaggaatgtggttgacactcctgtcgtgtgtcggctacgtgcttcccatgttaaacacttttcaatgtccttgttccagtcaatgatgcttgaacttaaacaacggtgagatggtccttgaacgccactgtaacgcttttcttgtttaacattgaatttgattgggccaagaaacaatatgtcacggagaactgatgtgcttaaagcccgaacatgagcactgggatgagaaaggcaacgaacagtagcaggtagacgacacttcaatagatttgagagtccatccgtaatggctgagcttgaatccccccacttgactacaagctgaactgctttagctgttgcttctaggagctctagttggggtaaggtgcatgcttctccatcaacaagcattccatccgtggcgcgtagaagaagatccgacgcacttgctagaattaccaatgactctggggtgtcatgatttctcataagctctacaattagttgtacaatccgctggtttattttccacatcctctgaccttgctcatcatctctagcaatccaaggctgcaaatctttctccgcctgaagaacaattgccgctgatgcttttgctggtgaagcggatacgacattgcatagagcatcaaccacctgtcgccacccctgt

SEQ ID NO: 15359 - DNA, 581 bp, Brassica napus
  Predicted polypeptide sequence is orthologous to G481, G482, G485, G1364, G2345
cccacgcgtccgcaccagcgaggcaagtgataagtgccagaaggagaagaggaaaactgtgaatggtgaggatttgttgtgggcaatggcaacgttggggtttgaggattaccttgaacccttgaaggtataccttgcgaggtacagggagttggagggggataataaggggtcagggaagagcggtgatggatctaatagagatgcagctgctggaggtgtttccaatgaagatatgccgagctggtgaaagaagtcgcaagtaagctctctagagataaagaacaacgccaaaatgatcagggaaacttagagatcagtgtggtgtttgacaataaagttagagatccggttttagttggttgtagttgaagatttctcttattagatatgacaactctttgaaagaaggaaaaaaagtttgtccacaagctctctcatctcttagcttcgtttatggatttcaaaacttgaatatgaatggactcacttgtgcttccaagtaagcaagaggaggttgtaacttacattgtcctcattaacttcacgtagaatgtcgtttaaatgaaaaaaaaaaaaaa

SEQ ID NO: 15360 - DNA, 1177 bp, Brassica napus
  Predicted polypeptide sequence is orthologous to G4
atccctccgccgaagtcccgccgcgtcaccagcgagttcatctggccggatctgaaaaatctgaagaagaagtcgaggaagcgatcccatttcttcgatctggacaacgagttcgaggctgatttcaaagggtttaaggatgatgattcgtcttttgagtgtgaagatggattcgatgtgaagccctttgccttcaccgcagctaccaaacccgtagcttcccttcccaccaacgtcgccacgactggttcagtttctgacaagaaagctgtggagtccgatgagaaatctggcaagaggaagagaaagaatcagtacagagggattaggctgcgcccctggggaaaatgggctgctgagatccgtgatcctaaaaaaggctcacgagaatggcttggaacgttcgaaaccgctgaggaagcagcaagagcttatgacgcagctgcgcgcaggatccgtggcgataaagctaaggtgaacttccctgaggaggtgatcagtagtcctaagaagccagtggctaaaccaaaccagaccccagctttggttcagcagccaacgcatgtgagtcagtactgcaacaactcctttgacaacatgggacatgactccttgagtttcatggaagagaagcctcgggtttacaacaatcagttcttcgatgttggacagtatttcggttccgaccaggggagtaactcatttgactgctctgagtttgggtggagtgatcacgcccccaagacaccaccagagaattcttcaatggtagttaacaacaaccaagctacctttgctgaagaaaccattgcagccaagaaggtcaaactcagctctgaggacgagacaagcgacaatgatgatctgatggcgtatcttgacaacgccctgtgggagtctccgttagaagtggaagctatgctcggcgtagatgctgctgctgctgctggtgtggctcaggaagaggcaaacccaatggagctgtggagcttagatgatatcaactttatgctggatggagacttctgaagtgagtgatgggttgcctagtttgtaaatatactcagagccatttgtgtataagattgtgaagacaaacagccgtaacttttacttaatcttcagtttggtttttgtgtttgttgtcttgttttgtatccctaagacttgtttaaca

SEQ ID NO: 15361 - DNA, 366 bp, Brassica napus
  Predicted polypeptide sequence is orthologous to G4
gaagctgatccagctaagcagctcaaggtcatggattttgagacaacttacaacggcactgaatgggattcttcacttgatttcttcagtggagacgctgtggcgactcaggacaatggtgcaaatcctatggagctatggagcattgatgagatcaattccatgattggaggagtcttctaaagagatccattgtcatttaaagagttttaaaaacattttgaactctttcttgttgtcttttgtgttttggttttgttactttgtgcccctaaacatcttctttaacattgtcataagttaatatgttgaaccattgttctcttttgtaaaaaaaaaaaaaaaaaaaaaaaaaaaaaacatgtc

SEQ ID NO: 15362 - DNA, 685 bp, Brassica napus
  Predicted polypeptide sequence is orthologous to G12, G24, G1277
gacctctctccgacacatttattctctatcatcttcagcaaatcggtcaaattctcaaaacccacctcaaaagtctctctctttggagggtttacgaattaagatcctccatggacggcggcggagtagctgacgtggcagtcgccatgacgacgaggaagagagagagaccttacaagggcataaggatgaggaagtggggaaaatgggttgcggagattcgagagcctaacaagcggacaaggctatggcttggctcttactccactcccgaggcggcggcgcgagcttacgacacggcggttttctacctcagaggaccaacggcgaggctcaacttccctgagtttcttaccggagagaaattctccgaggaggacatgtcgggtgatacgattaggaaaaaagcgacggaggtcggtgctcaggtagacgctttgggcacggcggtgctaaatagccgccaccgtgtgtttggtcagaacggagagagtgatgatagtgataagaattttcatcggggttatcgaaacggtgagtcggaagaagatgataagagtttgaagagtggcggctggttattggaacgggttgacttgaataaggtacccgacccggaaaactccgatgacgactgggaaagcaataaaaaatttaaatatattttggagcggtggctgctgct

SEQ ID NO: 15363 - DNA, 842 bp, Brassica napus
  misc_feature (738)..(738): n is a, c, g, or t
  Predicted polypeptide sequence is orthologous to G19
gaaaaaaagaaagaaagcaaacagagaaaatgtgtggcggtgctgtaatttccgattttgcccctaacgtcaccaaggctaagggtaggaaactcacggcggaggaactctggtcagagctcgatgcttccgccgccgacgatttctggggtttccattccacatccaagactcaatccaccaaccaacaagaggaggcggcggagaaggagaaggaaaaggagccggtgacggagaaaaggaggaagaggaagaacgtttacagagggatacgtaagcgaccgtggggaaaatgggcgtcagagattcgagatccaagaaaaggcgccagagtctggctcgggacgttcaacacggcggaggaagctgccatggcttatgacgttgcggcgaagcggatccgcggcgataaagccaaactcaacttcccagatcttctccaccatcctactcgtagtcctgcgactcctctagcatcgtctccagtttcagaagttcagcctccggcgaagaagcactgcgttgtctctcagagcgagttgactcagccgagtttcccggtggagtacagtggagtggggagcggggacgagtttcaactggactacgatctgaaacagcagatatcgagcttggagtcattccttgagctggatggtgacacggtggagcaaccgagtcagctcgacgagtccgtctccgaggtggatatgtggatgattgatgatgtcttcgcgncgtatcagtaataaacgtaatataagtagaaatattaaataaagtttgtaatataactgccgttacgttctaaggtttgtaatgtgatgacatgagcgactgat

SEQ ID NO: 15364 - DNA, 665 bp, Brassica napus
  Predicted polypeptide sequence is orthologous to G19
agcataagagtgaaataaaagaaacagagaaaatgtgtggcggtgctatcatatccgattttgttcctatcctcaccaaggccaagggtaggaaactcacggcggaggaactctggtctgagctcgatgcttccgccggcgactatttatggagtttccatcccacctccaagcttcaacccaccaaccaacaagaagtggcgttgaaagatgaggcggtggtgaaggagaaggagagggagccagcgacgacggagaaacgggggaggaagaggaagaacgtttacagagggatacgtaggcgtccgtggggaaaatgggcttcagagatacgagatccacggaaaggcaccagagtctggctcgggacgttcaacacggcggaggaagccgccatggcttatgacgtagctgctaagcgtatccgcggcgataaagccaagctcaacttccctgatcttattcctcctccgctgacatcacccccagtgtcagacgatcagcctccggcgaagaagctctgtgtactctctcagagcgagttaactcagccgagtttcccggtcgagtgcattgggttcgggaacggtgaccagttttcagaaccggagttacgggtttgagcttgatttacgatctttaaacaggcagattatcgaggctcg

SEQ ID NO: 15365 - DNA, 780 bp, Brassica napus
  misc_feature (11)..(11): n is a, c, g, or t
  misc_feature (603)..(603): n is a, c, g, or t
  misc_feature (671)..(671): n is a, c, g, or t
  misc_feature (684)..(684): n is a, c, g, or t
  Predicted polypeptide sequence is orthologous to G19
ggttctctctngaaacccagcatcagagaaagaaaagaaacagataaaaggtgtggcggggctatcatttccgatttggttcctatcctcaccaaggccaagggtaggaaactcacggcggaggaactctggtctgagctcgatgcttccgccggcgactatttatggggtttccatcccacctccaagcttcagtccaccaaccaagaagaagtggcgttgaaagatgaggcgggggtgaataagagggagcctgcgacggagaaacggaggaggaagaacgtttacagagggatacgcaagcgtccctggggaaaatgggcgtcagagatacgagatccgcgaaaaggcaccagagtctggctcgggacgttcaacacggcggaggaagccgccatggcttatgacgttgcggctaagcgtatccgcggcgacaaagccaagctcaacttcccagatcttattcctcctcctgccactccggcgctgacgtcatctccaccatcagacgatcagcctccggcgaagaagctctgcttactctctcagagcgagttaactcagctgagtttcccggacgagtgcatggggttcgggaacggnggccagtttcagaaccatagttacgggtttgagcctggttacgatcttaaacagcagatatcgagctnggagtctttcctngagcttgacggtaccacggcggagcaaccgagtcagctcgacgagtcaggggatatgtggatgatggatgatgtcatctcatcgtatgcataaaat

SEQ ID NO: 15366 - DNA, 615 bp, Brassica napus
  Predicted polypeptide sequence is orthologous to G27
atgaaaaaactcaaactcatggatcactcatcctgccggaggagatatcacgatcctccgtcacaggcgacggctagaacactgaataataacaataataatccgaagaagaaaagagtcgtcaaagaagatcttgatgatgaaaagattgtttcaaagcatccaacttatcgaggggtgagaatgcgacaatggggaaaatgggtctccgagataagagagccaaagaagaaatcaagaatctggctcggtaccttctccacggcggagatggcggcgcgtgctcacgacgtagcggctttagccattaaaggcggctctgctcacctcaacttccctgagctagcgtaccaactccctagaccggctagtgctgaccctaaagacatccaagccgcagccgccgctgctgcagctgccgtcgccgttgacatggaagtagagacgtctacgccctctcctgtaagctcggaaccatcgtctccggctacgaccgcactagcagacgacgcgttttctgacctccccgatctcttgctcgacgtgaaccacaacattgacggcttttgggactcgtttccttatgaagagcctttcttctcgggaacttactag

SEQ ID NO: 15367 - DNA, 450 bp, Brassica napus
  Predicted polypeptide sequence is orthologous to G129, G136, G140, G146
gaaaacagaaataacaaaaataaagagagatatttttacaagaacaacataatttttagaaaagcagaagcagcaattaagtgatactgagattaataataatatattatctcttcaaaagagtttctcattagtaacttcccctttgtgctgatctatcatataatcttcaaaacccagaatcaatggaggaaggtgggagtagtcacgacgcagagagtaacaagaagctagtgagagggaagatagagataaagaggatagagaacacgacaagtcgtcaagtaactttctgcaaacgacgcaatggtcttctcaagaaagcttatgagctctctgtcttgtgtgatgcggaagttgcacttgttgtcttctccactcgtggccgtctctatgagtacgctaacaacaggtacaaaaaaaaaaaaaaaaaaaaaaaaaaaaacagtc

SEQ ID NO: 15368 - DNA, 789 bp, Brassica napus
  Predicted polypeptide sequence is orthologous to G129, G136, G140, G146
tcggtggtttattcatttggtgacgatatcacagaagcaatggatgaaggtgggagtagtcacgatgcagagagtagcaagaagataggtagagggaagatagagataaagaggatagagaacacaacaaatcgtcaagtaaccttctgcaaacgacgcaatggtcttctcaagaaagcttatgagctctctgtcttgtgtgatgctgaagttgccctcgttatcttctccactcgtggccttctttatgagtacgccagcaacagtgtgaagggtacaattgaaaggtacaagaaagcttgttccgatgccgttaaccctcctactgtcactgaagctaataccaagcactatcagcaagaagcctctaagcttcggaggcagattcgggacattcagaattcgaacaggcatattgttggagaatcacttggttcattgaacttcaaggaactcaaaaacctagaaggacggcttgaaaaaggaatcagccgcgtccgatccaagaagagtgaacttttagtggcagagatagagtatatgcagaagagggaaatggagttgcagcacgttaacatgtacctaagagctaagatagaacaaggcgcgagattgaatccggaacagcatggatccggtgtaatacaagggacggcggtttatgagtccggtctgtcttcttctcatgatcagtcgcagcattataaccggaattatattccggttaaccttcttgaaccgaatcaacaattctccggtcaagaccaacctcctcttcaacttgtttaa

SEQ ID NO: 15369 - DNA, 1098 bp, Brassica napus
  Predicted polypeptide sequence is orthologous to G129, G136, G140, G146
caatcaacaacttcacccttccattttctgcaacttctccaaatctcatactttccagaaaatcattttcccaagagaaataaaactttcctctttgttcatctctcttccccccaacagcaaacatggcttaccaaatggagctaggaggagaatcctctccacaaaggaaagctgggagaggaaagatcgaaataaaacggatcgagaacacaacgaaccgtcaagttactttctgcaaacgcagaaatggtttgctcaagaaagcttacgaactctctgttctttgtgatgctgaagtcgcactcattgtcttctctagccgtggccgtctctatgagtactcaaacaacagtgtaaaagggacaattgagaggtacaagaaagcaatatcggataattctaacaccggatccgtggcagaaattaatgcacagtattatcaacaagaatctgccaaattgcgtcaacaaattatcagcatacagaactcgaacaggcaattgatgggtgagacgattgggtcaatgtctcccaaagagctcaggaacttggaaggcagattagacagaagtgttaatcgaatccgatccaagaagaacgaactcttattcgccgaaattgactacatgcagaagagagaagttgatttgcataacgataaccagcttcttcgtgctaagatagctgaaaatgagaggaacaatccaagtatgagtctgatgccaggaggatctaactacgagcagatcatgccaccgcctcaaacgcaacctcaaccgtttgactcacggaactatttccaagtcgcggcattgcaacctaacaatcaccattactcatccgcaggtcgcgaagaccaaaccgctcttcagttagtgtaatattggctgaagcatgaaggagcaaggactgaataaaaaccagaactgggttaaggaacgagcgatataaagctgatgcactgttataaaaatatttatatatttatttcacgaatgttgtgtccatgctttctacattttatttaaattgcttatgttgatgtgaaattaatatcttaaaagacatgtgattaatgtgctttaatttgtttcg

SEQ ID NO: 15370 - DNA, 286 bp, Brassica napus
  Predicted polypeptide sequence is orthologous to G131, G135, G155
atgggaaggggtagggttgaaatgaagaggatagagaacaagatcaaccgacaagtgacgttttcgaaaagaagagctggtcttttgaagaaagcccatgagatctcgatcctttgtgatgctgaggtttcccttattgtcttctcccataaagggaaactgttcgagtactcgtctgaatcttgcatggagaaggtactagaacactacgagaggtactcttacgccgagaaacagctaaaagttccagactctcacgtcaatgcacaaacgaactggacaatgg

SEQ ID NO: 15371 - DNA, 286 bp, Brassica napus
  Predicted polypeptide sequence is orthologous to G131, G135, G155
atgggaaggggtagggttgaaatgaaaaggatagagaacaagatcaatagacaagtgacattttcgaaaagaagagctggtcttttgaagaaagcccatgagatctcgattctttgtgatgctgaggtttcccttattgtcttctcccataaggggaaactgttcgagtactcgtctgaatcttgcatggagaaggtactagaacgctacgagaggtactcttacgccgagaaacagctaaaagctccagactcccacgtcaatgcacaaacgaactggtcaatgg

SEQ ID NO: 15372 - DNA, 1008 bp, Brassica napus
  Predicted polypeptide sequence is orthologous to G151
ttcatattcacattcaggggtaaaagagaaagaattaagatggatcgtgggaaaatagagataaagaggatcgagaatgcgaatagcagacaagttactttctccaagaggcgtgctggtttgctcaagaaggctcatgagctctctgttctttgcgactctgaggttgccgtcatcgtcttctccaagtccggcaagctcttcgagttctcaagtactggcatgaagcgaaccgttttgagatacgagaactaccaacgttcttcagatgctcctctgattaaatataaaccagagaaccaggaggaggattgtacagaggtggactttttaaagaatgagatctcaaagcttcaagagaaacatttacaaatgcaaggtaagggcttgaatgctctgtgcttgaaagagctgcaacaccttgaacagcaactaaatgtctcgttgatatctgtgagagagcgaaaagaactattgttgactaaacaaattgaagaatcacgtatcagggaacagagagcagagctggaaaacgagaccttacgtagacaggttcaagaacttagaaattttctcccgtccatcaaccaaaactatgttccatcctacatcacatgcttcgctatagatcccaagaactcccccgtgaacaactctggcttggacgacactaattacagtctccagaagaccaattcagacacaacattgcagttggggttgccgggagaagcacaggctagaaggaggagtgaagcaaatagagagagcccatcaagtgattcagtaacaacgagcaccaccaaagcaactccacaaaggatcaatctagtttagcacctgaaaacaaaagcaaatggttctctgcttagccacatagaaatatgggaatgaggcacatgatgttttcctctgtagcaagtatcacattatttcaaaaccaatgttagaagagatgaatccgatgtatctcatctcacattctagtctaactctaaccccactctt

SEQ ID NO: 15373 - DNA, 847 bp, Brassica napus
  misc_feature (742)..(742): n is a, c, g, or t
  misc_feature (844)..(844): n is a, c, g, or t
  Predicted polypeptide sequence is orthologous to G157, G859, G1759, G1842, G1843, G1844
ggcgactttaaccgtacctcagaatcaaattagggcacagagacctctcggagacagaagctatgggaagaaaaaaactagaaatcaagcgaatcgagaaaaacagtagcagacaagtcaccttctgcaaacgacgcaacggtctcatcgagaaagctcgtcagctttctgttctctgcgaggcatctgttgggcttctcgttgtctccgcctccgacaaactctacagcttctcctccggggatagactggagaagatccttgatcgatatgggaaaaaacatgctgatgatctcaatgccctggatcttcagtcaaaatctctgaactatagttcacaccatgagctactagaacttgtggaaagcaagcttgtggaatcaattgatgatgtaagcgtggattccctcgttgagctagaagatcaccttgagactgccctctctgtaactagagctcggaaggcagaactaatgttaaagcttgttgaaagtctcaaagaaaaggagaatctgctgaaagaagagaaccaggttttggctagtcagattgagaagaaaaatcttgagggagccgaagctgataatatagagatgtcatctggacaaatctccgacatcaatcttcctgtaactctcccgctgcttaattaaccacctttactcggcggttaatcaaaataagaaacatataatctaaagataacctatgtaggttttacttttcgcagcttaattaaccncctttactcggcggttaatcgaaattaaaaacatataattaacaaataacctatgtcagtttaaccccaaaaaaaaaaaaaaaaaaaagaaaaaaaaaaaanaaa

SEQ ID NO: 15374 - DNA, 908 bp, Brassica napus
  Predicted polypeptide sequence is orthologous to G157, G859, G1759, G1842, G1843, G1844
aaaagaaagaaataaaagcaaaaaagagagaaaataaaagcaaaaataagaaagaacaaaaaacgctcagtatctccggcgagagctgaaccgaaccgaacctcaggatcaaattagggcacaaagggttctcggagacagaagccatgggaagaaagaaactagagatcaagcgaattgagaacaaaagtagccgacaagtcaccttctccaaacgacgcaatggtctcatcgagaaagctcgtcagctttcagttctctgcgatgcatccgtcgctctcctcgttgtctcagcctctggcaagctatacaacttctccgccggcgatgacctggtcaagatcgttgatcgatatggaaaacaacatgctgatgatcgtaaagctctggatcttcagtcagaagctccgaagtatggttcacaccatgagctactagagcttgtcgaaagtaagcttgtggaatcaaattctgatgtaagcgtcgattccctcgttcagctggagaaccaccttgagactgccctctccgtaactagagctaggaagacagaactattgttgaagcttgttgatagcctcaaagaaaaggagaaattgctgaaagaagagaaccagggtttggctagccagatggagaagaataatcttgcgggagccgaagctgataaaatggaagtgtcacctggacagatctctgacatcaattgtccggtaactctcccactgctttattagccccttaagtccaaaacttgtgactaaaaacaaaaataagttaccgaactattcccctataagggtgagcgttgtatatcttcacactctcttggctgagagaccctgtgtgtaaaaactacggtttgatttgagtaaaaatatatatttaagaaaaaaaaaaaaaaaaaa

SEQ ID NO: 15375 - DNA, 969 bp, Brassica napus
  Predicted polypeptide sequence is orthologous to G157, G859, G1759, G1842, G1843, G1844
ctctggatcaaattagggcacagagaccacttggagacagaaaccatgggaagaaaaaaactagaaatcaagcgaattgagaacaaaagtagccgacaagtcaccttctccaaacgacgcagcggtctcattgagaaagctcgtcagctttctgttctctgcgatgcatccgtcgcgcttctcgttgtctcctcctccggcaagctctacagcttctccgccggtgataacctggtcaggatccttgatcgatatggaaaacagcatgctgatgatcttaaagccctgaatcttcagtcaaaagctctgagctatggttcacacaatgagttacttgaacttgtggatagcaagcttgtggaatcaaatgtcggtggtgtaagcgtggacaccctcgttcagctggagggtgtccttgaaaatgccctctctctaactagagctaggaagacagaactaatgttgaagcttgttgatagcctcaaagaaaaggagaagctgctgaaagaagagaatcaggctttggctggccagaaggagaagaagaatcttgcgggagccgaagctgataatatggagatgtcacctggacaaatctccgacatcaatcttccggtaactctcccactgcttaattagccaccgttagacggggctgatcaaattaaaaaatccaaaacatacaactaaataaataagctttgttgtttttcacccttgaagggtgcacgttgtatatctcaatactcccttggctgagagattgtgtgtttactcctatgttagatataatgagtaaaataaaaataaaaagatctttgtaccttcgtcgagagagaattgtagtgagtgtgcttgtgtgttctttttctcttctttgcttcatggcgaagaagcctaccgtctaatttgtaacggagacgtggccctctctgcccttttgtattcgtaattcctttgtattaaaaa

SEQ ID NO: 15376 - DNA, 780 bp, Brassica napus
  misc_feature (748)..(748): n is a, c, g, or t
  misc_feature (769)..(769): n is a, c, g, or t
  misc_feature (779)..(779): n is a, c, g, or t
  Predicted polypeptide sequence is orthologous to G157, G859, G1759, G1842, G1843, G1844
ttagggcacaaaggcttctcggagacagaagccatgggaagaaagaaactagagatcaagcgaattgagaacaaaagtagccgacaagtcaccttctccaaacgacgcaatggtctcatcgagaaagctcgtcagctttcagttctctgcgatgcatccgtcgctcttctcgttgtctcagcctccggcaagctttacaacttctccgccggcgataacctggtcaagatccttgatcgatatggaaaacaacatgctgatgatcttaaagctctggatcttcagtcaaaagctccgaagtatggttcacaccatgagctactagagcttgtcgaaagtaagcttgtggaatcaaattctgatgtaagcgtcgactccctcgttcagctggaggaccaccttgagactgccctctccgtaactagagctaggaagacagaactaatgttgaagcttgttgatagcctcaaagaaaaggagaaattgctgaaagaagagaaccagggtttggctagccagatggagaagaataatcttgcgggagccgaagctgataaaatggagatgtcacctggacaaatctctgacatcaatcgtccggtaactctccgactgctttattagccaccttaagtccaaaacttgtgactaaaaacaaaaataagttatcgaactattcccctataagggtgaacgttgtatatcttcattctctctggctgagagacccccgtgtgtaaactatggntagatttaagtaaaatatatntttaagacana

SEQ ID NO: 15377 - DNA, 845 bp, Brassica napus
  Predicted polypeptide sequence is orthologous to G157, G859, G1759, G1842, G1843, G1844
ctccggctagtggaaaccggacctcaagatcaaattagggcgcaaagcactgttggagacagaagccatggggaggaagaaacttgaaatcaagcgaattgagaacaaaagtagccgacaagttaccttctctaaacgacgcaacggtctcatcgagaaagctcgtcagctttccgttctctgtgacgcatccgtcgctcttcttgtcgtctccgcctccgggaaactctacagcttctcctccggtgataacctggtcaagatccttgatcgatatggaaagcaacatgatgatgatcttaaagccttggatcgtcagtcaaaagctttggactgtggttcacaccatgagctactggaacttgtggaaagcaagcttgaggaatcaaatgtcgataatgtaagtgtgggttccctggttcagctggaggaacaccttgagaacgccctctccgtaacaagagctaggaagacagaactaatgttgaagcttgtcgagaaccttaaagaaaaggagaagttgctggaagaggagaaccatgttttggctagccagatggagaagagtaatcttgtgcgagccgaagctgataatatggatgtctcaccaggacaaatctccgacatcaatcttccggtaacgctcccactgcttaattagtcacctttaatcggcgaataaataaaatccaaaacatataactaaaacaaacaagatgtgtaattatccccttgtaaagggtgtacgttgtataatctatactctctctccggctcgagaggcttcgggtgtaaaactatttcagatttatgtaagatagaaaatctatgcaagacactttcaa

SEQ ID NO: 15378 - DNA, 271 bp, Brassica napus
  Predicted polypeptide sequence is orthologous to G200
gatgctactccaccattgacatttattgagaaatggcttttggaggaaacaaatactggtggtcaaatggaggtgatgagtccattgatggagctctctaatatgctttaatttaggagatgtccccctctctctttttctttctccctgtgaatcttattaatgtgactactaattttatagacacaaataaagaaaccaaaatacataatatcatatgtttttttggtttcgaaagaaaaaaaaaaaaaaaaaaaaaaaaaaaaaaaaa

SEQ ID NO: 15379 - DNA, 737 bp, Brassica napus
  Predicted polypeptide sequence is orthologous to G207, G227, G230, G242
ggacttcttattgaaagatcctctcgcctggtttcaatggcggatcgtgtgaaaggtccatggagccaagaagaagacgagcagctgaggctgatggtggagaagtacggaccgagaaactggtcggcgattagcaagtcaattccaggtcggtctggtaaatcgtgtcgattacggtggtgcaatcagctatctccggaggttgagcatcgaccgttctcaccggaggaagacgagacgattgtctctgctcgcgccaagttcggtaacaaatgggccacgatcgctcgtcttctcaacggccgcacggacaacgccgtgaagaaccactggaactcgacgctcaagcggaaatgtttagatggtaatccgacgacggaggaggatcaagatcgggcgaagaagaggagatcgatgagctctgaatctgtccctccggtggacactggattgtacatgagccctgagagtcccacccacgttgctagcgactccagcgcggttcctcctcagctttttaaaccaatgccagtttccggcggattcacggtgccgtcgccggtggaaatgacgtcatcgtcggaggaagatccggcaactacgttgagtctgtcactgtcgcttcccgtaagccaggagtcgaggaacacgggttcgagcgacaactcgttgccgtttccgaagtttgagagtcagatgaagattaatgtaaaggagagaggaaaagcgcgtagagc

SEQ ID NO: 15380 - DNA, 389 bp, Brassica napus
  Predicted polypeptide sequence is orthologous to G207, G227, G230, G242
gcagcgagtttatggtgatggtgcaggagatgattaaggcggaggtgaggagttacatggcggagatgcagagagaccatagtggtattggtggtggtgtatttgtgggataatggaatgtttccgattaagtcgagttggagttgggagaacggagtagacaagtgagagcttagaaactgttacaatgaatatcacaaactcttttaagaaatgtatagagaaaatcgagtgagcaatctcagtccatgaacctagagacgatgataaaatactcgaaataagcttttttttctttataagaatgttaatgatcatcgataaagtatgtgaatgattcactaaactggtgccgaaaaaaaaaaaaaaaaaaaaaaaaaaaacatgtc

SEQ ID NO: 15381 - DNA, 727 bp, Brassica napus
  Predicted polypeptide sequence is orthologous to G217
gagctccgtcctctgttcttcgttctgccgatttgcgcgagcattagcttcctttaagcttgagtgcgttggggagaacaaacagttgagcgaagatgaggattatgatcaagggaggtgtgtggaagaacaccgaagatgagatcctcaaagccgccgtcatgaagtacggtaagaaccaatgggctcggatctcctctcttctcgttcgtaagtccgccaaacagtgtaaagctcgttggtacgagtggctcgatccttccatcaaaaagacagaatggaccagagaagaagatgagaagcttctacatcttgctaagcttttgcctactcagtggagaactattgctcctatcgtgggacgaacgccatctcagtgccttgagaggtatgagaagcttcttgatgcagcttgcaccaaggacgagaattacgaagcggctgacgatccgcggaagctgcgtcctggcgagattgatcctaatccggagtcaaagcctgctcgtcctgatccggtggacatggacgaagacgaaaaggagatgctttccgaagcgagagcgaggttggccaacactaggggaaagaaggcgaagagaaaagctagagagaagcagctcgaggaagctaggaggcttgcttctctgcagaagaggagagagttgaaagcggctgggattgggaacagccataggaaaaggaagcgaaaggggattgattataatgc

SEQ ID NO: 15382 - DNA, 768 bp, Brassica napus
  misc_feature (9)..(9): n is a, c, g, or t
  misc_feature (17)..(17): n is a, c, g, or t
  Predicted polypeptide sequence is orthologous to G256, G666, G668, G932
taattgaanttaccgangggaaattaaataaaattattaatattagctcaggttatctaagctagttaattcggaaagccaaaaataaacaaattataaaaagaaaaagagatgatgatcctaaaattagaaccatctgattaggcaaattcttcagaagaaattagggttttcatccaacacaatatcaccaatcggtccaccagaatcctcaaacagccacttttcaaacaaagaccattgactttggttactgcatccagttatgtctggtttggtctcatgatccggtgatactccagcctgatgatatgatgagtcacaatctttcaagtgatcaaaccccgaaaatgactggaattcccctgcacagtcctcgacatcactcttgagcacatcttttgtctcagaatctggagaaaccattaaatccgcagagttcgaaatcttcggagagttcttcacccaccctttgagcaattttgctatattctcggtgctcgaggcataagcggtagatgtttcttgcgtcctaagaaacctgcaagctgaggaagtagaacgtcttgattcagcagaagaagatgttgtggccgtggtggcaaatgtagaggtaatgattggcgccacagcaggagacaaagcctcagagagagccttcttcgccaagtgaatatcagtttgaagccttctttcccattggcctcttgagatgtttgagttggagttagcagaagaagatgatggagaagaagagaggtctcttga

SEQ ID NO: 15383 - DNA, 612 bp, Brassica napus
  Predicted polypeptide sequence is orthologous to G264
ctgatggtagcttttcatgtcatttaaatcttacattggcttctgctccattaccagacaagacagcttcgcagatagctaaggcaactcataaaagtcaggagattggaagagttaccgagttaaacttcaactcaatagaaacaagttcaagtgagaaaaatcgaggtcaacaagaggttgcagctggaggtaaacaagcaaatgcagcacctccggctagggtgaatgatgtattctgggaacagttcctaacagaaaggccagggtcttcagataacgaggaggcaagctctacttatagagaaaacccatgtgaagagcaagaggagaaaagaaatgggcatgtgatgtcacgtaatacaaagaatatcgagcagctgaccctgtgacgtaacgacaccggtcatatcaacgataatagtctgtggttttggtatatgtatggatggagtgagtattgaaacattggactgaaacagcgtctaaagagtaagtagccttggcgtaaacgtatgtatctctcacctttttgtttgtttcgacaacttgtaattgactctagatttaagaaatattgacttattagtttggtaacaaaaaaaaaaaaaa

SEQ ID NO: 15384 - DNA, 621 bp, Brassica napus
  Predicted polypeptide sequence is orthologous to G275, G837
gattcgctgctgctttgaaggatctcaagctatgggtgatgaacgtggttcctgtagacgctcctgatacgcttccagtcatatatgaacgtggtttgtttggaatctatcatgactggtgtgaatcattcaacacttatcccagaacttatgaccttctccatgctgatcatcttttctccaccctaaggaagaggtgcaagttggagtcggtaatggctgaagtggatcggattctgagaccagagggaactttcatcataagagacgacatggagacaataggggaggttgagaagatggtgaagtccatgaaatgggaggtgaaaactacacagtctaaagacaatgaaggcttgctttcgattaagaagtcatggtggcgtcctacacaaactgagacaatcgaatcggccatagcttaagacaagtcagaaaagccatcacacttgagtatagtttcattcatgtttggttttctttcaggccttcagaaggctcttgcttatcaaaattgaattattagtttaatatttgtatcttttacgtatacgtaaactcatgaacacaaagttcttttgaaatcatttgcccgaaaaaaaaaaaaaaaaaagggggccc

SEQ ID NO: 15385 - DNA, 2090 bp, Brassica napus
  Predicted polypeptide sequence is orthologous to G278, G1290
tggatctcaagtctttcgattgataagtattcttcgttgattcggtccttctttcttggagtcttcacttctcaccatcggatctctgtgacctttgatggagaccattgctggatttgatgatttctatgagatcagcagcactagcttcctcgccgcaccggcgccaaccgataactccggatcatccaccgtctacccgacggagcttttcaccagacccgaggtatccgcgtttcaactcctctccaacagcctcgagtccgtcttcgactcgccggaagcgttctacagcgacgccaagcttgttctctccgacgacaaggaagtatccttccaccgttgcattctctcggcgagaagcctcttcttcaaggccgctttgacagccgccgagaaggtgcagaagtccacccccgtgaagctcgagctgaagacactcgcggcggaatacgacgtcgggttcgattctgtggtggctgttctggcgtacgtttacagcggcagagtgaggccgcctccgaagggagtttctgaatgcgcagacgagagctgctgccacgtggcgtgccgtccggctgtggatttcatggtggaggttctctacttggctttcgtcttccagattcaggaactggttaccatgtatcagaggcatttactggatgttgtagacaaagttatcatagaagacactttggtcgtcctcaagcttgctaacatctgcggtaaagcgtgcaagaagctattcgataagtgcagagagatcattgtcaagtctaacgtggatgttgttactctaaagaagtcattgcctgaggacattgccaagcaagtaatcgatatccgcaaagagctcggcttggaggtagctgaaccagagaaacatgtctccaacatacacaaggcgcttgagtcagacgatcttgaccttgtcgttatgcttttgaaagagggccacacgaatctagacgaagcgtatgctctccattttgctgttgcgtattgcgatgagaagacagcgaggaatctcctggaactggggtttgcggatgtcaaccggagaaacccgagagggtacacggtaattcacgtcgctgcgatgaggaaagagccgacactgatagcattgttgttgacgaaaggggctaatgcattagaaatgtctttggacgggagaactgctctgttgatcgcgaaacaagtcactaaggcggccgagtgttgtattctggagaaagggaagttagctgccaaaggcggagtatgtgtagagatactcaagcaaccagacaacacacgagaaccatttcctgaagatgtttctccctcccttgcagtggctgctgatcaattcaagataaggttgattgatcttgaaaacagagttcaaatggctcgatgtctctatccaatggaagcacaagttgcaatggatttcgcccgaatgaagggaacacgcgagtttgtcgtgacgacagcaactgacctacacatggaacctttcaagttcgtagaaatgcatcagagtagactaacagcgctttctaaaactgtggaattcgggaaacgcttcttcccacgctgttcgaaagtgctcgatgatattgtggactctgaggacttgactatactggctctcgtagaagaagacactcctgagcaacgacaacaaaagaggcagaggttcatggaaatacaggagattgttcaaatggcgtttagtaaagacaaggaggatcttggaaagtcgtctctctcagcttcgtcttcttccacatccaaattaactggtaaaaagaggtctattgctaaaccctctcaccggcgtcggtgacactatttgttcggggtaatatttgatgtaccatatatatatatttgagttatcatgtgtcttagtgtctctgtctattgttggctcagtcatatagttttgttcgtcattttgcatcctgtgtattccgcagctttcggtgtgtttgaagcaaatgctgtaaccttttgaatctgtgatatatctattataataaaccatgatgggtgttacagaaaaaaaaaaaaaaaaaaaaaaaaaaaaaaaaaaaaaa

SEQ ID NO: 15386 - DNA, 950 bp, Brassica napus
  Predicted polypeptide sequence is orthologous to G280
tcggcacgagctctctcctacctcactcctctctctctcttcctctccctgcaaaatcatggcgacggagaccgagcttgaacctcaacaatcaccaatggcggaggagcagcagccgagtcccttctctctccctccgtatcctcagatgatcatggaagcgatcgaagcatcgaacgacgcgaacggttgcaacaagacggcgatcgcgaagcacatcgagtcaactcaaacctctctaccaccgtctcacatgacgctcctcagctaccacctcaaccagatgaaacagtccggccagatcgcgatggtgaagaacaactacatgaaaccagatccgcaagctccgcccaagcgcggccgtggccgtcctccgaaggcgaagcctcagggagagtcaagccacgtggcggtcccggctccttccgtttcctcgccgaggcctagaggtcgtcctcctaaggcgaaaggaccttcctcggaggtggagacgaaagttgcggcaccgagtggctccgggaggccacgtggacgaccgccgaagaagcagaagacggaatccgaggcggttaaagccgatgttgaacctgcggaggctccggctggggagcggagagggcgtggaaggccaccgaaagcgaagcctgcgatggtgcctgttggttgctaaagttgacgctgtagcaaatcgaataagctttgattagaagcttaagcaacaaaatcctaaaagagagttcttttaaaaataattagtatttttctaagtcgagtttaatggttaattgtctgttattttaatttttaggggttggtggaaaaaaaaatgtcgtctgagaatgagagactgtaattcgggtttgcatgtggtggtgtgatgtataaatttcgggtatttctttaccctttttctaaagtaacgctttggtgaaaaaaaaaaaaaaaaaaaa

SEQ ID NO: 15387 - DNA, 718 bp, Brassica napus
  misc_feature (685)..(716): n is a, c, g, or t
  Predicted polypeptide sequence is orthologous to G353, G354, G2839
acaactatcacacaaacacataaactcaaaaatcttattctatttgtttcgttttatcatcagaaaaacataaacatggttgctatttcagagatcaagtcgacggtggagactacggcggcgaactgtctgatgctcttatcaagggtcggacaagaaaacgttgacggtggaagcgcaaaacgcgttttcacatgtaagacgtgtttgaaggagtttcattcgtttcaagcgttgggaggtcaccgtgcgagccacaagaagcctaacaatgagaatctctctagtttgatgaagaagacgaaagcttcgtcttcccatccttgtccgatatgtggagtggagtttcccatgggacaagctctaggaggacacatgaggagacacaggaacgagagtggcggcgccggcgcgttggttacacgcgagttactgtcggaggcagcgttgacgacgttgaagaaatcaagcagtgggaggttggcttgtctggatctgagtttgggaatggtggagaatttgaatctcaagttggaacttggaagacctgtttgttgatttgttttttctttttcctttgtgttcttttttcctggatatattaattagtttctctcattctttgatttgtttccttaatattttagattcatacatatacatctgcagatttaggaaaaaaaannnnnnnnnnnnnnnnnnnnnnnnnnnnnnnnaa

SEQ ID NO: 15388 - DNA, 735 bp, Brassica napus
  Predicted polypeptide sequence is orthologous to G353, G354, G2839
gaaacaactcacaacaataacaatcacaccaaacacatacacaaacctttaatcgtttcgttttatcatctgaaaaaaaaaaaaaaaatggttgcaatctctgagattaacccgacggtggaggctacggcagcgaactgtctgatgcttttatcaagagtcggacaaaaaggtgcggatcagaaacgcgttttcacatgtaaaacgtgtttgaaagagtttcattcgtttcaagcgttgggaggtcaccgtgcgagccacaagaaacctaacaatgagagtctctctggattggtgaagaaagccaaagctccttcgtcgcatccttgtccgatatgcggagtggagtttccgatgggacaagctctaggaggtcacatgaggagacacaggaacgaaagtggcggcggcgcagcgttggttacacgggcgttattgccggagccgacgatgacgacgttgaagaagtcgagcagtgggaagagggtggcgtgtttggatctgagtctggggatggtggagaatttgaatctcaagttggagcttggaagaacagtttgttaattttttttttttaatggatataataattagtttccttcattctcttgaatttttccttaatagtttagatttgtatatctgcagatttaggaaactttcatagggtgtaatcttttctttcctagtgaatatatttacttagcattggagatcaaaaaaaaaaaaaaaaaa

SEQ ID NO: 15389 - DNA, 671 bp, Brassica napus
  Predicted polypeptide sequence is orthologous to G371
gaacataaagcaaacaaaatctctgcaggtttcgaaaggcttaattagcactcaagcagaagagatctatatatatacctacaacctcttccaaggtaaaatggagatagagaaggtagaagactcagcagcattgggtgactccggaggagacttcgactgcaacatatgtttggatcaagtacgtgacccggtcgtgacattatgtggccacttgttttgttggccctgcatatacaagtggacttattccaccaacaatacaagaagacgcgtcgatcagtacgataaaaaggagtccccaaaatgtccggtctgcaaatctgatgtatcggacgctacgcttgtccctatctacggccgggggcagaaaataccccagtccggttcaaacgtaccgaacagaccatccggtccgctttatgactcaagaggagttggtcaacgtttaggagaaggtgagagtcaacggtacatgtatagaatgcctgatccagtgatgggtgtggtatccgaaatggtatatcggagactatttggagagtcttctacgaacatgacaccgtaccgtagcgaccatgacataagtctacggtcaatgcggcggacaatgcaggtggatgagtcgctaagcagagtctacttgttcctgctttgcttcatggttatgt

SEQ ID NO: 15390 - DNA, 782 bp, Brassica napus
  misc_feature (575)..(575): n is a, c, g, or t
  Predicted polypeptide sequence is orthologous to G390, G391, G438
agtacgtgaggaatgttgttggttcgattcagagagttgctttagcaattacgccacgtcctggctcgatgcagtttcccacttcccctgaagctctcactctggcccgttggatctcccgcagttacagccttcatacgggagcaaacatgttcggagctgatactcaaggttgtgatggagacacattgctcaagcaactctggaaccattctgatgccatcttgtgctgctccctcaaaactaatgcctcaccggtatttacatttgccaaccaagccggtttagacatgcttgaaacaacactggtggcacttcaggacataatgctggacaagactctagatgactctggtcgtaaagctctttgctctgagttcgctaagatcatgcagcagggatatgctaatcttccggcgggaatatgtgtgtcgagcatggggagaccagtttcgtatgagcaagcgacggtgtggaaagttctcgacgacagtgagtcgaatcactgcttggctttcatcctggggaactggtccttcgtgtgaagaagatgtttgtttgtgaaagaagaaganagggatgatgtattgttatgttatatattaaggttaggatgctgtttttctcactaaggtttgttaaatctagagggtcaatatgtgtaatatgttgacaaatgtgatgatgtctctttaacaattatgacactatgtatggcatgacttatattatttatattttgtgtttatgttgtaaaaaaaaaaaaaaaaaaaaaaaaaaaa

SEQ ID NO: 15391 - DNA, 528 bp, Brassica napus
  Predicted polypeptide sequence is orthologous to G431
caggcagaagatagggagcttaaaggacagctcttgcgcaagtacagtggttatttaggcagtctgaagcaagagttcatgaagaagaggaagaaaggaaagcttcctaaagaagctcgccaacaactacttgactgtggagccgacactacaaatggccttacccttcggagcagcaaaagctagcactagcggaatcaacggggctggaccagaaacagataaacaattggttcataaaccagaggaaaaggcactggaaaccgtcggaggatatgcagtttgtagtaatggacgcaacacatcctcaccattactttatggacaatgtcatgggaaatcctttccccattgatcacatctcctcgaccatgctttgatcgatcctttggaaaaactctatttcataatatctaatcattaaaaagctttgcaatatgtatactgtatggtttcttggaatactttggaacgtgcaacgttccgattgacaaaaaaaaaaaaaaaaaaaaaaaaaaaaaacatgtc

SEQ ID NO: 15392 - DNA, 695 bp, Brassica napus
  Predicted polypeptide sequence is orthologous to G464
ggagctggagatggggaaagctgagagtgagctagaactgggactagggctgagtctgggcggtggaacggcgtccaagattgttaaaccaggtggtggcggcgcgtggggagagcgtgggaggcttttgactgcaaaagattttccttcagttggctctaaacgagctgccgactctgcttctcacgctggtgcatctcctcctcgttcaagtcaagttgtgggatggccacctattggatctcacaggatgaacagtttggttaataaccaagccacaaagaaagaagatgatggtaagaagcaagccaaagatgatgagactaaagatgttacaaagaaagtgaatggaaaagttcaagttgggtttatcaaggtgaacatggatggagttgctataggaagaaaagttgatttgaatgctcattcttcttacgagaatttggcgcagacactggaagatatgttctttcgcactagtcccggtactattgggttaacgggtcagttcaccaaaccgttgaggcttttagatggatcttctgagtttgtacttacttatgaagacaaggaaggtgatgggatgcttgtgggtgatgtcccatggagaatgttcatcacgtcggtgaaaaggcttcgggtgatgaaaacctctgaagctaatggactgctgtaagacatcaagatccgaagga

SEQ ID NO: 15393 - DNA, 2547 bp, Brassica napus
  Predicted polypeptide sequence is orthologous to G470
atggcgagttcggaggtttctatgaaaggaaatcgtggacgaggagaaaacttctcctccgctggttacagtgacccgacggtcgccggcgaggcgcagaaaactcagtctaaccgatctgtggctgcagagcgcgttgtcgacccggaagctgctctctaccgtgagctgtggcacgcttgtgctggtcctctcgtgacagtccctcgacaagatgaccgagtcttctacttccctcaggggcacatcgagcaggtggaagcatcgacaaatcaagctgcagaacagcagatgcctctctatgatcttccttcgaagatcctttgtcgtgtcattaatgttgatttaaaggcagaggcagacaccgacgaagtttatgcgcagattactcttcttccggagcctgttcaagacgagaattcaatagagaaagaggcgcctcctcctccgcccccaaggttccaagtgcactccttctgcaaaaccttgactgcatcggacacaagtacacatggtggattttctgtgcttaggcggcatgcggatgaatgtctcccacctctggatatgtcacgtcaacctcctactcaggagttagttgcaaaagatctgcatgcaagcgagtggcgtttccgacatattttccgaggtcaaccacgaaggcatttgcttcagagtggatggagcgtgtttgttagctccaagaggctggtcgcaggcgatgcttttatatttctaaggggcgagaatggagaattacgtgtgggtgtaaggcgtgcaatgcggcagcaaggaaatgtgccatcctctgttatatcaagccacagcatgcatctcggagtattggccactgcctggcacgctatttcaactggaaccatgtttacagtctactataaaccgaggactagtccttcagagtttattgttccgtttgatcagtatacggagtccgtgaagattaactactccataggcatgagatttaaaatgagatttgaaggcgaagaggctcccgagcagaggtttactggcacaatcgttgggattgaagactctgaccccacgaggtgggcaaaatcaaaatggagatccctcaaggtacggtgggatgagaccactagtattcctcgccctgatagagtatccccgtggaagatagagccagctctttctcctcctgctttgagccctgtaccaatgcctaggcctaagaggcccagatctaatctagcttcttcaactccggactcttccatgcgcataagggaaggctcatctaaggcaaacatggaccctttaccggcaagtggactatcaagggtcttgcaaggtcaagaatacccgaccttgagaacgaaacatgttgagagtgtagaatgcgatgctcctgaaaattcggttgtgtggcaatcgtcaactgatgatgacaaggttgatgtgatttcagcttctaggagatatgagaactggatatcctcaggtaggcatggacctacttgcacggatttgctttctggctttgggacaaacatagaaccacctcacggtcatcagatacctttttatgaccgtttatcatcaccaccttctgtggctgcaaggaaaatcctcagcgaccaggatggcaagtttgaatatcttgctaaccagtggatgatgcactcaggcctttccctgaagttacatgaatctcctaaagtccctgccgcatctgatgcctctttccaagggataggcaatcccaattacggcgaatatgctttgcctcgtgcagtgacgactgagaatgctgctggcaactggccaatacgtccacgtgctctaaattattttgaagaagcggttcatgctcaggctagagagcatgtgacaaaacgtcctgcggtcgtacaagaggaggcagcaaagccaagagacgggaactgcaggctttttggcattcctctggtgaacaacgtgaatgggacagatacaactttgtctcagagaaacaatttgaatgaccctgcggggcctacgcagatggcatcaccaaaggttcaggatctttctgaccagtccaaagggtcaaaatcgacaaatgatcatcgtgagcaaggacgaccattcccggttagtaaaccccatccgaaagacgttcaaaccaaaacaaactcatgtaggagctgcacgaaggttcagaagcaggggattgcacttggccggtcagtggatctctcaaagttccagaactatgaggagttggttactgaattggataggctgtttgagttcaatggagagttgatggctcctaagaaagattggctgatagtttacacagatgatgagaatgatatgatgcttgttggagacgatccttggcaggagttttgttgcatggttcgtaaaatcttcatatacacgaaagaggaggtcaggaagatgaacccgggaactctatgctgtaggaacgaggaagaaccagttgttggggaaggatcagatgcaaaggacgcgaagtctgcatcaaatccttcattgtccagcgccggaaactcttaa

SEQ ID NO: 15394 - DNA, 735 bp, Brassica napus
  Predicted polypeptide sequence is orthologous to G477
ggggagtctctctctacttttagagagatatttctctctcgataacctctgttcacagacatctatctttcacagaggatcgagattatctcttttggtgtaatatatttcgatctttgatcgacttctcttctggttaatcagatttctttttcgcgatatcgatttttgttgtgttttcaacccaaatctgatatgttcttcatcttcttcttcgttgatcagttttgtggttgaaattaataaattcgcgttggcgatagtgttcttctccaatctcctcttttgcaaaaaaatatagaaaatcccgtttgcttgtattggaatctttttttctctaaggatatgcactcaatcctctttagcgagagtcaatctttactttctatgcgaaaccaattggcttttagtaaagtatctttgcggagaggaagcggtggagttggattgatatcagttgatttaacagaggtttagtcgagctggcatctccttatggatgatggtccggtaaaagatctctcgtttgtcaactgaactatctctaaaattatcatctacggagggatggagcttccattatacatgcataggctgaaacgaaagctggaggtaaaaggtattggcgtttgcagacagagatccatgaatcctatggtgtggagaaacaagagatggaagattgatcttcagaactcccagcggcgaaaaactacggtggttgtgtttgccatt

SEQ ID NO: 15395 - DNA, 622 bp, Brassica napus
  Predicted polypeptide sequence is orthologous to G484, G2631
ctaaaattataaaggagatgttaccagcagatgttcgcgttgctagagatgctcaggaccttctcatcgagtgctgtgttgagtttataaaccttatatcgtcagagtctaatgaagtatgtaacaaagaggataaacgaacgatcgcgcctgagcatgtactcaaagcgcttcatgttcttggatttggggaatacgttgaagaagtctactctgcttatgagcaacataaatacgaaaccatgcaagattcacagaggagtgtgaagatgaacaccggagcagagatgacggaagaggaagcagcagcggaacagcagaggatgtttgcggaagctcgagctagaatgaatggaggtggtgtttctgttccgcaaccagagcagcaactagatacccaacagccaaatctacaaagctaatcaagaaggggaggatacttcttttaacatttttttttttccggtagcatttctctgtaaagtgcaaagattcgtcttcttggtgttgataagctctttacatttttaacttagatttgtgttttcttttgaatctaaaatcgcttgggtgattcagatgtaattagtaaagcattgtcttgtttcaaaaaaaaaaaaaa

SEQ ID NO: 15396 - DNA, 500 bp, Brassica napus
  Predicted polypeptide sequence is orthologous to G489, G714
gaggatctgagggatgaggtcttggggagtattccgagagggactgtccctgaggctgctgctgctggatatccgtatggttacttgcctgctggaactgctccgatagggaacccggggatggttatgggtaaccctggtggtgcgtaccctcctaacccttatatgggtcaaccaatgtggcagcaacagggacctgatcagcctgaccaggagaattagctttgtcagagaaactagttctggaattaagaaaggaggagacttttagtgaagaaaatgaaaaagaacatatcagaagaatttcaaatcagtgtggtagaagaatcttaaagtgttttgttttatgtctattcaatcctttcttttaaggataaatttagatatgaaccagaagaatgtataaaactataactctgtaagggaacaagtgtgtggttgacaaggtttttaatttctatgttattgtttcttattatctttaaaaaaaaaaaaaaaaa

SEQ ID NO: 15397 - DNA, 849 bp, Brassica napus
  Predicted polypeptide sequence is orthologous to G502, G519
acaaaatgaaggcggagctaaatttaccggcgggattccgatttcacccgacggacgaggagctagtgaagttctatctctgccggagatgcgcgtcggagccgatcaccgttccggtgatcgcggagattgatctgtacaagttcaatccatgggagcttccagacatggctttgtacggagagaaagagtggtacttcttctcacaccgagaccggaaatacccaaacggttcgcgtccaaaccgggcagcgggaaccggttattggaaagcgactggagctgataaaccgatcggtaaaccgaagacgttggggattaagaaagcgctcgtcttctacgcagggaaagctccgagaggagtgaagacgaattggattatgcacgagtatcgtctcgctaatgtcgaccggtctgcttcttcgaacaagatgaacaacttaagacttgatgattgggtgttatgtcggatttacaataagaaaggaacggtggagaagtattatccggcggatgagaaagagagggtgatgatggtgattactaatactactacgacgtcggattcgaaatgctcgagtcacgtgatttcaccggacgtcacgtgttcctccgaggttcagagcgagtcgaaatgggttgatcttgaggacgcgtttgatgcgtccatgtttggttccttgttgcaaaatgacgcttttgtccctcagtttccgtatcagtctgatttcgccgctatgttcgaggacccgctggagcagaaacccttcttcaattggagttttggttctcaggggtaaagttgtaaagagcatagagtttgaaagctttctcagagtacccggcaaa

SEQ ID NO: 15398 - DNA, 1051 bp, Brassica napus
  Predicted polypeptide sequence is orthologous to G502, G519
gaaacaataagaagaagaagaaaaagtgggatatggtgaaagcaggggctgatttgcaatttccaccgggatttagatttcatccgacggacgaggagctcgtcctcatgtatctctgccgtaaatgcgcgtcgcagccgatcgctgctcctatcatcactgaactcgatttgtatagatatgatgcttgggaccttcccgacatggctttgtacggagaaaaggagtggtattttttctcaccgagagaccggaagtacccaaatggttcaagaccaaaccgggcagctggtactggctattggaaagctacaggtgctgataaaccaatcggtcgtcctaaaccggtcggtataaagaaggctctagtgttttattccggaaaacctccgagaggagagaaaaccaattggattatgcatgaataccggctcgcagacgttgaccggtcggttcggaagggaaacagtttaaggctggacgattgggtgttgtgtcgtatatacaacaagaaaggtgtcatagagaagcgacggagtgaggtagcgaacggtcatgtgatggctccggttatgttaaacttcgacaaaccggaattgatcggcggcgggtcgagctgctcggaccaacgagtagtgtctccggagttcaggtgcgaggctaagaccgaaccgagtagatggagcaacgccctcgaagttccgtttaattacgtagatgccatcgcagataacgagattgtgtcgcggctattgggcgggaaccagatgtggtcgacgcttgatccacttgttgttcggcagagaactttctaagctgtcacgtgcgagttggtggaaactaccaaccacgggcatcccacgtgccggtaaaccggtttgaatccactatgctgaaccggaagggaacggattgggttttttttggcaataattaagccttcgttttgctccttgattaatacgagatacacagcctactctatgtatgacccagcatagcaatataatggttctctacataaattttggaataaattcattttaaaatc

SEQ ID NO: 15399 - DNA, 1211 bp, Brassica napus
  Predicted polypeptide sequence is orthologous to G502, G519
atttcattaggattatattactagagacagatcctcgaatagaaaagaaaatgtcagaactacagctgcctccaggattccgatttcacccaaccgacgaagagctggtgatgcactatctctgccgcaaatgcgcctctcagtccatcgccgtccccatcatcgctgagatcgatctctacaaatatgatccttgggagcttcccggtttagccttgtacggtgagaaggaatggtatttcttctctccaagagacagaaaatatccgaatggttctcggccgaaccggtcagctggttcgggttactggaaagctactggagctgataaaccgatcggacttcctaaaccggttgggattaagaaggctctggttttctacgccgggaaagctccaaagggtgagaaaaccaattggatcatgcatgagtaccgtcttgccgacgttgaccgatcatcggctgctcgcaagaagaagaatagtctcaggctggatgattgggttctttgtcggatttacaacaaaaaaggagccatcgagaagcgaggaccaccaccaactccggttgtttacggcgacgaggtcgtggaggagaagccgaggctgtcggagatgggcatgcctcctccgccggtgatgccgaatgatttcgtgtactttgacacgtcggactcggtgccaaagctgcatacgacggagtcgagctgctcggagcaggtggtgtcgccggagttcacgagcgaggttcagagcgagcccaagtggaaggattggtcgggtgagaaaagtagccttgattttgggtttaattacatagatgccaccgcgttcgggggaggaggagggagcaatcagctgtttccgctacaggacatgttcatgtacaacatgcccaagccttattaggtgaaggcaaacgctcgtctatgggtatcacgagatcggttacggttacggtcggtcaatgagtgtgccgccattagatatttattaccatgatgtttgttgttcagtgttacttttattttctaagcggtcagattacgggaaatctctaatcggatggcggtcgatgtgtcattgtactagtgttgtttggtagaagaatccacatgtcttttcttttttgggctttagtggggcataaaagtcaaaagctaaggatatttgttattatctccttcgtaataatcaattaaatatttcttg

SEQ ID NO: 15400 - DNA, 1229 bp, Brassica napus
  Predicted polypeptide sequence is orthologous to G502, G519
atttcattaggattattactgcagacagatcctcgaaatagaaaaaaatgtcagaattacagctgcctccaggattccgattccacccaaccgacgaagagctggtgatgcactatctctgccgcaaatgcgcctctcagtccatcgccgtccccatcatcgctgagatcgatctctacaaatataatccttgggagcttcccggtttagccttgtacggtgagaaggaatggtatttcttctctccaagagaccgaaaatatccgaacggttctcggccgaaccggtcagctgggtcaggttactggaaagcaactggagctgataaaccgatcggacttcctaaaccggttgggattaagaaggctctggttttctacgccgggaaagctcccaagggtgagaaaaccaattggatcatgcatgagtaccgtcttgccgacgttgaccgatcggctgctcgcaagaagaagaatagtctcaggttggatgattgggttctttgtcggatttacaacaaaaaaggagctatcgagaagcgaggaccaccaccaactccggttgtttacggcgacgaggtcgtggaggagaagccgaggctgtcggagatgggcatgcctccgccgccggtgatgccgaatgatttcgtgtactttgacacgtcggactccgtgccaaagctgcatacgacggagtcgagctgctcggagcaggtggtgtcgccggagttcacgagcgaggttcagagcgagcccaagtggaaggattggtcgggtgctgctaatgataagaatagccttgattttgggtttaattacatagatgccaccgcgttcggaggtgtagggagcaatcagctgtttccgctacaggacatgttcatgtacaacatgcccaagccttactaggtgaaggcaaacgcttgtgtttttcgtctatgggtatcacgagatcggttacgatcggtcaatgagtgtgccgattcggcggagcctccattagatattttattatcatgatgttgttcagtgttacttttattttctaagctgtcagattacgggaaatctctaatcggacggcggccgatgtgtcattgtactagtgttgtttggtagaagaatccacatgtcttgttctttttgggctttagtgggggcataaaagtcaaaagctaaggatattttttattatctccgtcgtaataatcaattaaatatttcttgatc

SEQ ID NO: 15401 - DNA, 1060 bp, Brassica napus
  Predicted polypeptide sequence is orthologous to G502, G519
cgaagaaaagagaagacttttgaaaaaaaaaatgaaagcagggctaaacttaccagcaggattccgattccacccaacggacgaagagcttgtgcaattctacctttgccggaaatgcgcatcggaggagatctcagctccggtcatcgccgaaatcgatctctacaagttcaacccctgggagcttcctgagatgtctctgtacggagagaaagagtggtacttcttctcgccacgagaccggaaatacccaaacggttcgcgtcctaaccgggcggcgggaaccggttattggaaagccaccggagctgataaaccgatcggtaaaccgaagacgctgggtattaagaaagcgctcgtgttctacgcagggaaagctcccaaagggattaagacgaattggattatgcacgagtatcgcctcgctaatgtggacagatcagcttctgttaacaaaaagaacaaccttcgacttgatgattgggtgttatgtcgaatctacaacaagaaagggaccatggagaagtactaccctgctgatgagaaaccgatgaccgtgacggcggcttcatcgcctttcgatgcgtcggactcgacttacccgacgttgcaagaggatgactcgagcagctcggggggtcgcgtggtgtcgccggatgcgcgggaggtgcagagcgagcctaaatggggggagtttgagaatgcttttgatgcttccatgttcggtggtggctccatggacttgctgcagagtgaagattttgtgcctcagttcttgtaccagccttcttatgatttcaactcctggcaggaggatccgccggagcagaaaccgttcttgaattggagttttgctccacaggggtgaaaaaggaagagagtgaaaggttttttggtctgtgttgtgatatgtgttagagagaagttctcaatcatcttttgtttcttagtagtgagagaaagattgtagagtgttgatagtttcttagcatcttcaatgtttcattggcaggtgaattcttgttatttcatcagaaatttatatgaaaaattatacctt

SEQ ID NO: 15402 - DNA, 1066 bp, Brassica napus
  Predicted polypeptide sequence is orthologous to G502, G519
ccagatactcgaagaacgcaacgagagaaaaaaaaaagaaagaaacttttggagaatgaaagcagagctgaacttaccagcaggattccgattccaccccacagacgaagagctagtgagattctacctgatccgtaaatgcgcgtcggagcagatctcagctccggtcatcgccgaaatcgatctctacaagttcaatccttgggagcttccagagatgtctctgtacggagataaagagtggtactttttctcaccacgagaccggaaatacccaaacggttcgcgtcctaaccgggccgcaggaaccggttattggaaagccaccggagctgataaaccgatcggtaaaccgaagacgttggggataaagaaagcactcgtcttctacgctgggaaagctcctaaagggattaaaacgaattggattatgcatgagtatcgcctcgctaatgttgatagatcggcttctgttagcaaaaagaacaacctacgacttgatgattgggtgttatgtcgaatctacaataagaaaggaaccatggagaagtactaccctgctgatgagaaaccgaggatcatgacggatcagtcatcatctccttttgatacatcggtttcgacattgcaagaggaggattcgagcagctcggggggtcacagtcatgtggtatcacctgatgctaaggaagttcagagcgagcctaaatggagagagcttgaggatgctttggaggcttttgattcttccatgtttggtggtggctccatggatatgttgcagagcgatgcttatatacctcagttcatgcatcagcctaccgattgtttcacaaccttacaggatccgtttgagcagaaaccgtttttgaactggagttttgctccacaggggtgaaaaggaagagatgttggtgttgtgatgtggtagagagaagttctcaatcatttgtttcttagtagtaaaaaaagattgtatagtgttgatagttcttagcatcaatgtctcattgataggcaaattcttgtaatttccttatatgaaaatatacacattcttcaggat

SEQ ID NO: 15403 - DNA, 1173 bp, Brassica napus
  Predicted polypeptide sequence is orthologous to G502, G519
caaaatgaaggcggagctaaatttaccggcgggattccgatttcacccgacggacgaggagctagtgaagttctatctctgccggagatgcgcgtcggagccgatcaccgttccggtgatcgcggagattgatctgtacaagttcaatccatgggagcttccagacaaggcgttgtacggagagaaagaatggtacttcttctcacaccgagaccggaaatacccaaacggttcgcgtccaaaccgggcagctggaaccggttattggaaagcgactggagctgataaaccgatcggtaaaccgaagacgttggggattaagaaagcgctcgtcttctacgcagggaaagctccgagaggagtgaagacgaattggattatgcacgagtatcgtctcgctaatgttgaccggtccgcttcttcgaacaagaagaacaacttaagacttgatgattgggtgttatgtcggatttacaataagaaaggaacggtggagaagtattatccggcggatgagaaagagagggtgatgatgatgactactaatactactacgacgtcggattcgaaatgctcgagtcacgtgatttcaccggacgtcacgtgttcttccgaggttcagagcgagtcgaaatgggttgttgatcttgacgacgcgtttgatgcgtccatgtttggttccttgttgcaaaatgacgcttttgtccctcagtttccgtatcagtctgatttcgccagtatgttcgaggacccgctggagcagaaaccgttcttcaattggagttttggttctcaggggtaaagttgtaaaggggatagagtttgaagctttctcagagtatccggccactgaaccggaggggggaactcggtgtcggatcctgacccgggaaccaagctgggctaaacaagttactgagactttcaacatctgatgaagggacaaatggtgtgtccattggtctctatcagactcatcagcaaggttgacttatgttttttttgttttgtttataaagtgatatttaaagaaacagaactgtaaaagaaacagtgactatttcaaatcacatatgtattcatatatatgttgtatataacaatttttttttctagtagttgtttaatatctttgtaatcacatttttaattaatgaaaatttatttgccttt

SEQ ID NO: 15404 - DNA, 1114 bp, Brassica napus
  Predicted polypeptide sequence is orthologous to G502, G519
aaaaaaattgaacgaagagatttgaagagagaaaagagaagagaatgatgaaagcagagctaaacttacctgcaggattccgattccatccaacggacgaagagcttgtgaaattctacttgtgccggaaatgcgcatcggaggagatctcagctccggttatcgccgaaatcgatctctacaagttcaatccttgggagcttccagagatgtctctgtacggagagaaagagtggtattttttctcacatagagaccggaagtacccaaacggttcgcgtccaaaccgggcagctggaaccggttattggaaagcgaccggagcggataaaccaatcggtaaaccgaagacgttgggtattaagaaagctctagtcttctacgctgggaaagctcccaaagggattaaaacgaattggataatgcacgagtatcgtctcgctaatgtcgatagatcagcttctcttaacaaaaagaacaacctacgacttgatgattgggttctatgtcgaatctacaacaagaaaggaaccatggagaagtactaccctgcagatgagaaaccgaggaccacgacatcaatggcggatcaatcatcatcgccttttgacacatcggactccacttaccagaatgattcgagcagctcggggggccacgtcgtgtcaccggatgccaaggaggttcagagcgagcctaaatggggagagcttgaagatgctttagaggcttttgatacttcaatgtttggtggttccatggacttgttgcagagcgacggttttgttcctcagtacttgtaccagcctgattatttcactcccttccaggatccgcacgagcagaaaccgttcttgaattggagttttgctccacaggggtaaaaagggaagaagagagtaaattgtggtttaactgtgtggtgaagtgcttagagagaagttctcaatcatctttgtttcttagtagtaaaaaagatcgtagatgttaatagttgttagcatcataggcaaattcttgttatttcatcataattttatatgaaaaatattcaaatttttcacgatgttgcacctatgtagatactgatatataaagagatattaagattcag

SEQ ID NO: 15405 - DNA, 1079 bp, Brassica napus
  Predicted polypeptide sequence is orthologous to G502, G519
aaagaacctttccacataaataatgaaggctgagctaaatttaccggaggggttccgatttcacccgacggacgaagagctcgttaagttctatctttgccggagatgcgcatcggagccgataagcgtcccggtaatcgcagagattgatctgtacaagttcaatccatgggagcttccagaaatggctttgtacggagagaaagaatggtacttcttctcacctcgagaccggaaatacccaaacggttcgcgtccaaaccggtcagctggaaccggttattggaaagcgactggagctgataaaccgatcggtaaaccgaagacgttggggattaagaaagcactcgtcttctacgccgggaaagctccgagaggggtgaagacgaattggattatgcatgagtatcgtctcgctaacggtgatcgatctgcttctttcaacaagaagaacagcttgagacttgacgattggggtttatgtcggatttaccataagaaaggaacaatggagaagtgttatccggcggtggtgactactacgagtacgtccgactctaaatgctcgagtcacgtgatttcaccagacgtcgtcacgtgttccgacaactgcgagtcgaaatgggttgatgatctcaaggacgagttcatgtttggttccacgttgcaaaatgactcttttgtccctcagtttctgtatcagtcggaattcgccacaccgtacgaagatccgcaggagcaaaagccgttcttgaattggagttttggtcatcaggggtgaagttacaaagagcataaaggttgaagctttctcagagtatccagccaccgcacacgaggggactcggtgtcggattctgacccgtaaaccaagttgggccatacagttacagaattggtgtccactggttgttctgactcttcagctagattcgatttttcttttgttataaatgtctaaaaagatatcgaagtagaaacagaggaactgtacaagcaacagtgaccattataaatcatatatatatatatatatatatatatatattcatcataatcaatgagcatgagcttatttc

SEQ ID NO: 15406 - DNA, 794 bp, Brassica napus
  misc_feature (765)..(765): n is a, c, g, or t
  misc_feature (767)..(768): n is a, c, g, or t
  misc_feature (774)..(774): n is a, c, g, or t
  misc_feature (777)..(779): n is a, c, g, or t
  Predicted polypeptide sequence is orthologous to G504, G1425
ctatattcgagtcattatgagcccggggaagtctccaaaatatcaaaatcctctgcttacatattctcccttgagtatcatgagacggtcttcgtagaataactcatttgaaaatagcgagttgatggaaaacatgggggattcgaccatagggccgggtcatccgcatctccctcccggatttcggtttcatccgaccgacgaagaacttgtagttcattacctcaagaagaaagctgcttctattccactaccggtctcaatcatcgccgagattgatctttacaagcttgatccttgggagcttccaagcaaggcgagttttggagaacaagagtggtacttctttagtcctagagatcggaagtatcccaatggggttaggccgaatcgggcagcaacttctggttactggaaagccacgggaaccgataaaccaatatttacgtgcaatagtcacaaggttggggtcaagaaagcgcttgtgttctatggtggaaaacctcctaaagggattaaaactgattggatcatgcatgaatatcgcctcactgatggtaaccttaacacagctgccaagccacccgactcaaccacgtcaaggaaaaactcactacggctagacgattgggttctttgtaggatctataagaagaatagttcacaaagaccaacaatggagagagtattactaagagaagatctcatggaaggaatgctctcaaaatcatctgctaattcatcttccacatcggtcttagacancnnacacantannntatacgaagaacact

SEQ ID NO: 15407 - DNA, 992 bp, Brassica napus
  Predicted polypeptide sequence is orthologous to G536
ggagaagaaaatcgggatctctctaatggcggcgacgttgagcagagaccaatacgtgtacatggcgaagctggccgagcaagcggagcgatacgaggagatggtccagttcatggagagcctggtaagctccgccacgccggcgggggagctgacggtggaggagaggaacctcctctcggtggcgtacaagaacgtgatcggatctctcagagcggcgtggaggatcgtgtcatcgatcgagcagaaggaagagagcaggaagaacgaggagcacgtgtcgctcgtgaaggattacagatccaaggtggagggggagctctcgacgatctgctcggggatcctcaagctgctcgatacgcatctgatcccttcggctacggctagcgagtcgaaggtgttttacctgaagatgaagggggattaccatcgctacatggccgagttcaaatctggagatgagaggaagactgctgccgaagataccatgatcgcctacaaggctgctcaggatgttgcggttactgatctagcgcctacgcatccgatcaggctgggtctggctctcaatttctcggtgttttactacgagattctcaactcttctgagaaagcttgtagcatggccaaacaggctttcgaggaagccattgctgagctggacacgttgggagaggagtcgtacaaggacagtactctcatcatgcagttgctaagggacaacctaaccctctggacctccgacatgcaggagcagatggatgaggcctgaagatcttgtttgtggaagaacagacggttatgtaatttccccgcaaccatgaccgaaaatctagttcaaactcaagaaccccctttgctgtaaaacttgtcgaaaaaatggtctgtttatgacggttatgtgcacagctttggtgttatctgcttctctgttccaactctgtttttcttttttaatttatcatcatcttttcctaaaaaaaaaaaaaaaa

SEQ ID NO: 15408 - DNA, 825 bp, Brassica napus
  Predicted polypeptide sequence is orthologous to G536
gaactcgacaatccctaattcctaaactccctctcgtatctataacaaagactgtgatacgaaacgatgtcgtctcctcgtgaagagaacgtgtacttagccaagttagccgagcaagccgagcgttacgaggagatggtcgagttcatggagaaagtcgccaagaccgttgactccgaggagctcaccgtcgaagagaggaacctcttgtccgtcgcttacaagaacgtgattggcgctaggagagcttcgtggaggatcatctcttctattgagcagaaggaagagagcagaggaaacgaagatcacgttgctattatcaaggactacagagggaagatcgagacagagcttagcaagatctgcgatgggattttgaatcttcttgattctcaccttgttcccgctgcgtctttggctgagtccaaggtcttttatctgaagatgaagggggattaccataggtaccttgcttatttgcctccgactcatccgattagattggggcttgctcttaacttctctgtcttctactatgagattctcaactcgcctgaccgcgcttgcaatctcgccaaacaggcttttgatgaagcgatctctgagctggacacattaggagaagaatcatacaaggacagcacactgatcatgcaacttctccgtgacaatctgaccctctggacttctgacatcaatgatcgaggcgggtggtgatgagatcaaggaggcgtcaaaagacgagccctgagaggggaaaacagcgtagccgttgaagtgaccagagagagagtgagcgaggcattattgagtatgtatggattt

SEQ ID NO: 15409 - DNA, 706 bp, Brassica napus
  Predicted polypeptide sequence is orthologous to G536
ggatctcttcgagccgcgtggaggatcgtgtcttcgatcgagcagaaggaagagagcaggaagaacgaggaacacgtgtccctcgtcaaggactacagatctaaggtcgagacagagctctccacgatctgctcggggatcctcaagctgctcgacacgcatctgataccttcggctagtgctagcgagtccaaagtgttttacttgaagatgaagggtgattaccatcggtacgtggccgagtttaaatctggtgatgagaggaagacggctgctgaagatactatggtcgcttacaaggctgctcaggatgttgcggttgctgatctagcgcctacgcatccgatcaggctgggtttggctcttaatttctcggtgttttactacgagattctcaattcttcggagaaagcttgtagtatggctaaacaggctttcgaggaagcaattgcggagctggacacgttgggagaggagtcatacaaagacagtactctcatcatgcagttgctaagggacaatcttaccctctggacctctgatatgcaggagcagatggatgaggcctgaaggtcttatggaagaacatactcttatgtaatgtcccctcgtccgtgaccgagttcaaaccccgaaccttcccttctctagaacttgtcgaaaaaaaaaaaagtgtgtttatgatagttcatgtgcctttggtgta

SEQ ID NO: 15410 - DNA, 688 bp, Brassica napus
  Predicted polypeptide sequence is orthologous to G536
ctcctttcgcctcctccttcttctcctctcttttaacctacacagagagagataaaccgaatcaaacaaactaacaaacaaactctccgatctgcgatatcacaatggcagtttcatcgcgcgaggactacgtatacatggccaagctctccgagcaagccgagaggtacgaagagatggtcgaattcatggagaagctctccgccgccgcagacggcaccgagctcaccgtcgaggagcgcaacctcctctccgtcgcgtacaaaaacgtgatcggcgcccgccgcgcttcgtggcggatcatctcctcgatcgagcagaaggaagagagccgcggcaacgaggaccgcgtcaagacgatccgcgactacaaggcgaagatcgagtcggagctagcggggatctgcgacgggatcctgaagctgctcgagtctgcgctcgtcccttccgccgcttccgaggattccaaggtcttctacctcaagatgaaaggcgattactataggtacttggctgagttcaagatcggtaaggagagagatgacgccgctgataacactctctccgcttacgaatctgctcaggagaatgcgaaggggctagctccaactcacccgatccgtcttggtttggcattgaacttctctgtgttttattacgagatcctcaattctcctgatcgtgcttg

SEQ ID NO: 15411 - DNA, 784 bp, Brassica napus
  Predicted polypeptide sequence is orthologous to G536
tctagatccaccgttcagagcagttacaatggcggttccgtcgcgcgaggatcttgtatacatggctaagcttgcggagcaggcggagaggtacgaagagatggtccaatacatggagaaagtctccgccgcaacagatggtagcgagctcacaatcgaggagcgaaacctcctctccgtcgcctacaagaacctgatcggcgctcgccgcgcctcgtggagaatcatctcttcgatcgagcagaaagaggagagccgcggcaacgtcgagcgcgtcaaaacgatccgtgactacaaggctaagatcgaatcggagctctcggggatctgcgacggaatcctaaagctgctcgactctacgctcgtcccttccgctgcttctgaggaatccaaggtgttctacctcaagatgaaaggtgactactacaggtacttagccgagttcaaaatcggtaaagagagagacgccgccgcggataacaccctcgccgcttacgaatctgctcaggacaatgctaaggggcttgcttcaactcaccctatccgtcttggtttggctttgaacttctctgtgttctattacgagatccttgagtcccctgaccgtgcctgcaacctcgctaaaacggcttttgatgctgctattgctgagttagacactctaggggaagagtcatacaaggatagcactttgatcatgcagcttctccgtgacaacctcactctctggacatccgacatgcaggatgaatctgcagacgagatcaaggaagcagctgcagct

SEQ ID NO: 15412 - DNA, 806 bp, Brassica napus
  Predicted polypeptide sequence is orthologous to G536
aaaaaatctctctctctctctctctcactttctctctccaatggcggcgacactaggcagagaccagtacgtctacatggccaagctcgccgagcaggccgagcgctacgaggagatggtcaacttcatggagaagctcgtcacaggcgccacaccatcctccgagctcaccgtcgaagagcgtaacctcctctccgtggcatacaagaacgtgatcggatccctgcgcgccgcgtggcgcatcgtgtcctcgatcgagcagaaggaggagagccgcaagaacgaggagcacgtggcgctcgtgaaagactacagatccaaggtggagacggagctctcctccgtctgcgaagggatactaaagcttctcgaggagaatctgattccctctgcggcggcgagcgagtcgaaggtgttttatctgaagatgaaaggggattaccataggtacatggtggagtttaaggccggcgaggagaggaaagccgcggctgaggataccatggttgcttacaaggctgctcaggatattgcagctgctgatatggcgcctactcatccgattaggcttggtttggcgttgaatttctccgtgttttactatgagattcttaattcttccgacaaggcttgtgacatggccaaacaggctttcgaagaagccatagctgagcttgacactctgggagaagagtcctacaaagacagcactctcatcatgcagttgctcagggacaatctcaccctctggacctccgatatgcaggagcagatggacgaggcgtgaggatctcaaggaagggagt

SEQ ID NO: 15413 - DNA, 259 bp, Brassica napus
  Predicted polypeptide sequence is orthologous to G536
aatcatcacaaggacagcacgctcataatgcaacttctccgtgacaatctgacgctctggacttctgacatcaatgatgaggccgggtggtgatgagatcaaggaggcgtcaaaagacgagcctgaagaaggcaaacaagcttagatgttgactgtgaccagagagagagagagcgagactttactgcctatgtatggatttggctcttgtttcttaaaaacatatatgctatggggtttgtgtgttgaagcaccacac

SEQ ID NO: 15414 - DNA, 442 bp, Brassica napus
  Predicted polypeptide sequence is orthologous to G536
tcgtggaggatcatctcttctattgagcagaaggaagagagcagaggaaacgaggatcacgttgctattatcaaggactacagagggaagatcgagacagagctcagcaagatctgcgatgggattttgaatcttttggattctccccttgttcccgctgcgtctttggcggagtctaaggtcttttatctgaagatgaagggggattaccataggtaccttgctgagtttaagactggtgctgagaggaaagatgctgctgagagcactctcgtggctcacaagtcagctcaggatattgcacttgctgatttggctccgactcatccgattagattggggctcgctaacttctctgtcttctactatgagattctcaactcgcctgaccgcgcttgcagtctcgcaaaacaggcttttgatgaagcgatatctgagctgg

SEQ ID NO: 15415 - DNA, 1129 bp, Brassica napus
  Predicted polypeptide sequence is orthologous to G536
aattcggcacgaggattcgtcaagaataatcaatcacataagatcagatctcagatctctgaagaaggaagaagatggcggtttctgcgcgtgaggagttcgtgtacatggccaagctcgccgagcaagcggagaggtacgaggaaatggtagagttcatggagaaagtctccgccgccgtcgacggcgatgaactcaccgtcgaggagcgaaatctcctctccgtcgcttacaaaaacgtgatcggcgcccgccgtgcctcgtggcgcatcatttcgtcgatcgagcagaaggaagagagccgcggcaacgacgaccacgtcacggcgatccgcgattacagatctaagatcgagacggagctctctggaatctgcgacgggatccttaagctcctcgattcgaggctcgtccccgccgctgcttccggcgattccaaggtgttttacctcaagatgaaaggtgattaccacaggtacttggctgagttcaagactggtcaggagaggaaagacgccgctgagaatactctctccgcttacaaagctgctcaggatattgcgaatgcagagctagctccaactcacccaatccgtctaggtctggcattgaacttctctgtgttctactacgagatccttaactctcctgatcgtgcctgcagcctcgccaaacaggcctttgatgacgcgatagccgagttggacactctaggtgaagggtcgtacaaagacagcaccttgatcatgcagcttctccgtgacaacctcactctctggacatccgacatgcaggatgatgctgcggatgagatcaaggaagcatcagctccaaaaccaacagaggaacagcagtaacaatcttttgagtgaactgctaagtttctagggggtttgaaactttgttttctctttcgtccatatgtttcctaggtcgtcgcttgcccattcgcttttattcattcatcatgatttctggcaagtctgaaccatcaatcatcttctatctcagttgcttgaatgtgggttaatgatttcagtgtctgccatcgaaccttgctttgtgtgtttctcatcaatttgaagatacttttgtccgtcttaaaaaaaaaaaaaaaaaaaaaaaaaaa

SEQ ID NO: 15416 - DNA, 635 bp, Brassica napus
  Predicted polypeptide sequence is orthologous to G536
gaacactggttccaacattcactcgtctcctctaaaacgcattcatcgcctcattaaaaaacacatttcattcatcctctcccttctgacctcaatcgattcttgaaaatggtttccgcgcgtgaggagttcgtgtacatggccaagctcgccgagcaagccgagcgctacgaggagatggtggagttcatggagaaagtctccgcctccgtcgacggcgacgagctcaccgtcgaggagcgtaacctcctctccgtcgcttacaagaacgtgatcggcgctcgccgcgcctcgtggcgcatcatatcctcgatcgagcagaaggaggagagccgcggcaacgacgaccacgtcgcggcgatccgcgattacagggggaagatcgagacggagctgaccggaatctgcgaggggatactgaagctgctcgattcgaggctggtccccgccgcagcttcaggtgactcgaaggtgttttatctgaagatgaagggggattaccataggtacttggctgagtttaagaccggtcaagagaggaaagacgccgctgagaatactctctccgcttacaaatctgctcaggatattgcgaatgcagagctcgctccaactcacccaatccgtctaggtct

SEQ ID NO: 15417 - DNA, 701 bp, Brassica napus
  Predicted polypeptide sequence is orthologous to G536
gaccactcagatctttagacgaagaacgaaggattgttgaaatcgaagatgtcatcatcacgtgaagagaatgtgtacatggcgaaactagccgagcaagccgagcgttacgaagaaatggtcgagttcatggagaaagttgctaaatctgttgacaacgaagagctcactgttgaagagaggaaccttctctccgttgcttacaagaacgtgattggagccaggagggcttcgtggaggatcatctcttccattgagcagaaggaagagagcaaagggaacgaggatcacgttgctatcatcaaggactacagggccaagatcgaagctgagcttagcaaaatctgcgatggaatcttgaatgttcttgaagctcatctcattccatctgcttcgcctgctgagtctaaagtgttttaccttaagatgaagggagattatcacaggtatcttgctgagtttaaggctggcaacgagaggaaagatgctgctgaaagcactttggttgcttacaagtctgctcaggacattgccactgctgagttggctcccactcacccgatcaggcttggtcttgcactcaacttctctgtgttttactatgagatccttaactcgcctgaccgtgcctgcagcctcgccaagcaggcttttgatgaagcaatcgctgagttagacacgttgggtgaggaatcatacaa

SEQ ID NO: 15418 - DNA, 515 bp, Brassica napus
  Predicted polypeptide sequence is orthologous to G557
ccagacacaagcaacggtcggaggagagggtcaaaggaagagagggaggactccggctgagaaagagaccaagcggcttaagaggttgttgaggaacagagtttcagcacagcaagcaagagagaggaagaaagcttacttgggtgagttggaaaacagagtgaaagacttggagaacagaaactctgaacttgaagagagactctctaccttgcagaacgagaaccagatgcttagacagattctgaagaacacaacaggaaacaagaggggaagcggtggttctaacgctgatgcaagcctatgatctccttgttcttgtattattatttacctggataaactttacaaggaattgtattaaataaatattttcttggctgtgacttgtgacagaattatcttctagtctttagattttctttttttgtttgtttgatagatttgcttaattcaaaagttaattttgttgtatgataaaaaaaaaaaaaaaaaaaaaaaaaaaaaaaagaaag

SEQ ID NO: 15419 - DNA, 1749 bp, Brassica napus
  Predicted polypeptide sequence is orthologous to G561, G562
tctctccctctctctcgtcttcctccttcaaaaaaaactgaactctttttttctctctgttttttctagagagagagagagagattggaatgcgttaaaatttctctttagttttcaagttttctcgatttggatctctgagctagcttacagatttttggagaaagagacaattgttgttaagtgtggaaacgttaagaccatgggaaaaagcgaggaaccaaaggttaccaaatcagacaacaaaccatcttcaccacctgcggtattttttttttttttttttttttattaatttcagaccataactctcaagtcaatagtgttcttgtaatagagtcaaaaccagtgttatcttgatgtgttgacaggatcaaacaaatgttcatgtctaccctgattgggccgctatgcaggcttattatgggccaagagtagcaatacctccttattacaactcagctatggctgctgcatctggtcatcctcctcctccttacatgtggaatcctcagcatatgatgtcaccatatggaacaccgtatgcagcggtttaccctcatggaggaggagtctacgctcatcctggattccccatgcctcaaagtcaaaagggtgctgctttatcaactccggggacgccattgaacatagacactcctagtaaatcaacaggaaacacagagaatgggctgatgaagaagctgaaagagtttgatggacttgctatgtctctaggaaatggtaataatggtgatgaaggtaaacgctcacggaacagctcagaaacggatggttctagtgatggaagtgacgggaataccactggggctgatgaaccgaaacttaagagaaggcgagaaggaactccaaccaaagatgaggagaaacatttggttcagtcaagctcatttcggtctgtttctcagtcaagtggtgataacgttgtaaagcatagtgttcaaggaggaggtggagctatagtctctgctgctggtgtaagtgcaaattcaaacccaaccttcatgtcacaatctttagccatggttcctcctgaaacttggcttcagaacgagagagagctgaaacgggagagaaggaaacagtctaatagagaatctgcaagaaggtcaagattaaggaaacaggctgagactgaagaactggctaggaaagttgaagccttgacagcagaaaacatggcgttaagatctgagctaaaccaacttaatgagaaatctaataatctaagaggagctaatgcaaccttactggacaagctgaaaagttcagaacctgaaaagagagttaagagctcaggaaatggagacgacaagaacaagaagcaaggagacaatgagactaactctaccagcaaactgcatcaactgcttgataccaagcctcgagctgacggtgtagctgctcgctaatcataacactcttgtgtgtcgacttctacttaatttgtcgacagaaacaaagaaaaacaagtgtatgctaattccagaaaacttgttagatagtatagaagagatggagatggagatggagatgatttgatcttatatatatagattttccagagaggggtgattgttaatatggagaggctctatttttatatatggcttcctttgttgcattcagtattgacctcatgagtgtagtgtatgtatgagagacatctctcagatcggtgtttgttgctttgcttggataagaaaatcaataacaaacattttctac

SEQ ID NO: 15420 - DNA, 1292 bp, Brassica napus
  Predicted polypeptide sequence is orthologous to G561, G562
agagagacaagttactgtgtcagtgtctgaatcgagcaatgggaagcaacgaagaaggaaagaccacacagtctgacaagccagcacaagtacaagctcctcctcctcctcctgagcaaagcaatgttcatgtgtatcatcatgattgggctgctatgcaggcgtactatggaccaagagtagccataactcctcaatattacaactcaaatggtcatgcagctccacctcctccttatatctggggctctccttcgccaatgatggctccttatggaacaccatatccaccgttttgtcctcctggtggagtctatgctcatcctgctcttcaaatgggctcacaaccacaagggcctgcttctcaagcaacacctgttgttgcaactccgttgaacttggaagctcatccagctaactcatctggaaacacggatcaggggttcatgacaaagttgaaagaatttgatggacttgcaatgtctataagcaataacaaatctgggagcggtgaacatagcagtgaacctaagaattctcagagttctgagaatgatgattccagcaatggcagtgatgggaatacaactgggggagaacagtctaggaagaaaagaagccgggaaggatcaccaaacaacgatgggaagccttcatctcaaattgttcctcttctaagagatgaaagtgagaaacatgcagtgactatggggactcctgttatgcccacagctatggacttcccacagccattccctggtgcgcctcatgaagtctggaatgaaaaagaggttaaacgagagaagagaaaacagtcaaacagagaatctgctagaaggtcaagactgaggaagcaggctgaaactgaagaactgtccgtcaaggttgatgcactagttgctgagaacatgactctgaggtcaaaactaggccaactaaacgatgagtctgagaaactacggctggagaaccaagctttattggatcaactgaaagcgcaagcaactgggaaaacagagaacctaatatctggagttgataagaacaactctgtatcaggtacagtagtagtaagaatgcggaacagcaactcttaaacgtaagtctaagaaccgattctgtcgcggctagctgactgtgacgcaaaaggaagaacccacttcatgtcttctaatggattctgattgtaacttcttaaaaagatttttttttccttagatttatagctctctgcatggtgaacagaaactgatgtatatccttaagcagaagagactcagagcgtgatctga

SEQ ID NO: 15421 - DNA, 713 bp, Brassica napus
  Predicted polypeptide sequence is orthologous to G618, G2057
gtacacagaatttaaacgaggcagagagagagagagagagagagattcagacatgggctagtctgctgcttttgataaatcatcttcctcctaggctttatctatctctgctttttacggttagagtttttttgaggtgagactatgcgtgagtaagagttacatccatttcgaattattactctggattccccaccgtctaaccctgccgccgccgcctcgacgaacaagactccgaccttcctcaatatgctcaaccaatggcagacgaccacgacgaagctcaccacttcctccaccctcaacccccgccgccttcttcaatgaggcacggcgctgcgtcagacgagatagtggaggttcaaggaggtcacattgtgcggtcgacggggaaaaaagaccggcacagcaaagtctgcacggccaaagggccacgtgaccggcgcgtgaggctatcggctcacacggcgattcagttctacgacgttcaagaccgcctgggcttcgaccgtccgagcaaagccgttgactggcttatcagaaagtcttagacttccatcgacgagctcgctcagcttcctccggggagtcccgccgatgctattcgcaaagccgccgcaaacgctaaaccgagaagaaccgccgccaaaaccaaaatctcgccgtcgccgccgccgccgcaacggggacagcttcagttggggggtgcacgg

SEQ ID NO: 15422 - DNA, 770 bp, Brassica napus
  Predicted polypeptide sequence is orthologous to G620, G1821
acaaacacaagctcgtgtgagtttgaagaaaggatatggaacgaggaggcttccatggctacggcaagttctccctcaacaccaccaccaatccagagagcggcatgcagctatcagaactcaaccagcctaccaaaaccgctgacggcggccaagaggagtgcacggtgagagagcaagacaggttcatgcctatcgccaacgtcatacggatcatgcggaggatcttacctgctcacgccaagatctctgacgactccaaggagacgatccaagagtgtgtctccgagtacatcagcttcgtaacaggggaagccaatgagcgttgccagcgggaacagcgcaagaccatcactgccgaggatgtcttgtgggcaatgagcaagctcggttttgatgattacattgaacccttaacattatacctccaccgctacagagagctggagggtgatagaggagtaaactgcggtgctggatccgtttgtatgaccaatggcatggtggtcaagaggcctaatggtaccatggctgagtatggagcctacatggcaccgtaccattatcgtcatcagaacgggtttgcttacagtggtaacgaacctaattctaaaatgggtggttcatcatctagtttttgaacacagttttcaagcaaaaaaaaacaatgatgctttgtctctatgtatcttctccttgaacgaacctagtgttttcaattgatcttttcttgtgataaaaaaacaaaaaaaaaaaaaaaaaaaaaaaaa

SEQ ID NO: 15423 - DNA, 835 bp, Brassica napus
  Predicted polypeptide sequence is orthologous to G620, G1821
gaatgcaacaaatcactcaaataattaatttattaagatcttaaaaaacggcagagaaacaatggaacgtggagctcctctctctcactatcagctacccaaatctaactcgggactgaacttggaccagcacaacaactcaatcccgacaatgaccggctccatcagtgcatgcgacgacaagaacaagactatcttgccgcagcaacaaccaagcatgcctcgtgagcaagaccaatacatgccaatcgcaaacgtgataaggatcatgcgtaaaatcttaccgccacacgccaaaatctctgacgacgcaaaagaaacgattcaagaatgcgtctccgagtacatcagcttcgtgaccggtgaagctaacgagcgttgccaacgtgagcaacgtaagacaataacagctgaagatatcctttgggccatgagcaaacttgggttcgatgattacgttggaccactcaacgtgttcattaaccggtaccgtgagttcgagaccgatcgtgggtgttcacttagaggtgagtcatcatttaaaccggtctatggaggaagtggtatggggtttcacggcccacctccgccgggttcgtatggttatggcatgttggatcagtctatggttatgggtggtggtcggtactaccataacggatcgggtcaggatggatcagtaagtggtggtggtggatcttcctcttctatgaatggaatgccggtttatgaccagtatggtcagtataagtgaagatgaaaattcttgattttctgcatgtctattcaaaacatgttttggatagttattatgtatgccaacatatctattggt

SEQ ID NO: 15424 - DNA, 696 bp, Brassica napus
  Predicted polypeptide sequence is orthologous to G620, G1821
ggtggctttgaagaaaggatatggaacgtggaggcttccatggctacggcaagttctccctcaacaccaccaccaatccaggggaagcttttgatggcagagagcggcatgcagctaccagaacccaaccagcctaccaaaaccgctaacggcggccaagaggagtgcacggtgagagggcaagacaggttcatgcctatcgccaacgtgatacggatcatgcggaggatcttacctgctcacgccaagatctctgacgactccaaggagacgatccaagagtgtgtctccgagtacatcagcttcgtaacaggggaggccaatgagcgttgccagcgggaacagcgcaagaccatcactgccgaggatgtcttgtgggcaatgagcaagctcggttttgatgattacatcgaacccttaacattgtatctccaccgctacagagagttggagggtgatagaggagtaaactgcggtgttggatccgttagtatgaccaatggcatggtgctcaagaggcctaatggtaccatggccgagtatggtccctacgggactatggcgccgtaccgttatcatcatcagaacgggtttgcttacagtggtaaccgaccctaattctaaaatgggtggttcatcatctagtttttgaacacaaagttttcaaagcaaaaaaaacaatgatgctttgtctct

SEQ ID NO: 15425 - DNA, 562 bp, Brassica napus
  Predicted polypeptide sequence is orthologous to G624
gtctgcgatacagtgagacgccgtagggaaactctgttgcaacggaaaaagaagcagcagcagagtgagatagaaaacaaagcacacaaggagatggagtctccaaactctgatgaggaacgtcaccaatctgttaacaacagtgggaccaccagtaaggactatgagcgtcatgcatcgccgccttcaaaagcacaaatagatttgaacttccaaccagagaaagatgaagaatctcctcttccccgttcaaagacaacgactaaggacaagtctctgcatcatgatgaagcaagaagctcatcaagtgctcataacaagctccatgtagattttgcagactcctaaggtgaataggattatgatggcagaaaccagagaaagcttctagtaattaccatttttaaccccacaggcatggcgcattttggacataaagggtagttttaatatatttacggatggaagctcattactttttctaaactcttagctaattacaatgagcaatataattttctcggtcaaaaaaaaaaaaaaaaaaaaaaaaaaaaaacatgtc

SEQ ID NO: 15426 - DNA, 672 bp, Brassica napus
  misc_feature (591)..(592): n is a, c, g, or t
  Predicted polypeptide sequence is orthologous to G635
atgaaaccaaaaacgtggataagtcacctgatgcagagactaaaacagaggatagcgaaagcagcagagaagaggaggatgatgataatacatctgattctcaaaccaagtcgtcaacgaaacgtgtgaggaggaacaaatggaagcctgaggaagttaagaaggtgatcaggatgcgtggagagttgcacagcaggttccaagtggtgaaaggtagaatggctttgtgggaagagatctcttcaaatctatctgctgaaggaatcaatcgaagcccgggacagtgcaagtctctgtgggcgtctcttattcagaaatacgaggagtgcaaggcggatgaaagaagcaagacgagctggtcacattatgaggacatgaacagcattttgtctgagttagacacacctgcgcctaagtaatgtgcttacattacatgtatcttgcgaaaagagtcatctccaaaatattaaatcgaacagagacattcattatgttatgtaacatgtaagatgtttttttttttgtctgtagaagccattaaaacatgaatgccgagaaagaaaaaagccttgagtcaaatgtttagactcnnaaaaaaaaaaaaaaaaggggaaaaaaaaaaaaaaggggggggccccccttaagggaaccaattttaattacggggggggg

SEQ ID NO: 15427 - DNA, 765 bp, Brassica napus
  Predicted polypeptide sequence is orthologous to G652, G1335
ggtagacaaagaaataaagaaagaaagagagagagagagaagatgagtggagaaaacgacaacggcggtgctaagcgcaggggctcggtcaagtggtttgctgccgagaaggggttcggtttcatcacccccgaagacggcggcgaagatctcttcgttcaccagtcctccatcagatctgagggataccgaagcctcgctgaaggagaatctgtcgagttccttgttgaggtcgacaacaacagtggccgtaccaaagccatcgaggtgaccggacccgatggcgctccagtccaaggtaccagccgtggttcatctggaggacgcggaggctttggcggcgacggatacggaggaagaggtggaggccgtggaagttacggtggacgaggtggtggtggtggtggccgaggaggaggaggcgactgctacaagtgtggtgagccaggtcacatggcgagagagtgttcccaaggagggggaggatacggcggtggaggtagaggaggtggcggcggtggaggaagctgctactcctgtggagagtcgggacatttctccagggattgtactagcggtggacgttgaaacggacagctgtcaggcggttggtaaggctgagtttgttatgatctggtggacaagtcttgtcgatgcgtactatctctttattttccacttctttttgctcctgacggatggatctttgtcgttttctatgttttgttttcggttaacgcctgatgggttcgattttacgatatg

SEQ ID NO: 15428 - DNA, 1172 bp, Brassica napus
  misc_feature (805)..(805): n is a, c, g, or t
  misc_feature (1151)..(1151): n is a, c, g, or t
  misc_feature (1153)..(1153): n is a, c, g, or t
  Predicted polypeptide sequence is orthologous to G773, G1412
aaacatctaaacacattattttatctgctgtagagaaaaaaatgggagttagagagaaggatccgttagcccagttgagcttacctccaggttttcgtttttacccgacagatgaagagcttcttgttcagtatctctgtcggaaagttgcaggctaccatttctctctccagatcatcggagatatcgatctctacaagttcgatccttgggatttgccaagtaaagctttgtttggggagaaggaatggtacttctttagcccaagagatcgaaaatatccgaacgggtcaagacccaatagagttgccgggtcaggttattggaaggcaacgggtaccgacaagatcatcatgtcggatggtcaccgtgtcgggattaaaaaagctctggttttctacgccgggaaagctccaaaaggcacgaaaacaaactggattatgcacgagtatcgactcatcgagcattctcgtagccatggaagctccaagttggatgattgggtgttatgtcgaatctacaagaaaacatctggatctcagagacaagctgttgcttctccggtacaagcttgccttgaagaccagagcacgaacatgtcgtcgtcgccgkcttcttcgtctcagctcgacgacgttcttgattcgttcccggagatgaaagaccggtcttttgatcttcctcggatgaattcgctcaggacgattctcaacggcaatttcgaatgggctagcttagcaggtcttaatcccatgcctgagctagctccgatgacctacggtttatcgaattacggaggttaccncgcgttccaatcggcggagagcgggtgtaggagttcgcaggtcgatcaggagcagaactcgaccgagttgactcagagtctcgggtacagctcgagcgggttcggactttcgggtcaaatgtacgagtttaggcaatgagagatgggttaatgtaatttggctactcatatgagtggacgcggttaaaaaaagtaaaaaaaacctagagtggcaattatgtaaacaaatagagaattataatgggccttcttaaccgattcggttaggcttaggattccagaaagcgaaggccttgagattagtttttatctaatatgacggaccgaaaatgtaatagcgcacgcncnctacgttaatgggctcttt

SEQ ID NO: 15429 - DNA, 849 bp, Brassica napus
  Predicted polypeptide sequence is orthologous to G791
tgttataagaagataacaccggagaagaccaaagcaaccataagactaagaaagccgagaaagaggagagcaaaacaaatggacttttcttgctttttttctttttttccggrgragcaagaagcaaaccagttgatgattttcttgagggtcgtcccagttaagcaactggtggacgaaggacgtgatcctgagaagtatcgactgaagcaggaggcatgaactgccacatggcaactcctgggtaactgatgactggcaccatcttgtttccgggagcttggccttgcgcagaagcaaaagcagttggcatcataggtggggctgggaagaagcttggttgaggaggagcattcatggctttcagctgttgctccagcttctctttctctgtcttcagcctctgcttctcatctcgcagctcgttcttctcggtctttaactctttgattttgtcttgaagactcgaattggagtccttcaacttctgcgcctcgccacgtagttgtgtaaccatgcggacagcatcgaccaagattgcagccttgtctgtsttgggaggattccccggctccaaaattgcacccaattccataaacttgtcattcagcctgtcacgtcgctgcttctctctacaggctttagagctagtggcagaggacgattcacatctcgccctctttttggagcaggttccttggtggcttctgaatttccagctgagcatcactchagactggaacgccataggtgctggtgagaggcaggagagcaggcttgaatgtgaacttcatagtctgcgtygatcawtcggtatcaatagcgtttcggggcacatctctcaactca

SEQ ID NO: 15430 - DNA, 434 bp, Brassica napus
  Predicted polypeptide sequence is orthologous to G852, G2633
gaggttgtgaatctgatagcttgtgccggggttgaaagagagagagaggcatgagccgttagggaagtggaggtcgaggtttcacatggcgggtttcaagccttatccgttgagctcttatgtgaatgcgacgatcaaagggttgcttgagagctattcggagaagtacacacttgaggagagggatggagctttgtatttagggtggaagaatcagcctcttatcacttcttgtgcttggaggtaacttatgcttgatctgcaagaggagtttagataatgtttacagttcgttgattctgttttgtaaaagtaaaagaaacttatgaaccgataaaacatttgtcaaatgttgtaatagtagtagcagtagtaaggttggtgttggtgttggtgtcagataaaaaaaaaaaaaaaaaaaaaaaaagcttgtc

SEQ ID NO: 15431 - DNA, 648 bp, Brassica napus
  Predicted polypeptide sequence is orthologous to G912, G2107, G2513
atgacctcattttctaccttctctgaactgttgggctccgggcatgagtccccggttacgttaggcgaagagtattgtccgaagctggccgcaagctgtccgaagaaaccagccggtcggaagaagtttcgagagacgcgtcacccagtttacagaggagttcgtctgagaaactcaggtaagtgggtgtgtgaagtgagggagccaaacaagaaatctaggatttggctcggtactctcctaacagccgagatcgcagcccgtgctcacgacgtcgccgccatagccctccgcggcaaaacagcttgtctcaattttgccgactccgcttggcggctccgtatcccggagacaacatgccccaaggagattcagaaggcggctgctgaagccgcggtggcttttaaggctgagataaataatacgacggcggatcatggcattgacgtggaggagacgatcgttgaggctattttcacggaggaaaacaacgatggtttttatatggacgaggaggagtccatgttcgggatgccggccttgttggctagtatggctgaaggaatgcttttgccgcctccgtccgtacaattcggacatacctatgactttgacggagatgctgacgtgtccctttggagttattaa

SEQ ID NO: 15432 - DNA, 1185 bp, Brassica napus
  Predicted polypeptide sequence is orthologous to G912, G2107, G2513
tgctgcatgaattcggcacgaggagagaaataaatatcttatcaaaccagacagaacagagatcttgttacttactatactacactcagccttatccagtttttcaaaagaagttttcaacgatgaactcagtctctactttttctgaacttcttggctccgagaacgagtctccggtaggtagtgattactgtcccatgttggcggcgagctgtccgaagaagccggcgggtaggaagaagtttcgggagacacgccaccccatttacagaggagttcgtcttagaaagtcaggtaagtgggtgtgtgaagtgagggaaccaaacaagaaatctagaatttggctcggaactttcaaaacagctgagatcgcagctcgtgctcacgacgtcgccgccttagctctccgtggaagaggcgcctgcctcaacttcgccgactcggcttggcggctccgtatcccggagacaacctgcgccaaggatatccagaaggctgctgctgaagccgcattggcttttgaggccgagaagagtgataccacgacgaatgatcatggcatgaacatggcttctcaggttgaggttaatgacacgacggatcatgacctggacatggaggagacgatagtggaggctgtttttagggaggaacagagagaagggttttacatggcggaggagacgacggttgtgggtgttgttccggaggaacagatgagcaaagggttttacatggacgaggagtggatgttcgggatgccgaccttgttggctgatatggcggcagggatgctcttaccgctgccgtccgtacaatggggacataatgatgacttcgaaggagttgctgacataaacctctggagttattagtactcgtatttttcttaaaattatttttggaatgataatattttattgaattcggattctacctattttttttaatggatatcctttttttctggtagtgtgagaaacgattgtgaatgtttccacaaaagtgttggcaatgttgtcaaatgctgggtattttgtgcagcatagtcatcttggtttccttatatgcagcaactaaattttagtttttaagtaaaaacagaagaggaaagagaatgaatgttattaaataaagaaagaaaaatctaaaggtgggtttagtatgaaaaaaaaaaaaaaaaaa

SEQ ID NO: 15433 - DNA, 945 bp, Brassica napus
  Predicted polypeptide sequence is orthologous to G912, G2107, G2513
aattcggcacgagctgagagataaattaaacatttatcaaaccaacgaaacatagatctttgtacttactatacttcaccttatccagttttatttttttatttataaagagttttcaacaatgacctcattttctaccttttctgaactgttgggctccgagcatgagtctccggttacattaggcgaagagtattgtccgaagctggccgcaagctgtccgaagaaaccagccggccggaagaagtttcgagagacgcgtcacccagtttacagaggagttcgtctgagaaactcaggtaagtgggtgtgtgaagtgagggagccaaacaagaaatctaggatttggctcggtactttcctaacagccgagatcgcagcccgtgctcacgacgtcgccgccatagccctccgcggcaaatcagcttgtctcaattttgccgactccgcttggcggctccgtatcccggagacaacatgccccaaggagattcagaaggcggctgctgaagccgcggtggcttttaaggctgagataaataatacgacggcggatcatggcattgacgtggaggagacgatcgttgaggctattttcacggaggaaaacaacgatggtttttatatggacgaggaggagtccatgttcgggatgccggccttgttggctagtatkgctgaaggaatgcttttgccgcctccgtccgtacaattcggacatacctatgactttgacggagatgctgacgtgtccctttggagttattagtacaaagattttttatttccatttttggtataatacttctttttgattttcggattctacctttttatgggtatcattttttttttaggtaacgtggaagctgagtgtaaatgtttgaacaattgtgttataaaatgctagtatttttgtgtgcaaaaaaaaaaaaaaaaaaaaaa

SEQ ID NO: 15434 - DNA, 1061 bp, Brassica napus
  Predicted polypeptide sequence is orthologous to G912, G2107, G2513
aaattatacaaaaagagttcgagctcttgattacttaattaaaaacaaattttacttctcttttttttatggtcttttgtcatgatctgaaatacggtctttgttgataaatcatatatgccgattttgatttttaatccacctgagagataaattaaacatttatcaaaccaacgaaacatagatctttgtagttacttatccagtttattttttaaaaaattataaagagatttcaacaatgacctcattttctaccttttctgaaatgttgggctccgagtatgagtctccggttacgttaggcggagagtattgtccgaagctggccgcgagctgtccgaagaaaccagccggtcgtaagaagtttcgggagacgcgtcacccagtttatagaggakttcgtctgagaaactcaggtaaatgggtgtgtgaagtgagggagccaaacaagaaatccaggatttggctcggtactttcttaaccgccgagatcgcagctcgtgctcacgacgtcgccgccatagccctccgcggcaaatcagcttgtctcaattttgctgactcggcttggcggctccgtatcccggagacaacatgccccaaggagattcagaaggcggctgctgaagccgccttggcttttcaggctgagataaataatacgacgacggatcatggcctggacatggaggagacgatcgtggaggctattttcacggaggaaaacaacgatgtgttttatatggacgaggagtccatgttagagatgccggccttgttggctagtatggcggaaggaatgcttttgccgccgccgtccgtacatttcggacataactatgactttgacggagatgctgacgtgtccctttggagttattagtgcaaatttttttttcaattttttcgtataatattcttttggattttcggattctgcctttttatgggaatctttttttttttggtaatgtggaagctgagtgtgaatgtttaaacaattgtgttatcaaatgctagtatttttttgtgcagcctcgtgccgaatcctgcagccc

SEQ ID NO: 15435 - DNA, 879 bp, Brassica napus
  Predicted polypeptide sequence is orthologous to G912, G2107, G2513
cccctcgaggtttgttcgcctctagttccagaggccagtataaaaaacaccaactctcactcccaacttttttatcgaactacaaactttagaatccacctgaaagataaaataaacatttatcaaaccatcagaactgagatctttctagtctcttactatacttaaccttatccagttaacaatgacctcattttctgccttctctgaaatgatgggctccgagaacgagtctcctgcattaagcggggagtattgtccgacgctggccgcgagctgtccgaagaaacctgcgggtcggaagaagtttcgggagacgcgtcacccaatttacagaggagttcgtcagagacactcaggtaagtgggtgtgcgaggtgagagagccaaacaagaaatccaggatttggctcggkactttcctaaccgccgagatcgcagctcgtgctcacgacgtcgccgccatagccctccgtggcaaatccgcctgcctcaatttcgccgactcggcttggcggctccgtatcccggagacaacatgccccaaggatatccagaaggcggctgctgaagccgcggtggcttttcaggctgagataaatgatacgacgacggatcatggcctggacgtggaggagacgatcgtggaggctatttttacggaggaaaacaacgatgggttttatatggacgaggaggagtccatgttcgggatgccgtccttgttggctagcatggcggaagggatgcttttgccgccaccgtcggtacgattcgaacataamtatgactttgacggagatgccgamgtgtccctttggagttattaatacagagattttttatttccagtttttgtataatactttttttttggatt

SEQ ID NO: 15436 - DNA, 898 bp, Brassica napus
  Predicted polypeptide sequence is orthologous to G912, G2107, G2513
aataaatatcttatcaaaccagtcagaacagagatcttgttacttactatactacactcagccttatccagttttcaaaaaaagtattcaacgatgaactcagtctctactttttctgaactgctccgctccgagaacgagtctccggttaatacggaaggtggtgattacattttggcggcgagctgtcccaagaaacctgctggtaggaagaagtttcaggagacacgccaccccatttacagaggagttcgtctgaggaagtcaggtaagtgggtgtgtgaagtgagggaaccaaacaagaaatctagaatttggctcggaactttcaaaacagctgagatcgcagctcgtgctcacgacgttgccgccttagctctccgtggaagaggcgcctgcctcaacttcgccgactcggcttggcggctccgtatcccggagacgacctgcgccaaggatatccagaaggctgctgctgaagccgcattggcttttgaggccgagaagagtgataccacgacgaatgatcatggcatgaacatggcttctcaggttgaggttaatgacacgacggatcatgacctggacatggaggagacgatagtggaggctgtttttagggaggaacagagagaagggttttacatggcggaggagacgacggttgtgggtgttgttccggaggaacagatgagcaaagggttttacatggacgaggagtggatgttcgggatgccgaccttgttggctgatatggcggcagggatgctcttaccgctgccgtccgtacaatggggacataatgatgacttcgaaggagatgctgacatgaacctctggaattattagtactcatatttttttaaattattttttgaacgaataatattttattgaa

SEQ ID NO: 15437 - DNA, 874 bp, Brassica napus
  Predicted polypeptide sequence is orthologous to G912, G2107, G2513
gtaattcgattaccgctcgagtacttactatactacactcagccttatccagtttttcaaaagaagttttcaactatgaactcagtctctactttttctgaacttcttggctctgagaacgagtctccggtaggtggtgattactgtcccatgttggcggcgagctgtccgaagaagccggcgggtaggaagaagtttcgggagacacgtcaccccatttaccgaggagttcgccttagaaaatcaggtaagtgggtgtgtgaagtgagggaaccaaacaaaaaatctaggatttggctcggaactttcaaaacagctgagatcgcagctcgtgctcacgacgtcgccgccttagctctccgtggaagaggcgcctgcctcaacttcgccgactcggcttggcggctccgtatcccggagacaacctgcgccaaggatatccagaaggctgctgctgaagccgcattggcttttgaggccgagaagagtgataccacgacgaatgatcatggcatgaacatggcttctcaggccgaggttaatgacacaacggatcatggcctggacatggaggagacgatggtggaggctgtttttactgaggagcagagagacgggttttacatggcggaggagacgacggtggagggtgttgttccggaggaacagatgagcaaagggttttacatggacgaggagtggatgttcgggatgccgaccttgttggctgatatggcggcagggatgctcttaccgccgccgtccgtacaatggggacataatgatgacttcgaaggagatgttgacatgaacctctggaattattagtactcatatttttttaaattattttttgaacgaataatattttatt

SEQ ID NO: 15438 - DNA, 1222 bp, Brassica napus
  Predicted polypeptide sequence is orthologous to G926, G2632
gaaaacttgctcagatcgttcatcttccaagcggaagcgtctccttccatcaccgtagacgccttccgtgacggtctctactcgctctttccctgaatggaaactgaagacatgcattcaaaatctgaaagtgggaatcagatcgtttcagaggctcatcatcatacatcatcaacgtccattaacagtttaaacccttggctgcgtgctgctgcttcctgcaatgcaaactcttctgtggaagaagctggagataagtcgatagcattggagaaccaaaccaatttggaatcatcaaacgggtccaagtcaccatctaaccgagatgaaaatggtaacaaggagtcacaagtcacagcctctccccaacagtcagctgcggattacagtgaaaaaagccaagaacttgtgcatcctggcagtacaccacctcctcaccctcaacttgttagccacactgttggatgggcatcctcaaatccataccaggattcatattatgctggaatgatgggagcctatcccttgacttatgttccacacggtgggatgcctcattcaagaatgcaactgcctcctgagatggcacaagaacctgtttacgtgaatgctaaacagtaccaggcgattatgaggcgaaggcaggcacgcgccaaggctgagctagagaagaagcttatcaaatccagaaagcgttatctacatgaatctcggcatcagcatgctatgaggaggcctaggggtactggaggacggtttgcaaagaaaactaacaccgaagcttcacagcaaaaagatggagaaaagagaaatgcttgtgctactcagtccccgacgtcatctcattctgatcagcatgaaggttgtagtgatgagtatagaacaaatcagtccgatgagatgcagagttcagcttataagataagggaagaagcagactgttcagggcagcagtggaacaacatttcctcaaaccatccttctcaacctcttttagctatcaagtaacctctacgctggcaaatcattcttggctctatctttgttggcttatgtgttagcagccattgaagagttatctcagttttcttctttcttgttttgtacaaacactagtgtgcttatgttagaatgcttctttgtcaacaccctttaggtttaataacaaacttgaagttttgaatccgaaactatgtgattgagaactaaaaaaaaaaaaaaa

SEQ ID NO: 15439 - DNA, 720 bp, Brassica napus
  Predicted polypeptide sequence is orthologous to G1011
gcttcatcaaagttgtctgtcggtggccggtggctcttcagccgcctgttaccatatgttttccttttgtttttatctgtttatacttttgatctacggatcgattctctgtcttgtgttgcgataaatcttcgttaggctatcttttgtggtgtgttatgtttttactcaaatcagaactgcttttcactctatatcttattctgatttgggtttaaactaaataaagtttttgtatattgccttccacttcgttctcaattttattccgatggatggtgggtttagttcttttttcaacgttcactctgagttcttgctaggaaaatcagtcttcgcaaatagttcagccataagtgcaaagcgaagcaactctgacagaaagagggaggagttaatggatttttcaaatcatgaaagaagaaaattcaaaagaactggcgctattcttcagcggtctggcaaaggattttcttctacttgatttaagcttccctagacttaattatggtgaaaattatggtgaatcaaggttacttttctcagttatccacggttaaggtggagggttttgcatttggtatcggaatacccaattttgagcatctctgcttgattgggatatggcgacgtcgggtgatctacggtggtgacaatctgcagtgcggccggagtttgcccgtcaacgcatgtaggacgcgtgtcttaggaaagatcgct

SEQ ID NO: 15440 - DNA, 710 bp, Brassica napus
  misc_feature (574)..(574): n is a, c, g, or t
  misc_feature (602)..(602): n is a, c, g, or t
  misc_feature (677)..(677): n is a, c, g, or t
  Predicted polypeptide sequence is orthologous to G1033
gaacaacacacgtacgatccttttgctctcctctctctctctctctagaaaccctgcaatcctcttcctcaagattcgagtatgaaaggaggtaaatcgaagactgaaaccaggagctccaagctctctgtggccaagaagcctgctaaagcagcaggtcgcagcaaagcggcggctaaggatcctaacaaacctaagaggccagccagtgccttcttcgttttcatggaggactttcgccagacttacaagaaggaacaccccagcaacaaatctgttgccgctgttggtaaagctggtggagaaaagtggaagtccttgtccgactctgagaaggctcccttcgtagctaaggctgataagcgcaaggttgagtatgagaagaccatgaaagcctacaacaagaagctggaggaaggtccaaaggaggacgaggaggaatctgacaagtctgtgtccggggtgaatgatgaggatgatgccgatgatggtagtgatgaggaggaagacgataactaaagaagttgaagctggtagcactatataggacgctacatcaaggatctcggatgtnttttattttctttctttttactgatgtnttcaacttagtaaagctgccactatctctctgattatgattctaccggtaatggaaaaagtgtgtgtagaatgtntgaattagagatatgcacctctatgtaacgatt

SEQ ID NO: 15441 - DNA, 358 bp, Brassica napus
  Predicted polypeptide sequence is orthologous to G1033
gcccttttttttttttttttttgaacaaaaaaaccctaaagcgactttaaaaaaaaacagcccccacctaaaaaaaaaacctgggattcattggataaaacaaagggggggatccccttttggcaaacttgtttttttcttggccaaaatcaaccttagggggaggggagggaaataaaacaaaccatcaaccgcctttgggcctttttttttttttttatgttggggaaacaaaaaacccccccaaaatcaaaaaacaggaaacccttccaaaaaaaatccccaattttttttttttgttcaacaacattttttttttttttggggggaaaccaaaccccaattcattgaaaaaaaa

SEQ ID NO: 15442 - DNA, 730 bp, Brassica napus
  Predicted polypeptide sequence is orthologous to G1033
gagcctgcaaaaaaaaaaaacttccaacgttatggagttcgtctgaatcaaagtgtcgtcttcaacggattcatttacaattgttctccgcacctcacacaatctatcattgaatgcatcccattttacttcctttctcagaatataaggtaagtcatatccagtaaatttcattagttcattctctcaatcacaatcataagctttcaaaaatcccattgataaaaatggttaattaagctatattttaagtccaaacaggtgccttcttcattttcatgtactcattgcctactgattcttcaatttaatgtgttcagtatcttccaaggattaaactttttggctgtccaaaacttttttatttggctaatgtgaaatttactgaaggttagaagagtagactttttgtgatcccaagggagtacttcccctagactttcaagaagaacatcctacggaacaaatataatagcacaaatataatagcacaaatatactgctgatggctggaggttcttttgtaacttagcctcttgatcttgaaaggcacactgacgttgaattcgaatgaaaaacagaagaagacaccttatgttgctaaggctaaaaagtgtacagttgactacaagaagaacattaaagaaaaggggcagaggattcagaggggcagaggattcaaaggaaggagttgatcttgatccagcaaaaaaaaaaaaaaaaaaaaaaa

SEQ ID NO: 15443 - DNA, 335 bp, Brassica napus
  Predicted polypeptide sequence is orthologous to G1062
ggtttgccttgaatgtgttccgcgctgagcaatgccaagaaggacaggagatattgccatgatcaaatcaaagcagtgcttttagatacagcgggctatgctggtctgatctgatcatgaggttcttgagcatctgatgaagaaactaagcctttaaatatgcaattttctttactttctttcttcaagttaagcatgtatgcaactgtacatgagacatgtttaaattaacctttttgaacttggggggttgttcgatatattacttcagcctttattatcatgtgtgttttaagttagaaaaaaaaaaagaaaaaaaaaaaaaaaactctgtc

SEQ ID NO: 15444 - DNA, 511 bp, Brassica napus
  Predicted polypeptide sequence is orthologous to G1249
gaattacatggcggaagaagaagagacgacgacacgaccggagtttccaatcacaagagtgaagaagataatgaaagtcgacaaggacatcaacaaaatcaactcggaagctcttcacctcgtcacttactccaccgagctcttcctccgcttcctcgccgataaatcttccctagttgcggcggagaagaggcgaaaaacggttaccctcgatcacctgagaatcgccgtgaagagacaccagcccacgagggattttctcctcgactcgctccctctcccttcctctcagcccgtccgagtcaccaaaacggcgtcggagaagaagccgccgcctgctgggacccgtcgcatcgacgctttcttcagtaaaggcaaggcgaaagttgattccccttaagaccccaaacttcttctttgctccatgtttatgagtttttgttatgttaaaagtagttaatgttatgtttcaatagaaaaaaaaaaaaaaaaaaaaaaaaaaaaacgtgtc

SEQ ID NO: 15445 - DNA, 443 bp, Brassica napus
  Predicted polypeptide sequence is orthologous to G1389
tcatgggatgatgatgatgcaaggcctcagcttccccatccatggagaagaacctactcaaccaaactcttcttcttctcctccaaactcacatctctaaacacagaagaaaagggtaagaacaatggaggtttctcatctatcaggacacggaggaagaaggatgaattaatgagatggaagaagagtacgcgatatattaattgttttaccatccatgatctatccatatgtttatagatatgtggtttcagttattatgattcaagactacttctactactctctttttagtatttttattattcagttttgcttatttactttatggttctgcattgatcatcaagactatgatactgaatgagatgggttctatgtgtgtgtttccaaaaaaaaaaaaaaaataaaaaaaaaaaaaaaaaaaaaaaaaaaaacatgtc

SEQ ID NO: 15446 - DNA, 515 bp, Brassica napus
  Predicted polypeptide sequence is orthologous to G1481
gacgaggaggaagcggagaatcatagtggtgccgtggtctgcggaagcggcggcgcaactgcctcctatgatgagttcatcatcatcatctgacggcggagatctggtggggaaaagggcgagggactgctccgatgacgagatcggaagctcttcttcagctcaagagttaaactattctccaccgttaaagcgaccgtcgagagaaggacgcgcgtccaaatcaacggctgtgattaactctcttaccagattagaaggagagggcacattgaacggcgccgttgattcatctctcgttgccatcgccagaacgaaaagagatctcagccgttgattctccgtttcctctctggtaaatcatcacccgtccatttctgaaattctaacaatacatgttttagtaatcgaggtagtagtttaattgttgtcgtgcaacattgtattttattttgatctattaatagcattattattacaaaaaaaaaaaaaaaaaaaaaaaaaaaaaacatgtc

SEQ ID NO: 15447 - DNA, 577 bp, Brassica napus
  Predicted polypeptide sequence is orthologous to G1510
gcatcttcgttggtgatgaagttggttaagccacccctccatttcctgtagcgaaggagtcctcgtcgcatctttcagtaaggatctttcccggtttgtttcgctaccctcttaattcctcagtggcttcgtattgtatgtttgaagcaatataaagaggtcgatgtgtgggatcaaccggatgaagatgcgggggagcggtttgtcccgggtggttcagttcttttggttctagggttcaggggtcagtatcgtgtgggatctgactcgggtgtgatgctaatttgtgtggttctggctcttcatctcttcatcgtgaacagaggttcagatgagtttcggtcgtttatgtctttcacgtcgcttgctcacttgtctgaatgttgttctccgcaagttatccggctgctttaggctccttactattatctttggcctttgtacattaatgtatgtgggtgtagaggtatgatcttgctttagtcttttaagttagcattcagtttgttggtagttgcctgtgtttgggcttaagttacccttgtatgggttctagttccgaggattcactttgtcc

SEQ ID NO: 15448 - DNA, 649 bp, Brassica napus
  misc_feature (628)..(648): n is a, c, g, or t
  Predicted polypeptide sequence is orthologous to G1535
cggcaaggcttgagcttccttctggcttcactcctctgagacagacctcttttaccaggacgtgttatcccgtgggaggtgacgaaggtgacggaggtgagggagggtggcttgtgcttgatctccccctcccttcaagattcggccaagaagagcttccttacgtgagaagctttcttgcgtttcctgctaggtcccatgggttctcgcgagtcatctcgctcgagattgggctgatctacaaaaaagattcccaaacccagtccgatcccaattacgatggtacaaacttttggtcatcgctttggttttggacactttctcgtgagtgtcaacgtcgtagccttcatttctcagcagggactgacaaagcggtggtggagtaaagcggtggtggagtagtagaagaagacaactaaagacctatactactccatattttatgtttatccccaggctctctctctatctactatttagaactgctacataagtttcttgcacttcacactctctttttctattattatataaaaaaatcttcatcaagtgatgatgataaacagatggctttacatttgattccactagtaaataaatctatgattatgttgttgtcaaaaaaaannnnnnnnnnnnnnnnnnnnnc

SEQ ID NO: 15449 - DNA, 493 bp, Brassica napus
  Predicted polypeptide sequence is orthologous to G1793
ggaacatcggccgaggaagagtttcccacggttaaagttgattacgatatgcctcctttaggtggagccacagggtgtgaacgatggactaatggagagaatggtcaggggtcaaatccaggaggtgtcttcacaatgtggaatgaataaaaggttgttttctgtctctcttgcgaggcaaggtatggttctgaatgatagatattattttcttgtttaccaagtagtttagaatcggctggagtcttctcgattagcagaggctttagaatttttatcacttttgacggcgaagatgatgaatttgtagacggcggttaatcaagtcctcaagggttagtgttttatgggcactgaaacaagatggatacgtgcccaaattttgtttaaaagctaacccttttgactaatttctcaaacctgtaattccttttataattaagatttatgttccctttgtaaaaaaaaaaaaaaaaaaaaaaaaaaacatgtc

SEQ ID NO: 15450 - DNA, 643 bp, Brassica napus
  Predicted polypeptide sequence is orthologous to G1794
gagtttggctcggtacgttcgacaatgctgagtcagctgcaagagcttacgacgaagctgctcttcgttttagaggcaacaaagccaaactcaacttccctgaaaacgttaaactcgttcgacccgctgcaacacaatctgtgccacaaaccgctgttcagagaccaactcatttaaggaactcgggttctacaagtaccattttgcccataagacctgcttcggagcaaatcgttcattctcagctgttaatgcaaccgtacagcatgagttactcagagatggctcgtcaacaacaacagtttcagcatcatcatcaacaacaatctatggatttatatgatcaattgtcattttcgttgccttttggtcacaccggagactcaacaatgctatccacatcatcatcgtcatctcattctcgtcctctgttttctccagcagcagttcaacaaccgccggaatcagctagtgaaaccggttatttcaaggagttaaaatggtcacaagacaagacaaacaataataactataataatagtccatcctcctaatggaattgcttcatttcttatttttctttttactataaataagttagcgtttaggttttaaaaaaaaaaaaaaaaaaaaaaaaaaaaaa

SEQ ID NO: 15451 - DNA, 596 bp, Brassica napus
  Predicted polypeptide sequence is orthologous to G1835
atagtttagaccaaaatccagttaggaaatgtatgcattgtgaggtcaccaagactccacaatggaggcttggacctaacggtccaaagacgctttgcaacgcgtgtggcgtgcgttacaagtcaggaaggcttttcccggagtaccgtccagctgctagtccaacattcactccggctcttcactcaaactcacacaagaaggtggctgaaatgagaagcaagagatgcaaggatggaagctacacgaccgaagagaatgatatgcaagatttgattccgaacaatgcctacactggtgtagacttaaaaccgagagagagatgattcaatctccaagtgttgaagtgattagagttgagaggagtaggaaagagtcagggggcagttttagatttagaagagatgaatgaagaggaacaatcaatttgaggagatcagaaattagaagagaattgattgtgattgtatttttgtatttgtagtgtgaatgggcaaagcagaagattttgaaaacattacagaaagttaagtgttgagtttccattaaatattcctctcattttctctttccaaaaaaaaaaaaaaaaaaaaaaa

SEQ ID NO: 15452 - DNA, 552 bp, Brassica napus
  Predicted polypeptide sequence is orthologous to G1935
gggttcatgagcaagagattgataatgaaagtgaagatgaggaggaagaactgaggaaattcgaacccgatccagtgaggtttacatcaatggaggaaatgggagcatgtgaaaatcatctacttagtactcttactcgtgtggttcagagaagggaacatttgttgagcagatcctgcgaagcaccaagtacccaacagagcatggaaaatattgaaggctgggagcatgaggctgagttcaaacaagcccgtatatataatagcgaactcagccaatgcatcaaatcattatgatctgccgttgcaaggaatcatctcaaatccaacccaaactccaaaatgatgtttgggtgaatcgcaaaaaatgcaatgttgttgacaaaaataaaacggtgcgtatttcctatgtcagtgcctaacctcctatggtttttatctttcagattctgaagtctgaactatttgtataaataaaggttggaaaaggtcattttgttagaacttagaaccataattgctacgaaaaaaaaaaaaaaaaaaaaaaaaaaaa

SEQ ID NO: 15453 - DNA, 725 bp, Brassica napus
  misc_feature (125)..(125): n is a, c, g, or t
  Predicted polypeptide sequence is orthologous to G2084
tcagagagtgtgagcgaatgggaggacgtcaggtgtgtgatctgcatggagccgccgcacaatgccgtcctcttgcaatgctcttccttctccaaaggatgccgtgcttacatgtgtcacactancgcgcgtcactccaactgcttcaagcagttccgcagaaacaagaacacaagccgatgcagtgtcaagactcttagctgtccctactgcagagaagaggttcacgggacggtcaagtcaacctccgcgcggagattcatgaatgcgagaccgaggtgctgttctatggacaagtgcggtttctctgggagctattctcagctcaagacacacttgaaagctgagcatccgggttctacgcctccgaaagtggaccctttggagaaacgcaagtgggatgatttggagagagcggagttcattgagatgatcaacgctcgtcagagatgggaatcagaacagagatctctctatcagcttccgcatcaccatcccttgatagatctcaactttgatgctttcatgcacaatctttttattggtgtaaggggtggtcaagcaagtgatgctaatacttcagtgccccggttggagttcgatggtaccagatggactccgtgaagattattccaagtgccgagtttagtcaagtgttgttccatagctgctctcttatatatcaaaaaggcgtttcccccgggaggaaaaaaaaaaaaaaaaaa

SEQ ID NO: 15454 - DNA, 623 bp, Brassica napus
  Predicted polypeptide sequence is orthologous to G2141
gccaagttgagtttttatcgatgaaacttgccactgtgaacccacaaatggactttaaccgtgaaggtcttcttgccaaagatgcacttcaactacgagctggtacgtcatctgcaacaccgtttcctccaaatatgccaatggtttatcctcctctgccacatggattcatgcaacagaccctttcatgcatgggaaggaccgttagctctccattgtctcccccaataaatggtggatacaagcgacaggaagcaaatggatgggaaggtgatcttcaaaatgtgatacagattaactatggagctggtgatgtcccacctgactctcaagcagcagctacagatgcatctcttccatcttcaaacatgaaggttgagccatgagattttctttctgttagatagaatgttatattcttgtaatctttcttttaaatttactgtgtactatatgatgtattaacgagtactactagtctactactactactaataagcatttaagattaggtaaaaaaaaaaaaaaaaaaaaaaaaaaaaaaaaaaaaaaaaaggaaaaaaaaaaaaaaaaaaaaaaaaaaaggaaaaaaaaacaaataaaaaaataaaaaaaaaaaaaaa

SEQ ID NO: 15455 - DNA, 649 bp, Brassica napus
  Predicted polypeptide sequence is orthologous to G2291
taggatccatgcaacagactggctgctgcaggagctctattcagccccaagtgttttgtagacggctttttcaaatacttctgagtttagagcagagtgatctctgaccaaaacagtttcttatacatctggaaaaccaacctggctgagccaaggaagaagtaaggccaaaaagaaaatgaaaagacatgtgagggcatatcaaaacatcatctttgatctttcagaaccagaagttatccctcaagaatcccaccaagagtctcatgcctccactggaacaacttcttttttgtacgttgtcctttcctgaagaattatggaagattcaagagagagagagagagcaagagacgtgagtgcaggtaaaaaagaagaagatcaagttgcatacgttgaactgcattaaagtacttaaatgctcccaccggttccttttgtgttgtttttattttggatgaagaatagagagttccatcaatagttgtgttgtaagaaaagagattcgcttagaaaagtgggttgatgtgtaaattttggttaacaattctattttaacacaaatgtaaaagatgaactaaataaaatgtataataaaaaaagatagtttaacgaagcaaaaaaaaaaaaaaaaaaaaaaaaaaaaaac

SEQ ID NO: 15456 - DNA, 808 bp, Brassica napus
  Predicted polypeptide sequence is orthologous to G2346
gacttggagaaaagaagttgtagaagacgtctagcttgtcataacgaaagaagaagaaagccccaagcaacaacagcagctcttttggcttctggttactctagaatcgctccatctctttacggaagcgttttgggagatcctacaacgtggtcaaccgcaagatctgtgatgggacggtccgcaccgtgggatagccatcaactgatgaacgttttgtcacagggaagttcaaggtttagtataacatacccagagatggtgaacaataatagcacagactcaagctgtgctctctctcttctgtcaaactcaaacacaactcagcagcagcagcagacatcaaccaatgcttacttgatggacgcagaaagggttacaatggctaagtcaccgcctgtttcagtacacaatcagtactcgaaacaaacctgggagttcatgtcaggcgaaaagagcaattggccttgtgtgtcgtcccctgttttgggactgagacaaatctctgagccagatgatgacctccagttcctgatgagcaatggcaccacaatgggtggattcgagctgaacctacagcaggagcaggttctgaggcaatactcttctactcaaaattttacttggcctctttgagactttctaccaagagcccttaccagtagaaggttgctagttgctactaagacttgatagtctcaagatcttattaaattatatatttttctatgctacttaaaacccgacaatggccttgaatctggatattatttttaatggttttggctcttgattttaaaaaaaaaaa

SEQ ID NO: 15457 - DNA, 587 bp, Brassica napus
  Predicted polypeptide sequence is orthologous to G2425
tatagtcgagtcgtatgagccggcgaagcctcctttttattaagcgagagtgtcatagagcctcacatatattgttaaaagtctcttgaataaataaataaatagtaagagtaatcaataattcacttgttctcaagctcagtcatcaccatcatcatctgacttcacgttgggctcgaattgatcagagagaagtgatacgtgacgagatctgattagttcaccggaaataaaatggggaggacgacttggtacgacgacgagggtttgaaaaaaggagagtggacggctgaagaagacaggatgctcgtcgcttacatcaacgaatacggtcttggggactggcgtgctatgcctaagagagccggtctgcaaagatgtggaaagagttgtagattaaggtggttgaattatttgaggcctggaattaaaagaggcaagttcactcctcaggaggaaaaagatatcatcaaatttcattcccttcttggtaacaggtgatttaatttgtattaaatgcaaaccaatagacattaatcttgccaaattaaataaatcaataatcatgttatattcataaaaaaaaa

SEQ ID NO: 15458 - DNA, 612 bp, Brassica napus
  Predicted polypeptide sequence is orthologous to G2465
cagggatcatatgaaagtcgatggattaacaaacgacgaagttaaaagccatttacagaaatatagacttcacacaagaaggccagcgactacggtgacggcgcagggtaacggaaactcgcaacaaccgcagtttgtggtggtcggagggatatgggtgccgtcaccacaagaagttcctccaccgtcagatgtagctaataacggtggtggtgcatatgctccagtgacgctccaaccaccaccacaatcactaccaccgcaatctcctaaacgttcggtggagagaagtagcggccggtgcaactctcaggcggcatcttcctctacgaacacgacaacttcttctcctgtttcatagtgtgggtttgattttgtaggtttgaagcaagtgaatgtaagatgtgtaaccaaagagtgttctttcattagtatgtacacgaacgaggtaagtaaagagtctttgttttctatcttttggatattcccttgttgttttgttttttttttgtgttcaagttttgacagattttggtgattgcatatactatataagaatttagaataatacatgaaataatttccaaaaaaaaaaaaaaaaaaaaaaaaaaa

SEQ ID NO: 15459 - DNA, 720 bp, Brassica napus
  Predicted polypeptide sequence is orthologous to G2510
cccacgcgtccgcccacgcgtccgcccacgcgtccgcccacgcgtccgagaaaccttctcgacgacgaggcatccagtgtaccacggagttcgcaaacgccgatggggaaagtgggtttccgagattagagagccacggaaaaaatctaggatttggctcggatcttttccggtgccggagatggcagctaaagcctacgacgtggccgcgctttgtctgaaaggaagaaaagctcagcttaatttccctgacgaaatcgacgatctacctcgaccttcgacatgtacggccagagatatccaagtcgcggcggccaaagctgccaatgccgtcaagatcactaaagcggtagatgacgtggcagacgtcgacgacggagatgatttctgggaaggcatagagctgcccgagcttattatgaccggaggtgggtggtcgccggagcttttcgttgccggagaagatgccacgtgggtggtcgacggtgactcgtatcagtatcagttcatggcgtgtctgtgagtgtagttgtcttgtcgactgtgtcgtattcgctatacgtgtgcgctgtattgttattgtgttggatagatcgatttaatgcaactatatttttatgcattttcattttatttgtttctagttttattgttttatgtgatttataaatatataccctgttaagtttgtaaaaaaaaaaaaaaaaagggcggccgctc

SEQ ID NO: 15460 - DNA, 719 bp, Brassica napus
  misc_feature (694)..(694): n is a, c, g, or t
  misc_feature (696)..(697): n is a, c, g, or t
  misc_feature (699)..(702): n is a, c, g, or t
  misc_feature (704)..(705): n is a, c, g, or t
  misc_feature (707)..(707): n is a, c, g, or t
  misc_feature (710)..(712): n is a, c, g, or t
  Predicted polypeptide sequence is orthologous to G2636
taccttacttcctccgttaaggatgaatgggttctctctaaagttagtctgaaaagcagcgtagttgtcggtagagagcagacgaagttgctctcttcttctaccgcttccgtcgccggagaagtctcctcttctgctccgatcattgacgcctttgcgacggagcacgtgtcctgtttctccaatacctccgctgcagctcatgccgatacgagctttcctacgtaccttcccgctccgccgctttcactgccacgtcagcctcgacgaataggtggtgatgacgtggcgtttggtcagtttatggatatgggatcttcagggcagtttaatgtcgacgaagcagcaacgttcttaccgtatctgcctccgacggttcttcatcctcctcagacgttcgaactgtacggtggctcggccctgagttgctggccgtttgctctctgatgatcgttgctatgctggtttagtctcgactctcgaaccatttgtttgttgtgttgtgttactcgcatgtacgtgtgtttgtaatatctctatgcgtgttgtaacatgacttgtatgtcatttcctagcagtagtagtactctcggatcatttgcattatgttttgtaatgtcttttgcatgactttttttatattaatttcttgtttgcttggtcattaaaattaatcacagttaacttaaaaaanannannnnannanaannntcctgtt

SEQ ID NO: 15461 - DNA, 724 bp, Brassica napus
  Predicted polypeptide sequence is orthologous to G2717
gactgtctttaacctaattttttttttcaaaagcctcccgaaatctgagaaaaaaacccaacaagggaagttggagttggtctcgcgaagatcagattcggcttagcgtttgatgggtgctccaaagcagaaatggactcaggaagaagagtcagctctaaggtctggcgttatcaagcatggacctggtaaatggcgcaccattctcaaagaccccgactttagtgaagtcttgttcctgcgttccaatgttgatcttaaggacaaatggaggaacatgagtgtcattgcgaatgggtggggttcgcgcgagaagtctaggttagctgttaaaaggacgcactctcttcctaaacaggaagctacctcacttgccaacactagcccattgcagagtgatgaagaaatggcagatgccactggcacttctgcacccaatgtaaggctggatagccttataatggaagcaatatctaccataaaagaacctggtggctctaacaaaacatcaattggtacctacattgaggaacaatatcacgctcctccagacttcaaacggttgctgtcggccaagctaaagtacttgacagctcgtcggcaacttatcaaggttaaacgcaagtataggattccagactccactgctttgtcttcccacagaagaaaacatttggggacatcttctggaaaacagaggagtctctctttgccttcacctaaa

SEQ ID NO: 15462 - DNA, 692 bp, Brassica napus
  Predicted polypeptide sequence is orthologous to G2854
ggaaacggcaacggcggcatatcgtctctggctttaggttatcgccgtcatgatgcagcggccacctcccgccgctaacggggccgccgcaggatcggtcagatcccttcggaccagcaagcttaccaccaccaccaatcgtggatgatgcagcagcagcaactacagggtcagcccccggcagcatggaatcctcagtcggcgccgtctccggttcaacagtacggcggtggatctcagaatccaggatcagctggagagatcaaatcctggtggatcggagacttgcagccgtggatggacgaaggctacctcatgagcatcttctctatcaccggcgaggttcaacaagctaaagtcattcgcaataagctgaccgggttaaccgaaggctatgggtttattgagtttgtgtcccatgctgcagctgagaggattctccagacgtacaacggtgctcagatgcctaactgtgagcagacctttaggctgaactgggctcagctgggagcgggagagagacgccagtctgatgggcctgagcacacggttttggtaggagatctggcgcctgatgttactgactacgtgcttaccgaaacgttcaaggctgtgtattcctctgtgaagggagcaaaagttgtgactgatagggccacgggacggtccaagggatacgggtttgtgaagtt

SEQ ID NO: 15463 - DNA, 3108 bp, Brassica napus
  misc_feature (852)..(852): n is a, c, g, or t
  misc_feature (2123)..(2123): n is a, c, g, or t
  misc_feature (2235)..(2235): n is a, c, g, or t
  misc_feature (2706)..(2706): n is a, c, g, or t
  Predicted polypeptide sequence is orthologous to G2907
gctgcaggaattcccggatcttttggatttattagccctcctcgattagatatggaacagttgttatcggaagctcaacacaggtggctgaggcctgctgagatttgtgagatccttcggaactatcacaagtttcatattgcaacagagtctcccactcgaccagccagtggttcgctctttctttttgacaggaaggtgcttacatactttaggaaagacggacataactggaggaagaagaaggatgggaaaacgattaaagaagctcatgagaagctcaaggtaggaagcattgatgtgctacattgttactatgcacatggggaaggctacgagaattttcagagacgatgctactggatgctcgaaatagagctgatgcatattgtgttcgtgcactacttggaggttaaggggagccggacaagtatagggatgaaagaaaacaattcaaattctctaagtggcacagcttcagtgaatattgattcagcagcaagccccacgagcagattgtcatcgtattgtgaagatgctgattccggtgatagtcatcaatcaagctctgtcttgcgagcatctcctgaacctcaaactggaaatcgcaatggttggacatcagctcctgggatgcgtattgcttcacaggttcttgggaacagagtcggagaaactgattcccagagatcatttgatgtccaggcttgggatgccgtcgagaatttagtgacaaggtatgatcaaccttgcaacaatttgttggtggaagagcgtacaaacaaatttggaatgttaccagcagagcatctcagaagtcctcttcaaaaccaactaaattggcagattccngctcaggatgatctaccattgccaaaatggcctggttatctggttccacattctggaatgactgatgacactgatctggcgttattcgggcaaagtgcacaagacaattttgagtcattttccagtctccttgacattgaacatctgcaatctgatgggattcctccttcagatatggaaagtgaatatatacctgtaaagaaatccttgttgaggcacgaagatagtttgaaaaaggtcgatagtttttctcggtgggctagtaaagagctaggcgagatggaggatttgcagatgcagtcttcgcgtggagatattgcatgggcctctgttgattgtgaaactgcagcagctgggctctcctttagcccttctctctccgaggaccagcgtttcaccatagttgattattggccaaaatgcgcacagactgacgctgatgttgaggtcttggttattgggacgtttctgcttaatcctcaagaagtaactatatgcagctggtcatgcatgtttggtgaagtggaggttcctgctgagattctagtggacggtgttctttgctgccatgctccaccgcatacagctggccaagtgcccttttacgttacctgttcaaacagatttgcttgcagtgaattacgagaatttgatttcctttctggctctaccaaaaagatcgacgccgctggtatttatggatactctacaaaagaagcatcacttcagatgcggtttgaggagctgcttgctcatagagctttcgttcaagaacaccaaatatttgaagatgttgtggagaaacgaagaaagataagtaagatcatgttgctaaatgaggaaaaagagaatctctttccagggatatatgagagagattcaaccaaacaagaaccaaaagaacgggttctcagaaaacagtttgaggatgaactctatatatggctcatccataaagtgaccgaagagggtaagggaccaaacatactggatgaaggcggacagggtgttctacacttcgttgcagcacttgggtatgattgggctatcaaaccgattttagcagcaggagttaacattaacttccgtgatgcaaatgggtggtccgcccttcactgggctgcgtttagtggcagggaggaaactgtcgctgtgcttgtctctctaggtgctgatgctggggcattgacggatccatctccagagcttccattgggcaaaacagctgctgatctggcttacggaaaggaacacagggggatttcgggttntcttgcagagtcatccttaaccagttaccttgaaaagctaacgatggagtcaaaggaaaacagccctgccaactctggtggaccaaaagctgttcagacagtctatgagagnaccgctgctcctatgagctatggtgacgtaccagaaacgctttccttgaaggattcactcaccgctgtccgtaatgcgacgcaagcagctgatcgtctccatcaagtattcaggatgcaatctttccagcggaaacagctgtctggatttgatgacgatgatggtgacgagattggtatctccaacgagttagcggtttcttttgcagcttctaaagctaagaatccaggacagagtgaagtctttgttcattctgctgttacccacatccagaaaaaataccgtggttggaagaagaggaaagagtttcttttaatccgacaaagagtcgttaagattcaggctcatgtgagaggacatcaggtcaggaaacaatacaaaccaatcgtttggtcagtgggattgctcgagaaaatcattttgcgttggagacgcaaaggtactggactaagagggtttaaacgcaatgcngtccccaaaaccgttgagccagaaccacaatgccctatgattccaaaggagggtgactatgattttctagaaaagggaagaaaacaaacggaggaaaggctccaaaaggctctcacgcgggttaagtcgatggttcaataccctgaagcacgtgatcagtaccgtagactcctcaccgttgtcgaaggcttccgtgaaaacgaggcttcatcaagtttatctgtaaacaacagagaggagccagtcaactgtgaagatgacgatttaattgacattgattctcttttgaacgatgacattttgatgtccacttctcccttgaatgactcgtttgtgtattcattttcattctttcaactttctaactttttgcaccttttctctgtaaatatcataagttga

SEQ ID NO: 15464 - DNA, 706 bp, Brassica napus
  Predicted polypeptide sequence is orthologous to G2990
ggaaacgtgtcgaagacctacacaccaaagagacgcatggcgaaggaatgaattgtccccatctctaccgactgggaatagccgtcgggaccgcagaccgtcactccaccggaaacacgagccaccaacatcatccacgacttaaagctgtcactggaacagacaaagcactttaccaccggaatccaccgggacactaaccacaaccaccgaaaaccacctccaacgattgtattggagatataggaattcgatatcttccacacttgcgccagagctttggagagcatcaattgattgaatcaatatctcatccaaactcggccatcaaaaacgagaacagaacgtttcacacggctcgaacacttccaagggaacgatagccggcgacctccacctaagaagaaacggtgcagctccagagtccaaagccagatatccatcgaacgggagatgcgatactggaaacaaatacggacaaaaaaaaatgtagtttattatcccatggactacattcggaggaagcaaaaagaaaaaaaaactaaaaaagtataaagatacttaaaagcatgttacttacttcctttccgttacttccgttttgttatggataaaaaaattagaaaaaaatcgtttcatctttctatgttcttatgaaattttaatttgttaataataaacaattgtaaaaaaaaaaaaaaaaaaa

SEQ ID NO: 15465 - DNA, 651 bp, Brassica napus
  misc_feature (595)..(595): n is a, c, g, or t
  misc_feature (600)..(600): n is a, c, g, or t
  Predicted polypeptide sequence is orthologous to G2998, G2999
tatctctctccattaaaaccattcacaagcaaaaagctttgagcttttaatgagtttaagatcctcttcggttcctcctgcaaaaaactgggttgttcctcgtgtacttgctcttatctggttctaattttaatcaaactccaagaagaagaaaaaaaaaatggatatgagaagccatgaaatgatagagagaaaaaaagatgacaatggcaacaatggtgttggtagcattgcaaatgaagataatgtcaacggtaatcacaacaacactcgtgtctcttctcaaaccctagatcatcaccaccagtccaagtctccgtcttcttttgccatctccgccgccgctaaaaccgccgtacggtaccgggagtgtctcaagaaccacgcggcgaacgtcggcggaagtgtacacgacggatgcggcgagtttatgccgagcggcgaaaaagggacgatcgaagctctcaaatgcgctgcttgcgactgccaccgtaatttccaccggaaagaagtcgacggtgtgggaagctcggatgtgatcgctcaccaccaccgtcatcaccaccatcagtacggtggaggaggaggaggaggnagaanaccgccgccgccgaacatgatgcttaacccgctcatgcttcctccgcctcc

SEQ ID NO: 15466 - DNA, 545 bp, Brassica napus
  Predicted polypeptide sequence is orthologous to G3095
tggtccaggtggtgatcaacgctctttgagctccggtgatgaaggtggtttcagcttctctccgggaacaccgccgatatacaatcaccggaactcgagcagacgaaaaggaatccctcaccgcgctccattctgaataaaataaaaaaagttactgaatttcaacctccatattaactttaattaaatactataggtaataatacgcatcaatattataaaatgtataactctggaggtgaaatttaggatgttgtcataatgttgtaaatgggtcagtgtctttcatttttctcttctttttatattttcttcgtaaaagataaatgcagcataattagacacatacataatacatttttatataaatatagaagaatctagggctgaatagggaagtgttgttagcttgttggaaagggcgtggctcttgtgttgtgttgttatgtaatgtaatgtgtacattaaattttgttcatacaacaataatataaagtcaaattatgtataaaaaaaaaaaaaaaaaaaaaaaaaaaaaacatgtc

SEQ ID NO: 15467 - DNA, 774 bp, Chlamydomonas reinhardtii
  misc_feature (674)..(674): n is a, c, g, or t
  Predicted polypeptide sequence is orthologous to G481, G482, G485, G1364, G2345
gcacgagggcaaactcaccttgagctgcaaagcaaccaattgcttgagttacgaagaatagctcttaggggcgctttactgacgtgtttttcgtcgaggttgtgttggacgggccttcaccgggcgcctgcttcgcggcttctccgcgatgagcggggacgagggcgacggtcgagatggcaacagcaatgcgcgtgagcaggacaggttcctgcccatcgccaacatcagcagaattatgaagaaggcgctcccgaacaacgcgaaaatagccaaggatgcaaaggagacggtccaggagtgcgtctcggagttcattagcttcatcacgtcggaggctagtgacaagtgccagcgggagaagcggaaaacaattaacggcgacgacctgctgtgggccatgacgacgttgggctttgaggagtacctggagccgctcaaactctacttagccaagttcagagaggctgaggcggcgacatccaataagccagggggcggctcaggtgccaacgcggaggcaaagcgtgaggcggccgcggcggctgcggctgcggccgcagctgcggctgcagtttcgcagcaacaggcggcgcagcagcagatggcggcgcagctgcaagctggcatggcgttcccggggctcatgccggcgcagttccaggggctaccgnccggcatgattcccgctggcttacccggactgccgcttgcttccggcgtgccgggcctgatgatgcccagtggcgttgtgcccagcaggagctccctagt

SEQ ID NO: 15468 - DNA, 480 bp, Chlamydomonas reinhardtii
  Predicted polypeptide sequence is orthologous to G207, G227, G230, G242
ctcagtcagcccgtcacacgaagcaaagcctgctgcgttcacgcccagcactcagacacgtctcgcttatgaccggacgcaagtccgcagagggcggccgttctggccgcccgcgtacccacgcgaagcggtcatccagctttagggaggacgacctcgacgcgcagggcgagaaacgaggaccctggaccccggaggaggacaagcagctgacggacctggtgctcagctgcggtgcccagcgttggagcacaatagccgagtccattccaggccgttccggaaagtcgtgccgcctcaggtggtggaatcacctgagcccgcaagtgaaaaagggtcctttcagcgatttcgaggacgccgtcatcgtgcggtcgcacgagaagtatgggaacaagtggtccgttatcgccaagctgcttccaggccggacagacaacgcagtcaagaaccgctggaactccacgctaaaacggaagc

SEQ ID NO: 15469 - DNA, 503 bp, Chlamydomonas reinhardtii
  Predicted polypeptide sequence is orthologous to G217
ctgcagctgcgccaagcgccgcgcctcctccagctgcttttcacgagccttgcgcttggccttcttaccacgtgtgttggccagacgcgcgcgtgcctcgctgagcatctccttctcgtcctcgtccatgtccaccgcgtcggggcgcgcgggcttggcctcggggttggggtcaatctcacccggccgcagccgccgcgggtcatcacgcggatcgtagttgacgtccttggcgacggcctggtccagcagacgctcgtatcggtccaggcactgcgcgggcgtgcggcccacgatgggcgcgatggtgcgccactggcacggcatcagctttgccagatgcagcagcttctcatcctcctcgcgcgtccactccgtcttcttgatggccgggtccagccactcgtaccagcgtgctttgcactgcttggcagacttccgcaccagcagcgacgaaatacgggcccactggttgagcccatacttcatcactgccgccttga

SEQ ID NO: 15470 - DNA, 485 bp, Chlamydomonas reinhardtii
  Predicted polypeptide sequence is orthologous to G217
gaaaagcgcgagctgaaggcggcgggcattgacgtgcgcgcccggaacaagaactcgcgcgccgtggactacagcagcgaggtcgccttcgagctcaagccgcaggccggcttttactcgactgcggatgaggagaagaccactcgctccatgcagcaagagttccgccctgtgacggtggaagagctggaggggcggcggcggaaggacattgaggaggcgctgatcaagaaggacgtcaagcgacagaagatcaacgagatgcatgacgcgccgaatgccgtggccaagcacatggggctggaccaggaggggccgcgccgccgcggcaagctcatgctgcccgcgccgcaggtgagcgaggcggagctggagcagatcgcccgcctgggcgtggacggagctctggaggccagtgtgtcggagggcgcaggcggcgacgccacgcgcacgctgctgggtcagtacaaccagacgccggcggc

SEQ ID NO: 15471 - DNA, 531 bp, Chlamydomonas reinhardtii
  Predicted polypeptide sequence is orthologous to G291
gcacgaggtacatctgccacatacttaactcccggctctggagcaaactcccgtgcaatctagggtcgcacctcctgttccgggcttgctaggcttttccgcacgatggctggggagtctagcaccgcacgtgtgagatgggagcttgaaaacaacattgctcctgcagcctcggaggacacagatgcactcttcaagtatgacgcggcggagcagcagctagcacagagctgcaagccctgggcgaaggaccctcaccactataagcatgtgcgcatgtcggctctggcgctgctgaagattgcgatgcacgcgcgctcgggaggcaatctggaggtcatgggtattctgcagggcaaggtggtgggtgacacgttcattgtcatcgactcgttcgcgctgccggtggagggcacggagacgcgcgtgaacgcgcaggcggaggcgtatgaatacatggtggacttcctggacacaaacaaggcggtgcaccggccagagaacgcggtgggctggtatcactcccacccc

SEQ ID NO: 15472 - DNA, 736 bp, Chlamydomonas reinhardtii
  Predicted polypeptide sequence is orthologous to G312
ccccgcgggctggaggaatgcgggacgaggctagcatcggggccgcgctgggaggtggcggcagcggtatgcgtcgatcaggcggaacgttcttccgatttcattcgcgtgaggggtcagagcttggcatagcgagataaacgtcttcgtgcgtagtgcgcgtgacaccagagtgcagaattgcatgggcgcggcggcgggattggtgcaggtcggacactcgccacgcgtcggcactggacgcaaaccttcccactgctgcgcaggctgtggccgctgtgttgcctgcctgcacgccccttctgagaggcgccggtgtgatgacggcgattgtccttcccatcctcttcggtgtctgtgcgcgagtcgtagcaataagttggtttgcgggagatatagtatttcagataattacggatgcgggcggtgggggtccgaatgcgacgcctgcgcgcatggggttacgccggaccacacgcgtgggttcaggagtcaggacccttcgtgaaccgtctgcagatcagggcgaggggcgagcggtcggtcccatgtggtgcgaatggggggtacttgaaggacattcgagccatcctcggaagtggcggacggaggtggcgcggggtctgatgtgtggtgggagtcccctacaccagatggggtgctgcgtagttgacggacgcgacagcggaggcttttgaggtcgataatgtacacagtatttcggcattgcggcatc

SEQ ID NO: 15473 - DNA, 793 bp, Chlamydomonas reinhardtii
  Predicted polypeptide sequence is orthologous to G324
tgcatttacgccagactcgacattaactcctcactaaagggaacaaaagctggagctccaccgcggtggcggccgctctagaactagtggatcccccgggctgcaggaattcggcacgaggaccacgtgcgcgcatgcggcatatgctgctggctgccggcgctgtgcctaccagcaggcagtaacccagaggctcgagttgtccgttgattgaatgcgtcgtcttctagctccctttgactgaactcgtcttcaatgctgcgcagcgagtacatgtacttatccgcaacgcgagcaggggggactccctgtactgatgttgagcctgtagaaaaccgcatctacttgtatactgtcctgcgagcagtgagcccgccgccttgctctcctgtcttgcaaactgtagtcacagcctcacaggccagggcacacttcgcatccatcgcgtcacactgtttcgttatggctatcttagctgagggtattattttcaagtgagagggccgagtctgtcttcctaaagtggaggggagggcacatgcagtgcacgggtggaggacagagcgctgatactctgtttgcaagaggcgcgagttgcacgtgagtggaatctgagtgacttacagtgcccatgagtactgtacatcgtgccggtggagctgacggcaaggggttctgaaacactaccgacctgggggggcacatcgctgccctggcgtcttttggccatgggctgatcgacaatcaaaaagccttccgcaaattggcaaatcggaccgggagcggggaacca

SEQ ID NO: 15474 - DNA, 664 bp, Chlamydomonas reinhardtii
  misc_feature (565)..(565): n is a, c, g, or t
  Predicted polypeptide sequence is orthologous to G328, G2436, G2443
gctacctggagaagaagaagaaccggcgcttcggcaagaccattcgctacgcagctcgcaaggcgtatgcggagatccggccgcgcatcaaggggcgcttcgcgcgcaaagacgagattgcggcgtggaaggccgccaacggcggcgacgatgccatcgtgcccgagtgcctcgacattgtgctttgagcgcgagtcagtgcgtgtaagcgcgagtgggcgcggggagcgcaggtgtccagtgagttccagtgccaaggcttgttccagagagggcttgcgggctacggattccgccgccggcgcggcgtacgtgccgcagtttttagttttgacgtcggttccgtctctcgtgcttaaagattgccgtttgcgcagggtgtggacgtgccgtgtggtgtgacgtgaaagtgcaagagagcgtttttgacaacgtgctcgcatgccgtacacatacactggcatataccacatatatcaaggcagtccgggccagcgttttggggttgactggagaccagtcaattcaggctggttacagcggaagcgctgctcttgcgacacanaaaggatagataacgccgattcggcaaatgcactagctagcagcgttgtttggggccttgtgcgctttcgcgccatgcgcttaggtcgccaaggcatgt

SEQ ID NO: 15475 - DNA, 590 bp, Chlamydomonas reinhardtii
  Predicted polypeptide sequence is orthologous to G328, G2436, G2443
taaacgcaatactccccaacaacacaaatataccacacctctatacgcgagaatgtcgagttgcgtcgtgtgcgcggccgcagcggtcgtttggtgccagaatgacaaggcgctgctttgcaaggactgcgatgtgcgcatccacaccagcaacgcggtcgctgcgcgccatacccgcttcgtgccctgccagggctgcaacaaggccggtgctgcgctctactgcaagtgcgacgccgcgcacatgtgcgaggcttgccacagctccaaccccctagctgctacgcacgagaccgagccggtggcgccgctgccgtcagtcgagcagggcgctgcaccggagcctcaggtcctgaacatgccctgcgagtctgtggcgcagtctgcggccagccccgcggcttggtttgtggacgacgagaagatgggcacgaccagcttctttgatgcgcctgcggtgctgtcgccctcgggcagcgaggccgtggtgcccgtcatgtccgcccctatcgaggacgagtttgcattcgcggccgccccggcgacgttcaaggaaatcaaggacaagctcgagttcgaggctctggacc

SEQ ID NO: 15476 - DNA, 709 bp, Chlamydomonas reinhardtii
  misc_feature (238)..(238): n is a, c, g, or t
  Predicted polypeptide sequence is orthologous to G347
gcaatatagccacatcttaaagcacttgttgaatttgaggagcataaaagagcaacttgtcaaaggagctgctcgcaactcgcttgacgggcccggcgcaaaaatgtcggtgtggatgcccccaggcggaggctcaggttccatggccccgccttctcaaagccacctggtatgcggaggatgccgctgcctgctgatgtatccccaaggcgccttcaatgtccgctgctcacgatgnggacacatgagattgggacgaggatgaggtcgatgagtacagagaagaaatagaatattttagaataaaaaaataaagaaaagaaagaaaaaagtagagtgggtgggaagaaaggaataataaagagagttagagtagtgttgatttgagtaaattacaatgttatgcactgtaatgtcggttgtctgatatgataactgttaatatatatataaaaaagtactataactatgaatagaaaataaagtaaagcgtattttacatttctattcgtatggagaaactgaattatagtaataacagtatgatgcactatagtgcaatgtccatataaacaggggtaatattttaaactaaatctggactttgatacgaagtagtagtagagtggactagagataaggaaaagtgtgatggcggccacacttgcatataccgaagacgggagaaaaaagtgagtaagaaaagaag

SEQ ID NO: 15477 - DNA, 525 bp, Chlamydomonas reinhardtii
  Predicted polypeptide sequence is orthologous to G484, G2631
gctatagcttacgataacgccatacgatttacccctagattgctagccacgccctgcttcgtccactttcttttattcaaacagcgtgtccctggttattttaggctccaatagcttatgaaatgtctgacgatagcgacgtttcattgccaaggactaccttacaaaaaatgatcaaggacttacttccaccggacatgcgctgcgctaatgacacggtggagatggtcattgcgtgctgcaccgagttcatccagcttctgtccagcgagtctaatgaggtggcgacgcgggagggccgctccatcatccaccctgaccacgtcatgcgcgcgctcacggagctgggcttccaggagttcgtgggcgaggtgaacgcagcgctgcacaccttcaaggaagagaccaagacggcacactcgcggaaggccgacctgaggaagacgggcgccgagcaggcggggctcacggaggaggagcagattgctctacaacagcagatgttcgcagcggcacgtgcgcagt

SEQ ID NO: 15478 - DNA, 785 bp, Chlamydomonas reinhardtii
  Predicted polypeptide sequence is orthologous to G489, G714
ttttttgatagcaaaacgtcacactggctatagagagcccaaggaacgccatgtgtgtagtgatgctcgcatctagggaaaggccacccacctggtcaccacgcctgcaatcggcctgggcaccgttattacacctcacagccacacactccttgcctctgcaccactgcgccagagaccaccactgcatccagcatcccttggcttcctctctgccaagtactaggtaattaggacaagttacggattgaggtaatcagttcgctctcccgggggcgcatcaggccgttttcatacctgccgctaaacacccgcccgtttggcaccgccggttacagcctaccctcgccggcggactgtctctgacagtctgaccagtcggccgaccggggccattcgaagctcttttgcactacagcaccgcaggccacaccaccggggaaccgagtttaccagtaccgccgttcactttggtaaataacggtagaaggctctccagggttttgtagagtatcactcatgccgctgctgctgcattttaagaccccgcaccctgccgtttagctacatgccacaaagccgcgacctgcttttgcagcccaccctcccaaccagacagcaaagttggtatcacccgagctacccagatcactagtttgagctcgggcgcttggacatgcacgcccaactcccagtcctgccgagggctttgttttcaggccggtttaacccatagcttggttctctcccagatgctttgcgcctaaccccacggaccttggctt

SEQ ID NO: 15479 - DNA, 707 bp, Chlamydomonas reinhardtii
  Predicted polypeptide sequence is orthologous to G504, G1425
cacgctgggcccacagaaggtatagatgaggttgttgatcaggcggcggtccttgtcgtccgtcacgcggccgccgtagttgatttccgtgaacaagaagcgcagcaccttgaacggaatcacctcgtacttgtccaaatactcttgcagctgcgccagcgacacgttgaggtcgccgtccgtaaagtcgtagcggatgttccagcccagcggcctcgaacttgcgcctgtcctggatgacggcgtggaacaggcacagcccgaacaccagccgccgccagtcctccggcttggaggaggcggccaggtaggcgtccgtgaggcggttgtactggcggaccaggttggacttgaggcccttgggcggctccagcgtcatcttgacgccgttctgcaggatggccaccgggaagtcggggctgggcatggacgtgagccacagccggaagtccttgtgcacgcggtcgggctggatgccctccacgatgcgctcaagcgttggcatccagctgaccgccaggtggcagttctgcaggcacacccagatgccgcgctccatgcccgcctccagcagcttctcggccttggggccctggccctggcccagcgacaccttctcaaacttgcggctgaatttcatgtcctccgcaagcttcagcaggtctgtgtgacgcagcaagggacggcagttggtttgttgggcaggc

SEQ ID NO: 15480 - DNA, 1286 bp, Chlamydomonas reinhardtii
  Predicted polypeptide sequence is orthologous to G536
gcaccaggtgctctaggcgcacatacgcaaacataggaacaatggcggaggctaactcgcgcgagctcgcgctttacagcgccaagattgctgagcagtctgagcgttaccaggacatggttgaggagatgaagaaggttgctgtgctggctaatgagcaggagctgtcggtggaggagcgcaacctgctctcggtctcctacaagaaccttgtgggctcccgccgcgctagctggcgcattctgcagagcattgagcagtcggagcaagctaagggcaacgagaagcgcgtgggcatgatcaagaggtaccgcgcggtggtggagggcgagctcgacaaaatctgccatgagatcctggacctgctcgacaagtacctggtgcccagcgcctctaccaccgaggccgctgtcttctacctgaagatgaaggccgattaccaccgctacctgtctgagtacaagacggacgaggccaaagcggcggccgcggagttgacgctggccgcctacaaggtcgcccaggagaaggccgacgagctgcccacgaccaaccccatcaggctgggtctggcgctcaacttctcggtcttctactacgaggtgatgaaccagcccgcgctggcctgctcgctggcgaagaaggccttcgatgaggctatctctgacctggactcgctcggcgaggattcctacaaggacagcgcgctcattatgcagctgctgcgggacaacctcaccctgtggacgtcagaaatgcaggacgacgacaagaatcgggcatgagcgtagcgcagcgcagccttgggtgtcggagccccggtttccagcggctcatggggggtcctcggcgagcaggcgctggactgtttgcatcttgcgcaactctgagccgcccgcctgttggggcacgctattccataattgtggagtcacggcacggttattaggtacgctgatgacggcgtgagacccagaggagggtttcgaggagcgtggcgtgtgttttccgatggggtgccggccgtgtttgaccggacagtacggtgatgcacggtgccggcttgtgtttgtattgagttttgtttcagcactggtgtcagcattctcggtcacggggccgcatgcggcttcacgatgcggccaaacataggtagaagtgtggtccccgagtgggcgcgcttgagaagcgccaagcagactcactgcggacgagcgtccatgatggccatggcgctcacacattatgtaaagactagcgcgcgaaaaaaaaaaaaaaaaaaaaaa

SEQ ID NO: 15481 - DNA, 283 bp, Chlamydomonas reinhardtii
  misc_feature (177)..(177): n is a, c, g, or t
  misc_feature (232)..(232): n is a, c, g, or t
  misc_feature (242)..(242): n is a, c, g, or t
  misc_feature (271)..(271): n is a, c, g, or t
  Predicted polypeptide sequence is orthologous to G536
cgcacatacgcaaacataggaacaatggcggaggctaactcgcgcgagctcgcgctttacagcgccaagattgctgagcagtctgagcgttaccaggacatggttgaggagatgaagaaggttgctgtgctggctaatgagcaggagctgtcggtggaggagcgcaacctgctctcnggtctcctacaagaaccttggtgggcttcccgccgctgctagctttggcgcattntctgcagagncatctgcagcactctgcgagcacagctcnaagggcaacgag

SEQ ID NO: 15482 - DNA, 282 bp, Chlamydomonas reinhardtii
  Predicted polypeptide sequence is orthologous to G536
gcacgaggctctaggcgcacatactcacacataggaacaatgggggaggctaactcgcgcgagctcgcgctttacagtgctaagactgctgaccagcctgagcgttaccaggacatggctgaggagatgaagaatgatgttgtgctggctaatgagcaggagctgccgttggaggagcgcaacctgctctcgatctcctacaagaaccttgagggctcccgacgcgctagctggcgcattctgcaaagcattgatcactaggagcaagctaagggcaacgag

SEQ ID NO: 15483 - DNA, 1464 bp, Chlamydomonas reinhardtii
  Predicted polypeptide sequence is orthologous to G536
agacaccgtgcttcacacagtctcacacacaccttgcatttagcccgctacagagagcactagctgagatggcggtcgaccgggaggaatgcgtctacatggccaagctggccgagcaggctgagcgctatgacgagatggtggaggagatgaagaaggtggccaagctggtgcacgaccaggagctgtccgtggaggagcgcaacctgctttcggtggcttacaagaacgtcattggcgctcgccgcgcgtcctggcgcattatctcctccatagagcagaaggaggaggctaagggcaacgaggagcatgtccagcgcattcgcaagtaccgcactgtggtcgaggaggagctcagcaaaatctgcgccagcattctgcagctgttggacgaccacctgatccccactgcctccactggcgagagcaaggtgttctacctgaagatgaagggcgactaccaccgctacctggctgagtttaagaccggcgctgaccgcaaggaggctgccgagcacaccctgctcgcgtacaaggccgcgcaggacattgccctggtggacctcccgcctacgcaccccattcgcctgggcctggccctcaacttctccgtcttctactacgagattctgaactcgcccgagcgcgcgtgccacctggccaagcaggcgttcgacgaggccattgccgagcttgactcgctgggcgaggagtcctacaaggactcgacgctcatcatgcagctgctgcgcgacaacctcacactgtggacctccgacatgcaggaccccgctgccggtgacgacagagagggcgctgacatgaaggttgaggacgctgagccctgaaaggagcttctgcagcagccggggccgggtcagtagcctgaagctcgttctacacgtaatacggggaatcgtttttagggtttgggagtgggcctgttctgaagtgcacgcttcaaacatggctgcacgtgtggtccacgcacggtgttcgtcacatgcattgttgtcgtggctacccggggtcgataaattctttgcctcaggtgactggtcccacacataggcggggagatccggtggggagttgcgcttgtcgaggtcggcgtgaagtggcgttacagctatctcgtcggagaaccctaactacgagagtggcgggtccgaagacgtgtcatgcaaaacacgttgtgtgggtgcgtacagagggcctcttgacattgtgttggccatcacggcccaatgcgcacgttgacgagtccgggtacattccgtaaattcaatcgcaatgcgtaggttcttagacattagaccgccatgagtggtggggccgactgcatacgttggaccagaccgtggcgctggcgctgtgagatggaacatatgtgaagtgcgtgaggcgtgttgaagcgcactaatgcttgcaaaatggcttccatggaaaaaaaaaaaaaaaaaa

SEQ ID NO: 15484 - DNA, 515 bp, Chlamydomonas reinhardtii
  Predicted polypeptide sequence is orthologous to G600
ttagtctaaaacagatcaacaatttcaccgagtccaatactcatggacacacggtagctgcagcctctttctccgcaaactcaacgcttctagcttccagcttacaatctctggccctgaggggcccagtcaacgggcttgcttgtgccgatcgggcgaggtcggcacccgaggctagcgccccctctggggctgttcctgcctacctagggacgaggcctacggcaggaggcctagggcgccatggccagctctatccgcttcaagttccgggctgagctgtcttacagcaacctgcccttcgatggccactacatcacggtcggcgagctcaagcggctcatcgccgagaggaagggccttggcgttgacgcagccaacgagctgcagctcacggacgcaaccagcaaacgggactatgacaacgacgcagagcaggtcatgaagaactcggcggtaatcgtgcggcgcgtcgccggcgcagacaagccgacaaccttattgagcagctcagc

SEQ ID NO: 15485 - DNA, 443 bp, Chlamydomonas reinhardtii
  Predicted polypeptide sequence is orthologous to G652, G1335
catctacctgggcatcgcgtgccctgcgtgctgccacaaagctggccccccagaccgccgactgagcgaggagggtcgcgggaatgggcgagcagctgaggcaacagggaaccgtaaagtggttcaacgccaccaaaggcttcggcttcatcacgcctggtggtggcggcgaggacctctttgtgcaccagaccaacatcaactcggagggcttccgcagcctgcgggagggtgaagtcgtcgagttcgaggttgaggctgggccggatggacgctctaaggctgtgaacgtgacgggccccggaggggccgcgcccgagggcgctccgcggaacttccgcggtggcggccgcggccgcggccgcgctcgcggcgcccgcggcggctatgctgctgcgtacggctacccgcagatggcgccggtctaccccggctactacttc

SEQ ID NO: 15486 - DNA, 667 bp, Chlamydomonas reinhardtii
  Predicted polypeptide sequence is orthologous to G729
cctgtgggtgctccgtccctgtcttattaaaggcaactcctcaaacctcctgtctcgtccgctgcccgttcattaagcattgacttgacaaacactacacgcacacatacacacacattcatctgtccaagcagacttgtgacgggcactagcgttgaccgcgccacgtaccagtccggattgcggcacgtgggtgtgagacacgcggccgtgcactgttcgtgcggtctcctgtgaaccatccgccgtcagctaatatagctgccgactgccctatcgagtgatcacacggcctcgcgcttaaggcataatacgcacacgcgtttccaactgcctcgcgggccacaccatcatcaaacacgtcagtattgcgtcggagggggcgccacagcaagctccccaaacaatcacaggtcacactgcggtttgtgtcttttcctaggtttcatgggcgacatacatactcacaaaatcactggtcattgaaggaacacgtccaaccccgtttgctgtcgattgcgtacgctcaggtattcatcgagcctatttcaccctgaccgccgaggtgaacgcatcgtcactcaaaccgtccccccaaggcctttcatcacacgcatgcaagttggttaaaacctccagtcgcaaagtttgtaggcaaccctcgtgc

SEQ ID NO: 15487 - DNA, 810 bp, Chlamydomonas reinhardtii
  misc_feature (16)..(16): n is a, c, g, or t
  Predicted polypeptide sequence is orthologous to G831
tgcatttacgccaagncatcgaaattaatccctcactaaagggaacaaaagctggagctccaccgcggtggcggccgctctagaactagtggatcccccgggctgcaggaattcggcacgaggagcctctagggctcaacccctagcccgcgagcctttgctcgcgtgggggcgcacaacatcttagttgtcgaccttggctttcgtttccaaatttttgtcgcctgttccgggcgcttttatcagattggttcagacagggttggggttcagacaggcgctcagcgccgagctttgggttcgaagttccatggcggcccgcgggcggctggtcgcatgagttcttcggtgttgtgttgtcagtggtttccgtgtttgcaggtagtgggtagccctcgtggtcgcccttggcccggcgcaacggctggcgcatcggtgcctcgcctgtgtgctcctcggcgcctttcctcgtggcgcccagtcagccgtcgtctctgtctgcggtcttcctggctctgcagattttagccctgggggttttagctcgcagcatacggttcacggacccgtatgcgcctggtgaccgcagtcgggtagtcccgggtttggagtgggtttgctggttccatggtgcccggccgtattgtgagcattttttcgcctacgagggtctgtatgggcattgcgtgggcggtcgtcaggggtcgcctgcttcgggctcttgcggtcctgttgtcatcttctcgtatgggtctttgtcagcctcgtacctgagaggtcccttcctgagtgcgaacataatataattca

SEQ ID NO: 15488 - DNA, 693 bp, Chlamydomonas reinhardtii
  Predicted polypeptide sequence is orthologous to G896
gcacgaggcttcattagcaccaaggccaacatcttccggggcatccagtggctgatgacggaccagcagcccggtgactcgctgttcttccacttctcgggccacggctcgcagcagtacgaccgcaacggcgacgaggaggacggctacgacgagaccatctgccccaccgacttccggcgcgcgggccagattgtggatgacgagctgaaccgcatgatggtccagccgctcatgcccaacgtgacgcttcacgcggtaattgacgcgtgccactccggcacggcgctggaccttccctaccgcgcaaaggtcgaccacagcggccgctggtactggaagggccgggcgcgctacgacaagtgcacgcgcggaggcacggcgtttcagtttggcgcttgcaaggacagccaagtggcggcggacaccaataagctgtccggcaaggcgtacacgggcgccgccaccttcagcttcatcgaggccattgagaagtatggcgtgcagcagacatacggcgtgctactggggcacatgatgcagacgctgcgcgccatgaacggcggcatggtgtccagcggcgccaccggcattctggccagcctgttgctgggcagcagcatcagcagcggccaggagccggtgctcagctgcgacaagcaggtcgacctctatgccagccgccttacatct

SEQ ID NO: 15489 - DNA, 810 bp, Chlamydomonas reinhardtii
  misc_feature (643)..(643): n is a, c, g, or t
  Predicted polypeptide sequence is orthologous to G1033
ttttttgggaagcgcatagcgttacaggccgtcccaagcgtcctggacttgggctttagcaattatgtacacggttggtgtccggcacgcgcacgcagcaatggctgcgttggtactattccgcactcagtcaacagtcaatatgattgtccgtgtaggagtccacacccgagcaaaaaacggtcaggagcatcacaaacaccgttctgtaacacaagtcacgtccacacagcagtatggtgcagtgtggagtacatgcgcagtgacagcggctgtcacgcagcgtccaaagcagtcgtagcgttagaagcgaagaattcagttagcggtacatacgggtacaagtagagcccacaaaatgccacctacggatagctagcctccgtacagactagcgacccttgccatgcccacgcaagattccgctgcttgtggtcgcagtttactcatcgtcatcaccatcatcgtcctcgtcgtcgtcatcaccatcgtcatcggcctcaggctcgtcctcctcctcctcctccttagccttcttcttgggcgcagccttctccttcttggccgcgggcttcttggaggcacccgacgagccgccgtaagactccatctccttctggtagcgctccttgtccttagccgncttctcatcgaactccttcttgtcgtcagcggacaggccctaccacttctcgccgatcaccttgccgaccttcgccgaggcaatgccagggtttttcggacttcacgctctcacggatggcggtcgaagagtacatgaaggaagttgagggcttctttggggcgttg

SEQ ID NO: 15490 - DNA, 611 bp, Chlamydomonas reinhardtii
  Predicted polypeptide sequence is orthologous to G1038
tattgttggtggacgacgatcccaatctactccttttggtcaaggattatttggaatatcagggttaccaagtcaccaccgctgggaacggtcgtgaagctctggacctgctgacaactacagtgcccgatatgattgtttgtgacatcatgatgccggagatggatggctacgccttcatcgagcaggtgcgccaaaacccggatattagttggattccggtgatgtttctttctgccaaaggccaaagccacaatcgggtgaaaggactcaacgtgggagcggatatttatatggctaaaccctttgagccggaggaactggccgcccaagtgcaatcttgtctccgtcaagctgatcgcctattgcaacacaataatcatcccctggaagacaatgctcgggtgcaggtggccagggacgtggaactcacccccaccgaaaccaaggtgattcaattggtagcccagggattggccaaccgggaaattgccgaccacttaaaagtcagtcagcgcactgtcgaaagtcatgtatcgaatatgttaaacaagacaggattacacaaccgcaccgagtaatcactagtgcggccgcctgcaggtcgacca

SEQ ID NO: 15491 - DNA, 698 bp, Chlamydomonas reinhardtii
  Predicted polypeptide sequence is orthologous to G1064
ttttttgaacgccaacttccatggtctaagtggacggggggctgctttgcagcttcctccgtagtccgttccaaccataccatccctggtcaccgttcatacatttggtcgccggcatgcgcgcgggcaggctgcctgccttttgcacactcacagccattcaaaaccgttctttccaaccccggtgacggcaaagcacagccggcagcagcagccgacctttccctcgtcaccggtctatgcccccgctctacttcacggggtccagcttcacctttctccaccggaaagagtggcacgtcccgaactcccgcgaaggtcatactgcgccgcaaaaaggcactcaacaaaatggtgcaagcgcaagcggcagccatatcatatcgcattcggggggatgcacgggcccagacggtagccacgagcgtgttgatcgcgcccacgtgttgttcgctactgctcttttacgcgcgcgatgccttttgctgatgcctggttggttgccagcaccaggatgtccgcgatctgcacgtgctccggacgcgtgcaggcgtacagcacgttgtctgcgatgtcctcggctgtgagtgggtcgaagccgcggtacaccgcgtccgccttctcctggtcgcccttgaagcggaccaggctgaactcggtctgcgcggcgcccgggctgatgctggtgacgcggatgg

SEQ ID NO: 15492 - DNA, 373 bp, Chlamydomonas reinhardtii
  Predicted polypeptide sequence is orthologous to G1078
gcacgagggttttatgacaccaagggcaagggcaagggtaccttgcattgagacgagttgtgaagacagatcagatgaggcgcctgcgtgcgtgtagtatcatatgcctggttgcgaactgaggatgtgctagattgtacttagtgctaggctaaagggtggatcgggctttcgttgatggttcggggatgttgagtgccacgaaacggacgcagactggataacatcgactaacacttttgagcccttggcacatcacatgagagcttaggacggcccgggaggtgcggcggatacggctggtgcctgcttggctggtgcctgctcttgcggcgttgcgggtggggagtggatgtgaaaccgcgtgtgtcct

SEQ ID NO: 15493 - DNA, 430 bp, Chlamydomonas reinhardtii
  Predicted polypeptide sequence is orthologous to G1242
agggccgcctcacggagaactcggccaccaaggtgaacaaggacgacctgatcaacatggtgcgctacggcgccgagctggtgttcagctccgactcatccaacatcacggacgccgacattgacgccatcatcaagaagggagagcgcgacacggccgacctgaaccagaagatgcagcagttcacggacaacgccatgaagttcaccatggacggaggcatggtgtacgacttcaaggacgctgacgacgagcgggccgacattggcgacctcaaggccatcatgggctccaactggattgacccgcccaagcgcgagcgcaagcggcaccagctcaactacaacgacgccgactactacaagaacgcgctcaagaccggcgccaaggacccgcgcgcgcagcggctgcccaagatgccgcagctgca

SEQ ID NO: 15494 - DNA, 451 bp, Chlamydomonas reinhardtii
  Predicted polypeptide sequence is orthologous to G1242
gcacgaggagatccagcgccagcaggacatcatgaacgccatcgccgccaagctggagcggtacaagaacccctggcaggagctcaagatccagtacggcgccaacaagggcaaggcctacacggaggaggaggaccgcttcatcctgtgcatggtgcacaagctgggctacggcaactgggacgacctcaaggccgagattcgcaagagctggcgcttccgctttgactggttcttcaagagccgcacgccacaggagctgggccgccgctgcgagacgctgatccgcctgatcgagaaggagaacgaggacaatgccgacgcgccgccgcgcaccggcggtggccgcggaggcggtcgcggagggcggggcggcggccgtggaggcggcgacggccccgggcgcaagcgcaagggccaggtggggacgccagcggccggcactccagcg

SEQ ID NO: 15495 - DNA, 690 bp, Chlamydomonas reinhardtii
  misc_feature (628)..(628): n is a, c, g, or t
  Predicted polypeptide sequence is orthologous to G1255
ttttttagaggcgtcaccttacacatatacagggcttatcactatgctgtagcaagagctatatgcgcacgctgtgcgcataagtactccggcgtatggccgtgtcactgcatggggtttgccctgttggctgaccggataccccgaacatcaacactcccacgcgggcagacaactagcaaacacatccccactcgagtaagctatcgtcctactcaccactcttcgcacacgagtaactaaccatgttccactacagcccattgactcatcaagcaatagcaaaatacgtttcgctacgcacaggcactagtccacgaagttacctatcaaagcaacatgacctatactgcacacgcatactgttcgcactgccaagataaccgcaagtcaaagaccggttcctcaaacgcacacaactgccaaatacgcatttgttctattgcacgcatcgtctttgttccatcgcagtcatgaacgcatgtcacgttgtcgtcattgctcttgcgctgtccatctagcgcacacccatgccaatccggcaccgcacaaaccgatcctctggcaccgttttggttagcgcatcaaccaccatgcggcttgtgggacagtattggaactgcacctngccgcgctccacacgctgccgtacaaaatggtgctgcacatcaatgtgcttcgtgcgtatcg

SEQ ID NO: 15496 - DNA, 773 bp, Chlamydomonas reinhardtii
  misc_feature (773)..(773): n is a, c, g, or t
  Predicted polypeptide sequence is orthologous to G1335
ccggcgttccagcagcatgcattgaaatcctgtcgggctttccgcccaagcaaattcaggtacccagcgagggagctgtgtcggcgctgggacttgcaaacggcgacacgctaacagtgcgccaaggcgcggcgccggcgcttcccccggccgccgcgctgccgccagtggccccccagtcagagccatcctcctcgggcgcgggcgcagccacgcactcagcagcagcgggggcaggggcgggggcgctcgggggctttgcggacatggaggatgaggacgagatgctggcacgtgccattgcagcctccctggagtcccagcagtcgggggcgggggcgggggcgtcaggcgcgggggtgtcaggagcggggccagctgccacgccacggccagcaggggcggcgccaggagcggcactggctgcgccctcgagcggagcgccgcggtccgtgaccaacgcgccggctggaggccccgcccccagctccgtgcctgtgccgggcggagacgggtcgagtgtggtgcggttgcttggaggacaagtgacaacagatgtttggttaacgcggtggggcactctatgatggatagtatcatctgcttgtagcatatgatgctgtatgtagttgaaaataagcttccagagccgtctattttaagagtacattgcgagcttgcccatcctcgctcactttatgtaagtaatttttcaaagcgggtggcgccgtaattattcttttttctcaatgtaacgtacccaaggagctcgn

SEQ ID NO: 15497 - DNA, 785 bp, Chlamydomonas reinhardtii
  misc_feature (785)..(785): n is a, c, g, or t
  Predicted polypeptide sequence is orthologous to G1389
gtgcatgtgcgttggcgtttgcatgctgttcgtttggttgccaccagctgttttgccgtggttaaggaggtacggagagatttaccgtcggtcggatatatagctgcaggcctttgggcgggcacgctcgcaaccgagtaccgacccaaatggcgctctctacgatgctctccgaatcgcattgacttgtattggggatgacaaaagcacgctgccgaaaagtgtgtgttgccgaggcgcgtacatgagcaactggggaggaggacgaacatggggctgttgcgctgaacgtgtgctcgcagcgcgtgttgatgtgaaagagcgtgtgtatgtgcgcaccaggcacagatgtagacatcatcggtgagcttgggtatgaggcgtgatggtcataagattgttttgtaccgcgcgtgtgcgtgacttgtttttggtgtgagccgtagctctcgtgcaggtggagtggttagcttgaatttatcgtccatatgacttgacatgctgtcggtgcacggattgcagttgatatatttctgtccaggcattttgcagcactacacctgctattgtgtcaggatcatttctttcttttgtgctatgagcgtatctctgctaacttggcaaatgtttagctctatttacggtacacctgatgagtgtattctctgggtaattttcttattctctctcttgtggtgcctttgccactcccagcatctgcgtaattttctgctacgttatattcgtgcgtaggtttttacttcctgttatatatgtcttcttan

SEQ ID NO: 15498 - DNA, 663 bp, Chlamydomonas reinhardtii
  misc_feature (640)..(640): n is a, c, g, or t
  Predicted polypeptide sequence is orthologous to G1488
gcacgaggccggtgcagggcgtggggccggtaccgcctggcatgatccctggcctggtgcccggcactttcatggctcctggcatggccttccccgaggccaagcgccctgtgccgtcggtgccgaagccgcgcaagcgcgcctcgcccaatggcaacccgccgaaggcgcctgcacccaacccgaacggccactgctgcacccagtgcggcacgcagaccacgcccgtttggcgcgcgggcccgcacggccccaagacgctctgcaacgcctgcggtgtccggtatatgaaggttgccaagtcgggcgccacgcagccggctccgaggcggcagcagcagcagcatcaccagtagcacgctgtggcgggctacatggccggcagcgatagtacggagcgtgcggcgtcctgcgggcagcggcacggcttcccaaatgcacagcggttgtcctccgcgacatgcccctgaatgggtgctggtcaaggcagagcaactgagcgcgcgttgtaggttacgggatgtgcatgtggactaaactggtgaggcctgaatggtgggttgtgccaaaggccgtgcaggagtgcttgacgcgcgctcccacgttgatggtcgtgcaccgacaatacggtggggccggngcacatgtgttgttggttgccgc

SEQ ID NO: 15499 - DNA, 606 bp, Chlamydomonas reinhardtii
  Predicted polypeptide sequence is orthologous to G1493
tcactataggtgcgaattgggtaccgggccccccctcaagaatcggccccaggcgccgataagattgccaaggaagcccgaaaccccccaattcagttagtttgcggagattgtgtccatggacaagagccagtaccgattcctcgtcgtcgacgatttcccgacgatgcgccggatcgtgcgtaacctgctcaaggaactcggttttgccaacgtcgacgaggccgaagacggcgccgccggcctggccaaggtcaaggaaggccggttcgatttcgtgatctcggactggaacatgcccaacatggatggcctgcagatgctgcagagcatccgggccgacgccaacaccgccatcagcaagctgccggtgctgatggtgacggccgaggccaagaaggaaaacatcatcgccgccgcccaggcaggagccaacggctacgtggtcaagccctttacggctgccacgctggacgaaaagctgggcaagattttcgagaagctcgaaaagggggcgtgatgagcgagatgcatgatggcgcccaggcgctggccgcagaaggtgtggaccacggcgacatgcccgaaatgctccagcgcatcggc

SEQ ID NO: 15500 - DNA, 415 bp, Chlamydomonas reinhardtii
  Predicted polypeptide sequence is orthologous to G1506
aaatacatacacatactcgcacggaaccggcagtgaaacctatcctgcgacagattttgagaccgcgccatatcaatcgagcttccgcttgcctgcgcttccgacttgcagtcgaccggtctgcaccacgaaatcgtgtagtgttgctgccatagcctgacacaatgcgaggctccactggcggcccctgctgccactgcggcaccgtcgcgactccctgctggcgaaaggggccctgcgacaagccggtgctctgcaatgcgtgcggcagccggtacctggtcaagggctcactcgctgggtacttccctggcgcgcgccgggcgagtgcgggcacccgtagcgaggcgcctcacattcaggcgaccgtcgtttccgcggacggcaagtctgctgcgcggaaatccgccgcgct

SEQ ID NO: 15501 - DNA, 776 bp, Chlamydomonas reinhardtii
  Predicted polypeptide sequence is orthologous to G1521
ttttttgagtcgggtccaacttcaaagccataggacggccagggttgtgactgcggtacgcacgcctgctacgagcagggcgtgcaaaagacggcaatattgtaacgactggatgagcgctatactgccctcgaaaccgccaccctacggccttagcctcgttctttcatttgacgtgcacgtcatgagcaatcgctaacgctagtcacagcccgcagtcctgatcacctccaccaattaactgggcagatcagcgcaagccagctttggtgctgaagggcgaccataagttattagtacccttggtgccacatcaataccgtacatcccggaatcctttgcactcgtggtcagtgcaaggcctctgtatcccccatctatgcaccttacagcacacaatggtgcttccctgagcgccatgtccgaacacattatgcgcagtaacctcaacccttatgcttggagccctacccgtgggacacaaactgttgacaagtatatgtccctccagcaacatgacaagatgctgccgccgacgtcctgatcctaaacatcctacgggctccaccaacatagggcttatattttgccgtcagctgttgagtcttgaccatgtagcacccacacgtttgtggtaggcctcatgaatacgccaactaacgttttcttccaatcgttaggtattgattgtgacattcgcaacgacctttctctttcgatgtggcggtttgattagtcttattttctacttacttacgtttgttttagattctcta

SEQ ID NO: 15502 - DNA, 740 bp, Chlamydomonas reinhardtii
  Predicted polypeptide sequence is orthologous to G1753
ttttttctcgaaaaaggttacatgttatttcagcctcggttggcgagcgctgtttggcacgcacacatgtgcattaccgtacacagccgttgcgggcccctggcgctcaattgcatcccccctgccgaacgtaaatgaattccttttggccacactagcgcatcatcaaacactgcgacacaagatcctgcagtcagggccagcagcagcgccaccactactcctttgcttgcatgggcgctgcgtgagcggcgcccaagcatttgaaaaccttgccagggagcgtgcatgagcgccatgtcgctccaacaggctcctccttggctctttagcacaaggggctggacaggagcttgaactggtagcgccagcgcgtagcctcaaaaacaatgttggtccggacggtgccgcgggcgccctcaaagatgccagtgccgcccacgatggggttgaaaaactcgttgtcctgcttgtccgggaactgacccatccaggagatggccgccgtggtcgccgaaggtcagggtggtgggtgcagtagttcagcatccagccgtcgtcgccgctcacgctgttaacgaagcacgcagacacaacgtcgccggccttccgacccgagtcgccgctgccgccccacacggcctcgtccaggaatcccagagagtagccaatgaacttcgtctgggttggtctcgggcatcagaaatcaggcaccgacagcgtgtccttgtttgtaagct

SEQ ID NO: 15503 - DNA, 716 bp, Chlamydomonas reinhardtii
  Predicted polypeptide sequence is orthologous to G1932
ttttttcgcgggttcccattacatggggtattcccagccggcatcaccgcctgtgtcattgggtcgagtcatcccgtcctcagccgcctagcgcaacctcctttccgccgccgtccttggataccggaaagcgggagcgccttctaatgtcattaccgagttaaggtcaaggtccaagggcctgacccctcgtgctatattgtaggggggataaacgggccgcgctcctgagttcggtacctgcgcggggccagctaagctaacccagcagccagcgcgtaaacgcctaccagcggcgacagacataaacacgcaagctttactccgagcggccagcgtatgccgtcacttcccatcgccacctgctcctgtgcgcagtaccgaaactccagtgtgcaatcaatggacagccatgcgccggccccctttcccccgtctagtattggccatgaatcacatctaaacacgatgatatcgggcgggagcggccaatcaatacgcgccccgctactttttcacccagtcctttcgcacttcgcacgcatcgtatcacgtcatgtctgttggcctgttctctacctaccccgtgcaacccctgtccatagttgggtgcctcccctcctatgcaccaggaccttgtttaaccaacaccacgcaccaacctacccacgttcccaacggtggcagacacgcgtgcctcgcagccgattgagtct

SEQ ID NO: 15504 - DNA, 738 bp, Chlamydomonas reinhardtii
  Predicted polypeptide sequence is orthologous to G1948
gcacgaggccaagatcaacgtgaacctcacggacaagctggtcgatctcgtcaagaagaagaccatggagccgttcgtggaggagcttcagcgcgaggacatggacgtgaaccagccggactccaagggccgcctgcctcttatcgaggcggtgcgcacgaaggaggttaagctggtagatgcactgctgcagtacggagcgctggcgaagtcaaaggaccccgcaaccggcgcctcgccgctgcacgtggccttccagcataacctgccccagattgcccggctgctgcttcagtacggcgcggacatcaatgtggaggacaaggccggcaagaaggcgcgggagttcgcgccctccaaggagatccgcgacctcatcaccgcctacgacgccgacggcgccctggcctttgaggacgcgcccggcacctggaccaagcttaaaaaggacaccaaggaggactactgtttcaacaccaagaccggcgatagccgatggaatctgctccctactgcgcctgttatccggcggacctgcatgacccccccgtaagatatagaacgacgtttaccggtatcagattactccttttcatgtatttttcttgtctttatttcacgccgtagcttctactccttattcataggccacttcaagaaaaacaggagagatgaagtagcaattaattgtaagtattttttttttattattaactttttagacaatataagtcaatc

SEQ ID NO: 15505 - DNA, 638 bp, Chlamydomonas reinhardtii
  Predicted polypeptide sequence is orthologous to G1950
cggaggtggtcaaggcactacttgcggctggtgccagcacagatgtcgctgacatgtactacgaattgacgccactgcacaaggccgctggcaacggccacacggaggtggtcaaggcgctacttgcggctggtgccggcactgacatagccgacaagaacggactgacaccgctgcacaaggccgcttccaatggccacatggaggtgattaaggcgctacttgcggccggtgccagtaaggacatcgctgacaagaatggactgacgccactgggcatggccgcttccaatggccgcgcggaggtggtaaaggcgctagttgcagctggtgcccgcgcggacaccgctgacaagaacggattgacgccgctgcacaaggccgctgacaacgggcatacggaggtggtcaagatgctgctggcggcaggtgccagcaaggacattgccgagaagcagaacggagaaacgccactgcacaaggccgctgacagaggctacattgaggtagtcgaggtgctgctggcggctggtgcggacaaggacatcgctgacaagaacggattgacgccgcttggcatggccgcttacagcagaggcggcatgggtgtattgaaggtgctacttgcggcaggtgcc

SEQ ID NO: 15506 - DNA, 588 bp, Chlamydomonas reinhardtii
  Predicted polypeptide sequence is orthologous to G1950
gggatttcatataactacaagccgtgctgaggagcctatctaagtcctgggcccgctgggcctcgctcacactatgggctcggcgtggtctgcgcctgcatttagggccgtgcgaaacggagatatcgccgagattgaaagacagatacgagcatacaatggtagggacaactggcgcgacctgcgcgacggcaaggaccgcaattcgctgctgcacatcgctgccctccacggcaaaccccaagtcgtgaagctcctgaccaagcagcacagttttccaacagagatgattaacggcaggaacaacactgcgttgctggagcttgcacgtgtgtccggcgtggactctcaggcctgcttcgcggaggtcgtgcatacgctgctcacgagcggcgcggacgtcaacgccattggcgagaacggctggtccgtgctgcactgcctcgccatcaaccccaacccccgcctgcgcgtgccgcggcagcgtgacgtggcgcgccacctcatccagcacggcgccaggcctgacgtcaaggacagctctggccgcctcgccctccaccatgccgtcgacacaggccacctgca

SEQ ID NO: 15507 - DNA, 642 bp, Chlamydomonas reinhardtii
  Predicted polypeptide sequence is orthologous to G1950
tacgcgcttaggcattctagaggcttgtctcgaagcactcgttttgcacgcttccgcctcactcgccttatacaaagccatcaactacatttcttgtatcagctaccatcgttcactttgcataatctagcctagcccagggcgccatggatggggaacagcaacttgaggagcaagcggaagcgcagcccgttgcccattctccagaggaggaggaagaggagcccatcgacatctttcaagctattaaagagggagactatgaggcggtgcagattgctctggaccggggggccgacatcgagcaaacctcgtcagggggagtgacgcctctgatccaagctgtacaatgtggggccgagcaagccgtggaaatcttggtacagtccggcgccgacgtgcacgccgccacccgctccggcgacaccgcgctgcactgggctgcctacggcggcggcggggcgcttgtgcagctgctgctggaggcgggcgccaacgtggacgccgtgggcgacctgggcaacaggccgctgcacgtggcggcaagcagggggcacgaccaggtggtgggtctgctgctgacgcacaacgcacacacggcgttcaagaacgcgtacggcaacaccgcgctgtcgctggcca

SEQ ID NO: 15508 - DNA, 591 bp, Chlamydomonas reinhardtii
  Predicted polypeptide sequence is orthologous to G1950
cggatgtataaaacacttcatcgaggttgctagtgctgagaccagagccagttccaggcgtagctattcttgccagactgcctgcaagactaatcacaattactcgttcctgatcatgtctaacccgctggcactacttggcttggctcgcgacaacaagtcggatgacatccggcgcgcggtgaaggacgaggggctgaagccgaatgctgcaaatgagttcggtcagacggcgctacatgtggcttccctgtggggcaacgtggaggccatccgtacgctgctggactgcggcgccgacgtaaacatcactaacagccggggctccacgccactgcatttcgcagccagcgccaagaagagcgcgctggcggcgtgccaggccctgctggacgcgggggcggacacggagaatgttgacttgatgggccgccagccctacgagatggcggaggacgaggcggtgcggcagctgctgggcgggccggacgcgcgcatctttgagttcgccagcaagggcgacgcggccgggctccggaagctgctggaggaggctgccaaggaggacgccgacacgccggtgagcctgcg

SEQ ID NO: 15509 - DNA, 577 bp, Chlamydomonas reinhardtii
  Predicted polypeptide sequence is orthologous to G1950
tcggcacgagggacaacactcgcctgtttccgcccgttctgaagatcaattctaggtttcccaccttgaacatattacgcggctggccaagcccaccgctgccgaattgcactgttagggagctctgtccagacaaaacatcagtaaaccctgcggaagacggccggctttcccgcgcgttggagcggctttcggcccacgctggcaggtagcctctcgagaggcgggtaggcgcaggtggtcaaacgcctgcccatggagaaggccgctgagaaggcacgtgagggcgacctcgcctactttgaggcgctgagccctgaggagctcacgcggttatgtaaacgaaaggacgaggacgagcgctcgctgctccacaacgccgtcacgtccggcaacctggagctgtgccagctgctggtgggccgcggcggcagcgcggaggcggtgaacgaccaggacgaagagggctggacgccgctgcagtcggccgccagctgcggccacgaggcggtggtggacctgctgctggcggcgggcgcggacgtggcggcggccaactcgggcggccgcaccgcac

SEQ ID NO: 15510 - DNA, 711 bp, Chlamydomonas reinhardtii
  Predicted polypeptide sequence is orthologous to G1950
gcacgaggctgatgcggccatgacaacgtaaaagcaaggtcagcgttgcaagcccatatgcaccataaccgttggcaactgcaaaccagaagcacaggagcgtacggaaggagctctaatatatcgtctgcaccagcaccgggcaggcatggtggcctaccttgttggtcgcctccagttttgcgccagattccgcaagcaccttcaccaccccggcatggcccttgcccgcggcgatgtggagtggccttgagccgtcctgtacgcgcagatagcacatgctggggttgtgccatcacagcgcagactaagctcaattctgtactttacagtgcagcttgcttgcaagaccattcccagggcggaaagtgcacccacctcgtcagtgccgtcaacggcatccttgtcggcgcccctggcaaggagcaaccgcgccacctccacttggcccgcattagcagcgaaggcaagtgcgctcgggttgctctcctgcagcgacatgggcacattaatcaccgtcatggcacttcgcggggaaacggctgcaagtgctatgcccgcagcgacaaaggcacgcaccccgcatgcgtcgacgtccaagcccgcgtccagcagcgctgcgacggcctccacgtgtcccaatccggcggcaatgtgcacgggtcgcatggtgccctgcacgccgcgggacgaagcaagccgctacatgta

SEQ ID NO: 15511 - DNA, 766 bp, Chlamydomonas reinhardtii
  misc_feature (17)..(17): n is a, c, g, or t
  Predicted polypeptide sequence is orthologous to G2067, G2115, G2294
atgcttttacgccaagnctacgacattaactcctcactaaagggaacaaaagctggagctccaccgcggtggcggccgctctagaactagtggatcccccgggctgcaggaattcggcacgaggccgactccagccatacaggcgcccgcgccaggagctccaagcacgcggacgacttccaggtcgccgctgctctgagactggatgctggagcctgaggactggtctggaggatgaagctgaagctgaagttgaagttgagctagttaggctgcgcacgtggttggctgtggttggtctctactgttcagtgcgggtcttgtacgtctgtgcggtgctagactgctggagttcgcgtttataagtcagtgatatttgatatcgtttttttcttgtggcgcagagatcagagacaactcatcgttgactggctttagcggctctgagatattgtgttctatggcctcgtacgtcgatctctcttgatttatttgctgtttaccggtgagggtaaatgtgtcatatgggtgacgtagggtggtttgtaggttgtcaataaatctttatcacctctcgcggtgagagggtgttaatccgtgttatgtattattatactgcggatacgtaccaacctttttatcgcttcgaggccccgttgtgcacgggtacatagtggtcgcgctagctgaccttcacggctaatgggcgatatggtgcgtgttgcgctctcattttatatcccccttgaagatctggagctcaaaa

SEQ ID NO: 15512 - DNA, 747 bp, Chlamydomonas reinhardtii
  Predicted polypeptide sequence is orthologous to G2110, G2574
atggttttacgccaagactacgacattaattcctcactaaagggaacaaaagctggagctccaccgcggtggcggccgctctagaactagtggatcccccgggctgcaggaattcggcacgaggcgtgttctacagctgagccaaattcatggcctatgtagttgttgctctacaaaggctgttacttgacgacttcgtcattcttcaacatagctccttctgtcgttccgatacccgaagcactatatagatggcatcccaaggctttgcgatgccacgactcactttcgggcgcgacattgtggcgagtaagccctgcgcagcactgggcttgcggcgggctcccgcatgcccccgagtagcgcccggccgggctgagcagcagccgcgcaagcacctggagcccgtgcacgtagctcaggcacccctctcgtcttccacaacgacaaatggcacacacagcgcacccgccccggttgcttcgacctcatctcgggacgcgagcgaggctgccgctgcttctgcgctctcggcaaaccttctactgatctgccctgaccagaagggcgtgattgctgctgtgagccagcttctgtatggcttcggctgcaacatcgacgcttcggaccagttcacggacagcagcaagcgaaatgttcttgcagcacatcacctttggcttctcgaagatcgaaattggacctgagtacgccacggaaactgttacatgacgttaaaataactat

SEQ ID NO: 15513 - DNA, 480 bp, Chlamydomonas reinhardtii
  Predicted polypeptide sequence is orthologous to G2147
gcagcagcagcagcagcagcagcagcagcagcagcagcagcagcagcagcaggacaaacggaacctcttccagcgtctgcttggtggctgctatagcggcttgggcgctgacgcccctggcagcagcagtgacgacgctctgcgcgagcctatgcccacagcccctgccggcactgctggtgcggcgcccgccgccaatgggcagatccgcagccatgcggccatcctgactgacgccgcggtcatcttcaagatcgagctcgtcgtagaagcggacaaacacaggatggcaaagtcaggcggagatagttcatgctgcgctactgcggctggctcttgaagagacgcatgcgctcatcgcgcggatacagagtaagagcgacaccatgagggcggttgcggcagccgacctgatcgtggagttaaaggcggcggcggagtttctcgcatatgcgcgtgaacgcatctgtgaggccatca

SEQ ID NO: 15514 - DNA, 670 bp, Chlamydomonas reinhardtii
  Predicted polypeptide sequence is orthologous to G2147
cgactccgggcagtgggactcgcgctcgctgacgtccatgaacctgccccagcaacagcagcagcagcctgggagcgcgaccatggcctccgcacaggcgcaacagcagcaacaacagcaggcgcagcaacaggcgcagcaacagcagcagctcactgtgtcgctcaattcacagcagttgggcgcggtaaaccagcacctctatagcgtgcaggtaaggccgccgcaacaataccatttcaacctgtcgccaagtattgtgctctcggtttgtgggcttttggccttatatctggaaggcctttctcaccccatgcctcgcttacacagccacacactgcaataccaacacgcacctgcgcctctgccacccctgcttgcagacggtaagcggtgctacgctgcagctgtccccgggtgcgggcggcatgtttgcgctggtcatcaacggcacaccgccgcaggtggaggcggcacgcagcctggtggccacagtggtgggcggccagatttgagcgctgggaaatggcggtgtggccgcgcacacgtgcaacgaggcacgtgagggcgcgccgcgctgtatgccgtacgggcccggcggcatggatgtgccgggagcgtcatgaagccgttgatgcagcactgtcagcagccacgcaagcagcagcac

SEQ ID NO: 15515 - DNA, 185 bp, Chlamydomonas reinhardtii
  Predicted polypeptide sequence is orthologous to G2334
tcggcacgaggggcactactaaggatgtgaagtccagactcccgcgtcacatcgccctgtgcagacatccgaccagcgctctgcaccaagccacatcacgccacgtgcgcacgccgcactgcatgaggaggtgggacacgggccgcaaaagcggcaccttgttaatgacgagtggtgtgaaaaaa

SEQ ID NO: 15516 - DNA, 716 bp, Chlamydomonas reinhardtii
  Predicted polypeptide sequence is orthologous to G2574
gcacgaggagctgcctggggcgtgcgggtacttacatccaaccaggtctgtaagttttgtgtcgttgcctgacattgaattaagaaatactagtcagatcggtccggcccgcgttcggtgtgcacaacctgcaagctttgatcggcgacagagatatgattcaacgtggccctaaaacactgcttgcatgtactgcacagcacgtcgacatgtcacaggaacggtgagagagcagcatggagcaatgtggaaacccattctgccccaaataggatagttgtagggccacgaaagaatccatatcataagtatggcgcatttaaatgcttatcaaggaaacgaagacaccggggtcctcgggccggcacgaattctcgaaactcttttgcaatatggagccctgccacctgctgccgctctcacacctttgaacagttgacatgttaccgtgtatgcgcagaggagtagcagggggaaacacaccgtggggcttcacagcggggccaaccccccttcattagcccgcaacccgcctctgagtgtatcctactagggacagctcagacgctggcagaggcacggcatgtgagtggaggtggccgatggaaacttgcaggctggagggctgtccggcacaccggtgcgggcgctgcgtgtcgcgccgaatttcacagcatggcatggcggcggccggcatcagcgggacacccacgcac

SEQ ID NO: 15517 - DNA, 838 bp, Chlamydomonas reinhardtii
  Predicted polypeptide sequence is orthologous to G2592, G2713
tgcatgacagccgagatacgcaattattcctcactaaagggaacaaaagctggagctccaccgcggaggcggccgctctagaactagtggatcccccgggctgcaggaattcggcacgagggttcaaccccagcggcgacgcggacaccatcctggagcggctcaaacaccggaagggactggaggagctggtggtgatgggcaacaagccgacgcgctggaatgacgagctgaacgcctactgactgaactttaacgggcgcgtgacggaggcgtccgtgaacaacttgtacttgctgctttcccatttgcattttcttatattcctgtttttcttttttctgtcgttgttccgacgcgcccgtcctctcacgagcggaagtatagttttaaaatatcttgataatggggtaaatgctaggtgcgaacgtggtccttttcctgttggtaccggcggattcggttggtatagggaatatacgtatagtccctaatcacagtcgattcttcgtgttcttttctgatatcgttggtgtgattgattctgtgtgtaagaagtgtccaaattcgacgccgtcaccggttacattgattcggtatatttatatactatcctctgaaagtgggggattaagaagatatgtcatccggggttttatataagcagttataaatatagtcgaccgctctcctctgttatgtgaagaagcgtgtgagtccggcgactacgatacatatacatttgctgttcagtacaactaccgtatagtgtatatgagttgataagcggtaaactgatcacgtaatctattccgatagactcagtaatccaaacaat

SEQ ID NO: 15518 - DNA, 611 bp, Chlamydomonas reinhardtii
  Predicted polypeptide sequence is orthologous to G2603
caactacgactattggaagtcccgcgaagcgcccgcgccgtcgccaaagcctcaacagccggtcgcgcggtccagcgacgcatccgcggggagccaagggagcaatcaccctcggaccacggtgcgggaggaccggccgcagccggcgccatccttggcactggccatggggtccaacgacggcacattcgacatttgacctgcataacagtgacgatcactgcccttgtgtgggcccacgcgccttgatggccttggagatgcagctgccatttccctctcagtgcacgtgacttgcagcatggataagcatacgaattttggcaatgcaagcgcacgcataatacccttgaatgtagcattgcccgtggccagcagatgtgggcgcacacgggcttgagttgttacgttttctgcagattcccaggaggatgtagcgtgagcacgtttgtaatggccaagtgccgggccctctagaggcactgggcctggatcgcatacctcactgtgtacgtagaaatactggtggatattgttggatgtgcatgccagcgcagagggccccaaacgcagaggctgctggaaaagcgtaatcagtcccaatcgtgtcg

SEQ ID NO: 15519 - DNA, 835 bp, Chlamydomonas reinhardtii
  misc_feature (835)..(835): n is a, c, g, or t
  Predicted polypeptide sequence is orthologous to G2768
tgcctgagcgtccaagaatacccaattaattcctgcgactaaagggaaccaacaagctggagctccaccgcggtggcggccgctctagaactagtggatcccccgggctgcaggaattcggcacgagggcgcgctggatcccagtttcagccgtcacgtcggcgctggaggacgcgttctacctggcgttcaagaacgtggtgcccaccggcaagcgctacctgctggggctggatgtgagcggctccatgggctgtgccaactgctccggcatgacgtccctcactgcgcgccaggcagcgacggacgtggtgatgatactagttgagcgccggtccggggtgccggagctttactcctttgtgcccgtcctcgtgcttgttctcaccccctgccaggtcggttgttctctactctagtgtcgcgctttttcggtcatgtgcaccccttccttcgcgcgtccgtctcggatcatgagcgtcgggcccgtgcgacggtgacgcggcgcccgacgtggcgtgcttcggtcgcgctcttttgttgggattggcagcacgttcatatagagggatacccgggggagggcgactcgtgtggcgggtaatgtcaagtttttatcggggcagacccgccagtgcggatgattctgcgtgagggatcggacactaagttagcaaaactgctcgtgtatctcgtggcgcgctcactctgctgggcggctcaatttataccgccagcacctaagggatacacttgacaacgccggcgccgcgagggtacattgagaggcgaaacctgtaccacccgccggcagtgcaagacaaaagaggagtcn

SEQ ID NO: 15520 - DNA, 688 bp, Chlamydomonas reinhardtii
  misc_feature (685)..(685): n is a, c, g, or t
  Predicted polypeptide sequence is orthologous to G2869
ttttttaggtagatgcaatgctacatgggctccgtgttggagcggattgattcagcgttgcacgttcaaccatagtcatctgcaaagccccggcgacggttcatgttgtcgttgctttcctgtacgccatcgcacaggtgtcatctcagttgcaaaccaacaggtcatcatcgtcaccaacaaccgcaaccatgacgacatacacggtctcagtaacgcgcacgtaaaacacgtgcatagacacgacacatttgtgcctcttccattctgttgcgtcacaagcccgatgcaacggacgtaggtgtgaagactgctgtcgtgcgggaggtcgtcaaaatcgtgtctctctcagtctcagcgcggaaccaccaccgcggtctcccgaccgcctctttaacacagtacaagcacaaccaaacagatactcgttattgctggtcatactttgcaccttgtgctgcgcctctcggtagcacattgcaagcagcaaacctcagctcacgctgtgtggcgcagctgtccacgcgtactcctgcgccgcggcttctcttccgctcgcggcctttagtaagggcggaagcgctgctgctggcccacggtgttgcgtgccatggccgcgcggccgtagcccgcggcggcgccggcgccgtagccatgacgccgtacgccatggcagggtagccgncgt

SEQ ID NO: 15521 - DNA, 755 bp, Chlamydomonas reinhardtii
  misc_feature (17)..(17): n is a, c, g, or t
  misc_feature (27)..(27): n is a, c, g, or t
  misc_feature (43)..(43): n is a, c, g, or t
  Predicted polypeptide sequence is orthologous to G2993
gactttgggtacgactncctatagttncgaattgggtaccggngccccccttttttcgcataatactgttacaggtcaagagcccgtcgcacaaatagtccgagggccgtgaacaccaattagttgggaggccccacggcacccttggcactatgtatgtatgccgaatgactgggaacgtcagcttaaaaatgggccctcgctgcattgcatgatgggtgttgcaaaccctgctgccgcacgcccagtcacgccccgtgtactcttacactgtgccaccggccaactcactgcgccgaaaccaggaaccgtcccagcaccaccctccaaacgcaaaagtcataatggtacaggtcacggtaaaacgtgtgcgtgggggcgcccctatctcaacaggcgccgcaaaggcgcgaacacgatagtcgaaggttcaacatccttcattgtacagccgcccacccatatgatagttgcaaaggaagtggaacagcctcagccgggcaaattatagctaccgcaaacagctgcgaatgcaaccgcagccggggaaacgcgcgcccgccgcaaacaattagggtttcgttggggctggtattaacaacccccaccaccaacaagcgttgggcgcgaccctctgttccaaccgctttcactaaagcagtaccagcccaaacaatttcgcacccccttccccagaagtccccggttgaaaaaacacaccttcctaactacttgggaacaatgtcgctcaatgg

SEQ ID NO: 15522 - DNA, 704 bp, Chlamydomonas reinhardtii
  Predicted polypeptide sequence is orthologous to G2994
ttttttcgatcttcaggtatttacatgggagcatgaactgctgtatgtgcgtccttcatgccgccttgccactgccactgtttgcgtgtccgttctgcatctgcacagtcgtcaaagtcatatgctgtgcccacgtccccagagttcacacacacacacacacaacgcgccctcacgcttagaattgtcccataccaacacaccaccctgcacgctaacacgccctccgttttaactaactgttgtcgtacccctgtgaccgcttccagtgcaccgctatgcgcatggaagctcccctactaagtattaacacacacctccaactgaccgccacactgacgcacccaacgagtctgccaaacgtcccgtcagccgcccacaccgcatgcaaatagagctgcgagggcggttgcactgtacaccccaccgcacgtctccaccaccttcgagcgacactgcacaacgcggtacctgactgcaccacgacgacacttgcgtattgatgaggccacgccagcgcctcgccatgcaagcaaccccggaaaacagccattccgtcggcgctcctagggccatcacgctgtaaggcggggaacaaatctctgtcacacaggtgcaacttgtaattggtacgggctctgtgatgtcaatgctttggccctcgccagaccaagttactcttattacggtaatcttcttgccag

SEQ ID NO: 15523 - DNA, 630 bp, Chlamydomonas reinhardtii
  Predicted polypeptide sequence is orthologous to G2996
ttttttggatagcggtcatttacacggatggcacggggcctgccaaagcgccagccttcctgctgcagtgaaacaacaccaccacgccgacgatggacatgaggcacgcccaatgtggctttcctacaccacgttgtacgcatgcaccggctcatcggctgcaagcacgggcagccgcacgccacagccgtctgccgtcaaggttcctcatgtgcagtggctggccccgccgcctaactttgggccctacatttcgcccagcttgccagcggatatcatggatcgtcctcacatgtccaacaccacaccggcaacacagcctaccggtggcactcggaacaaccatgatgggcaacgcagcgcatagcagaaagaattcctcggggcaagcattgtcacgcacgccagccagagcgggcgcgggttcagggatatggggcggaaatacggaattcaaaggtaaaataataaggcgcagctccgggaaacattgctgaaatatgggctgaaagttcttagggactaatcagaatcatgaagggtatgctgctacaacttgcagatgcagagctgacctaacacgcaccaaccttcctcaccagcgttcacattgctgcatcttacttgcct

SEQ ID NO: 15524 - DNA, 716 bp, Chlamydomonas reinhardtii
  Predicted polypeptide sequence is orthologous to G3032
ttttttaggaggcgcgatgtaacattacgtgacgggcggcaccgagacttcctatgcatgcgacacgcccggccttttgttaatagttggaaatgactcttgaagactgcaagtgcacaagagcacaggaaggcttgtacaccaggcagtggcgggcgggggttgtgtctttgtgcggtacaaagcgccgtttcgacggactccgctccctgagggcctccagaccttgctccagagtccagaccccttctctttgactcaaaaccgcgtcgctctcaccgccaatctcctgacccgcaacatgcacacaataaattttgaggcgcctcatagcacaaggcacctgcaagccggccacataacttgcgtccacagttctcaacggcggcggctgtggcgacaccactctcaagtctctacccagcgctcagcttctgcatcagcttggctttggcctcatagaactttacgatgtccgcgtccgcgtcagggttgcctgtgaggaacggccgcgccatttccagcacagccgcgtccactccctgcatgctcggcccgccactcgagtgcgctgcggcgtgctgctgcaccgccacaccgctgccggtgcgcgtcaccgctggactggcggcgccgttgcccggccccggacccggccctggccctaacccgtgcatgccttgaggatgcccgttcccgtacccatgcgagcccag

SEQ ID NO: 15525 - DNA, 698 bp, Chlamydomonas reinhardtii
  misc_feature (173)..(173): n is a, c, g, or t
  misc_feature (698)..(698): n is a, c, g, or t
  Predicted polypeptide sequence is orthologous to G3032
ttttttggcctccatagttcatactcacggcgtcgcgcctcgggcgctttgctcgcgacagtcaattggccatcgatccgcgaagttgcttgtcaatccggctgctttggacccgccgcctacttgcaaataggctttttgtctgcaccacactgcactcgggcaaaggcggncctttgcccacccaagcattggcctagcgcgcagccacaatccgtatgtttgaggcataatgttcagcacgctgcccacacatccatgcgcactgccgggctcataggaccctcagcagccagcacctgccaagcgtccgaccaaggcccttcccgcagcaagctttcgcccagttacacggaccacacccactcacggacacgccaggacaccaacctggcaaggcagctgtgttatttaccccacatccacactctgggggtgctgtgcttacctccatacacacacacacacacatacagacagacacgcaatgccaatgcacaaccacgctctcaatatccatgcggccaccatgaccatggaccgccacgccgacaaccaccctgcaaccagacaacacaacactggcacagaggataccgcagtgctcacaggaaacgaacacagccgcctcaactagacgtggggaggagatgcggtcgcagccgccgcgtccgcacttgttgtggagtccacagcan

SEQ ID NO: 15526 - DNA, 666 bp, Chlamydomonas reinhardtii
  misc_feature (631)..(631): n is a, c, g, or t
  Predicted polypeptide sequence is orthologous to G3074
gcacgaggcaacaatcagcttctcacgttctacacacacaagcgagcaccagaatcaccgctgctcaagagggctgcaatttaactcgcactatggtctccacgcgccgcagcggccagcggcaggagaccactcctgagccgcagcatcaagtacaggattcgcccggccccagcggcacctcgtcgcaacgttccggcggccgctcggccgccggccgagggagaggcgcgaaggcggccaagaagctcgagccgattgaagaggacactgctcaccatggcgctgagcaacaacaagcaacggcagcaggttctcagcgtgaagcggtggtggcacctgtgaccagcacacaagatgaagagcggcgccaatctggtgccgccgcctcggcgcgagatgaccacgccacgtcacctcttctacgcacaacaacaaccaccacgcggcgaggacaatccgcaacaacaactactactacattaacaacagcagcagctccctctggaccagctgcgagcggctcgcaacagccggccccgccgaaggcccagcccgtccacttgggcgacagcgatgaggacagtgatgacgaggacatcctagggcccaacctgatgggccagctggncgtcgtccctgcgggccgcacttcaagcgcgggcg

SEQ ID NO: 15527 - DNA, 971 bp, Gossypium hirsutum
  Predicted polypeptide sequence is orthologous to G28, G22, G1006
gaaaaaaaaacatccccagacacaaaatttgaaaattttgagattagatttttagaggaaaaaaaataggttgactgttttgttttggctatggagatgtattcaagtgcaaacgactccgatttggctatgctggactcaattcggcaatacttactcagcgattcatcggaccttcgactcactgcttccactgattttacctcggctccccccatgttttgcaggagctcaagctttagccgtttgtacccctgtttcactgaaacctggggtgatctcccgctcaaagaagacgattcccaggacatgcttgtttacggactcttacgagatgctctaactgtcggttgggcaccgtccgataactctaagacgaatttcgcgccgatcaagccggaaccgcaagaatttttaccgcagacatcggtggaaaaagtggatacggtggcggagaggacggttcctgcggtggtgccggccaaagggaagcattacagaggcgttaggcaaaggccgtgggggaagttcgcagctgagattagggacccggctaaaaatggcgctcgggtttggttaggtacttttgagacggctgaggatgcggctttagcttatgatagagcagcctataggatgcgtggctcaagagctttgttgaattttcctctgagggtgaactctggggagcctgatccagtcagagtaacgtcaaagagatcgtcgccggagccgtcttcgtcttctggctccgaaaatgcgtcaccaaaaaggaggagaaaggtggctggctcagctccggcagtggttcacgctgggttagacatgggtgctgggaggtgaagttaattataaagttagtacgtgtgcacatggcgagcagctattagtcagtaatgctgacgtgtcagtggattaatttcagctgcagtaagcttatcttctaatgtacattctttcaatttataaac

SEQ ID NO: 15528 - DNA, 836 bp, Gossypium hirsutum
  Predicted polypeptide sequence is orthologous to G28, G22, G1006
caggagctccagctttagccgcttgtacccttgtttgactgacacctggggtgaccccccactcaaagagaacgattctgaagacatgctagttttcgggtaccttagagatgctttaaccgtcggttgggccccctccgatcactcttccccgactttcccgccaattaaaccggaacctcaggagattccgacggagacagcggtgaaagaggttcctacggtggcgaatgcggcggttcccacggtggttcctgccaaagggaagcattacagaggagtaaggcaaaggccgtggggaaagttcgcggcagagattagggatccggctaaaaacggggctcgagtttggctaggcactttcgagacagctgaggatgcggctttggcttatgataaggcagcttataggatgcgtggctcaagggctttgttgaatttcccattgagggtgaattccggggaacccgacccagttaggatcacgtcaaaaagggcaacaccggagccatctacttcttcgtcctcgggttcagaaaacgggtcaccaaaaaggaggagaaaagtaggtagcgcggctccggttgtagctcaagccggtttaaatatgggttttggagcgtaaagtattgaggtgggaccttgtacatgtggtgaacagctattagtcagtgaaatgctgctgaggtgttaatagtgtaatgtaagcagaagtaagcttatagttatggacaacctccatcccataggaattttgtagaatcggaaaaaaagttatttttgttcttaaaaatagtattaacagcgtggttaaaactaaaaaaaaaaaaaaaaaa

SEQ ID NO: 15529 - DNA, 665 bp, Gossypium hirsutum
  misc_feature (490)..(490): n is a, c, g, or t
  misc_feature (502)..(502): n is a, c, g, or t
  Predicted polypeptide sequence is orthologous to G481, G482, G485, G1364, G2345
cccgtctctcccgcccttttttttcctttttatttttttatatataatatatatatttcaattttcatttctactaagggttttgtccatggcggaagcactggcaccggcgagtcccggcggaggaagccacgagagtggcgagcagagcccgaaatcgaatgtgcgagaacaggatcggtttctacctatagctaatatcagccgtattatgaagaaggctcttcctgctaacggcaagatcgctaaagatgctaaggagactgtacaagagtgcgtctctgagtttatcagcttcatcactagcgaagctagtgataagtgtctgagagagaagaggaagactattaatggggatgatctgctctgggctatggcgactttagggtttgaggattacattgatccgcttaggatttacctttcccgatacaaagagatggagggtgatgctaagggctcggctaaaggtggagatgcctctgctaanaaagatgtccanccaggcccaaatggccagcttgttcatcaaggttcattctcaccaggtgttttttatgggaattctcaagcccctctgatgcttcccattcaaggcgctgattaatgaatcctgatcaccgttctccaattcccttatctataccccgtaattatcctgttcc

SEQ ID NO: 15530 - DNA, 843 bp, Gossypium hirsutum
  Predicted polypeptide sequence is orthologous to G481, G482, G485, G1364, G2345
gtttctctttgttaaaagaataatttagtacaaagaattttttttatttgaggtttttgtatggatggtgtgtgaactgatggatagttgcattttggttatgttatatatatatataaatatgcatttggtttcactttacttgctaaaacttttataaaaaattgatggatactaatatgtttcattttcattttcccagtgatctaaggtcattcaaggacatggcggatggtatggcaagggggccaacgagtccagcaggagggagtcatgagagtggagagcagtgcagttctcactcaactgtgagggaacaagaccgttaccttccaattgccaatataagcagaatcatgaagagagcattgcctactaatggcaaaattgctaaggatgctaaagaaactgttcaagaatgtgtttctgagttcatcagcttcatcactagcgaggctagcgataaatgccagaaagagaagaggaagacaattaatggagatgatttgttgtgggcaatggcaacattaggctttgaagactatattgagccacttaaaatatatctggccaggtacagagagttggagggtgatgctaagggatcaatcaggggtgaagtgcctcttaaaagagatgcagttcgagttcttgctgtccccaacccacaggtgaaacaatgatatttactttagattcttgttcttggcctaaatttgatacacttggctgtttgtttaagcattctgtaaagtcctgaactgaattaccatgtctcttgtgcattggtggtgaatgaatcctgcagtttcctatcgaaggatcattgaactatattaattc

SEQ ID NO: 15531 - DNA, 700 bp, Gossypium hirsutum
  Predicted polypeptide sequence is orthologous to G481, G482, G485, G1364, G2345
catcagatctgatctgagtcattgtctttttcctttcttctccagcgtccgattttcccttgaaaatccaatctctttcactcccgcccttttccatttttcgttttaatcaatttcaattttttccccactttctggattctttacatggcgacgtcggcaccggttccggcgagtccaggtggcggtggaagtcatgagagcggcggcgagcaaagcccgagatccaacgtgcgagaacaagagaggtttctccctatcgctaacattagccgtatcatgaagaaagctctccctgctaacgctaagatcgctaaagatgctaaggagaccgtacaagagtgcgtttcggagttcatcagcttcatcactagcgaagccagcgacaagtgccagaaggagaagaggaagacaattaacggggacgatcttctctgggctatggcaactttagggtttgaagattacatcgatccgcttaagatttaccttaccaaatatagagagatggagggtgatacaaagggttcggttaacggtggagatacatttgctaagaaagatgtccaaccagagtcaaatggccagcttgctcatccacgttcggtctcgcaaggtgtttattttgggaattctcaacccagtcacaagccaattaagtggtttgttccaaaactgaaacgaaacaaatccattgaac

SEQ ID NO: 15532 - DNA, 452 bp, Gossypium hirsutum
  Predicted polypeptide sequence is orthologous to G867, G9, G993
ttttttttttaaagagctaaacatgaatcaataaatataaaaacagaagaaattgacagttatttcatatttttttcttggacgaaatgtattacacctaatttcagctttcttcagcctttttgtcttgtaatatacaattcaacttttacaacttgctactacagcccctccatgtccccccctccccttttctttttcttcctacaccgtcttttaacattcacaaagctccaaaaacaacaaaagaaggggaaaaaaaaaagaaaaaaaaagggaaattaattaggtgatgttacaaagcatcaattaccctttgtttcttgctgcactctaattctaaaagctccatttctctagtccttttcccattacatcctccagctagaccaacattttcactgccaggcattttaaatatgttgaccccaaatagcctgaccatttgaacc

SEQ ID NO: 15533 - DNA, 872 bp, Gossypium hirsutum
  Predicted polypeptide sequence is orthologous to G1274, G1275
gcggccccttcgaccaaaactctatcaaagaccaaaagtccagattttccttaaaaatggacttttctcatcaaaaccctaactctaaccctaattacactttcttccctgaaaacgtcaatcccatgcccgattttgaggtctccgattatctcgatcttgacggcagtatcttcgacgacgatacatcgtcggagaaaggcatggctgcagctactgaacttagtggtgcaacatcaaaaaatagtaacagaaaatgcaaaaatggagtggggaaaaacaaatcggaactgggggtacgagttgcgtttagaatgaaatcagagatggaggtgaccgatgatggatacaaatggaggaaatatgggaaaaaatccatcaagaacagccccaatccaagtgtaggatgcaatgtgaagaagaggatagaaagggacgtaaaggaccaaagttatgtggtaactacatatgaaggagttcacaatcatgagaccccatccatggtttactacaaccaaatgtccattatggctcctaatgcttggacctttcaagcttctcctccttcttcttcttctacatgaaaagaaaacttatatacatacatacatacatatatatatattatccttagaattatatatctgcttctttgccttatggtgttgcctaaaatggtgagctattactttttagttgacactaattttcccactatgcattttccgggctgacttagttaaaatacagtcgggccaaagctagtggattgactatccgtcgtctttgttgtaatttccatctctgttaattatcaaaactcagaactactttctctttcttttttttaaatgggatatattaataataaa

SEQ ID NO: 15534 - DNA, 547 bp, Gossypium hirsutum
  Predicted polypeptide sequence is orthologous to G1274, G1275
tcggcagagattcagacaagtctgaggttgaaatactggatgcatgggtacaggtggaggaaatatgggaagaaaatggtgaagaacagcccaaatccaaggaactactacaaatgtttgattgaaggatgccctgtgaagaaaagagttgaaagagatagagaggatccaagttatgtcattacaacttatgaggggatccataatcactaaagtgtatcttgaatcagtggttttgtttttgaccactacctaagtccggcagaagggccaacatcgatgatcgcatcagctgcatgatacttgagtcatgcattatgattaagaaacataaagatgatatcggaaaagccgaggttggttttattcatgtatgcatctttaaatttggccaactttattttgttcttgttttggttatgtacataatttgttggcttgtagaaccctgagtttcaactgatgtcttaagttgaaacacagggtatttactgaggttttaactgtttgatccagttttgtttaagagtaaaaaaaaaaaaaaaaa

SEQ ID NO: 15535 - DNA, 671 bp, Gossypium hirsutum
  Predicted polypeptide sequence is orthologous to G1792, G1795, G30, G1791
aaaaatgcttcaatctttattggtttcatttattctcaaaatcaagaagctcctctaacaatttatcgtccaagcactccaattccagcactattctttcttcatctttcttgcttttcacatgttcaaaggaatacgaagaagaagaagcagcagaagcagatgatgaagaagatgatgatgatgatgatgatgatgatgaaggggtagcggtggggggagagtttactgctgtggatgaaatgatatgttcatctcggaagttgagaatagcggagtgacccctcatagagaaagcagctctgtcataagctcgagcagcctcctctgctgtatcaaaagttcccagccacagccgaggtcctccttgcctcgtcgagtcccgaatctcagctgcgtatttcccccaaggccgcctcctcacacctctatatcgaaggctggactccgcctctcctgctttcttcatcttattttgttccttacgttataaaccctcacttgaagaactacatttgtttttggaattttcgctgccaaggcggtgggcaccagttttcgacgagtttccccgtggtttacaacacaagcgacagagcaattcgtttttacagttcaagttcttgggtcccaagctttatgttaacaccattccagttgatgtaggtatg

SEQ ID NO: 15536 - DNA, 959 bp, Gossypium hirsutum
  Predicted polypeptide sequence is orthologous to G1945, G2155
atttcttctcattcttctgctctcccactgtttctctcttcaccctttgccattcatctccaaagaaatttattattttaaccagagaggaaacaagaaacaatttggagccatttagttaaaaaaatgaaaggtgaatttctagaaccccaaaatgaaggtgaaaaccccaataataatatgttttcaaagcttcaccaccctttttctcatcactttcaactcagtcatgattccgatgacacccccactcccaaacgcccgacccgtggcagtggcggcggaggaagcgacggagctagcattgaagtcagccgcagacctaggggccgtcctcctggttccaaaaacaagcccaagccaccacttgtcgtcactcctgatcctcaccctcccatgagtccttacattctcgaaattcctagtggaaacgacgtcgttgaagctctctcccgtttctctcgtctcaaaaacattggactctgtgttctaacgggatccggcgccgtttcagatgttactcttcgtcaacctacgactactactccatctccagctactgttactttccatggcagattcgatatcttatccctctccgctacgttcttaccccaaacggcgtcgtgtcacgtgcctaactcgttctccatctctttagccggtcctcaagggcagatcgtcgggggtttcgtagccggttcgttggttgcggctgccaccgtgtttatagtagctgccacggttaacaacccttcctatcatcgtttaccaggagaagacgacgaaacaagaaacacggtgtcatctagtggtggtgatgatggtggtaaaggacagtcgccgtcttctggtggtgtggagatggagtcgcggtggtgggctgattcttgtgtgttcatgtatagtgtcacatgggtagtggttcagatgtgatttgggccctaccgcagacacac

SEQ ID NO: 15537 - DNA, 919 bp, Gossypium hirsutum
  Predicted polypeptide sequence is orthologous to G1945, G2155
cttcaattttaaaaaacaaacaacttcaatttttatttttattttattactaaattctacttattgaaaaaaattatttgtttttttttattatcttttatacgcaaatatatataaaaaatccatttacaaacatgaaaggtgaatatttagaatccaaaaatcagaaccccaataacatgttctcaaagctccaccaccaccagcaccaccctcatcaacatcaacatcaaccccaacaccaaactcaccctttttctcatcacttccaactctctcgtgattctcagaatcccgactctgatgacactacccatacccctcccaaagatcttaccaccaaccacagcccttctctccccagtggtggtggcaacggcggtgcttctcgtggtggtgccaacagtggcgacggtgctagcatcgaaatcgttcgtagacccagaggtcgtcctccgggctcgaagaataagccgaagccgcctgtcatcatcactcacgagcccgaccctgcgatgagtccttacattctcgaaatccccggagggaacgacatcgtcgaagctatctcccggttctctcgtcgcaagaacattggaatctgcgtgctcacgggatctgggaccgtttctaacgtgacgctccgtcaaccttcttcagcaactccgggagctaccataactttccatggcagattcgacatcttgtccctctccgccacgttcctatcccaaacgacgtcgtgtcatgttcccaacacgttctccatctctttggctggtcctcaaggccagatcgttggtgggttcgtagctggctcgttggtagcagcgggcaacgtgtttatagtggctgctacgttcaacaacccttcgtaccatcggttacccgttgaagaagaagcgagaaacgcggtgtc

SEQ ID NO: 15538 - DNA, 823 bp, Gossypium hirsutum
  Predicted polypeptide sequence is orthologous to G2
aaaaaatgtgggatcttaacgattctcctgatcgttcaagagacgaggaatcggaagggtgttcatcgccggtagacggtgaagaagggaagggtaaacgggttggatccgtttcgaattcgagttcttccgccgtggtgatcgaggatggatcagaggaagaagatgcagcagctttaaagaaacgaaacagtaacatgatttttgggttctcggtgcctgtcgagaccggtggaccagctccggtgactcgtcagttttttccacttgaccaagacccagaaatgagggcagttcccagcggaactgcacaagggttccccatggctcactgggtcggagtcaaattccggcaatcggaaccactcgccgttgctaaatccgttgaagctacgaatcccatgaaaaaaagtagaagaggaccaaggtcaagaagctctcaatatagaggtgttactttctatagaagaaccggcagatgggaatctcatatttgggattgtggaaaacaagtttatttaggtggatttgacacagcacatgccgcagcaagagcatatgatagggcagcaatcaaattccggggagttgaagctgatataaatttcagcattgaagattatgaagaagatttgaaacaaatgagtaacttaacgaaggaagaatttgtgcatgtacttcgtcgacaaagcactggtttccctagaggaagttctaaatatagaggagtaaccttgcataaatgtggaagatgggaagctagaatgggtcaatttttgggcaaaaaatatgtttatttaggcttgtttgataccgagattga

SEQ ID NO: 15539 - DNA, 866 bp, Gossypium hirsutum
  Predicted polypeptide sequence is orthologous to G3
tttttctccttcttatggcttacaagttatagtttccagaaacaaggggaaataaaaaaaaatccattttgttttaggattttggtcttcttttatcttttgggtcatggagctaggtgattgttgtttaacatcaagtccagcaagcggagagaagcgaaagctgcataggacacagcaaaaggagaaaccattcagagggataaggatgaggaagtggggaaagtgggtcgctgaaatcagagaacccaacaagcggtccaggatttggcttggttcttacaccacccctgtagccgccgctcgtgcttatgacacagccgttttctacttgcggggtccttccgccaggctcaacttccctgacctcatattccaagaagacgagcttagggatatctcagccgcttccatacgcaagaaagcaaccgaggtgggggctaaagtcgacgctttacagacctcactccatcatgcttctgcttcatcatcggaatcatcgaaccctactcgagttttccgtaaacctgatttgaacaagtaccctgacagttctgatgaagattgaaaacaatataatagtttaccataacccaaaaacctataactgttcatactcgccactttttttttttccccacttatgtctttttgattctctcatggaatagcaagtgcccaaagaatagaatcaataaaaaaatggattgattctctgtttgataaggttatgaatgttttactttgggaatacaagtttagtttatggcatgtaacttttaacatgaatggatattgatgaaacagggatatatatcgctgagttagtaaatactcctaattccttgaccaaaaaaaaaaaaaaa

SEQ ID NO: 15540 - DNA, 962 bp, Gossypium hirsutum
  Predicted polypeptide sequence is orthologous to G4
caacaacccaaacaaacaaacaaaaaaggaatcgcctctacttctactttttacataattctcactttcaattccctcactctgatcaagccgccatgtgtggaggtgctataatctctgattttattgctccggtgcggtcgcgtcggctgacggctgactacttgtggcccgatctgagaaaatcgcaatcgaaaaaggcttccagtaataggtactcgaagccggcgatcgatttcaccgataacttcgaggccgactttcaagacttcaaggatgataaatccgatatcgaagactatgatgttgatgatgttttggctgatgccaagccctttgcgttctctgccgcaaagaaagcatcttctactgtttctcatgctcaagctgagaagtctgcaaaaagaaagaggaagagccaatatcgaggaattcgacagcgtccatggggtaaatgggctgctgagatccgagacccgaggaaaggggttagggtctggctaggaactttcaatactgctgaagaagctgcaagagcttatgattctgaggcacgaagaattcggggtaagaaagcaaaggtgaacttccctgatgagatgccacgcacctctccaaaacgtgtgattaagacaaatgatgagaaaccacttcccatgtcaaatttgagccctgttgaaccaaatatcaaccagaatttcaattgcttgaacaaaccagagcaggtcttttatgataccatgggtttcgttgaagagaaggcaccaatggatccatttgcttatgtggacactgttcctgctgctgttgatgttggattgaaaccctttggccaatctgacaatacccccttgtatttcggctcagaccagggaagtacttcctttgactgttctgacttcggctggggagaacatggtgcaaagactccggaaatatcatctgctcttgaagctactatg

SEQ ID NO: 15541 - DNA, 1538 bp, Gossypium hirsutum
  Predicted polypeptide sequence is orthologous to G4
cggcacgaggagagagagagaactagtctcgtgccgggaaaatttacaattaaaaaaattaattttgccctctaaatttctctaaaaaatctcctaaatcccatactttaaatccaattcgccatgtgtggaggtgcgattatctccgatttcattccgcctgcgcggtcgcgactggtgacggcgaattatttgtggccggatctgaaaaaatccggctctaaaaagcggtcgggtagaaagcactcgaagaagccggcggtcggctttgaagatgacttcgaggctgattttcaggtgtttaaggatgaggattctgatgtcgatgacttcaacgatgatgttgatgatgttttggctgatgttaagtcctttgctttttctgctacaaagaaaccctctcctgctgtttctcatggttcaaactccataaaatctgtggaattcagtggtcaagctgagaaatctgcaaaaagaaagaggaagaaccagtatcgcggaattcgccagcgtccgtggggtaaatgggctgctgagatccgtgatcctaggaaaggggttagggtgtggcttggaacttttaatactgctgaggaagctgcacgagcttatgatgctgaggcactgagaattcggggtaagaaagcaaaggtgaacttccctgatgagactccacgtaccactccaaagcatgctgttaaaatgaattctcagaaacctctttccgggtcaaatttgagttctgttcaatcaagtctcaacccagatttcagttactcgaacaaacttgagcagggctactatgataccgtgggtttcattgaagagaagtcactaatggatcagtttgcatatgcagaccctgttagagctgctgtagatgatgggttaaaaccctttgctgaccctgagaataccgcttcgttttttatctcagatccagggagtaacaactttgacagttccgaccttgtctggggcgaccagggtgccaagactcctgaaatatcatcctctcttgaacctactctagaggtcaacgagtttctggacaacgcaaaccctacgaagaagttgaaactgagcttgaataatgtcatgcctactggaggagacaattcggtaaagagtttatccgatgagctattagctatggacaatcaagtgaactactttcagacaccatttattgacgagaactggaatgtttcgatggatgacttccttaatggagatgcaactcaggttggcggaaacgaaatgggtttttggagctttgatgactttccttccatagatgggggtattttctgaacaaactctccttacttattatccgtttccgtacataaggcatcgtgttagcgagtttcgaccctctggcaactgcttgactattgtttctatcttgatatctctaacaccgaaaaattcaaatttaaatttcgagtgactgttagaacttacaacattgattatgtgtgatttatgatgaaaatttgaaactcctatgaatgtttaaccaaaaaaaaaaaaaa

SEQ ID NO: 15542 - DNA, 1596 bp, Gossypium hirsutum
  Predicted polypeptide sequence is orthologous to G4
aaaaaaccaacccatttatttcactacccaacaacccaaaagataaaaggaatcgtttacttgttcgtagcaatttatcgtcatttcaagctcaattctctgaaaattttgtgctgaacttcttttttctctttgtaccaccatgtgtggaggtgctattatctccgatttcataccgccgtcgcagtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtctctcatggttcgaactctgaaaaatccatgcaattcaatggtcaagctgagaaatgtgcgaaaagaaagaggaagaaccagtatcgtggaatccggcagcgcccatggggtaaatgggctgctgagatccgtggcccaaggaaaggggttagggtctggttaggaactttcaatactgctgaagaagctgcgagagcttatgatgctgaggcacggagaattcgtggtaagaaagctaaggtgaacttccctaacgagactccgcgtacctctccaaagcatgcagtcaagacaaattctcagaaaccactttccaagtcaaattcgagccctgttcagccaaatctcaaccagaattacaattacttgaaccagcctgagcaggaatactttgataccatgggtttcgtagaagagaagccatcggtcaatcagttcgcatacgtggaccctgttcctacgtctatagatgctggatttaatcaatcagataatgcccccttgtacttcaattcagaccagggaagtaactcgatcaattgttccgactatggctggggagaacagggtgccaaaactcctgaaatatcatccattctggaagcttctgtagagggtgatgagtttcttgaggatgctaaccctagcaagaagctgaaaccaagttccgacaatgttatgcctgccgaagacaactccgcgaagaccttgtcggacgagctgttggctttggacaaccagatgaaatacttccaaatgccgccatttattgaaggaaactgggacgccactattgatgctttcctcaatggagatgcaacacaggatggtggaaacccgatggatctttggaactttgatgatttccctaccatggcggagggtgttttctgagcgaactttccataataactagtgtttgtaaataaagcaacatgaatttggtcaaaatctgttgtgaagttgaagtaaaaaccaagctatatgcatgcttaagccttgcctgcactgctttcagaggtttttagtatgtaccccttttttatgtgtttttttgtagactttggactaaattttaaatttgagtgactgtataagtaactgtgtctgaatttgtctatgtttgaatactgaaaaacatatgaatgttttaaacccaaaaaaaaaaaaaaaaa

SEQ ID NO: 15543 - DNA, 473 bp, Gossypium hirsutum
  Predicted polypeptide sequence is orthologous to G5, G974
accaaaagcaagggaacaagaaaaaaacatcaaaggaaatgaagaaggacaaggttcaagtggcaacgcctgaacctgaggaaaagacagtgaagttggagaactcttcatcttcgtctccggttgtgtcggagaacgaggtgtcagcagaatcttcacctttatcagatcttacattctcgaatttcaacgaacattcatggcctgaatttggtttttcttcggaaaactttatgttgtcgaaatacccttcatatgagattgattgggattctattttaaaatcctaaaagaagggtatgtttcatttcttgtaacagttaagctcactgcaatcgagtttttggtagttgcggtggcaggtcagggtccttagcctattgtatttataaggaattggaaatgtttcccatggtggtcagctcgtttttttgtacagctgaaccaaggtagaaaaaaaaaaaaaaaaaaag

SEQ ID NO: 15544 - DNA, 835 bp, Gossypium hirsutum
  Predicted polypeptide sequence is orthologous to G5, G974
ccgtcccacgcgtccgctcaaagttgggttttgcctgttctttggttttgattaagaaacaggtctgtttttttggatatggcagctgttatagatatgtataatagtagcagaaactcagttttttatgatcctttaagagaagagttaatgaaagcacttgaaccttttatgaaaagtgcttcttcttcttcttcttcttcttcttcttcttcttctccctcacagcccaatttgtaccctgaatattgctccccattgaacggtagtacccacttgttttcaaaccatgggttctctaactatgacaagaacatgttgggttttgagcaaacaggtagttcacttgggcttaacgaactcaccccttctcaaatccttcaaattcaatcccaaatattacatcaacaacagcagcaacaggttgcttccatggcggctgttgcaacaccaccaacaacaacctttgagaacccaagggtgggctttctttcaccaaagcctgttcctatgaaacatgtctcttccaccccaccaaaagctgcgaagctttataggggtgtgagacagaggcattggggcaaatgggtggctgaaattagactccctaagaaccgaacacgactttggcttggcactttcgacacagctgaagaagcagccttggcttacgacaaggctgcttataagcttagaggagagttcgctaggctgaattttccccaccttaagcaccaaggagctcatgtttttggcgagtttggtgactacaaacccctccatgcctcggttgatgctaagcttcaggctatctgtcaaagcttacaagcacaag

SEQ ID NO: 15545 - DNA, 949 bp, Gossypium hirsutum
  Predicted polypeptide sequence is orthologous to G5, G974
gagttattcacaccaaaaatttaagagagaaaaaagaaagaaaaattgatttgtggtttttgttttaagatcaccttccccccccttttctctgttaatccccgcttctctgaatccctttctgttaatcatctgtttctatttttgaaaaaaattctgatttttgggtttgttttttgttttcagttattgacagtcgtttgaaagcaaacttagattacaggattttcttcaaaagccaggtgttttcagaatcgagatccaggttttttgcttttaatttttctgttttttgtagataaaatcagctgaaggggtgatttttgatacctcaaaagcttgattttttagggctatcttggatttaaaggggttgtctattttaaacaaaaacctccttaatcctcttctgggtttttgaaacctgttcttaagttttgataagaaacaggttacttttttttttcatattcaagtttcaatcttttctgtttgaaagaaatggcagctacaatggatttctatagtagcagttcagatatatatggtggagagttgatggaagcactcgaaccttttatgaaaagtgcttcttcctcatcctcttcttccccttccccttctccttccccttcatcttattctccctctccttctccttctccttctacttcatacctctctttctcttcttcccaaacacaacccaatttttacgcagatggttgttgttattccccagcagttgatcaattttcagggtgttcaacagcctcaacttggttcaaccattgggctaaacaacttaacccaagctcagatcaaccaaattcaggctcaattcctcttccaaaacaatcaaccaagctacctttaccaaaatcctcaacttaacgccaaccccaacaccaaccatatgctcagctttcttagtcccaagccagtcccg

SEQ ID NO: 15546 - DNA, 1493 bp, Gossypium hirsutum
  Predicted polypeptide sequence is orthologous to G5, G974
acctcttttaatccgttctggatttaggacctgttcttcaagttttggtaagaaacaggttaattttttattaaaatttggtcctcatcttatttctagttttagtgtaatggcagctgcaatggatttcattagtattggagtagatcaatcagatctatatgggggagaattgatggaagctctcgaaccttttatgaaaagtgtttcctcctcttccccttccccttccccttccccttccccttcttctcttccttctacttcttacctttctttctcttcttccgaaacacaacctaatttttacccagatagctgttgttacccttaccctacaccaatggactcagtatcatgtccccaacagcctcaaactggttcaacaattgggctaaatagcttgacacaagctcagatccatcagatccagcttcaattccacctccacaacaaccaaccaagctacctttgccaaagtccccaacccaacaccatcagcgccaatagtaacccgatggttagctttctttgccctaaacctgtcccaatgaaacacgtgggtgcgccatccaaacccaccaaactttacagaggagttaggcaacgccactggggaaaatgggtcgctgagatccggttacctagaaaccggacacgtctttggttaggcacttttgacactgctgaggaagcagccttggcttatgacaaagcagcttataaactaagaggtgactttgcgagactcaacttccctaaccttcgtcaccacggttcccacgtaggtgactacaagcctttgccttcctctgttgacgctaagcttcaagccatttgtgagagcttggtacaaaaccctaagcaagggagcaagaagaaatcatccaaggttacggcagacaccaaaagcaggaacaacaaaaaatccgacatggcagagccaaagcccgaggagaatacagcgaaagtggagaactcctcatctttgtctacggttcaatccgagagtgagggttcggctgtatcttcacctttatcagatcttacattctcggatttcgacgaacaaccatggccggaagtcgtttcttcttcggaaacttttatgttgtccaagtacccttcagagatcgattgggattccattctaaaagcctgaagggaaaaacccaagtttcgttttctgtgtaacagtcttttgttgtttaggagtttcctttcgtgtatttttttttgtaaagctagctgcaatggagtttttggcagttgcagtggcatgtattttaggttattaagagtctgttaatgagtgtaagtgcttgtgttcataagaatttgtgattttctccatgctggtcagctcgtttttttacttgctgaaccaaaaggtgaaatttgttagtgtctataaaaaaagtttatagcttttgtattttgtacgaattaaatgttatttatgttgttgtattctctggtatcgtgttttcttc

SEQ ID NO: 15547 - DNA, 811 bp, Gossypium hirsutum
  Predicted polypeptide sequence is orthologous to G12, G24, G1277
ctaacatataactttgttgtgtcggaaaaacattacatttcaaacacgacacaaccaaactaactatgtcatctccaactctccattcttctcctcccccttcatagttccagctttcttcccctgttctaataaaaacccaagcctcccgactacacaacccagagttgaggaacataggatttctccaataatttgcaaggcatggagaatggaacaggagttgttgcttcaagggagagttcgaggaagtccacggcggagaggccttacaaagggataaggatgaggaagtgggggaaatgggtggctgagattagggaacccaataaacggtcgaggatttggttagggtcttattcaacacctgttgcggcggctcgagcttatgacacggcggttttttacctgcgtggaccgtcggcgaggttgaactttcctgaccttttggcgggagagagagttggcagcgccggtggcggctctctcggtggggatttgtcagcggctactataaggaaaaaagctattgaagttggtgctagagttgatgctcttgaggcagctcaccaccaccaccaccatcataatcatcgtggtcataattataatcatggttatgacgaagagttgaagccaagtacaggcggttttttacatcgggttgacttgaacaagatgcccgacccggaagattcagatggtgaatgggaaaggaaataggaagttaaaaaaaaattgattgaatcatgaccctccaacttttatgatgtaatttttgttccgtctcttttggcggctaccccgaggg

SEQ ID NO: 15548 - DNA, 941 bp, Gossypium hirsutum
  Predicted polypeptide sequence is orthologous to G19
caacacctccaaatttcccttaaacccttcctttttacctcaatcaacgctgcttttcaagcccgcaaaaatagttcccttccttaagaaatgtgtggcggtgctatcatatctgagttcatcccacggaaaggtggccgccacgtgaccgccgccgatatctggcctaactcccctttcgtgaaaatcaatggcttttgctcttaccgcgaccactcagtctaccatttcaaaagatcccaacccgaaccgccatcgtcgttaggtgatgaacaagtggagaagaaaccgaaaaggcagaggaaaaatctttacagaggcataaggcaacggccgtggggcaaatgggcggccgagattcgcgaccctcgaaaaggggttcgtgtttggctgggcactttcaacactgccgaggaagcggcccgcgcctacgaccgtgaagctcgcaaaatcaggggcaagaaagccaaggtcaatttccccaacgaagacgactccttctccaccccgtacaatctgaaccgttccacgcccaattcgaacccttgcgtttatcaacagcatataaacagtaactatggattcaattacgatttgaatgaaatcggtgggtacgcaactgacccgatcgttatatctggagatgaaaataaagggtccgacgaccaaaatgtgaatctctgttacgtccctgtgaaggctgaggaacttgaagaagaagagaaacggcgagagccgatgaacaacgccgtgtcggctgtgggggttcaagaagaaaacaatgaagtggagaaactgtctgaggagctcatggcttacgagaattacatgaaattttatcaaataccttatctggacggggaatcgccgacccaaaacggcgtagctccgcacgatagtgtcgtcggtgaactttggagcttcgacgatgatggcgttgc

SEQ ID NO: 15549 - DNA, 1190 bp, Gossypium hirsutum
  Predicted polypeptide sequence is orthologous to G19
ataaccgtcggtctataaatcctagaccccaataccaaagctttttccatctgaaaaaaaaacaggttttcttttaagataacacccaaaaatgtgtggaggtgcaattatttccgatttcgtcgcccccaaatatgaccggaaattgaccggcgatgacctttggtctgaacttgacatattctccgacctcctaggtttcgacaacaatggcaaaagctttgtcaatcatcagtttcataacaacaacaacaacaagctcattaatccaaaagacaatcaacttaacaaagagagaagcgagacgattcagaagacaagccaagtcactaaaaaggttgaaaagactcagcgaactcggaaaaacttttacagaggaataagacaaagaccatggggcaaatgggcagctgagattagagaccctcaaaaaggcgtccgagtttggctcggtacctataacacagccgaagaagcggctcgagcctactatgaagccgccaagcgtatccgtggtgataaagccaagctcaacttccctcaaacgcccaccaaaaatcaagcagcttcaccagctcttactcagcttcctcctgctaagaaaaggtgcatcgttcccgagttaactcaaccgagtttccagactgactcaccaccttatcctatgggtcttgggtatggaagaagtgaagattataagccgattgaagtggtggagagtgagttggagttgaaagaacaaatctggagcctggaatcattcctgggtttggagactaaccatgagactatgactcagctgagtggtaacggtgggactgactcactggagctttggacacttgatgacctcgtaactcagtataagcaacggcgctaacatgttcattagtgggggcgaaaattaaataatagttagcgttaatcaatgtttttgtgttacttagggtttttttatttatgctatcatgcattatatatatatatatgagaataaaggattaacgctttgctcttgcatggattagttagcgttaatcaatatttgtgtgttaattagggttttttattatgttgttatatatgtatatgcttaaggactttcatgtttgtatcaatgcattagttgcattatatatattaagaataaagggattttacacgttgcagtttgaaaaaaaaaaaaaaaa

SEQ ID NO: 15550 - DNA, 916 bp, Gossypium hirsutum
  Predicted polypeptide sequence is orthologous to G19
atgagactatgcggccgctgttacaagtcgacgaatcaacttaacaaagggagaagcgagacgattcagaagacaagccgagtcactaaaaatgttgaaaagactcagcgaactcggaaaaacttttaccgaggaataagacaaaggccatggggcaaatgggcagctgagattagagaccctcaaaaaggcgtccgagtttggctcggtacccataacacagccgaagaagcggctcgagcctacgatgaagccgccaagcgtatccgtggtgataaagccaagctcaacttccctcaaacgcccaccaaaaatcaagcagcttcaccagctcttattcagcttcctcctgctaagaaaaggtgcatcgttcccgagttaactcaaccgagtttccagactgactcaccaccttatcctatgggtcttgggtctggaagaagtgaagattataagccgattgaagtggtggagagtgagttggagttgaaagaacaaatctggagcctggagtcgttcctgggtttggagcctgatgagacaacaactgagttgagtggaagtgctgagcctgactcagtggacctttggatgcttgatgaccttgtgacacatcatcaacaacagcctcagctcttttattagaaattaaaaagttttaattagggtaatgttatgtttgatatgattatgcttaagactttaatgtttgtattaatgaagggtaaatagttgtgacaataaaaagattggccacccagttttaatttatatttatttctaatttgggtgacatgtaaattggtttcgagaaacattgaagtacccataatgttagttcatgtatcagatatagtaaacactttggattaataaaaaaacctcctaatattttatttgtaaaaaaaaaaaaaaa

SEQ ID NO: 15551 - DNA, 1079 bp, Gossypium hirsutum
  Predicted polypeptide sequence is orthologous to G19
gcacgaggatctaagaacccgaaaagtagagctttggttctctgtctgctgcttctttcttctcttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttcactcagttcgacaacaccaaggccggttccaaagccaagaaccttgaaaaagtgacaaacgagtcgactcagaagacaagccgggggagagagaaagaagggaagactcagcgaactcgaaagaacatttacagaggaatcaggcgaaggccatgggggaaatgggcggctgagataagagatcctcacaaaggtgtccgaatctggctcggtacatacaacacggctgaagaagcggctcgagcctacgatgaagccgccaagcgcatccgcggggacaaagccaagctcaacttccctcaaactccacgcctaactcagcctcctgctaagaaaaggtgtatgatggctcctgagttgactccaccgagttctgaaaccaagagcccaccaaccccacaaccttttatgggttttggttacgagaatggagtttacaggccgagtgaagcaatggaaagcgagatggagctgaaggagcaaatctcgagtctggagtccttcctgggtttggagcctgatgagatgacaactgagttgagtggaagcgctgagcctgagtcagtgaacctttggatgcttgatcaccttgtgacacatcatcaacaacagcctcagctcttttattagaaattaaaaagtttaaattagggtaatgttatgtttgatatgattatgcttaagactttaatgtttgtattaatgaagggtaaatagttgtgacaataaaaagattggccacccagttttaatttatatttatttcctaaaattctaaaaaaaaaaaaaaaaaaaaaaaaa

SEQ ID NO: 15552 - DNA, 550 bp, Gossypium hirsutum
  Predicted polypeptide sequence is orthologous to G20
ttaaactgaagataaaattcttaattagaccaattttaatttgattacaaagaccaattcatatctcaactgtaacattaccagataatacacgtggaatgtcttacatgctatacaatatacaccaaaattttcttcgtatatgcttttagaacttgaggaagtattgcaaaagtctcattctaagataaaccggcctgtgtcttataaaaaaagaaatctgcaaaagtaagaattcaagcaaaatatatattcctcccattgcacccgaattactcattcctcaggccgaaagaaggtatatgtcgaactcgtctccgtctttgtaacctcaggattacgagatggtccagtaggaagagcaggaacaagagatgtccaaagcacagggtccaccaaggagtcaattgtattgtagttggtgagaagtggaacagacaagaagggagtcaaagggtacacatttttctgaagagatgataacccaccagtcatccccattgcggctccaagtctgtcacctccagtatcatgatttactgatttttca

SEQ ID NO: 15553 - DNA, 532 bp, Gossypium hirsutum
  Predicted polypeptide sequence is orthologous to G21
taccaattaatgatcaagaatcggcagacgtaatggagcgagcagcttgatggtagtgcggtaatcgtgggctcgagctgcatttctgcggtggggtaagtcccgagccatattctcgatttcttttttggttgtcggatttcggacacccatttgccccaactccgcattcgtacaccacggtataccggttgcttcctttccaagtctcctacagctttctttgaacctttaatagctacactgttttttgaagttttcttgtattgtttaggacccgaaacggagaatgagatggaggtggccacggtggtagtggtagagatgacggaacaagaagtaagcgggttattataatgagcatcattctcaatgtcgatatccctttccatgacagatagatagatgcctagttttttgttaaagaaagaaattctaaagttgtaggggcctttatgatttatgattctttcacccatgaattctcatttaaaaatgcatgatatgatatgataaaaaaaaaaaaaaaaaa

SEQ ID NO: 15554 - DNA, 766 bp, Gossypium hirsutum
  Predicted polypeptide sequence is orthologous to G26
ccatgaacctttctgcccagccaccacacgttaccgtgaccggtgattggcggtgagcgaagcccgttctaaaccgattaaagccacatatgccaatttcaaccccgaaatcctcacttagacttcgatttagacgaagaagatgaggactccgaaggcgaactctcaatggtaaaccctctatttttttagattcgtcgaatagattcaaaataaagtaaaaaaaaaacaagaataagagcagagacataatctacgaatcacctttggtaaactctttttgaattgatttcttttttcatatatgcgtctgttctctctattttacatcgtttcattcagttttatagccaaaataaataaaataaataaataaaaagaaatccaaatttcattgctgtcatttgttgctatttgctgtccattgcttgtggttgttttcgtttgttagtctgttgcaggtacagctagagggtggcgcgtgtggaggccattatgggggtgaagcgtgaagtcactggtggctgcttgcggcccgagggtagacggggctagggtttgctgcaagcatggtttgggcttagggtttattattcttttgtgtctgcttgtaaaattttgggcttaattttattattgggtattgggttttgtaatgggctaaggggttatagactgttttattgatttttattattttttggttttttgcatttagtttataagtctaaaggcccgggtgaaatggcctattacaatataaatc

SEQ ID NO: 15555 - DNA, 822 bp, Gossypium hirsutum
  Predicted polypeptide sequence is orthologous to G43, G46, G1419
ttttttttctgtaaaaataaaataataatttcattaaataaacaaatcaagaaacaaatacaattttaattaaataaaaaaccttaggctttggcattctctagtttatatacactaataatactcatactaatccaaaacacacacctcttcattaatccatttcttgacggccgttaacttttttccgtttatagtagatgattcaagccgtcacgtcaaccaacctttccttatttagtaaacgacaccaccatctttacataacggcgagtcctgaaatagaataaccgaacggagataaaggtgataatggaggaatactaaatattcccttcatatcttcactatcccaaaaccctttccaatttgacggcgtcaaacatactcccgtcgtcgttacgttttccgttatctcttcctttttcactactttcctctcttgttcttcttcttctctttttcttttattcgagggttgggattcagttgagttcgagtttccgatttcgagagggaaattcaaaattgctttacttccacgtagcttaaaagcagctctatcataagctttagcggcttcgatagcggtttcgaaagttccgagccaaattctagaaccttttcgattagggtctctaatttcggctgcgaactttccccatggtcgtcttcttacacccctgtaatgccttttctcgtcatgttcctcgatggctttcgtggcggtggaggttatttcaactttcgatggtggaattgtgacgttaatagaaggtcgacgttggcttagggtggattgtttatgaaactggggtcgac

SEQ ID NO: 15556 - DNA, 823 bp, Gossypium hirsutum
  Predicted polypeptide sequence is orthologous to G43, G46, G1419
gcggccgcgtcgaccgcggccgcgtcgacatgacatcttctgaagaaacattagccttggaactcattcgaaaacatcttcttactgactttgcttccatggattcttttcttgccagtcttcatcatatagtggaaaccccacaattctctcaacttcatagccccaatcagatgaaacattctactctaagccaacgccgtcctgctataaacgtcgccattcccgcaccgaaagtgaacgtaagcgacgagcagaggcattacaggggtgttaggagacgaccttggggtaaatatgcagctgaaattagagaccccaacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcaacccactctgaattaagtaaagcttgtataaaaagaaaaagagaggaagaagaagaagaagggagagtggagagtaaagtagtgaaaagagaggagaagggaagtgtgacgccgggagtatgtttaacgccgtcaaattggacggggttttgggatagtgaagatatgaagggaatattcagtatccctcccttatctccgttatctccgtttgggtattccgggcttgcggttatgtgaaagtgaaacgcttttgatgggtttttggacgccgttaactaaaatcaggaatggttggctgacgtggctagttcaagttgtatcattagtgtacattgccttttgttttatttataacattc

SEQ ID NO: 15557 - DNA, 909 bp, Gossypium hirsutum
  Predicted polypeptide sequence is orthologous to G43, G46, G1419
gaaaaaatttcaaattttttattatggaagcaagcagtgaagtaacaagtgcgcttcaatatatcaagcaatatttactcggtgagttttctccagtgggattagggagtgtttcaagtgaaaatcagtggttacctcagtcgaaacctcgagtttcgagctctggatctgaatctcatttgagctccgattcgtcttttacagtatcaaattttaattgcctcgacgatgatgatgatttctttcaattccctaccgatttccctggattccaatttgaatcaaaacctcaaattatcgatctgacgacacctaaatccctctcatcaaacgccggtgctttcgaatttgaagtcaaacctcagatcgctcaaatttcaacgacgaaacataaagtttcttcgaattcgagctctcagaatcggaaacggtcgctgaaaatctcgttgccgcataaaatggagcagattcagttcggtaaaacggatttagctcaggcggagccgaaagtctcaaattccgaagacaagaagcattatagaggagtccgacaaaggccgtgggggaagttcgcggccgaaatccgagatccgacccgacgaggttctaggatgtggctaggaaccttcgaaacggccatcgaagccgcgaaggcttacgaccgagcagctttcaagctacgtggctcgaaagcgatccttaatttccctctcgaagccgggacgtcggatacacgcgccgacgactgggagaggaagcggagcagagatgacggcgaaagagaagagaggcaagtaaaggtagtgaagagagaaaaggacgatgaggtgacaagaacgagagagaacggcgaagtacctttaacgccgtcaaattggaacggctttttgggttgggaataacgaccaa

SEQ ID NO: 15558 - DNA, 938 bp, Gossypium hirsutum
  Predicted polypeptide sequence is orthologous to G43, G46, G1419
caaacccacaaacaaaaaaaatccttatcttctcattttctctcttgttttcagtttttggatatggaaagtagcagtgaagtgtcgagcaggcttcaatatattgaacaatatttacttgatgaaaatcaatttcctcctgtgggattgtggagcttttcaaatgaaaatcaatggacaaattatccgaaatccgaggtttccacctctcaatctcactctctttactctcaaacttccacctctgattcctgtcttacagcatccaattttaatagccttgacgaagatgatttcttcaacttctctaccaatttcccaggtttcgagtctaaccaaagtgatgttttcgaatttgactccaaacctcaatttatccatctcaccacgcctaagcctctcgcttccgacgccactgcttgtgaattccaagtgaaatctcgatcttcttcgaattcgactcccaattctcagagtcgaaaaccttcgctgaaaatctcgttgccgcataaagtggagtggattcagttcgggaaaccggatttaaccgaggtaaagccgaagaattcaaataccgaagagagaagtaagcattacagaggagtccgacaaaggccgtggggaaagttcgcagccgagatccgagatcctaaccgaaaaggttcacgggtctggttgggaacttttgacgccgccatagaagccgcaaaggcttacgaccgagccgcctttaagttacgtggctcaaaagcgattcttaacttccctctcgaagctgggaagttggatgtaatcgccgctgacggagagaggaaacggagcagagacgacggcgctggggatgagagagaagttaaagccgtgaagagagtaaatgatgatgtgactaaagcgagagataacggcgatgcgcctttaacgccgtcaaattggacatc

SEQ ID NO: 15559 - DNA, 888 bp, Gossypium hirsutum
  Predicted polypeptide sequence is orthologous to G43, G46, G1419
tccccccaaggtgagtcccacatttgaaaaagctgtcaatttccatggcgatgggatagggagattttgatcttcactgtataaatagatcctcactcactcccacatttcaacttcatatccaatttcatcatatacaaattccttgtaaactttaacaatgccggctacatttgaagaatcaacaactctcgagttcattcgacaacaccttctcggtgactttgccaccgtcgatgctttcataaacaccctcgattttggcctttctcaccttcaaccccaaagccatcaactccctgaaatcttcacccatggtgtagaaccagcgccgataacaaaggagccattctgtgaagagaaaaggcattatagaggtgtacgaagaaggccatggggaaagtttgcggcggagatccgtgacccgaaccggaaagggattcgggtatggttagggacttatgatagtgatgtcgatgctgctaaggcttatgattgtgctgcgtttaaaatgaggggtcagaaagcaatactgaattttccacttgaagccggagagggaagccagccaccggcggttactaccgggaggaaaaggaggagagagaagagagtttggttgccggaaagtgacatcacatcgccgggaagtagtgaaatggcttgggaggtgaaggaagaagagggtgagcttgatgatgatgatcggaatggactgtctctcttaactagaaaacgtgttatagtgacatgttagataatgtattaaatgcccaaatgtattttataataacgtaatcaatattactaaatagtaattacgggagttagatgagatagtaaatgcttttcctcccttaaaaaaaaaaaaaaaaaaaaaaaaaaaaa

SEQ ID NO: 15560 - DNA, 761 bp, Gossypium hirsutum
  misc_feature (535)..(535): n is a, c, g, or t
  misc_feature (554)..(554): n is a, c, g, or t
  misc_feature (595)..(595): n is a, c, g, or t
  Predicted polypeptide sequence is orthologous to G129, G136, G140, G146
attaaatatatactctcaaaacactttgctttctttgggattcgtgattttccgaaagctgaattggccggaactcttaccaaaatacctcaggtacaagtgatcaaagagaatgggaagaggaaaaatagagataaagaggatcgaaaacacaacaaatcgtcaggttaccttttgcaaacgcaggaatggcctgctgaagaaagcttacgaactgtcagtcctctgtgatgctgaagttgctctcattgtcttctccagtcgaggccgtctgtatgagtactccaacaacaacataagatcaacaatagacaggtacaagaaggcttgctcagatacttctaacacaaacactgttactgaaatcaatgctcagtattatcaacaagaatcagccaagttgagacagcagattcaaatgttacagaattctaacaggcacctaatgggagattccttgagttccttaactgtgaaagagttaaagcaggtaaaaaacaggcttgaaagaagaattactaggatcaggtccaanaaacacgaaatgctactanctgaaataaagtttttgcagaaaagggaaatcgaattgganaatgaaagtgtttgtctccgaaccaagattgcagaaattgagaagcttcagcaggcaaacatggtgactggacctgagcttaatgctattcaagctttagcttctcgcaatttctttagccccaatgtcattgagcatccatctgcttactcccatctctctgact

SEQ ID NO: 15561 - DNA, 704 bp, Gossypium hirsutum
  Predicted polypeptide sequence is orthologous to G129, G136, G140, G146
aatacaaaaataaacctttcctgcaataaaacagttaaaaaggagtccagtgctgaaacctaagttccttacattcatcataatcaacaactaggctttcaactgtttataaaccatatataaatatatatatatatacttgcatggcttataagatatatatatatgcttaaccagagataaagttggtagaacattagaggctgctgcttgcatgtcagcttgaatagatggaggtggaagagagaagcttatacaagttgaagaggagtttggtcttggttggagtaatcattattactgggttccagcaggtttactggcagaaagttgcgattgtaggaggaggctgcttgcatcagctggtttgattgttgttgcgctctttcattttcagctatctgcatccatacagccatgcatctattttaatcatgatcaacacccaacatctccatctatagttgaaattcattaggcagagaggcttacttttgctcgcaggtacatgttatcgttctgcagttcaacttcctagaaattatatacccattttacagctgttaataattaagacgacgacctttatgctatcactcatatcttgtatagtgtctaacaaactaaagattctgaagatgaaactacaatggggtttgaggatatcaaagtatacaatcccggacgcgtgggcggacgcgtgg

SEQ ID NO: 15562 - DNA, 763 bp, Gossypium hirsutum
  Predicted polypeptide sequence is orthologous to G129, G136, G140, G146
tcaagttaggaagcatggtgtaccccaatgaatcccttgaagactctccccagaagaaaatggggagaggaaagatcgagatcaagcggatcgaaaacacgacgaaccgccaagttaccttttgtaagaggcgcaatggtttgctcaaaaaggcttatgagctatcggttctttgtgatgctgaggttgctttggttgccttctctagccgtggtcgactctatgagtatgctaacaatagtgttaaagcaacaattgagaggtataaaaaggcttctgattcctccaatactggatcagttgctgaagttaatgctcagttctatcagcaagaagctgacaaactccgaaatcaaatccggaatttgcagaatgcaaacaggcatatgctgggagagtccatagggggattgcctatgaaagagcttaagagcttggagagtcgtttagaaaaaggaattagcagaatccgttccaaaaagaatgagctgttgtttgctgaaattgagtatatgcagaaaagggaaattgacttgcataacaataaccaacttcttcgagccaagatagctgagaacgagaggaagcagcagagcatgaatttgatgcccggaggttcaagtgctaacttcgaggccctacattctcaaccatatgactctcggaactacttccaagtcgatgctttacaacccgccaccaattattataaccctcagctgcagcaagaccagatagctcttcactagtctaatgttatggg

SEQ ID NO: 15563 - DNA, 660 bp, Gossypium hirsutum
  Predicted polypeptide sequence is orthologous to G129, G136, G140, G146
atgatcacgcgtgcggcgtctaactatgatcccgggtgaggaatcggacgaggaacctttggccttctttggaattgaattttccgaaagctgaagtggccggaactgtggcctaacctcagtaggaatatataaaagggtgaagatgggaagaggaaagatagagataaagaggatcgagaacaccacgaatcgtcaggttacgttttgcaagcgcaggaatgggctgctgaagaaagcatacgagctgtcagtcctttgtgatgcagaagttgctcttatcgtcttctccacccgtggccgcctctacgagtactccaacaacaacataagatcaacaatagagaggtacaagaaggcatgttccggtacctcaaacacaaataccgtcacggaaatcaatgctcagtattatcaacaagaatcagccaagttgaggcagcagattcaaatgctacagaattctagcaggcatctaatgggagattcgttgagttccttgacagtgaaggagttaaagcagctagagaatagacttgaacgagggattactagaatcagatcaaagaagcacgaaatgctgctagctgaaattgaatatattcagaaaagggaagttgagctggaaaatgaaagtgtatgtctccgagctaagattgc

SEQ ID NO: 15564 - DNA, 565 bp, Gossypium hirsutum
  Predicted polypeptide sequence is orthologous to G131, G135, G155
ggataaagcattacaagagcagaacaatgtccttgcaaagaaggtaaaggaaaaggagaaggaaatggcccatcagccacaacaaaacaattgccaagattcatcctcaatgcttccacaaccactgcagtccttgaacaccagtgacacaaatgaagcaaggagcaatggaagagaagagggtaatcctagtccagcacaacaccgcaactccaatgtgctattgccaccgtggatgattcctcgtattgagtaattaaaacaagtaaaagtctcttctctaattagtatgctatttaatgcatttacatataaaatatgtatatatgtgtttatatatgcatgcagcaaactgatgtgtgacctgcatctatgtgtaatcccagtgatgtaattattaaggagggttttgttggtacggaattataatataatgtaaaatatgaatttaactacgaaaccatattatcagttcagcaggaaagatgtatttttatctttattaaatgctatccttttgaaattacatttccaatttagagaacaaaaaaaaaaaaaaaaaaaa

SEQ ID NO: 15565 - DNA, 886 bp, Gossypium hirsutum
  Predicted polypeptide sequence is orthologous to G137, G145
ccctaacacgcgtccgaataaaattactaaaaagagagtcttctcttgtttttccatatatttgctttgaaattcatgaatgaaattttttttacaaaaagggttttctcttgttttttttcatatatttgtttagaaattcatgaatgaaattattaaaataatgggttctctctctctcttttacctttcttttcagttcttaaatcactatataaaacatggccatcttccatctttgttaagcttcttagggttttatttactcttttcagctgaaaatctagtcttttttttaatctttgttgtgattgtgaaaagtttaaaaaaaaaaggagagcaagtttgaaaataaaacagacaaaaacccattggatctttgtaataaaagcaacaagctcaatgttttcttctgatccaatcaagtagtttcagatgtcatttatcaaatcaagcagcgaagacaaacaagacattttacatgatcaaaacattggagaggtaccaaaaatgcaactatggagctcctgagccaaatgtgtcatcgagggaggctgctttggaattaagcagtcggcaggaatatttgaagcttaaagcacgttacgatgccttacaaaggtcccaaaggaatttactgggagaagatttgggacctttgagcagcaaggaactcgagtcacttgagaaacagcttgattcatcattgaagctaattagatcgacgcggacccaatacatgcttgatcagctcaatgatcttcaaagaaaggaacatcttcttaatgaagccaataagaccctaaaacaaaggttggtggaagggtatcaagtaaattcgttacaattgaatccaaatgcaacggaagacgtcggctatggccgt

SEQ ID NO: 15566 - DNA, 962 bp, Gossypium hirsutum
  Predicted polypeptide sequence is orthologous to G137, G145
gtttgttggggggggcgggggggttaattctgattacttgatggatgaagttgttagcgaaagcgtatcatccatgacagaataaatagagagaaaagcaagaagaagaacaaaagtgttaaagagagagtgtttgggggtattgcaaagataatatttttattggggaaaaaaagaatggggagaggtagggttgagttgaagagaattgagaacaagattaacaggcaagtaacttttgctaagagaaggaatgggcttttgaagaaagcctatgagctttccgttctttgtgatgcagaggttgctctcatcatcttctccaataggggaaaactgtacgagttttgcagtagttcaagcatgatgaaaacattggagaggtaccagaagtgcagccatggagcaccagagacaaatgtttcaactagggaggctctggagctaagcagccagcaggaatatctgaagcttaaagcacgttatgaagccttacaaaggtcccaaaggaatttacttggagaagatctggggcctttgagcagcaaagagcttgagtcacttgagaggcagcttgattcttcattaaagctgataagatcaacgcggacccaatacatgcttgatcagctcactgatctgcaacgaaaggaacatctacttaatgaagctaataagagtctaaaacaaaggttgatggaaggctaccaagtacattcactccagctgaatccaaatgccgatgacgtcggctacggccgacaaccaacccatcagcctcacggtgatgtcttcttcatccattggactgcgagccaacgttacaaatcggatatcagcccgatacgatatcgcggtcacgggtgcccgagtgtgatattacatgacgggatggctaccatgactatgacacataagaaatagagcaaagcatgcagtgcaatgcatgatgcatgcatgca

SEQ ID NO: 15567 - DNA, 527 bp, Gossypium hirsutum
  Predicted polypeptide sequence is orthologous to G142, G148
ataagtggtgctggagagaatagagaacaaaatcatcgccaagtaaccttctccaagagaaggaacggtttacttaagaagtcctacgagttgtcggtgctttgcgatgctgaggttgctctcatcatcttttccagtcgaggcaagctctctgaatttgccagtaatataagtgtgccaacaaccctggaaaaatactggcagcatcgatacagctccccagtcgatattcctctggacgaaacgcagacattgtatcaagaggtattgaggttaaaggcaaaatatgaatctctccagcgttcgcaaaggcatcttcttggagaagagcttgagtcacttaccgtgaaagagctctatagggcacaacacaaaataaaaattaattaccagcactcgcacagacgtagagggggaggggggagcaaagagaaaaaaaaagagaaacagaggaaggggagaaggagaagaagaagaaagcagaaacatcacataaaaaaaaaaaaccaaaaaaaaaaaaagaaacc

SEQ ID NO: 15568 - DNA, 1224 bp, Gossypium hirsutum
  Predicted polypeptide sequence is orthologous to G151
tatgggtagggggaaaatagagattaagagaatagagaatgctaatagcaggcaagtcacattctccaagagacgtgctggcttgctcaagaaggctaaggaactcgccattctctgtgatgctgaggttgctgtcatcattttctccaataccggcaagctctttgagttttccagctctggcatgaataaaacaatttctagatacaagtctgctcaaggttctccagagattgctcaagtggaacataaagcagagaagcaagactctaaggaggcagaccatctgaaggatgaaatagcgaagctacaaatgaaacagttacagctgctgggtaagaacttgaccagcatgagcctgaaagagcttcagctcctagaacagcaacttaatgaagggttgttatcagtgaaggagaagaaggaacaattgctcatgcaacaattagagcaatcaagattacaggagcagcgagctatgcttgagaatgaaactttacgcagacaggttgaggagctacgaggtttctttccaacaactgatcacccgatccaaccctatcttgaatgctatcctgttgaaaggaagaattctctcatgagccacagcattcccagtccagatttgacctgtaattgcactgttgaaaagggagattcagacactaccttgtatttggggttgccaagtgattatcacaagagaaagaaacctgaaatagaaagccactccaatgagtcagagagccagttggggctgctgtgaccctttccttcaaggtatttgctttgccttcaataggggatggcagaaactgagatatggtacagttgagtctagtttggtagtttctcaaagcaccagttgtccaaatcaatgaaggcaacacagtgaaagtatagatgtttctttgcaggatgaagagctaagttttctgctgatggatatagtttagtcgtgacagttattgggaaaaagggtgagggtattgcaaaaatatgctttactttttttttttctttttttttttggggcgtagctttgctttcccttgcaactttctttacctattaaattagtgaggttgcagttcatgtttcatttggtgactgagtaaatcttgttgttgacatatcttttttttcttctttctgctacttagaaagttgtaaaattttccttgattccccgcaagttttgtgaaaaaaaaaaaaaaaaaaaaa

SEQ ID NO: 15569 - DNA, 1002 bp, Gossypium hirsutum
  Predicted polypeptide sequence is orthologous to G156
cgctagcttcaccaaaagagctgcagatttacgagagcaaagcaaatagtttccttaactaggtagagattataaaggcaaagaaaagagataattatgggacgtggaaagataccgatcaagaggattgagaaccagacgactaggcaagttacgttttcgaagcgacgagctgggttattgaagaagacccatgagttgtctgtgctttgtgacgctcagattgggctcatcatcttctccactaccggcaagatgtgccagtattgcactgagggttacagaatggagcaaatcatagaaaggtatcagaaggtcactggaacttgcattcctgagcatgacaatcgggaacatttgtacaatgaattggcagtgttgaggaaagaaactcgtcgccttcaactaagcatgcgacgctacactggtgaagacatgagttctataccattcgaagagctcgatcaacttgaacacgaactcgaacgctccgtcatcaaggtccgagagcgaaagaatgagctcttgcaacaacaactggataacctacgtagaaaggagagaatactagaggaagaaaacagcaatatgtaccgctgggtgcaggaacaccgagcggcgatcgagtatcagcagggaggaatggaagctaagccagtggagcatcagcaagttgtggatcaattctctttctttggagaaccaagcagtgtgcttcagcttgctaccattcctcaacagttccaatcctatcagctccagcttgctcagcccaaccttcaagattctaatgtctagtattgtgccattgcagctatgattttctgagaagaaaagaagatggtatattacatagacagagagtcagcattattgggatcgaatcttgtgttcaaattatctattgaaaacatatttctgatattatttttgtttaagggagtgtgctatatgctttcatgtttctgaagttaaaacattcaaactcacatcatacccttt

SEQ ID NO: 15570 - DNA, 845 bp, Gossypium hirsutum
  Predicted polypeptide sequence is orthologous to G184, G186, G916
gcggccgcgtcgacctccagatgcacctcgtaactttaatgcaacaacatcaaagacatgagattaatgaagtgaaggaacaagaagcgagtctgattgtgcctagacaattcatggatctacgcccatcgggcatagctgaaaccgatcatgagccgtctcattcttcctcagaagaaagaacgccttcagggtcgcctcccaacaacgttcaagttacatcacctaaggattgtttgaaaaccaaaaacccagtttctcagttggatcaagagagttctagtttccgggatggtaagagaacaggtagggaagaaagcccagaatctgaaaacttgggtcgtaacaaactccaaaagatgaatccatcaaagccaatcgatcaagccactgaggctaccatgagaaaagctcgtgtttcggttcgagctcgatcagaggctcccatgataagcgacggatgccaatggagaaaatacggacaaaagatggcgaaagggaatccctgtcctcgagcttattaccgatgtacgatggcagttggttgtcctgttaggaaacaagttcaacgctgcgcggaagatcgaacgatcttgataaccacttacgaaggcaaccataatcacccgcttcctccagctgcaatggcaatggcgtcgactacggcctcagcggctaccatgttgctgtcggggtcgatgcatagtggggatgggatgatgaaccctaatttgtttccaagggcaacgcttccatgttcttcaatggcgacaatctcagcttcggctccattcccgactgtaacattagaccttactcactcacccaacgctctacagttccaa

SEQ ID NO: 15571 - DNA, 821 bp, Gossypium hirsutum
  Predicted polypeptide sequence is orthologous to G184
tactcaagcttgagagtggctcactgaagcaacagaggtcatagcatgttgattacccacatactcggggacgtagggagaatacttatgaagcagtatgaaggacttgctttggctgattctgctatgcttcagcttcggcaagctctttctgcttccgaatcgtgacctggcacgttcttgtggagtggcctttttcttcatcgcagaacaagcaaaacagcctcctagggtggtcttcgtatcttcctccgaagcttctgtcccctctgcctcttggagctggtggcctgaaggaactttgttgcggccctgatgaaagggaaatgttcccttgggcaatttcaataatgttttagtgattaagtgcccaacacagttaattaagttcttatgtgccaagtaaagtgagaagtacaaatcaaagaaaaaggtacgtttctagacttagtacaatgttttgagtactaatatgttttgtctaagtgctagaaacagtgagaaaaaattggaaaaagagttggctatgtgcagcaaactccagctcggcttggcacaccggactgtctggtgcgccaggctggtccgcgtgaactcgccgctctcgggactcgacggcggcgtacgactaaaaatcaccagaccgtccggtggtgcacctgactgttcggtgagtcatccgctgcgaactcgtcgccctcgagaaaagcaaaggggcgacgtggctataattcaccggactgtccggtggtgcaccggactatccggttagccaatggtcgcctgcgccaacggtcggccgcgccatctttgcttgacac

SEQ ID NO: 15572 - DNA, 452 bp, Gossypium hirsutum
  Predicted polypeptide sequence is orthologous to G189
tttttttttttggcattggaaactttaatttggaattgaattttcaatccctcaataattgcaaaatctaataccaaatctaacatctttttcttcccttttgatctcaaatggtctttcaattaaagaaagcacaaagcatataatttacaaggaaataaacgagcagatttgataatatcctcaaatcccgaacataaacagtaaaatcaacattaataatagaaaaaaatattgttcatctatgaagattcaagtatggtggtttctgcaacagatagagaatggttatgatcaccttcatatgtaactattagcattgaagcatcatctaaagctctttccacatgttttctagcaggacatcctcttacgctactgcacttatagtatccccttggatgtggtgaacccttgattggtttttgaccatattttctccatgaataatc

SEQ ID NO: 15573 - DNA, 802 bp, Gossypium hirsutum
  Predicted polypeptide sequence is orthologous to G189
aataaaacagatcaaacgacaatttatttattgaaaataggtcgaaaggtacagaaaactgacaaagcacatgaattagttcatggcatggatttattgtttaataaaccttctgaataaacctagaaaacaagtcacaggtagacaaacatgaagttatgccaacaatcaatcctattaaagggtcatatataaacatcagagagataacttgcaataagagtaaaaaacatgcttttttactttaaaatgacagtgcgaaatcttgctagaaaacctaccagacctatttttttgatatcggtagtaccaccatagagtgtagccatcctcttctttgagtttcgagtgcgaaaatggttgccatatcaggaagtcaggggtggtgggattttctgttcccgtcatcatcccttacagctgaactttgaagagattcggtcagcaagttgggtgaatatgagttgtatcttccagcagagttgttttgtggtgtaggaattggacctataattgcaaccacggcatgctgaacgagaaaagacattaccagctgaaggatatgaagaaacctaaaagttgccaggaaaaaatacacacaactaatgattgagaattgcacctgggctttggaggtaccgccttgtatcacatgcagtaagtaatgcgcagagtgtacaatccatgtgatgcaaatagttacactgtcaggccaagccaccattattaagattgaaaaatcggaaaatgatactcggttaaagctggcatggctatcttccgaacccaagtgactttaaac

SEQ ID NO: 15574 - DNA, 883 bp, Gossypium hirsutum
  Predicted polypeptide sequence is orthologous to G192
ttgagatccccaatttatcaaccaaaaatacctcctttttttttttatcttcttcttgtttatatatataataatcgcaaaagcccactcaaatacaaactgcctccttttctctcattgcaaccattaaaaagtcagcgcctttttttgtcttttacattctgttctaacgtttccttcgcagaggaggaggcagccgaagatacaggggtgtgttcatggatgtggattgggatttgcatgcggtggtgaggggctgcgccaccgttacaacaaccaccagcagcagcggcggcggctgcggtggtgttgctgcaaacagttctttaatggcggatttataccctcaatcccgtttttcttcgtttggtagccaagaagaaccttttcagggtcaattttcgtgttttccgaaccagttcgaagctaagaacgccatggaggaattgcataagctttacaagcctttcttccccaaatctcaacctcagacaaaacaacagcaagaacatcaacaagtaaagcctaagctgtctcaagttggctctgttacaacaactagtagcagcacgtctacgaacaattctcgatctaaaagaagaaagaatcagctgaaaagggtttgccatgtgccgccggaaggtctctcttcagatgtgtgggcatggagaaaatatggtcaaaaacccatcaagggatctccttatccaaggggatattacagatgtagtagctcaaaggggtgtttggccaggaaacaagtggaacgacacagatccgacccgaatatgttcatagttacgtacacagccgagcacaaccaccctgctccaacgcatcggaattcactcgctggcagcactcgccagaagcctttcactcc

SEQ ID NO: 15575 - DNA, 878 bp, Gossypium hirsutum
  Predicted polypeptide sequence is orthologous to G194
tgcatacattcatggagagaaaagaggctttaaaaatggaagactatgtaatgggaaactcaaactcatcgttttgtgattacacaggcaatggtttcccattacaaagtgtatttgattcatgtagtgaagatgataataataatttttcattagggtttatggagttgttgggtgttcaagactttacctgtccttcatttgatgtggctcaacaagttccagtttcgaccaagatggagtcacctgagcagggttttaatctgcctgctacaccttactcttcctcggtttcatcagcttcgagtgaagccatcaatgatgaacctgttaaagtagaagacgaccaagaagaagaagatgaccaacaaaaaaacaagaaacagtgagtatactttctttctgttcttttttaagtttaacccccttttctcacaagacaaagatgggttttttatgtttatgatggggttttgggtgtgtaggttgaaagtgaagaagacaaaccagaagagacagagagagccgagattcgcgttcatgacaaagagcgaggttgatcatctggaagatgggtacagatggagaaagtacggccaaaaagctgttaaaaacagcccttttcctaggagttattatcgttgcaccagcacctcatgtaatgtgaaaaagagagtggagagatcttttaccgacccaagcattgtggtcaccacttacgaaggccaacacactcaccccagcccactcatgcctcggccgaatctcgtcggttctactataaattccggcatctccgccggagccgcagcagctttcagtgtgccaatgcaaaggaatactcagtctcactactactaccagcagcagcagcagca

SEQ ID NO: 15576 - DNA, 1064 bp, Gossypium hirsutum
  Predicted polypeptide sequence is orthologous to G196
ttttttttttttttttttttttttaaaaatagaagatgctaaactagaaccattagtactggaaggcataatcacttcattatgagcattttaactacttttatttttttttcctgagacccataaacactactgatcaagaagggacaacaggaattccttcatcccaaaacttgcttcgcatcatcaaacttgtgaaagctgaagatatgggtagttcttcaagctcatcaaagaaatcattttcttctgattttggtattgaagatgttgttatatgaaggcaagacagtggctcttcatccaacagaaaccccagtgtgtcatgggttttctctagattcccgttgaagggatcttcttggctaatgatgttattctggggaaaacttaatggggattgtaaatagtgaaaatgctgctcttcacttgcatcttcatctgtactgctcgttttgttttgctccttttttacttcttctggctctttttctgaaacctccgggagctgcttcagcgtagtagttgggggcttatcatcatcactatgggtggtttggggttctttaggggactgttttaggtcggcgcagtggagatcaggacctggatggttatgactagaggtgtaagtgatgataagcatcgaggcatctgttttgcatctttccacttgctttttggctgaacaaccttttgatgtgctacatctgtaatagcctctgggataaggagatcctttgataggtttttgcccatattttctccaggaccataaatcagaaggaggcccctcgctctttagctttccaccattttctcctaccttcagtgtaacaacaatcttctcaaccaccttccttcttttggatgactgagtatcagttgggttgagttcggaatcatctgaagccaattttggagagacagaatcgtccatcaccacttctagtcataggaacagataaaaatcaaaaggattaaagatctccaaccaattgattgtgagaaagataaaaagggagttaggcaacacgacataaaaccccgcaacttgcttcttc

SEQ ID NO: 15577 - DNA, 620 bp, Gossypium hirsutum
  Predicted polypeptide sequence is orthologous to G197, G255, G664
ctgagattttagggttaaattagtgaggagagaatgaggaagccttgctgtgataagcaagacacaaataaaggggcatggtctaagcaagaagatgagaagctcatcaattacattcgaattcatggcgaaggttgctggcgtactctccctcaggctgcagggctccttcgatgcggtaaaagttgtaggctgagatggataaattatctaaggcctgaccttaaaagaggcaactttactgaagatgaagaggatcttattatcaagcttcatgcactcttaggcaaccggtggtcgttgatagccggaagactacctggaagaaccgacaacgaggtgaagaattattggaactctcatctaagaaggaagcttataaacatggggatcgatcccaataaccatcgtttgatcactcacaatcatcttcctcgcccacatgatcccaatagtggtgcaagtataatatctcctgcttcaaaagttccagtcaccgataatactaatattcatccaccggagaaatccagaggtgacaatgatcaagtttcggatgctgcaagttccctggaggatcataagctccctgatttgaacctcgatctcaccatcagtgg

SEQ ID NO: 15578 - DNA, 1145 bp, Gossypium hirsutum
  Predicted polypeptide sequence is orthologous to G197, G255, G664
tgcaaacgtaggctactagtgctgctattttccacaagttgaaaaaggtttctttgtgttactgaattatgggaaggtctccttgttgtgagaaagctcatacgaacaaaggtgcgtggactaaagaagaagatgatcgcctcatagcttacatccgagcccatggtgaaggttgctggcgttcactccctaaagctgctggccttctccgctgtggcaaaagttgtagacttcgttggatcaattacttaagacctgatcttaaacgtggcaatttcactgaagaagaagatgagctcattatcaagctgcacagccttcttggtaacaagtggtctcttatagcggggagattaccaggaagaacagataatgagattaagaattactggaacacgcatataagaaggaagctattgagcagaggtattgatccagcaactcacaggccactcaatgaggcttctcaggatgtaacaacaatatctttcagtggtgccaaagaagagaaagagaagattaatactaacagtaataataaccctattggatttatcaccaaagatgaaaagaaaatcccagttcaagaaaggtgtccagacttgaatttggacctcagaattagccctccttattaccagcaaacccaaccagagtcattcaaaactggaggaagaactctttgttttatttgcagcttgggagttaaaaacagcaaagattgcacttgcagcaccatcactactgctgcaggtagcagcagcagcagcagtagccacagcaacagcaacaacagcagtggttatgatttcttaggcttgaaatctggtatcttggaatatagaagtttggaaatgaaataataaagagtgaaaatttggatttttaactatgtagttcaactcccccccccccccgaaaaaaaatattggagagaaatgacaaggagatcattgttattagttttaaaatctctttcatttctctttttttatttctaatttgtatgattattatatcacattatatatgcatatattagtagaatagatgatcattgttgttggtgagtgtttatgcatttattgagttataaaaccttcttcttctttcaaaaaaaaaaaaaaaaaaaaaaaaaaaaaaaa

SEQ ID NO: 15579 - DNA, 376 bp, Gossypium hirsutum
  Predicted polypeptide sequence is orthologous to G198
gcggccgcgtcgacactcaattgaattccaactcaacatacgtcaacaatagcggcattgaagaagaaccagatagctactgcagcgacattttaaagtttgaaatcagagatagtttggatgttaatgatttcatgtaggtccaaaatcaaaactcacaaaaaggagtttccatttatgtgctttcatttttcttttttggactaagtcgggtgggggggtgtcgatacttgtaaaattttctacaaataatttattttgttgtattttttaccctacggcaagatcctaccatttcctcctcctttaaaaaaaaaaaagttatttcaatatcatggaaaggttccattattaaaaaaaaagtcgacgcggccgc

SEQ ID NO: 15580 - DNA, 847 bp, Gossypium hirsutum
  misc_feature (780)..(780): n is a, c, g, or t
  Predicted polypeptide sequence is orthologous to G200
ttttttttttttttttttttttttatgggatacgatcttattttattttattaataacttaaaaagagcgtactcatctcatgtcttgtccaagtcatgagcaaatttatggttgcaaacaaataaatacatacatatgaaaactcttcagagctcataattctagttaagaacctgatcgcttaaaccgtaaatattaggttcattggaagtcactggtttggttcagatccaagctgtacggcaacccaaacgttgtcactcattggcagaacagtgctacctgcaggaaacttcatgttcggtacccgtggacgaactatgatcctgttgcaagatatgctactcatttcaacatgctgcttcattgaatcctcaactaaatttgttgtcacccagtgattagacggaatattagctgttgaggggttatcttccggcagaggttgatcagacaaaatcagtgaggatggactactttcccaatcagtagtcatctctggttgtgggaattgagctgagtgatgatccataaatgttacattaactccatcatcctgccgatctgcccctaaagttgagcttgaattaagcaatgaaccagatttggatccaagattttgttcagtaccagcattgacatttgttggcgagtgggaagatgagaccacatgcacttcctggtcatggtaggcccggatttatgtttgttggaaccttatttgacttgcactcttttaacctcaatgtaagccactttttgctgccaaaaacctcacntcgctttttggaacctcgctccctctgtcagtggaaaggcttctcctttcacctcaccactgaaaat

SEQ ID NO: 15581 - DNA, 878 bp, Gossypium hirsutum
  Predicted polypeptide sequence is orthologous to G207, G227, G230, G242
gcggccgcctctactttttttttagtggtaaatgtcaatcttaatttaatgcctggagcacaggccatattcattcatgaaacctgacatttgttcaaagttcttttgccctttaaagaaccaaggaaaagaaacaaagatcacccatattaacaccaagacaaatggaaaacctccccccaaactagaccataaaaaacataaaacacattggcttaatcttaattagcctttttctcttttggtcttaatgaaacgctgatgtctcagctgataacatggagctcatatattctctaacctctcttgctatcacatctctcatcacatcccaaaactctgccggcaccctttcctctctcctcctctccgccaccaccaccgcacttctactactaactccactaccaggcggcgctagagtcaacgccgtcaacgcttcctcttctatcatcacttccgtagatcccaatgcacaatgatcgccaccatccattggctgatgagtaacccgtaagatctgttgctgatgttcttgttgctgttgctgttgatgatgatgttgcccttcccttgccctcctcttcaacgtcgagttccaatggtttttcacagcattatcagtccttcccggaagcaatctagcaatggtggcccacctgttaccataccgagcatgagcggccaagatggtatcatcctcagcttgggaaaacggacggtgctcaacattggggctaagctggttacaccatctaagcctgcaagatttccctgatcgaccctttatatatcggcttatcaaagaccagtttctaagcccatatctctccactagtcgagtcaaaatcctatcttcctcagcactccaaggacct

SEQ ID NO: 15582 - DNA, 848 bp, Gossypium hirsutum
  Predicted polypeptide sequence is orthologous to G207, G227, G230, G242
gcggccgcgtcgacgcttcttcgatattttttttcttcacctccattgacaaacaaactgagatctctgtttatatttcgaaactgttagtaacaaagcaatggatcaagatattgatcgtgtgaagggaccttggggacccgaggaggatgagtcattgcgtaagctggttcagctccatggtccgagaaactggtcgttgatatcgaggtcaatccccggccgatcggggaaatcatgcaggctgcggtggtgcaaccagttgtctcctgaagtcgcgcaccgtcctttcacggcggaggaagatgagatcatcatcaaagcccacgccaagttcggcaacaagtgggccaccatagcgagactcctcaacggtcgtacggacaacgcggttaagaaccattggaactcgacgttgaagcgaagacgatcggcggaagatggcgattcggttcaggaatcggagagacggtccagcaagtttccgagatccggaagcatcagcaacccgggaagtccttccggctccgacgtcagcgatttgggattgagcgtagccgaatcgacgccgcactctcgcgtttcgaccgcgcttaccctcggacgttcttggagcgacgagttggtcgagttgaacaacgataactcgtgtacggataaagagtcgggctcagtagcggaaaaagcacgataacgggacgaaaacggcgtcgttgggtacggaactattggccgcaatgcaggagatgattaagaaagaagtgagagattgcatggcggagtttggttttcacaaccaatgctggggttaacgagcgattaattttaaaattagcgaaaaccattaa

SEQ ID NO: 15583 - DNA, 902 bp, Gossypium hirsutum
  Predicted polypeptide sequence is orthologous to G207, G227, G230, G242
ccccgttgtaaccttcccccccctcctccgccgcagcattctcctctgtacagatatgaaattagcttagattaaaatttctttggggggttttggggttttcgtctttgtgatcagttcttttttttccttttaaattttccgatggcttctacgaggaaagatatggatcggatcaaaggtccatggagtccagaagaagatgaagctttacaacgtttagtacaaacgtacggaccaaggaattggactttgataagcaaatcaattccgggtcgatccgggaaatcatgtcggttacgatggtgtaaccagctttcaccggaagttgaacaccggccttttacccccgaagaagatgatactataatccgagcccatgctcgagtcggtaacaaatgggctaccatagctcgtttactcaacggccgtaccgataacgccattaaaaatcactggaactcgacgttaaagcgaaagtgcttgtcgatgaccgaaggttttaacgacgattcccctcagccgcttaaacgatccgccagtctcggaaccggcaatccaagtagtccatcggggtccgatttgagtgactcgagtttaccagctccctcaccggctttcaaaacgggttctttagtccctttgagtcaacatgttgaaacagcttcatcggcaacggacccacctactttactcagcctctcgttacccggttctgactttaccgaacctgtttctccacccggattcaacccgacccaagtgaccacacaggcttcggcaccggtcccagctccggtggagaagcagtttttcagtgccgagttttttgcagtaatgaaagagatgataagaaaagaagtgaggagttacatggcggggattgagcaaaatgagctttg

SEQ ID NO: 15584 - DNA, 939 bp, Gossypium hirsutum
  Predicted polypeptide sequence is orthologous to G207, G227, G230, G242
aaaaaaaacacacacacacacacacacacatccaaagaacccaagtccttccctattgcatgcctttcaatttgatttcatggatgtaacaagcacaccaaatagaaaagaaatggatcggatcaaaggtccatggagccccgaagaagatgacttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcatcttcttacgtgtacaagccgatcccaaggaccggcggtgttaacgttgatgtaaatgttacgccagctggagtggaagcggcatcatcttccaacgatccaccgacctcactgagtctgtctttaccgggggtggagtcatgtgaggtggtgtcaacccagccaataacggagtcaactcagaatcggagtgaagaaaggggaggtgggggtgatgggtttcagtgcggagtttatggcggtgatgcaagagatgataagggttgaggtgaggaattacatgacgcagatgcagcaacagcagcagcagcaaacggcgcagttccaggaggagcgggaat

SEQ ID NO: 15585 - DNA, 962 bp, Gossypium hirsutum
  Predicted polypeptide sequence is orthologous to G207, G227, G230, G242
gaaaaagccaaaaacccgatattatatccaaaagaaaccaaaattttatttgcatgcttttaaatttgatttcatggctgtaacaagcacatcaaacagaaaagaaatggatcggatcaaaggtccatggagccccgaagaagatgatttgcttcaaaaactagtccaaaaatatggacctagaaattggtctttgatcagcaaatcgatcccgggtcggtccgggaagtcctgtcggctccgatggtgcaaccaactgtctccgcaagttgagcatcgggccttcacccccgaggaagacgagaccatcatcagagctcatgcccgatttggtaacaagtgggccacaatagcccgactcctcaacggtcgtacggacaacgccattaaaaaccactggaactcaacgctaaaacgtaagtgcttgtcggttggggaagagagtaatttcattacacatggtgggtatgacggtaatttgggaggggaagggaagcaacaaccgttgaaaagatcagttagtgctgggctttacatgagcccggggagcccatctgggtccgatttgagcgattccagcgtccccgttttatcatcttcacacgtgtacaagcccatcccgaggaccggcggagtcagcgttgacgtcaatgttatgccattacctggggtcgaagcggcggcgtcttcttctaacgatccaccgacttcactgagtttgtctttacctggggctgaatcgtatgagttgtcagtttcaaccctcccagttaccgagtctactcagacgaggaacgaagcaaaaaatgatggaaagggaggcgaggtgatggggttcagtgcggagtttatggcggtgatgcaagaaatgataagaatggaggtgagagattacatggttcagatgcaacagcaaaacggtggcgtttcgagagagagggaatggggatgtgtttggatgc

SEQ ID NO: 15586 - DNA, 1006 bp, Gossypium hirsutum
  Predicted polypeptide sequence is orthologous to G208
taacaccgttattctttctctattctacctgatttgatttgatttgattttgtaactgatgggacgatcaccttgttgtgaaaaggctcataccaacaaaggtgcctggaccaaagaggaagatcaacgcctcatcaactacatccgtgtccatggtgaaggctgctggcgttccctccccaaagctgctgggctgcttagatgtggtaagagttgcagattaagatggataaactacttgaggcctgatcttaagagaggaaatttcactgaagaagaagatgagcttatcatcaagcttcacagtttacttggaaacaaatggtcattgattgctggaagattaccaggaagaacagataatgagataaagaactactggaacacacacatcaaaagaaagcttataagcagaggaattgatccacaaactcatcgtcctctcaatcaaacggccaataccaacacagtcacagcccccaccgaattggatttcagaaactcgcccacatccgtttccaaatccagttccatcaaaaacccgtctctggatttcaattacaatgaatttcaattcaagtccaacacagattcccttgaagaacccaactgtacagccagcagtggcatgactacagatgaagagcaacaagaacagctgcacaagaagcagcaatacggtccgagcaatgggcaagacataaatttggagctgtcgattgggattgtttcagctgactcatctcgggtatcaaatgccaactcggccgagtcgaaaccaaaggtagataacaacaatttccagtttcttgaacaagctatggtggctaaggcggtatgtttgtgttggcaattaggttttggaacaagtgaaatttgtaggaactgtcaaaattcaaattcaaatggcttctatagttattgtagacccttggattcatagggtcatctttttcttctttctttctgtttttaggagataaattaatgcttaattattaaaaaa

SEQ ID NO: 15587 - DNA, 1151 bp, Gossypium hirsutum
  Predicted polypeptide sequence is orthologous to G208
cggattttctttccccgtgtttggttgcacagaaagtgagagaaagttttacttttgattttgaaactccgatgagaaaaccttgctgcgataaacaaggcaccaacaagggagcctggtccaagcaagaagatcaaaagctcattgattatatacgtattcatggtgaaggctgttggcgttccctccccaaagctgcaggtttgcaccgttgcggtaaaagttgcaggctgagatggataaattacttaagaccagatatcaaacgtggtaactttgctcaagacgaagaggacttaattatcaaactccatgctctccttggtaaccggtggtcactgatagctggtagattaccaggaagaacagataatgaagtgaagaactattggaattcccatataaagagaaagctaatgaagatggggatcgatcctaataaccataagttgaaccaatatcctcatcatgttggtccccttaaccccaccaccaccaactccatggatgtggcatgtaagcttagagtgtgttcaacagacaatgatgatgggatctcagatgctgcaagttatctcgaagacgcaacaccgcccactggtatatccaacttggaccttgatctcacaattgcttttccttcgagtcctatcaagaatattattgaagaaagccagcagaaaacagcatctattgtaacaaatgatgaagaagaacaatatacagtccctacccttcttcttttcagatgagacaaaaaaaaaagcctcacacatgtggagattcgtgcaaaagacctaaaggcttacgaaggcaacatgcacgccattgtcaaattcttttggatgatggattgaaaccatatccttgtccattagaaaggaggaagataagctaaaactgtattattgtgtataaatttggtagaaagaaagatttcaacttaagaattaggatcaaataactgaatgaatgaacgaattgcagataagttgttaggaggttttcaatcaacttatctgcaattaatttggtggagctgatgtaggatgatgagttcatcgtacatgaactgaacctttgatatttcaggctctaattgtctgtttgtatgcgtaaagatattcttcaatgtgagatcagctaaaaaa

SEQ ID NO: 15588 - DNA, 601 bp, Gossypium hirsutum
  Predicted polypeptide sequence is orthologous to G208
aagagttgcaggttaagatggataaactacttgaggcctgatcttaagagaggaaattcagtgaagctgaggatgaacttatcatcaaactccacagtttacttggaaacaaatggtctttaatagctgcgagattaccgggaagaactgacaacgagatcaagaactactggaacacgcacatcaaaaggaagcttataagcagaggaatcgatccacaaactcatggtccactcaatcaacccaccaacaccaataaatccactgaattggatttcaggaacgtacccaaagcttcaaaatccaactttgctccaaacccatctcgggatttcaatttcaatgaatttcaagttaaggccaaagcagaatccattgaagaaggcacctctagcagcagtggaatgactactgatgaagaacaacaacaagaagaagaacaggacaagtatgcaggtaatagtcaagagttagatttggagctatcaattgggattagttcatccggaaagaacaacaactcaactggggtttcaactgctaactcagccgaatccaaaccgctgttagacaaaagcaatttccagtttcttggacacgc

SEQ ID NO: 15589 - DNA, 796 bp, Gossypium hirsutum
  Predicted polypeptide sequence is orthologous to G211
gttttctctctctttcatttgttccaatgtttgagagagagtgaattgagtagcttcatccacaagtgaaaacaataaaaatatatatatacagagagagagagacatgggaagggctccttgttgctctaaagttgggttacacagaggtccatggacacctagagaagacacattgcttgtcaagtacattcaagctcatggcgaaggtcactggcgatccctccctaagaaagccgggctacttaggtgtggaaagagttgcaggctgagatggatgaactatttgagaccggatatcaaaagagggaacataacacccgacgaggaagacctcatcatccgattacattcactcctcggcaaccgttggtctctcatcgccggaaggcttccgggtcgaaccgataacgagattaaaaactattggaacacccatctaagcaaacgtttattaagccaaggaaccgatccgaccacccacaaaaaactaccaccggataacccggttgtcgtccttgtcccgaagaagaaaaggaagaacaaatctacaaaaccaaccgagcaagaaaaacccaaaatccatctcccaaaacccattagatttacatcttcagtgtgtaccactaagtcttcgagccaaggaggtgaaaatggacaagtcctcgtcccatggtccaaatacatcaatgatgatgaaaaccgaactgggtttttatgttataatgacgatcatgatcttatcaacagctcagatttcgagtgccagtctcatcatgatcatgaccatgatcat

SEQ ID NO: 15590 - DNA, 1070 bp, Gossypium hirsutum
  Predicted polypeptide sequence is orthologous to G211
attcacaataaatggtaagcaagtgaagattcaaaatccaaacagccacgacagtacttccaaaacagtgtaagaaaaattaaatgacaaaagaaatagaagctatcgctaatatcaaatcgccgatcatcaaaatagttatctctctaagctaaaaaaaaaaaccatgagaaaccctacgaaaaaagacaacgttggaaccaagacgacgccgtgttgcagcaaagtagggttgaaaagagggccatggacgccggaagaagacgagttattatctaattacatcaacaaagaaggcgaaggacggtggcggactttacctaaacgggctggtcttctccgatgcggaaaaagctgtcgtctccgatggatgaattatctccgaccttctgttaaacgtggccagattgctcccgatgaagaagatctcatcctccgccttcaccgccttttagggaatcggtggtcactaatagctggaagaataccagggcgtacagataacgaaataaagaactactggaatactcacctgagtaagaaattgataagtcaagggatcgatcctcgaacgcacaagcctttaaaccctcaacaactctcaccatcaccaccatcactcaaaccttcaccttcttcatcatcatccatggcgaaaccaaacaatcctccttcccctcttcctgttcatgtcgtcaacgctaacaagcaaaattattatgacgatgggagcaatgaagaccatcaagggatgatcatgaacaatgaccattatcagcaacaacaagatcatgatgatgtgttctcttcttttctgaattcattgataaatgaagatgatgatgcattggtttcgaatttgggactctcacaaggatgggaatctactcccttcgatcaaccaaaatgacccaatagagggtttgatgatgaatgttatttatatagttttttttcaaagtgtgttgattgtatgtttaaatcatgttgttgccaaacttaattcatcaaacctgatggttctttttatgtttgttgtgtttgaaagaaacatatgaatgtattgtttc

SEQ ID NO: 15591 - DNA, 727 bp, Gossypium hirsutum
  Predicted polypeptide sequence is orthologous to G212, G247, G676
cccttccgcgcgtccgcccacgcgtccgctggtaggttgacatggaagaaaagagtgaatataaaaaagggctgtggagtgcagaggaggacagcatcctgatggagtacgtaaggaagcatgggaaagggaaatggaatcggatacccaaagtaacaggcctcaagaggtgtgggaaaagctgcagattgaggtggatcaattaccttagtcccggtgttaagcgtggtcgtttctccgaccaggagaatgatcttatcatccgccttcataacctactcggcaacaggtggtcactcatagctggtcgggttccaggaagaacagacaatcaagtgaagaatcattggaacactcatttgagcaaaaagcttgggatcatcaaaaatcctactgctcattcttcacaatcccaaactccctccaagtctagtagagatgatgataatagccatagccaagctcaagaccaggtgatgatgaccaacacagatgccttgccctcgcctcgtgactacggaaacggaagctcttctcggttttggcaatgtcataacaatgatcatttcaatttgcatacacctacccctgtcaatgtcttggacttactagaccacgaccaccacgtctctcttgattttgtttggcatggctttgcctaaccttgtaatctctgcactcctttttctcacctcaattattgttttcaactttggattggattgca

SEQ ID NO: 15592 - DNA, 812 bp, Gossypium hirsutum
  Predicted polypeptide sequence is orthologous to G212, G247, G676
aaactaatccatatactgcaaaatccttgtgcatcttcttcaaagcaaacagcaacaactccaacaaatgtccatgaaaaaagaaggtgaaattctatacaaaaagggattatgggcaatggaggaagacaagttactcattgattatgtcaatgtccatggaaaaggacaatggaacaaaatagccaacagaacaggtttgaagagaagtgggaaaagttgtcggctaaggtggatgaattacctgagtcctaacgttaaaaagggtgatttttctgaagaagaagaagacctcgtcattagacttcataagcttcttggaaacaggtggtctttgattgcgaaacgagttccaggtcgaactgacaatcaagtcaagaattactggaatagtcatttgaggaagaaactagggatcattgatcaaaacaagacaaggatcgatttttgtcaaagttcaaagcaagtcaaagtgtgtcatgttgatgaggcagccacggatccaagtcctggacatggaacaaccactgaaaccacgggtataacagtggatcagagtaaccagcacgaagtcattgatcatcgggtcttaaacaatactactcaagaatcaatgaccactgagaagtatatcaacactttctggattcctgaccatgattatgagctaagtacacttgccatgattgaccacttccatgaatgggtctctttttcaccttaactagagactatgttattaaaattacgggtttaatttttaaatataaagtatgccttctaacatggcatagttgaaatttttaaaagat

SEQ ID NO: 15593 - DNA, 884 bp, Gossypium hirsutum
  Predicted polypeptide sequence is orthologous to G212, G247, G676
tctcactctttgcctcttctgactgttggctaataatggctccaaagaaggctggagtgagcaaaagggtttttaacaaaggttcatggacagctgaggaagatagaagattggctaaatatattgagattcatggtgcaaagagatggaaaacaatcgccattaaatcaggtttgaatcgatgcggcaagagttgcaggttgagatggttgaactacttgagacctaacattaagagaggcaacatatcagatgaagaagaggacttaattattaggcttcataaactgctgggaaacaggtggtctttgattgctgggagacttccagggcgaacagacaatgaaattaagaactactggaattcccatttgagcaagaaaatgataaaccatgatgtcagaacagaacaaacttcctcctcggaacaaattgtgcctcacaaagcatgggaaactgtccagatggaagaagaagaggtagtaaaaggaagtgatgaaattgaaaactctgaattcagcattgatgtggacgaattctttgacttctcaacggaaggttgctttggtttggattgggtgaataagttccttgaacttgatgaccaacaggatccattagcaatggtataataagtttgtaattaacatgtttccttgaataaataaataaataaagagatgttctcaggcattatctcgtcttattattattatttttcaatcattctcctttccccctcatttttcatctgagacagtcggattgttcggattgttgttatgcctttatttgcattttgtgatgatcattaatttagttgggaacttatggctaaattgtaactaaaaaactggctggttggatatataattcctttggat

SEQ ID NO: 15594 - DNA, 550 bp, Gossypium hirsutum
  Predicted polypeptide sequence is orthologous to G214, G680
cctttaaatgcttctatctcagaggggaggttttttaactgcagtagcaagcataaaaaagtccaggaaagcgaataagtcaatgtagatttagatagtacacaacaccacctacacgaaaagtctcgtgagctgcaatcgaataaaagtcttttaagatcaacatatgaaaaggaaataacgatatgggggaagaacattagagattgcattcaacaaacaaactttgcctttgttaattgtatgcaattgtgtaaaagtcaagttgaaggttccccttccaagcgtaccctcttgggacatttctcttcaccttgactgccagtgttcatcactctgttttctttggcttccacagaacaccttttgtaaggtttaaatccagttcggccagcttttagttttgaatgtcctaatccaatagtcagcaggccctcttctgtactgttcttgtctcttgataatgcatttttcacagtttcttgatgatcagaacaagaaccccatgtattgctgttgagatctaaagttgatatttcttcgtcttcct

SEQ ID NO: 15595 - DNA, 920 bp, Gossypium hirsutum
  Predicted polypeptide sequence is orthologous to G214, G680
accgttcactcttttccagcctcaaattaaactcccccatttttttttattttcaaaaaatttccagaaaaataaatccacatgaaattatagtggctgagatttctcgtagtattttttgtgttttaattctcacaaaaaaagagcttgttttcacttcttttgctttgctttcttcaagttctgtttttccaatttctgtatattccgatctttttttcattgccggaaactatgaactttccgactgttttccggtgaactaattttttcatgcgtgatcgtcgtttccagtgttctcatcctccatggctatttctcaaggtattggcgtctacgggttcgttttggcgaggattctgaataaaggaattttgttttaagttcattggaagaagccgtctcttctctctgttacggtggatacttaaattttttatttctattttaattctctggagatttagctttcacctgaagtttactatatgattaattaaaatagtaaaaatttattaaatgatgaggcagtaatatttgttggagtagtaatagaaaacagagacggatctctatcgattgttgtcgttggcttttttgttttttgcagtagtaaatagcagtcatcaggttttgtggagttcaaaaacggctctactatttgtagtattgaatgtccaaagaaatgaaaggaggtttgtgttttacccgttgctcgttagagaggatttgaagcagcggtagcgctgcccaggtcctgtcaatggacacatactcttctggggaagaactcgttcttaagactaggaagccttatactattaccaaacaacgtgaaagatggactgaggaggagcataatagttcctagaggctttgaagctctatggacgagcttggcaacgcattgaagaacacat

SEQ ID NO: 15596 - DNA, 512 bp, Gossypium hirsutum
  Predicted polypeptide sequence is orthologous to G225, G226, G682, G1816, G2718, G3930
ggcaccagcaatccgctgcggaggctgcattcctgcgtccgttgcccatgacccgatcttacaggatcggggaagcgatcgggcagtggcggaaaaccccgtcggacacggcgcttcaccggggtcggacgcttcgaatgcgtctgcgaagggtgagcacatccaaaccgagcctgacggaccacatgacggcgcgggacccgtcgtcgatcacccgatcccggcgattctaaagaggaatccagtgaagattccaagcttgacttctcagaagatgaggaaaccctcattattagaatgttcaatttggttggagaaaggtggtctttgatagcagggagaatccctggaagaacagctgaggagattcagaagtattgggcttctagattctcttacaataatccaatgcccaatctgagttaggattacatccaagtgtttgggttttgcattgggtgattgtttcagctttggtttgcagcgtatatatatatataaaagcaaatgcc

SEQ ID NO: 15597 - DNA, 557 bp, Gossypium hirsutum
  Predicted polypeptide sequence is orthologous to G225, G226, G682, G1816, G2718, G3930
agtcccttcccttcaatcttcaaaactccattaatggctgactctcaacattcctcttctggtaaaacttatgtcaactctcaagactttagttcagaggaggaaacaaatgaagaatcaaagcttaaattctctgaagatgaggaaacacttataattaggatgtttaatctggttggagagaggtgggctttaattgctggaagaatccccggtagaacagctgaagaaattgaagagtattggaataccaggtattcaacaagtgaatgagaaaaaaaaaaggacatttttaaagaaaggggccaaatttgagggactggatggcaattatgggcaagagagcaatgatgggtatttgttgtagtcaccaaaaaggggtcaagaatatggtataatcggttcaacccgacttagaaaattgagcattgttgtttgatgttttggggttttctcttgttttgatgtacttttactatggggggatgtcttcatggccctatatatacttttaatatcccaaggatgtttctgagcttaaaaaaaaaaaaaaaaaa

SEQ ID NO: 15598 - DNA, 1606 bp, Gossypium hirsutum
  Predicted polypeptide sequence is orthologous to G229
tttttattcggtacacacttgcttacgaaaatcaagttttaatgctatcgtcccttttgttgctactatccgcaagtcaaactgctaaatttgtttgtttccttctattattttagccaaggatagaccaagttatccgcattttggccctgatttcccatcttgactagctggtggtggcagttacacatagggagatggggagggcgccttgttgcgaaaaagtggggttgaagaaggggagatggacggcggaagaggatgtgttattgaccaagtatattcaagctaacggtgaaggctcctggagatcattacccaagaatgcaggattactgaggtgtgggaagagttgcagactaaggtggattaattacttgagagctgacttgaaaaggggaaactttacttcccaagaggaagaagtcatcattaacttgcatgctactttgggaaataggtggtctttaattgccagttacttaccaggaagaacagacaacgagattaagaactattggaactctcatttgagtagaaaaatccatagctttagaaggccattaactcaaagcatgccagtcatcatggacctcaccaagacggccgtgattgctaagcggaaaggaggtagaactagcgaagggtcgatgaaggaaaacaaaagctgcagtacccagaaagatactggaagttgttcaaataaacctactgaaaacgtttgtgttaatgaagttgagccattcccatccactccattgttagaaaaagaaaccttgtccactacagccattgaagatcgcatggtactggatcaacatggagaagataaggagagaacaacccatgttgtacccagtccttgtcacgacaccgttgttgaaggaatgttgggttcaagcgaggagagagagagcctggtgactgaggaaggaaccatagagaattcaatgcagtgccctagtggcaacgctgagaaagggactggtattttagcaccacatgagagtattgatagcagtgagatagagtggtttaatgatatcctggatagtgaattgctacagccaagtgggcatttgacgtttactgaactaggagaggacaggtggaatgtgaaaacacacacaactgcagctaataacgaggaaatagtgagtaggaactgtagtgcagatagtggtggggtcttgagctcatgtacttcaacaacattttactttgttgatgattgggaaaatgttgttccaagaagtgagctttgggatgagaaggaatacatgtgttcttggctgtgggagccaagcgactatcatgggaaaggagagagacataaagtggatgataatggctttgaggggcacaatcccatgattgctgctaacgtcgcttttctcctaatgctcctccttgttcctcctgctttagtgtctagctacacttccatgtcaatattttatctaggtagacagtgtgaacatgtcctgccgttttttctttttgttttacttttagattttgcttctcttttcaattctgatgctttgttttctttgtaaactgatttgtgatggaaaaaagattgaagaaaacattttcaccgaat

SEQ ID NO: 15599 - DNA, 1290 bp, Gossypium hirsutum
  Predicted polypeptide sequence is orthologous to G256, G666, G668, G932
gaaaacttgctgtcatctttttgactctttggggagggagttggaacttggataccacccttttttcctctttttaagtcagcatcctcactgtcttacactttgatttctatatatgtaatgctgcaacatcaaatcctttgtcttactcttagactcgtcttaaagctcccaccaacataaactaaaccctaaaaacacaagaaatcaactgcagttttgataatgggaagacaaccttgttgtgacaaagttggtgtcaagaaagggccatggactcctgaagaagatctcatcttggtgtcttatattcaacaacatggtcctgggaattggagggctgttcccaccaaaacaggtttgcttagatgtagtaagagttgcaggcttaggtgggctaattacttaaggcctgggattagaaggggtaacttcacagaaaatgaagagaaaatgataatccaccttcaagccctcttaggcaacagatgggctgcaatagcatcttacctccctgaaagaacagacaatgacattaaaaattattggaacactcatttgaagaggaagctgaagaagctacaaggcaatgaaagttcttctagatacgggtttccatcatcatcatcgtcataccagatttgtagaggtcagtgggagagaaagttgcagacagatatccatatggctaaaaaggatttatctgacgcattatcacctgagaaatcaagtgacttagttgaaatgaaaccctttaatgaccacacatcttatccaaaaccaagtggatatgcttcaagcactgaaaacatagctaagttgttgaaagggtggatgagaaataatccatggaaaatggctgattctgcagattatagtgaagaagggactgttccaatgaaggaagacaagaacagcaaggaaatggcagaggcatttcaatcacatttagggtttgaatctttagattcttcactttctgatatctcaccatctatgtcacctgagacaagcctttcacaatatgaaagtaagccacacctcaatgctcaaagccaactttcactgcttgagaaatggctttttgatgaaggcaaggattaccaactttgtgacattacattagaccaaaatcttcattttttctaaaaggtagaggggaaagttctttgttttaagggcttctttggggtacttttcatcttggattataagtttttctaggttgaggtttcctagagtgaaacaaattcaatgtataaatttaacattattgttgcaaaaaaaaaa

SEQ ID NO: 15600 - DNA, 787 bp, Gossypium hirsutum
  Predicted polypeptide sequence is orthologous to G263
ctttgggagggatttgatcaatcggaaagtcggaaaatatggcgcaaaggtcagttccggcgccgttcttgatcaaaacgtaccagctggtggatgatccgatcaccgacaatgtgatttcatggaatgaaaacggcacgtcttttgtcgtttggaaaactgctgattttgcaaaagatttgcttcccaattatttcaagcacaacaacttttccagctttgtccgtcagctcaacacttacggatttcgaaaggttgttccagacaaatgggaattcgcgaacgagaacttcaagcgagggcaaaaagagctcttgtccgaaatccgtcgccggaagacggtgacaacatcgccggctaataatccggcgaacgggaaaacgtctggtgccggagcttcctcccctactaactccggtgaggacctagggtcaacttccacgtcgacatcaccggaatcgaagaatccgggatcggtggaaacgacgccggcagtgaacacgaatcaatacgccgatctatcagacgagaacgagaagctgaagaaggataatgagatgttgagctcggagctggcgcaagccaagaagcaatgcgacgaactggtcgcgtttttaaccgagtgcgtgaaggtggggcccgatcaaatcgatcgcatcatgcggcaaggaaacggtggttccacccttgaaggcgacgatcttggccgtttctacggcgtcgatgacaacgacgatgatgaaaaaggtggcggcgaagatggaaacggaagtttgaaactgtttgg

SEQ ID NO: 15601 - DNA, 899 bp, Gossypium hirsutum
  Predicted polypeptide sequence is orthologous to G263
gtttgggggggaattgaaatggcgcaaaggtcagttccggcgcccttcttgacgaaaacgtaccagctggtggatgatccgaacaccgacgacgtgatttcttggaacgaaagcggcacctcttttgtcgtttggaaaactgctgatttttctaaggatttgctccccacctatttcaaacacaataacttttccagcttcatccgtcagctcaacacttacggatttcgaaaggttgttccggacaaatgggaattcgcgaacgacaacttcaagcgaggggaaaaacagctcttgtccaaaatcagtcgtcggaagacggtgacatcaccgccggctgatgctccggcgaaaggcaaaacatctggtgctgcaactccctctccgactgactccggagaggacctaggatccacttccacgtcatcaccggaatcgaagaatccgggatcggtggagacgaatcaattcaccgatttatcagaagagaaccagaaactgaaaagagataaggagatgctaagcattgagctggcccaggccaagaggaaatgcgacgagctggtcgctttttttaactgaatgcgtgaaagtggggccggatcagatcaatcgcatcatgccgcaaggaagctgtggctccaccatcaacggcgaaggtcctggccgtatctgcggtgtcgatgatgatgaaaaaaccagtgaagaagatatggggagtttgaaactgtttggggtttggttgaaggggctcgcgaggaaacaatcatgtacgggggacctcacgctaaggaaatgaagacggtagattttcggcacgtgcctttggtgatggagagcggcaaggtttgcaactgagcagtttttttaattttgtgataattgtagtgtattctcat

SEQ ID NO: 15602 - DNA, 550 bp, Gossypium hirsutum
  misc_feature (473)..(473): n is a, c, g, or t
  Predicted polypeptide sequence is orthologous to G268
ttttgattttaacttaacaaataaatattttttgactgtatctaaccaatgaaataaaataaattaaaaaacaatgatcctacccctaccctgagaaaacaattttaaaagaaaagttgcatatatatatatagtagaattaagttacaaaggaactgtaaaaaaccataccaggctgcattttggctgaagaaatcagatctctctaagaacctcaatgtgtctgatgtcctcctccatcctcctccggtccaacgactggatgatattaagacacttgtaattgacgacttgtattttatttggaaacaatcatttgcaaggcttgctttagctgtcttcaatttgcggaaggggtgaggttttggctttcgagtctttagttctgttggttcaactgcggagtaggcgcttgtcacataccaagatcctataacttgcatgaggaccctcggatgtatcgcgtagagtangatgccaacccatggcttttgcgatatcttgaagttcatccataacatcaagagaatcgcggatgtatgctcgtcca

SEQ ID NO: 15603 - DNA, 550 bp, Gossypium hirsutum
  Predicted polypeptide sequence is orthologous to G268
gttttttttttttttttaatcgaataatggctttaacttttttacccacactcgtgccagggcacaatcagataaggaatatgattctctaaatacatcattatttaaaaaaaaaaaaactgaacagtcacatggaatctaaataatgctcctactgcctagagaaaaataaaatgcacctacaatgaccgtatatgttacaattacgttagaaaagagttcacctttcaccccaggacatcatccttctctatagcacacagcacaccaattataagagctgaaactcatcagcatccccccgtcccatgacttgcatccttcaatcctcttatctgcagttcaaatttcgatacacaagcttctttctttcgcttgcaaatgactgcgcttgtcgaactatctttccaacttgcattactaaacatcacagataatacttatagttccaatttgttcaaccatgacgcttgtcacatgtcaagatcctgtaacttgcgtgaggaccttcggatgtatcacgtagagttggccgccaacccaagggctt

SEQ ID NO: 15604 - DNA, 782 bp, Gossypium hirsutum
  Predicted polypeptide sequence is orthologous to G268
ttttttttaagacgtaaaggttacattgacactgacaaactttgtaatgtacaattacacttggaatacaacagagaaaaatgaaatcctttagtatatgttcgtccaaatgtagtaataccaatcagtaatatttactacatacatagaacaatagattatatttatattatttggaacgagttgcagctcttactttttagttcagggagttgcagcttctttctatatgtgattttgacgtacttcccgaagttgtgaagcaacatggttttacggatattcatcaaacaagcacatcacatacgtttctcagagatcaaaattttccagctcgcgtgtggaccttcacctgtttcgtgcagcatagccacccatcccattgcagttgctatttcttgaagttcacccataacagagattgaatctcgtatatatacacgtccaccaggtctcagcatgcgatccatctctagcatgatggttgacatattacacctctttttctcaacagagaaaagacctgctgcgtgtaataggtcatatgttctaggataagtatcgaatggttcacaccagtcatgcataactcctataagcccacgatcataaataacagacaaggtgttgaacccactaacaggaacaacattcataacccagcaatcaatctgaagatcatgtaatgctgctgcaaactgtctattatttcattccagtatttcgattcagctctaaagatttcctttctggatatataggcattcatttctatgctttga

SEQ ID NO: 15605 - DNA, 866 bp, Gossypium hirsutum
  Predicted polypeptide sequence is orthologous to G268
cgaagctctctgttagttcaaaattagaaaaagaaaagctctctgcttctctgttgaattttttttcttccatccttcctgagaaaatttacgaataaaaatacttttaaacaaaatgaaaccgactgctccaataactagtactacagcaaccgtcacggcatcttcgacgacgattgaggcccttaaaaccctcaagtttgttaagcttgtagccattgttgtcctctctgtttccctcgttttccttgctactcacttatcctcctcttcttcttccttctcgatcaattactccttacaaactccgcaagcgtcgcctccggtttctccaccaccacctcctcccccttctccgctaccatctcctcctccaccggccgtgcgaagaacggggataatcgacgaaaatggagcaatgtcggacgaattctttgtcggagagtcaggctcgaactctacgactggttttacggagttcagtgatggcgacgaggaaggacgagaacaagaagaggaggaaagaaagagtaagagcgacggtgacgttagggttggggttgagaaatataaggtatgtgataagagtaaagttgattatataccgtgtttggataataagatagcaattaagctgtttagtaagagtgacaaaggggagaaatacgagagacattgtcctggaaaagatgagatgttggattgtgtgattccaaggccggaagggtaccagagatctataccttggcctcagagtcgtgatgaggtttggttcagcaatatgccacatactcgtctagttgcagataaaggtgggcaaaattggatatcaataaagaaagataagttcattttcccaggaggtg

SEQ ID NO: 15606 - DNA, 705 bp, Gossypium hirsutum
  Predicted polypeptide sequence is orthologous to G274
gcggccgccttgactgcagctctcaactctcccaaattgtgggttatgcatgtgatgcctaccatagcagagaaagataccctgggtgtcatatatgagcgaggattaattggcatctatcatgactggtgtgaggctttctccacatacccaaggacgtatgatatcattcatgcacatggtctattcagcttgtacaaggacaaatgtaatttggaagatattctattggagatggaccgaattcttcgtccagaaggtgcggttatattccgtgatgaagttgatgttctaattaaagtgaagaagataacagcaggaatgaggtgggacactaagatggtagaccatgaagatggtcccttggttcctgagaaagtattggttgctgttaagcaatattggaccgttgggggaaatacgacatcggcacagtaaacagcagacggcaacaaacttaaaccatggcatgaactgagtttgtggattatatgagtttgacatgaattgatgaatttccagcctgaaaatttttgccagcaggattgttttggtgtagggaggtgggtcacaggattaggtgaactaaggatcagtctgtgttcatttgtattaatttgtgaacagatagctataaactatgcttccaaagtttaatgatgattgaattaatcttattttttgttttaaggtcgacgcggccgc

SEQ ID NO: 15607 - DNA, 710 bp, Gossypium hirsutum
  Predicted polypeptide sequence is orthologous to G274
gcacgaggctgagcaaaaaaagattgaagagttagctgaacaactttgctgggagaaaaaatatgagaagggagatattgctatttttaggaaaaaagttaatgacaaatcctgccgcaggaattctgccaatatgtgtaaacctaggggttcagatgatgtttggtacaagaaaatggaaacatgcataacccctttccctaaggtaagtagtgcaagtgaagtggcaggaggggaactgaagaagttcccagctaggctttttgctgtccctcctcgtatatccaaaggacttgttgagggggtctcagttgaaacttaccaagaggacaataagctttggaagaagcatgtaaatgcttacaaaaggataaatagattgattggtactgcaagatacagaaacgtgatggacatgaatgctggtcttggaggatttgcagcagctctcgaatcacccaagtcttgggtgatgaatgttgtgcccacaattggcaaggacaccttaggtgtgatctatgagagaggtctaattggaatatatcatgactggtgcgaaggtttctctacgtatccaagaacatatgaccttatgcatgctaatggtgtctttagcttgtatcaagataagtgtagctttgaagacatccttctggaaatggatcgcattttacggcctgaaggagctgtgatattccgggatgatgtcg

SEQ ID NO: 15608 - DNA, 672 bp, Gossypium hirsutum
  Predicted polypeptide sequence is orthologous to G274
ttttttttttttttttagcacgacttgaatctaatctatacttggaatgatgaatatctttgaccatcaaaccatcacgtatgattcaagtttttttaatattttaattatcaataattaatacattttaattatatttgatcatttaaataatattattttacatcacttaaaaaatattatccaatgaattaaaaagataaagagataaatccattccacattaaaaattagtatatatgtaaattactgtataacccgctgtattgccaatctcatccaacatgaattgatcaagtaactttcggcctcaacatagccgaaatgacgagtccaacattcacaaccagctgcaccatattatgatcagccaacaattctagttatcagcctcgtgccgaattcggcacgagggttgagacatatgaagaggacaataacatatggaagaaacatgtcaatgcatataagaaaatcaatagacttattgactctgggaggtatcgtaatattttggatatgaatgctggattgggaggatatgctgcagctctcaactctcccaaattgtgggttatgaatgtgatgactaacaataaagagaaaatatacccggttttaaaatataaccaagaataatggcactaatcagaacggagttagggattccca

SEQ ID NO: 15609 - DNA, 846 bp, Gossypium hirsutum
  Predicted polypeptide sequence is orthologous to G275, G837
gcggccgcttcgacatcgaaattatgcattttaattcaatctggaaattttggcccaaaaattgaaattgtcataagtaggtatgattttgcattagaaggatgactagatctacggtaaactataacatctcagattatattctagggccatggaatgttacagttatgtgagcatcatgttcaaacaatagcagactttataggttcttcttccgtgggacgccaaaatgtcttacgaacacaaagcaatccctcgttgtccttggaatatatcattcggatctcccattgtagtgatttagccatgctctccacctcgcttattgtttcaagattgtctcgtacgatcagctttccttctggcctcagaatccgatcaacttcaacaattaccgcaaccaacttgcacctctttttgatactagagaagagatgatcagcatgaacaacatcatacgttctagggtatgtattaaatgactcacaccaatcatgatacattccgaacaagccccgttcatagattattggaagtgtatcgggagagtcgattggaactacattcataacccaaactttcaggtatttcagggccgcagcaaaccctccataaacggctttcatatccatgacatttctcacagaagaccagtcgattcccatcccactcaaataggactgggagaccacttttttccagtgactgtagtctgcagtgagatcactctgtgcagctttaccataaacgccaacctgagaaattcaccaatatggtggcttctccaaccgttccggccactgtgcaggccaaaaggaaccacgctttgttgaatctactggcact

SEQ ID NO: 15610 - DNA, 850 bp, Gossypium hirsutum
  Predicted polypeptide sequence is orthologous to G275, G837
cgacttcatagaagagtctgtgcctgatgtagcttggggaaaacggtctcgcgtagtattggatgttggatgtggggttgccagctttggaggttttctttttgacagaagtgttgttgccatgtcctttgcaccaaaagatgaacatgaagctcaagtacaatttgcacttgaaaggggaattcctgctgtgtctgctgtgatgggtactaagagacttccctaccctggcagagtatttgatattgttcattgtgcacgatgtagagttccatggcacatagaaggtggtaaactcctcttggagctgaatcgtgtcctgcgacctggtggtttctttgtgtggtctgctactccaatttatcaggacaagactgaagatgttgaaatctgggaagctatggttgaactaacaaaatcaatgtgctgggagcttttaaacaaaactagtaaggatgcagtaaatggggtggctgtagcagcatttaggaagcctacttctaacgactgctacgagcaacggtcaaaacaagagcctccactctgtcctgagtctgatgatccaaatgcggcatggaatgtgcccctgcaagcttgcatgcacaaagtgccagtagatgcttcagaacgtgggtctcagtggcctgagcgatggccagaaaggttggaaaaatcaccttattggttgagttcccaagttggagtttatggcaaagcagcaccagaggattttgctgcagacaatgagcactggaaacgggtagtaactaagtcatacctaaatgggatgggaataagctggtcatctgtcagaaatgtcatggacatgaatgctgtttatggaggattt

SEQ ID NO: 15611 - DNA, 960 bp, Gossypium hirsutum
  Predicted polypeptide sequence is orthologous to G275, G837
ttcaacaaagacggtaaaaaaatgagccaaaacgcgtaaattcctccaaacccagatccctgcaacaatcccatcaaagataacaaaaagctatatgtaacaagaaaaagcatttaaaagaaaatggccatggcgaagtattcaagagttgatgggaggaagtcgtcgagttactgttcaacggctgttatagttgtgtttgttgctttttgtttggttgggatttggatgttcatgtcctcatctgttgtcccacttgagaattcggatttgtcatctcaggagactagaaatgaggcgaagcaaacactgcaagaaggcgtttctaagcaatttgatgatacctcaggtgatttatcggaggatgcaacaagagaaggtggcactatgcctggtaaagtatccttgaatactgatgaggaatctcgaaagtcagttgaggaaaaccaggaagaaaatcatggaaatgatagttctgatgagaaaaccgactcaggaaatgaacaaaagacagtggatggagatgatgggagtggaaatggtaaagatggggagatggattcaagagagggagagtcaaatttagagtctggacaagcagagaatgaaggtggcgaaatgaataacaatgtgcaggcagaatcagaggagaactcaggtgaaatcagatctgagtcagctgagggtggtaagaacaatgatgaagaagtaagtgaagatataataaaacatgttgacaaagaggatatttcgactgaggaaaataacgaaaagaatcaagatgagaactcagaaccaagtgccgttgagaacagtgcggaaagcgaggaaaacaatcaaacttcaaacgagattcttcccactgctgctcagtcagaaattttgaccgagtctacaactcagaatggagcttggtcgactcaagcagaagagtcacaaaatgagaagaaatcgcaacaa

SEQ ID NO: 15612 - DNA, 434 bp, Gossypium hirsutum
  Predicted polypeptide sequence is orthologous to G280
accaaatccgtcagcaccggaaggccacgtgggcgcccccctaagaaggctaagactggtaccaacactgctcctccacctcctccaggcgtgaagcgaggccgcggtcgacctcccaaagtgttaccgtcggtaggttttcagtaaagcagccaacttaaatgaaagagaatggagaaaatggctcataccgtcattgctccacctcccgctttaggtttaatatttttttaaccttaattttttaggtgtggtttagttatcagctaattgacgttttagctgttttttttttcctttttaatttttagttaacttggggtgggggtactgtaatgattttactgtagggcttagactttacttttgttcgactccttgtaatttccatgtaattgttaagacccttttctttaaaaaaaaaaaaaaaaaag

SEQ ID NO: 15613 - DNA, 804 bp, Gossypium hirsutum
  Predicted polypeptide sequence is orthologous to G280
gcggccgcgtcgaccttcctctcactctcttcttcgctttctcttaaataatacgaaagctaaaagaaaaagctctaaatttcaatggcgaccgaagaaattagtcgaactcaaggcctcaatccttctcaacaatcttcttcacttccagactaccctcagatgattctggaagccatagaggcattgaatgagagagagggctccagtatgtcatccatcgccaagcacatcgactccactcactccgatctcccagcgtctcacaccactctcctctcccaccacctcaaccagatgaaacaaatgggtcaaattgttatgttgaacaacaattactcgaaacccgaccccaatgccccacccaagcgtggacgtggacgtccacctaaacccaaggttcctcttccacctggcgtcgtcgtctctcctcccagacctcgtggtcgtccgcctaagccgaaggacttattggctccccccaagcccaaacccgtcagcaccggaaggccgcgtgggcgccccactaagaaggccaagactggtaccgccgccgctcctccacctcctcccggcgtgaagcgaggccgcggtcgacctcccaaagtgttaccgtcggtgggttttcagtaaagtagccaagttaataaacgaaagagaatggagaaaaggactcattccgtcactgctcctaccccagccgcgttaggtttaatatttttttaaccttaattgtttaggtgtggtttagttatctgctaattgacgttttagctttttcggttttttgttgtagttaacttt

SEQ ID NO: 15614 - DNA, 487 bp, Gossypium hirsutum
  Predicted polypeptide sequence is orthologous to G291
ctttttaaaaatactgggatttgattccatgcaaatatttcttcaacaacaatgcataaactaaaaattatgcaaaaagcttagttcaaaacaaattaagaccccttcccaacaggataggcttacatcagtagggcagggaagggtacaaaactatgcagcctggaatccaatatatatttccttcttgtaaaaaactggggtctcacgctcaagggaaccatttcatccgggaggatgttagaattaggtttcaatcataggctcaggaccagactgatcgttctgggacctactcgactgtcgtacaaagttgaaaagaatgtctttgatgacctgtgacattaaaccatggacttgctccaaagttatctttgcactatctctagtaatcttagcaagctgagattcttccttctttcgagggggtcctagtgggccaatgcgagagtgagccaattggttctctgcttgctcggacgcgtgg

SEQ ID NO: 15615 - DNA, 944 bp, Gossypium hirsutum
  Predicted polypeptide sequence is orthologous to G291
atttgaagaacaagaatggattctgccatagcccagaaaacatgggaactagaaaacaatatacttaccgtcgagacacctgacccttcatcggattctatattctactacgacgaggcggctcaagccaagttccagcaagagaagccttgggccaatgatcctcactacttcaagcgcgttaagatctctgcgctcgctctccttaagatggttgtccacgcccgatctggtggtaccatagaggtgatggggctgatgcaaggcaagaccgacggcgatgctatcattgtcatggacgcctttgctttgcctgttgaaggcactgagactagggttaacgctcaggcggatgcctatgagtatatggtcgattattcccagaccaacaagcaggctgggcgattggaaaatgttgttggatggtaccattcacatcccgggtatggatgctggctgtccggtattgatgtttcaacccaaatgcttaaccagcagttccaggagcccttcctggcggttgtaattgacccaacaaggactgtttccgctggaaaagtcgagattggagctttcaggacataccctgaaggatataagcctcctgatgatcctatctctgaatatcagaccattcctctgaataagattgaagactttggtgtgcactgtaaacagtattatgcattggacatcacttatttcaagtcctcacttgattgtcacctcctggatctgttatggaataagtactgggtaaacaccctttcttcttcacctctcttgggtaatggagattatgttgcacgacaaatttcagatttagctgaaaagctggagcaagcagagaaccaactggctcactctcgcattggcccactacgaccccctcgaaagaagttgcacgaagaatctcagcttgctaagattactagagatagtgc

SEQ ID NO: 15616 - DNA, 923 bp, Gossypium hirsutum
  Predicted polypeptide sequence is orthologous to G291
gctcaagccatgtccctcaaagccaagccttggggcaatgatccccactttttcaaacgcgttaagatctccgccctcgctctcctcaagatggtcatccacgcccgctctggtggcaccattgaggtcatgggcctcatgcaaggcaagaccggtggcgatgccatcattgtcatggacgcctttgctttgcctgttgaaggcacagaaaccagggtcaatgctcaggccgatgcctacgagtatatggtcgattattcccagaccaacaagcaggctggtcgattagagaatgttgttggatggtaccattctcatccagggtacggttgctggctctctggaatcgatgtttcaacccaaatgcttaaccagcaatttcaggaacctttcctggcggttgtaattgatccaaccaggactgtttctgctggaaaagtcgacattggtgctttcaggacataccctgaaggttataaacctactgatgatcccatctcagagtaccaaaccattcctctcaacaaaatcgaagactttggcgtccactgtaaacagtattatgctttgaatatcacttatttcaagtcctctcttgattgtcatctcttggatttgttatggaacaagtactgggtcaataccctttcttcttcacctcttcttggcaatggagattatgttgctggacaactttcagatttagctgaaaagctggagcaagcagagaatcatttgacacattctcgtattggtcccctggggacctctcgaaagaaggtcggtattatctttgtcatttctacgttctctcaatctatttcaaggacaaatgactaaatatacaatgtcagataccaggaagaatcacatcttggtaagattacgagagatagttcaaagataacagtagagcaagccca

SEQ ID NO: 15617 - DNA, 550 bp, Gossypium hirsutum
  misc_feature (441)..(441): n is a, c, g, or t
  Predicted polypeptide sequence is orthologous to G307, G308, G309
gatggaatcaataaattgataatttattatatattcaaaaagaaaagaaaagaaaaaacaaatacctgtccaaacttatggttggtggaattggaattgaagtgtccatcttcaactttgggtttccatgccgacaagaaaaacattgggcatcccttgttacctaaaatcaaacactcttcttcctcccccattatttctaacaaactttcatcctcaacgctagattatctttcctctggtttaatggaattcgactaaagccagccattgaaaagagatgttgccattctgtcaaagttgggtgccgcctaattacattattaccttcccatgcctctatgttgcactcgcactcatactcataaaaaaaaaggcccaagtcgcaccaccaatcaacagtcttcaaggaatactgaaatgaatccttgaaacatgtcnagaaattggagtgggtatgattagaataaaagtctagcattatcacaatcgtcggatttatctccttcaatcttactaactctctctccattgctttatgcatctctta

SEQ ID NO: 15618 - DNA, 914 bp, Gossypium hirsutum
  Predicted polypeptide sequence is orthologous to G307, G308, G309
cgataccatccactataacccttccgatctagcctcctgggttgactcgctgctgtccgagtttactcagcctcctacttgtccctccgagttcatcatggatcctgaaaccaatcagacggtggtaagcgacgcatggaccactgccgaacctcatatgccgcaggtgcaccagaatatttcttaccagcaacaaagtttgaataatcagttaacggttgataatcagttaacggttgtaacagcaatggaggaagattccggtatacggttggttcatatgttgatgacgtgtgcggagtgcgttcaacgtggagacttctcattggctacttcatgtctcgaagacatgcaagggttactgacacgtgttaacaccgtctgcggtatcggtaaagttgctggacattttatagatgctttgagccgtcgtattttccaaggaattgggggcggttctatcaacggtggttctgcttatgagaatgagattttgtatcatcatttttacgaagcgtgtccgtacttgaaattcgcacacttcactgctaatcaggcgattctcgaagctttcgacggtcacgattgcgtccacgtggtggatttcaatttgatgcacggcttacaatggccagctttgatacaagcccttgccttacgtcccggtggaccccctttacttcggctcaccggcattggaccaccatcaccagatggccgtgactcgcttcgcgaaatcgggttgcgactcgccgagttggctcgttccgtcaacgttcgtttcgccttccgtggagtcgcggcttccaggcttgaagacgttaagccgtggatgcttcaagtgaatccaaaagaatcggtggcagttaactcaatcatgcagcttcaccgcttactcggggtctgatctaaat

SEQ ID NO: 15619 - DNA, 932 bp, Gossypium hirsutum
  Predicted polypeptide sequence is orthologous to G307, G308, G309
gggagtagtagggaaaaaccaagcaaaaccccccaatccccaatgctcagattcttcacccattcatcttttttctttggtttttgagcatcaccacacaaatccatagatacctcccctccacccccctctcaacccacaattttacacaggagaaatttatcacaatcatgaagcgagaccacaatcatctccaacccaacccagacccctcttctctccgcggcgctccttcaaccggaaaggccaaggtttgggacgaagaatccgcccaacaagactgtgggatggatgagcttttggcggttttgggttacaaggtcaaaacttcagacatggctgaagtggctcaaaagcttgagcagttggaggaggttatgtgtaatgttcaagatgatgggatttctcaccttgcttctgaaactgttcattataatccttccgatctgtcgacttggctcgagagcatgctctctgaacttaaccctccctccacttttgatccttttggcgctgctgggacggcggcggcggcgttggatgattcgtttcttgtccccgctgagtcctcaactttgacgacgttggatttcgacaacatcaatcggaaacatcagaaatctggtcaacaaatctttgaggaagcttcctgctccgattacgatctcaaagccattcctggtaaggctatttattctcaaaaaacccaaccccaaacccacgattcctcatcttcttccacacccaccaacgttaaatctgaaaaacgcttcaaatccacatccgggccgccctcgccctcggatatcttcccccctcctcctcctcccgctgctgcttcctatggaattccgactgcttcaactcgtcccgtggtcctggttgactcgcaagaaaatggaatcccggcttgtccatgctttgatggcatg

SEQ ID NO: 15620 - DNA, 980 bp, Gossypium hirsutum
  Predicted polypeptide sequence is orthologous to G307, G308, G309
cttactcactctgtctctcccaactttgggccatgctagatctgccccttctttcaatatttgaaaaccaagaaactaattttaatttgaatcatgttgcggtacgactccacctcgtcatcagcgggaagtagcagtggcagcttatcatcctcctcctcctcgtccaagccaccgcagcaagatattgatggactactcgccggtgctggttataaagtccggtcgtcggagttacgacaagtagctcaacgactggaacgactcgaaaccgccatgggtaattcgcctgcagatttctctcaacttgcctccgatgctatactctataacccttctgatctggcctgctgggtcgactcgctgctaactgagttcgctgagcctcctcccacttgctcctccgacttcatcgtggatcccgtaaacaatcaaacggtggtaaacagcgcgtggaccaccgccgaacctcatacaccgcaggtgcaccagaatattacttatgacgagcaacagagtttggataatcagttgacggttgtcacggccatggaagaagattcgggtataaggctggtccacatgttgatgacttgtgctgagtgcgtccaaagtggagacctctcattggctacttcattgatcggcgacatgcaagggttactgactcatgtcaacaccgtttgcggtatcggtaaagttgccggacattttatcgacgctttaagccgccgtattttccaaggaatgggcggtggctctgtcaacggtggctcggcttttgagaacgagattttgcatcatcatttttacgaagcttgtccatacttgaaattcgctcacttcacggccaatcaggcgatcctcgaagctttcgacggtcacgattgcgtacacgtggtggatttcaatttgatgcacggcctacaatggccagctttgatacaagccctggctttacgtcctggcggactcctttg

SEQ ID NO: 15621 - DNA, 2041 bp, Gossypium hirsutum
  Predicted polypeptide sequence is orthologous to G307, G308, G309
attttctccactttcttctatattctctcccttttttaacttccaacaaaaaccaaaaaccccaatttaacgcccccaccccttgttttccttttccatgaccaaattctagcaaaaaaaatgaagagagatcatcaagaaatttctgggagtggttcaaatccagctgagagttcatccattaaagggaaattatgggaagaagatccagatgctggtggcatggacgacgagttattagctgttttgggttacaaagttcggtcatcagatatggcggatgtagctcaaaaattggaaatgttggagaaagttatgggtactgctcaagaagatgggatttcacagcttggtgatactgttcattttaatccttcagatctatccggttgggttcaaaatttgttgatcgagttcaacggttcaacaacaacaccagatcccaatttcaacgatgattctgagtacgatcttagagcaataccaggggtcgccgcttacccaccggtgaaatcggatccgggtctagaaataacccggaaacgagctaaaactgagtcctcctcatcatcatcttcaacaactactcgtcctgttgtgttgattgactcacaagaagctggggttcgactcgttcatacattaatggcttgtgctgaagctgttcaacaagataatcttaaactagctgatgcattagtgaaacatattgggttacttgcttcatcacaaactggtgctatgagaaaagttgctacttattttgctgaagctttagctcgaagaatttatagaattttcccaccagattcacttgatccatcatataatgataagttacaaattcccttctatgaaacttgtccttatttgaaatttgctcattttacagccaatcaagccatattggaagctttttcaatggctagtagagttcatgttattgattttgggctaaaacaaggtatgcaatggccagctttaatgcaagcacttgcattaagacccggtggaccaccggcgtttcgattgaccggaattggaccgcctcaaccggataatactgatgcgttgcaacaagtggggtggaagctagctcaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccaagattgtcacggttgttgaacaagaagcgaatcacaacggtccggttttcttagaccgttttactgaagctctccattattattctacccttttcgactcgttggaaggttcaggggtggcgccagcgagtcaagacctggctatgtccgagttatacttaggaagacagatttgtaacgtggttgcttgtgaagggatggaccgagttgaacgacacgagccgctgactcagtggagaactcggatggaaacggccggcgttagccctgttcatttgggttccaatgcttataaacaagctagtatgttgttggccctcttcgccagcggcgatgggtatagagtggaggagaataatgggtgtttaatgcttgggtggcatacaaggccacttatcgcccacctcggcttggcgactcgctggtactgagtcaggtagtgagttaactcaggagctgagttgagaaaaagtaaaaaacctgttgaaaagaataagtggggtctatcttttaactgagttgcagaatgtacgagtgaatgaaaaaaatgagggtaaattaaaaaccagtccaagtgtgtaattctagtttttctttgtctattttttccccactttttagtattgtttttagtttcttttagggtagattttttttttaatggggagcctttgtaattttcaaggttggatctaatgtgaaggcatatctttttattactagaaaaaaaaaaaaaaa

SEQ ID NO: 15622 - DNA, 868 bp, Gossypium hirsutum
  Predicted polypeptide sequence is orthologous to G319
aaatgaagatgaagcggcagtatgattacttagaagaacagagttcttctttaacagttcatgcactggtacaatcttaaatacataatatataacttgagaaattaacaacacatataatagcagttgcatggttggtttttcacctttaacccaggaaagaagaagagccacgcctttggttccaaaaggggttatgatcttggaagacagctgattcaggatttgggtttttattatcaaagagatttgggtgacaattctcattatcatcatcaaaagtagtccatcgccttgagttgtttttaagcttctgtctggtaacatttctcatgttttccatctctcctacatgctccctgaattctttcttcaccacatctagaactacctctccatatctatcacaccacgacttgggaaagaactttttgaggtcagccttgtccacaggaagggttgtggaaattgcttcaatttgatcatccgaaaatttaagattggggtttgtggtggagagctctgattgaattcgtgatagctccttctttattttgtctcctactaccttatcgatgaagaaatccgatggagctccatttgcaagcagcttcctcttaatctgtttcgtgtctggtccctctccaatgggagttgcgacaagttggcatgaccccatgaatgcttcactatctgatctttcgttgagaggcaaaggagctgtctcatcctctgaatcatttctcctccatttcttgaaaccatcaaaaaccccattgtttctttgctgattttgatgctttctcctctgaaccagggccattattatgcccctctctttgctctctatgaaacagggttttaaatg

SEQ ID NO: 15623 - DNA, 904 bp, Gossypium hirsutum
  Predicted polypeptide sequence is orthologous to G326, G1337
tttaacatttcatcttcttcattgaggctagggtttttcaaacttttaatttagatttgatccaaaaaaagctatggttagtccagtttctgaaggtaaaggagctgtgccgtgtgatttctgcaatgaacaaatagcggttctttactgccgagcagactcggccaagctgtgtttgttttgtgaccagcacgtacactcagcgaatctgctctctcgtaagcacgtacggtctcagatctgtgataattgtagctctgaaccggtttcggttctgtgttcgaccgataatttggtgctttgtcaagactgtgattgggatgcacacggtagttgttcagtgtcggcggcgcacgatcggacattggtggaagggttttctggttgtccgtcggctttggagttggcttcggtttggggatttgatctggaagagaagaaaacgacagatcggaactggaacgtgtgtcatcaggatttgatgatgccggcggtggaatcgtggttgtacgaaactagcttgcaagaaatgatggtgccgtacgagagttttggttgttacggggagacgttgaagaagcagaataccggaagcgggaagtgtaaacaggtaatttataagcagcttgttgagttgatgaaaagagatctcatgtgcggcggcggaggagaaggtgttggagacggtggtggtggcggtggaggtgaagagaatctagcgtcgaacgtcgaacaaaacggcgggtttttgactcaacaagaagttttacagccgttgctggaaccgggaacggaaacgcaaacgcaagctctattcacttctttgcttatgatgcaaacgcaagagagtgagcgcatcgttaatggaggaaatgtggtattaaacggtaatccgaacaatcaa

SEQ ID NO: 15624 - DNA, 864 bp, Gossypium hirsutum
  misc_feature (21)..(21): n is a, c, g, or t
  Predicted polypeptide sequence is orthologous to G347
cttcatggaattttaactccntacaattcgatagctcatcaaagaattggaattggttcctaagttgaagtgtggtgaaatcggatatgcagagccagcttatctgtagtgggtgtaggagcattcttctttatcctagaggtgctaccagtgtttgctgttcattatgcaatacaattactccccctgtgatggaaatggctcaactcatatgtggaggttgtcgaacattgctaatgtatacacgtggagcagcaagtataagatgctcttgctgtcacaccattaatgttgcaccagcatccaaccagatttctcacatcacttgcgggcactgccgtacaactttaatgtatccatatggagctccatcagtcaaatgtgctgtctgtcaatatgttactaatgttggtatgggcaatgtaagggttccccttcccgtaaacagacctaatgggaaagctgccacagggtctatggctacgcaatctgcttcgccaagccaaactgttgttgttgagaaccccatgtctgttgacgagagtgggaaattgttgagcaatgtcgtggttggcataacaactggcaaacaatgaataatcccagtgtgatacttgagtatgattgtcgaggaattgatgtgatctcaagttgcaattggaaaaacattaacattgaatctaagggataagtgggttccattatagtgccaattgtgggcatgagctcctttatgatttacatagataataccaattgcctaccttagaaaagaatcagggggccgcacaaactaaaggatataaagggccgaagcggtgacgggcacatactgaaccctcatgagagaacccctcactgaaa

SEQ ID NO: 15625 - DNA, 507 bp, Gossypium hirsutum
  Predicted polypeptide sequence is orthologous to G351, G545
tttttttttttttttttttttttttttttttttgaatgatcaaaagaaaaaaaaatttaattcagctcaaacaaataaatcaatgaattgccaacagctgactgcaatagggagagttcacaaacaatgaacgcattcactgtacacaacaattcatcaaagatataaatcccagaactaatgaaaaattatatatatattgattgtaaattcaattattccttaaccatcaagacatggggtttcttggtcggcaatggactttccacctcttgttcggcatagatgtgaccaaatcttccatcttcattttcctcacaagcaggcatgtttaggtcaaagtcaaagttgagacggtggctttggctcaacgcgccgccgtctgacaacgtcaccccactcacgctaccgctcttgtaactgctgctgttgttgttgccaccttcgtagtggcagcgtttgtggcctcccaaggcttgtcccgtagggaaagacttgtgctcgtgc

SEQ ID NO: 15626 - DNA, 661 bp, Gossypium hirsutum
  Predicted polypeptide sequence is orthologous to G351, G545
aacttatcaatctttagggggacacaagtccagtcacaggaaatttgttggagctgatgaagactccacaaccaccgctgctgctgaagataaattcaccgcatccacgacggctacaaattcacatgccatgatcagcaaccaaggtggcaagacacacacgtgttccatctgttacaagacgttttcttcaggtcaagccttgggaggacataaaagatgccactacgaagctggcagcaacaataataacagcggtaacgatggtgttaaatcctggagccagagtcaacgtgacttcgacttgaatttacctgctggaccagatgaaacaagtatggacgttcttagacaagataaattttgccgcaacgatgaagaggtcgagagtccgtttaccgacgcttaagcacggaagctgcaaggtttattgaatgttttgtaaaaaatcagatttagattaggtgaatgattggagtggactttgttgttgtttattttagtctttttctttttcaatttaattggcatgttttaacgttatttatttatttacttttttagctctctcttggttttgttgatgtacatgaggattaaggtcattataaaatatttgtttgtttggtattgaaaaaaaaaaaaaaaaaaaaaaaaaaaa

SEQ ID NO: 15627 - DNA, 550 bp, Gossypium hirsutum
  misc_feature (77)..(77): n is a, c, g, or t
  Predicted polypeptide sequence is orthologous to G351, G545
tttacacggaaataaaatattcaatagaagaaaatgaatctaaaataatataattcctacaaaagaattcagtattntgtttagttgacttcaactttaggtggcatccatatcacgagacgtggctttttagcaggatgtgggctttccacttcttcatcgccgccggaaacaaacaattttgacggtgagagttcaggaaaagccggaaggttgaggtctaagccccgctggctggtggaactagtggacgctgatctttcaggtgtcgtaacgcctctagcagtcccagcacagccttcatagtgcaaacgcttgtgaccccccaaggcctgtccggaagggaagcttttatgacagatggaacactggtgggacctgccgcttgggttggaggtggaagtggaagaggtggttgttgaggttgattggtcatcgttaataccagatgaaagcttacggtggctggctttgtggccacccaaagcctggtaagagttgaaggccttgttgcaaactttgcacttgaatctaagttgttgatccgttg

SEQ ID NO: 15628 - DNA, 822 bp, Gossypium hirsutum
  Predicted polypeptide sequence is orthologous to G351, G545
gcggccgcgtcgacttcagtgcttcaatcagatggctttagaagctcttaactccccaacaaacgctgctgctccttttcacttccaagataccaatttacactgcctcgatgccttcaccaagcgtaagcgttccaagcgaccacgcttcgacgatgaccatgttcccaccgaggaagaatacctcgctctctgccttgttatgttagcacgcggcggtgctcctcgaaccacctccactaccttgactcaccaaaaacttggcacctacaagtgcagcgtttgcaacaaggcctttaattcttaccaggctttgggtggccacaaagccagccaccgtaaactttcaggagccaacgatgaccactcaacgccaacgacctcatccgccgttggatcaaacccaagcggtaggtcccacgagtgttcaatctgtcacaaaagcttccctactggccaggccttgggaggccataagcgacgccactatgaaggtggggctgcgaataccggtagcattacatctgaaggagtgagttcaacctcaaccaataccacccaccgggactttgatctgaatataccagctcttcctgcattctcaccggctaatttatttgtttccggcggtgatgaagaagttgaaagcccacaccctagtaagaaaccatgtctcttgatgcaaaaggccacccaaaattgaagtcaactaaattttaggccagattccatttttttttcttttatttttgtacatagcacatggaccattcatcggtctcaatggcagcaagttttttatttttattaattactcaaatg

SEQ ID NO: 15629 - DNA, 795 bp, Gossypium hirsutum
  Predicted polypeptide sequence is orthologous to G351, G545
gcggccgcgtcgacaaaacttccacttttctctattgtttgattatggctttagaagctattaactctccaacctcagccaccgctcctttccgcttcgatgatactaatttacactgccttgaatcctttactaagcgtaagcgttcaaaacgaccacgtctcgaccatgtcactgccgaggaagaatatttagctctgtgtcttatcatgctagcacgcggcggtggccaacgatctccttctccaaccaccatgccagaacccacctcgacggaggagcagaaaccgagttacaagtgcagtgtttgtaacaaggcgtttaactcttaccaggctttgggtggacataaagccagccaccgtaagctttccggtgggaacgacgatcagacgacatcggcgaccgggacagccggtggggttgttaagtcatccggcgggaagtcacacgagtgttccatctgccataaaagcttccctacgggtcaggccttgggaggccataaaagacgccactatgaaggtggggcggggaataataacgccggcgccaccgctaccgctagcagcgtgacggaatctgaaggagtggggtcaaccaacaccaacaccaatacccatatcagtaaccgggatttcgacctcaacatgccggttttactggaattctctccggctaatttctttgtttctgccgccggtgatgatgaagtgcaaagcccacaccctgctaagaagccatgtttatcgataccacccaaaatcgaagtcaacttaacaatttaaaaccctt

SEQ ID NO: 15630 - DNA, 964 bp, Gossypium hirsutum
  Predicted polypeptide sequence is orthologous to G351, G545
gtttatcaacttgggctatacttttctcacttctctccacttgtcacgcaacttccttccccctttaaaaccccatcccctcacttctcagtctccttcaactcacagtttctttccccttgcaaacacttttgctctgcatctctctagcatcccaattcataaccaaaggctccttcgttttttgtgtttactttcggtgttggaatcaatcggatggctttagaagctctcaactctccaactacaaccgctacgcctcctttccactttgaagataccactaacttacactgcctggaatcgttcaccaagcgtaagcgttccaagcgaccgcgtttcgatcatgtgaccaccgaggaagaatacctcgctctctgccttatcacgctagcacgcggcggtgatgccaactccaccaacacttctgttatcccacaccgccatcgttctcctactccaaccgcctcaccaccgcctgcaccagcaccagcaccgacctcaacagtgcaaaatgttagctacaagtgcagcgtttgcaacaagtcctttaactcttaccaggctttgggtggtcacaaagccagccaccgtaagctttcaggcggaaacgatgaccagtcaacgtcgacaaccacctctgccactgccggcggagttatttcatctgctttgaacccaagcggtaaaacccaccagtgttctatctgccacaaaagcttccctactggccaggccttgggaggccacaagcgatgccactatgaaggtggggctgggaatagtgctagcgcaaccgctagcgccagcggcgtgacgacatctgaaggagtgggctctaccaataccatgagccacatcagccagcgaatcgactttgacctgaacctaccggctttgccagaattctcaccggctaacttcttcgtatctggcggtgatgatgaagtggaaagcccacacc

SEQ ID NO: 15631 - DNA, 947 bp, Gossypium hirsutum
  Predicted polypeptide sequence is orthologous to G351, G545
cacagattaaacccctccaaaaaagcttacttttagcactctgtttttgctctcaaactcgaagggactcggaagtattagatatggcgcttgaagctctgacctcgccggcgacgcctttcaccaacaaatacgatgacgtggacaacaattacgtcgagacatggaagaaaggcaagcgttcgaagcgccaacgcggcgactctcctgctgctgttgaacttcaacccaccaccgaagaagagtacctcgctctttgtctcatcatgctcgctcgcggctcttccggtgctgatcgtgatgttattcgtcggtcttcctcttcgtcgtcaccgcctccgccgccgcctgctttgaagttgtcttacaagtgtagtgtttgtgacaaggcgttcccttcttatcaagctttgggcggtcataaagccagccaccgcaaacccctttccgccgacgccgctaccaccaccgccgccgtcaacgtcgataacccatcaacaaccagcaccgccaccaccatcaccagcagcggtaggcttcacgagtgttccatctgccacaagagtttccctacgggccaagccttgggtggtcataaacgctgccactacgaaggtggcaacaacaacaacaaaaataacaacaacagcggtagcgttagcgttagcgttagcggggttacgtcttcggatgggggggcgttgagccacaaccaccgtgcagtcgactttgactttgacctcaacttgccagccttgccggagttcagtcaaatgtacccagatgaagaagaggttcaaagcccattgccgaccaagaaaccacgtctcttgatcgccaagaaagagaaactggattcttcattagcacaagatttagaattaaattgaaaaattcagatcatttgtttttaattttcaatttttttctgggatttgtattttttt

SEQ ID NO: 15632 - DNA, 916 bp, Gossypium hirsutum
  Predicted polypeptide sequence is orthologous to G351, G545
cttgcacttgattgattcgaaggaaattagaagataaatatggcccttgaagctctgaaatctccaacaatggcgactgccccttacagcaacaagtacgaagacatcgacaacaattacttcgatacatggaagaaaggcaagcgttcaaagcgacaacgcgacgacgagtcttcttcttctccgccgccgccaccaccgccgacgaatgaagaagagtaccttgctctttgtctcatcatgctagctcgtggtggttccaccactgaaaacgccgtgacagacggtggaaacgatgaccatcgtctgtcttcttcttcttcagcaccggcaccagcggctttgaagttgtcttacaagtgcagtgtttgtaacaaggctttcccttcttaccaagctctaggtggacataaagccagccaccgtaaatcctccaccgatgctaaacccgataatcagtccatcaccaccagcagtaccaccgccagcggggaagccggcggtaacggtaaagcccataagtgttcgatctgccataagtctttccctacaggccaagctttgggaggtcacaaacgctgtcactacgaaggcggaaacaccaccaccaccaccaccaccaccgccgccatcaccaacaacaagagcagtagcgtcagcttgagtggggtgacggtgtcggacggtggcgcgttgagccaaacccgttgcgtcgactttgactttgacctaaacttgcccgctttgtgcgagttggaaatcaaagatggaagcagattttgtcaaatctatacagagcaagaggttgaaagtccattgccgaccaagaaaccacgttttatgacagcttctttagcacaacattaatttcattagtgtttataggaattaaacatagagtgaattcatttatttt

SEQ ID NO: 15633 - DNA, 760 bp, Gossypium hirsutum
  Predicted polypeptide sequence is orthologous to G353, G354, G2839
gcggccgcgtcgaccagatttcaacagcaaaacccaaagtttcatactttacagtgttccaagtattcagtgttttttatacaagttttcagattaatgaagagaggcagagatattgatgcgatggatatggcagattgtttgatgttattatcgagagttggggaaaccgaccgggttgctggtcgtgtctttgcatgcaagacatgtaataaaaagttttcatctttccaagcacttggaggtcacagggcgagtcataagaagccgaagctaacggtaggagacaatgaagggttagcggtttcgcctaagaagccgaagacccacgagtgttcgatatgtgggctggagttcgccattggtcaagctctcggcggtcacatgaggagacatagggctgctctgaatgacgggttggtaactcgggatttgttgccggagatgaataaatcgaccggagatggtagggatccatctatagatttgggtttgacgtcttggggagtggatttggagttgaagctggggaaagtgacaccaactccggttgttcattgttttatataggattaatacatgtgggttcatattattagagcacggtataggtagataggatttgattttaacattctttcgttacttgtatattgtttttggtctattttttactccatttttactacattgttattcatgtcttatttttatgttaagattgataataaaattacagaatataaaaaaattcaattaa

SEQ ID NO: 15634 - DNA, 622 bp, Gossypium hirsutum
  Predicted polypeptide sequence is orthologous to G374
ccttacacacgcgtccgcttgatttggagctagctagtggcacacttggtggggttgttacaacggttgaaggtttgattaccaaaattagtgaaagccttgagagagtgcatggatttacttttggagatagtcttgacgaatgtaagaaaaacaagtggctagactttaaagcaaggttgaacaagattttgagcatgacagaaccttggactttaattctggatgatgcattagctaactcttttattgcaccagcaactgatgatattaaagatgaccatcaactaatttttgagaaatatgagagatcatgggaacaaaatgaagaactgggcctgaatgacatcgacacctcttcagctgatgctgcttacaactcaacaggggtgacatccaatgagaacccccaagaataaatgaactgcaaatgatgtgtgatccagagcaagcattggatcaaactgtgttgtgcaaaactattcatactggctgctggactgaaacaatgtattcctaaaagatttagagccggactgcaattttgaggcttcatatatacttattactgtaaaattatactgtaaggattttttgtctactatgactaaattttagaatt

SEQ ID NO: 15635 - DNA, 774 bp, Gossypium hirsutum
  misc_feature (597)..(597): n is a, c, g, or t
  misc_feature (661)..(661): n is a, c, g, or t
  Predicted polypeptide sequence is orthologous to G378
ccggtctcattttccaacaatcacccaaatccaagggaagtgaaaaaaaaaaaagagagaaaaagaatggaatttcatgaataccaaattcgtttttcgaggcctccaccttccttctttggggatttccttgaaaagcttaaagatttttgcaatttcgccttttccgccattattggcaacattttctctgcgatcttaaccttcttctttgcattagtgggcaccctgttaggtgccatgacgggggctttgataggacaagagaccgaaagtgggttcgttcgaggcgccgcagttggggctatatctggagctgttttttcaatcgaagttttcgaatcttctcttgttctttggcaatcagatgaatccgggatcggatgcttgttgtatttgattgatgtcattgcaagccttctaagtgggaggcttgtccgagaacgaattggtccggcgatgctgagtgcagtccaaagtcagatgggagcttctgaaacaccttttgaagaagttcagaacatcttccaaccctgttgtttttaaaggattggctgaaaatttggttaaaaaattcccaaaaatcatattcactanaaataacaatgtcgatgcttctggggagaaaatctcctgtacagtttgccttcaggactttcanctcggagaaacggttaggagcttgccgcagtgccatcacatgtttccacttccttgcatagataagtgcttgtgagtcatgcttcttgttcattatgcaaaagggatctgtac

SEQ ID NO: 15636 - DNA, 651 bp, Gossypium hirsutum
  misc_feature (324)..(324): n is a, c, g, or t
  misc_feature (336)..(336): n is a, c, g, or t
  misc_feature (632)..(632): n is a, c, g, or t
  Predicted polypeptide sequence is orthologous to G378
gctttctttgcttcaagttttgtacttacactttttggttatcttttttagctacttgggtttgttttttcatcaattttggcttttcctgcagatcccattttcttgtatatattgtattggttttgtctctgacaaatgagaaagtttgtgcaatatttacctcttctaaactcctaaagtttgtgcaatatttacctcttctaaactcctataaaatgttactctgatttgggtatagtttggaggaccgatcctccctatttatagctgctatatcagtttgaactttggactcaaatttgcttgtaggaggatccgtantgggaactgtantacgagcaatgaaagggcaaacaacaaaaactgggtttttcacgggagctggaattggtgctgttgcaggtgcgatcacagccgttcaattgctggaatcattggctgatggggagtcattgtctaaggtcaccattcgcattaatttcatcctcactaatagttaaacattcaagtggaaaagtttctattttaattaaccctttgttgtaatataaaaataaaaaaataataaagtataaatttccttatttaatttgctgtcttatacgtggccttattggttagcttactanatgggatagttttcattgc

SEQ ID NO: 15637 - DNA, 927 bp, Gossypium hirsutum
  Predicted polypeptide sequence is orthologous to G383, G1917
tctcataccattgccccctttaaccccatcttagtagtgaaatgatgcataggtgtagcagtagctcgcaagggaacatggtgggtggaccttgttcatgcggtggcgtgttccatagccaaaacaactcgttctcgatgatgttttcaatggcggcgaaccagacatgttacgatgaaacggatgtgatgtaccctttcgcttcttcctcttcgtctgttgattgcactttgtctttaggaacaccttcgacccgtctcgttgaagaagacggttataagcgttcttcacgccgtgaaagccgctccggcggcggaggcggcggttcttgcatgtcgaacttgtgttgggacttggtgcgaaacaagaacacgacgaaagctggccgtaataatgataataataatagttcaggcaacgatcctcttttggctcgtcgttgtgccaactgtgacactacttcaacaccgctttggaggaacggtccaagaggtccaaagtcgctttgtaatgcttgtgggattcgattcaaaaaggaagaaagaagagcttcagctgcaaatgctaatgcttcatcaatagcggaacaacaacaataccatggctacaacaacagttcatggggttcaatgcaatgttattcatcgccggtgaatgaaatcaagttcatcgaagacggcgatcctttcctttcttggagactcaacgttaccgatagaccaacaaaccttattcacgacttcaccagataaacaaaaaaccaccaccaccaaccaaaacgccattgacggtgaagaccatggcggtgcctgcaaatcactgttcccttttttagtttgtgtaacttgttttgtcttctatagatggagtaagaacgggataattctatattcttagttgcttttttttctcttttttccttctccc

SEQ ID NO: 15638 - DNA, 954 bp, Gossypium hirsutum
  Predicted polypeptide sequence is orthologous to G383, G1917
ttcttccgttgattgcactctctctttgggaactccatccactcgtctttgtgaagacgacgacaagcatatccgccatgaacgtagtaacccttgcatttccaactattgctgggacatgttgcagaacaagagcgcaccttattcacaccaaaccaccaaagctagccgtggaagcaatggaaatagcagtaacggctcaggcaacgatcctctcttagctcgccgctgcgccaactgcgacactacttcaaccccactttggaggaacgggccgaggggtccaaagtcactttgcaatgcctgcgggattcgattcaaaaaagaagaaagaagagctacagcagcaaatgcaaacaactcatcgagtgcaacagcttcaatgctggaacagcaacaccatggctatcagtatcaccacaacaattcatgggttcatcagaaccaaaaaatgccatgtttttcccctcttaatgaattcaggttcattgacgatactgatcgagattctgatactggaatcccctacctttcttggagactcaacgtcacagacaggccaacaagccttgtccatgactttacaagataaaaaaaaatcaaagaataaagaagaaaaaagaaaaggaaaagaaaccctggttcccattgacggtcaagatcatgcaccaatgactgaaacgtatcacgatgatggtgacgcttacatggtcttcgtttcgtttagtcaaaaattctttttttatttatttatttaaattttgcttttctttgtttgtctcctttgtctgtcttcaatagatggtgtaagaacgggatcatcctatgttcttagttgcttttgattttgatatttttttttcatgttctttaacttttcctttcaccttcagttttatattagtaaaacatttctgttttagagttacaactttcttcacatatcatcccctt

SEQ ID NO: 15639 - DNA, 523 bp, Gossypium hirsutum
  Predicted polypeptide sequence is orthologous to G384, G385
ttttttttttttttttttaagaaaaaagctattcattaattttcaaagataccaaaaacataaaaccagaaaccaaatgtttgccgatggctactgtggactgtgagtcccaataatacttcaaaacacaaaaacataaaagaaaagaaacgatggaagctctcattgtctttttcccccgagaaagtcaatacccgaaccaaactaattctccttgcaaggaacatggaaggtgcgttcttgactttcattattactgttgagctagtcaccattttttgtttgctcggtcaagcgtcattacacatgaccgcagttctgatcctttcaagagtgcatttgattaggctattcacagtagccactgatcccacagagattttcgaattcggagccgaatcaactaagatttggaacgcaagggtaacgagtgacccgccggagccgatttccgtgatctctattcctctgttaggtccttcacagtcgggaagtatcgcgaaaccagaaggtaaaaagcgag

SEQ ID NO: 15640 - DNA, 2616 bp, Gossypium hirsutum
  misc_feature (2600)..(2600): n is a, c, g, or t
  misc_feature (2614)..(2614): n is a, c, g, or t
  Predicted polypeptide sequence is orthologous to G384, G385
gctcaccaaaaattatgccattatctttcatagttcgcccgttttctttttccctctcaaaattgattgactagaataatactactctttcattgctctggtttttttatctccagtttattagcaatgatgataatgagcggtgttgaaatccaaatggttgctcctactgagtaaaagagacccttttttccgctttcatttaaggtgttttcgtaaaggagagacgttatggattgcggaagcggcggcggcggcttaggagcgagtggttccggcggagaccatgattcctccgacctttcacgacggaaaaagccttaccatcgtcacacagctcaccagattcagaggcttgaatcgatgttcaaggaatgtccacacccagacgagaaacaaaggttacagctaagtagggaattgggattagcaccaagacagatcaagttttggtttcaaaataggaggacacaaatgaaggcacaacatgaaagagccgataactctgcacttcgtgctgagaacgataagatccgatgtgaaaacatagccataagagaagcacttaagaatgtgatttgtccttcttgtggtggtcctcctgctaatgaggattcttattttgatgaccagaaaatgagaatggagaatgctcaattaaaggaagagcttgatagagtatccagcattgcagccaagtacatagggagaccaatatcccaactcccaccagtacaacctgttcatatctcttcattagatttcaggatggcgagttttgacggctatggtgtcggcgctggtccttcactcgatctcgatctcctccccggaagttcgtcatcaatgccgaatttaccgttccaaccggtcgttatttcagacattgacaagtccctcatgtctgatatagccgcaaatgcaatggaagaactgcttaggctattacaaaccaatgaaccattgtggattaaatccactaatgatggcaaagatgctcttaatctcgaaagttatgaaagaatcttccctaagcctaataatactcattttaaatctcctaatattagggtcgaagcttctcgagattccggtgttgttattatgaatggcttagctttggttgacatgttcatggattccaacaaatggttggagctatttcccaccattgtgtcaattgccaaaacaatcgaagtgatttcacctgggatgttgggtacacataggtgttctttgcaattgatgtatgaagaactacaggtcttgtctccattagtaccaacacgagaattttatacactccgatattgtcaacaaattgaacaagggttatgggctattgtcaatgtttcatatgatttgccacaatttgcttctcaatgtcgatctcatagactcccttctggttgtttgattcaagacatgcctaatggttactccaaggttacttggttagaacgtgtggagattgaagacaaaaccccgattcatcgattgtatcgagaccttgttcatagtggttcagcatttggagccgaacggtggctcacgacccttcaaaggatgtgcgaatggtttgcttgcttaagggtatcgagcacttcgactcgggatctcggtggagtgattccatctcccgagggcaggagaagcatgatgaagctagctcaaaggatggtaaacaatttctgcacgagcgtcggcacgtcgaatagtcatcggtcgacaacactttccggttcgaatgaagttggtgttcgggtcaccgttcataagagttctgatcccggacaacccaacggtatagttcttagtgcagctactacattttggctccctgttagtccacaaaatgtcttcaatttcttcaaagatgaaagaactagaccacagtgggatgttctatccaacggcaacgcagtccaagaagttgctcatatcgcaaacggatcacatcccggcaactgtatatccgttttacgagcctttaatacaagtcacaacaacatgttaatactacaagagagttgcattgacagttctggttcactggtggtatactgtccagttgatttaccagctattaatgtagcaatgagcggcgaagatccatcttacattccgttacttccgtcaggttttacgataacacccgacggtcatctcgagcaaggtgacggagcatcgacgagttctagtactgggcacggaagatcgtccggtggttcattgattacggtagcgtttcaaatactagtgagcagcttgccatcggcaaaattaaacttggattcggtcacaattgttaataaccttattgctaatactgtacaacaaattaaggctgctttgaattgtcctagttcttgaactgatttgatttgggttatggtgcatgtgtgtgtctagggtttttcttactacaaggcatttttgtttttttttttttttcaatttaatctttggaagagtggttactaatattcgaagaggagtcaataacacaaacgtatatgttatttgtcttttcttaaattttaatcctttgtgttggacctcaacctcgcttgcttggttcgggtatattgacttctatnccattggctttatnct

SEQ ID NO: 15641 - DNA, 944 bp, Gossypium hirsutum
  Predicted polypeptide sequence is orthologous to G386, G707
tcagtttggcccttgttgaaaccttgatggactcgaatcgttggtcggagatgtttccatgtatgattgccagaacatcaacgactgatgtgatatctagtggtgtgggaggaaccaggaacggtgcacttcaactgatgcatgctgagctccaagtcctttctcctttggttccagttcgcgaggttaatttcctaaggttctgcaagcaacacgcagaaggggtttgggctgtggtcgatgtgtccattgagaccatccgagaaacttcgggtgcaccctcatttgtgaactgcaggaggcttccttctggctgtgttgtgcaagatatgcccaatggctactccaaggtgacatgggtggaacatgcagaatatgaggagagccaagttcaccaactctaccacccattgctaagatcggggatggccttcggtgcccaacgctgggtggccaccctacagcgccaatgcgaatgccttgctatccttatgtcctcctctgttcccactagggatcatacagggataactgcaagtgggagacgaagcatgctaaagctagcccaacgaatgacggataatttctgtgctggggtgtgtgcctccacggttcataaatggaacaagctgaacgtagggaacgtggatgaggacgttagggtaatgacccgaaagagcgttgacgaccccggtgagccaccgggcatcgtgttgagcgcggctacttcagtttggttgccagtgtcacctcaaagactgtttgatttcctgcgtgatgaacggctgagaagcgagtgggacatcttgtccaacggtggtcccatgcaagagatggcccacatcgccaaggccaagatcacggcaactgcgtctccctctctccgtgccagcgccatgaacgcaaaccagagcagcatgctgatactgcacgagacatgcatc

SEQ ID NO: 15642 - DNA, 971 bp, Gossypium hirsutum
  Predicted polypeptide sequence is orthologous to G386, G707
ctcgaatcgttgggcagagatgtttcattgtatgattgctagaacatcaacaactgatgtgatatctaatggcatgggaggaaccagaaatggtgcacttcaacttatgaatgctgagcttcaaattctttcacctttagttcctgttcgtgaagtaagtttcttaaggttctgtaaacaacatgctgaaggtgtttgggctgtcgttgatgtgtccattgatactatcaaagaaagtactacatttgttacctgtaggagacttccttctggttgtgttgttcaagatatgcctaatggttactccaaggttatatgcgttgaacatgctgaatatgatgagagccaagttcatcaactataccggcctttactaagttccggcatgggcttcggtgcccaacggtgggtggcgacccttcaacggcaatgcgaatgccttgccatactcatgtcctccaccgttcccactagagaccacaccgctataactgcaagtgggagacggagcatgttgaagctagctcaacggatgacagataacttctgtgccggggtttgtgcatcgacggttcataaatggaacaagcctaatgctgggaatgtagacgaagacgttagggttatgactaggaaaagcattgacgaccccggcgaaccgccagggatcgtactaagtgccgccacttcggtttggttgccggtgtcaccacaacggctttttgatttcctacgcgacgaacggttgaggagtgagtgggatatattgtcgaatggcggacctatgcaagagatggcacacattgccaaaggccaagatcatggcaattgcgtttccctcctgcgtgccagtgccatgaacgcaaatcagagcagcatgctgatattgcacgaaacatgcatagacgcagcacgtcgcttgtagtgtacgcgccagttgatattccagccatgcacgttgtcatgaacgg

SEQ ID NO: 15643 - DNA, 3023 bp, Gossypium hirsutum
  Predicted polypeptide sequence is orthologous to G386, G707
aaagacatgtcaattgggttttctttttaacgctttgatactgtgaatgtgaaagagaagaaagctttttccttgggttttgtgttttgattatggtttttccatgacatctttttgacttctcttttagttttttttataataaaatatatcgttgatgtccttttcaagcaattggtcaaacatgcagttacaaagattagggtttttcatatttatcagtctttccatggcgttttcagggatttttccagtctgggtttaggcaaaaggatttggtttttcttttttctttatcccctaaaaggtgtgacctttttttccctttaataaaccctgagaatagtgtgttgagtgagtcttgcatgggcgttgacaatagaacagcctttcttcattctaaaagaatggctagtcatggtgagctgaggctgattggagaaaactatgatcctggttttattgggatgatgaaggaagatgatggttatgggagtagtgatgattttgaaggtgcgttaggtaatgatcaagatactgctgataatggaagaccacctaagaagaagaagaaattccataggcacaatccacatcaaatacatgagcttgaatctttcttcaaagagtgtcctcaccctgatgaaaaacaaagaagggaacttagtaggaggctagccctagagagcaagcaaataaaattttggtttcaaaacaggagaacccaaatgaagactcaattggagcgccatgaaaatgtatttcttaaacaagaaaacgacaagcttcgagccgagaatgatttgttgaggcaggccatagctagtgccatatgcaacaattgtggggttcccgcagtgcctgatgaaatctcttatgaacctagccagcttatgatcgaaaattctcgattaaaagacgaactgaaccgggcacgtgctttaacaaacaagttcttgggcaggcatttgtcctcctcctccgccaaccctagtccttctccttctcagggcttaaattccaatgtggaggttgtagtaagaagaactggtttttgtggattgaacaatggaagcatttctttgcctatgggatttgagtttggtcatggggctacgatgccattaatgaacccttcttttgcgtatgaaatgccatatgacaagtcagccttggtggatgttgcattagcagctatggatgaattaattaagatggcacagatgggtaatcccctttggatcaaaggctttggtgatgggatggaaaccttaaatctagaggagtataagaggactttctcctctttcattggcatgaaaccaagtggattcacaactgaggctactagggaaactgccatggttccccttcgcggcttggccctcgttgatacactaatggatgcgaatcgttgggcagaaatgtttccctgcatgatttcaagagcagtaaccattgatgtgctatcaagtggtaaaggtgtaaccagagacaatgcattgcaattgatggaagctgaatttcaagttctttcacctttggttcctattcgtcaagttcaattcatccggttctgcaagcagcattccgacagtgtgtgggccatcgttgatgtttctattaatctgagcaatgctgcaaatgcactgatgtttgcaaattgcaggaggcttccttctggatgtgttatccaagatatggacaacaagtactccaaggttacatgggttgaacactcggaatatgatgagagcacagtccaccatctctttcgccccttactcagttctggttttggctttggtgcacaaaggtggattgccactctccgaagacagtacagcagcttggcacaactaatgtcccctgacatccacggtgaagacattaatacagtggggaagaaaagcatgttaaagcttgcacagcgcatggcatacaacttcagtgctggaattggtgcttcaagtgtgaataaatgggacaaacttaatgttggtaatgtgggtgaagatgtaagggtgatgactcggaagaatgtaaatgatcctggtgagcctctagggattgttttgagtgctgctacttctgtttggatgccgataacacagcaaacgctgtttggtttcttgaggaacgaacggatgcgtaatcaatgggacattttgtctagtggtagaccaatgcaggcgatgttcagtgtcgccaagggtccaggacaaggcaactgtgtctctatccttcgtggtgctgcagttaacggcagtgacaccaacatgctaattttacgagaaacatggagcgatgcttgtggtgcattgatagtgtatgcacctgttgacgcctcatcaatcagagtggtgatgaatggtggtgattcatcgcatgtggcactgttaccatcaggatttgcaattcttcctggcgtccaaactgatggaccttcaatgcaacctgacatcgatgagaatactagtgatggatgcatacttacagtggggtttcagattttggtgaacagcgttccgactgccaagctaacagtggaatctgttgaaactgttaaccatctcctaacctgcacagttgagaaaatcaaagctgccctttcggtaacacagctgggatctgttgagtaaaagtcacagctaaaagtttattaaataagtacagaatggaaagaaaatggaggggtttcaagtcaagaacgaaccgcttgtggagaagcaatgcttcatattcatgcttggttttgggcgttcggggattattattctggttcgggcattgacttggtggacctgtgagattctcagctcttcatttctcagttggcgaactttttttttgtttgtttgtttaatttagtcagtcatgtttaaaagacaaaatatagatacagcaagcctcgtctttttacttgttcttaaacataaagttaccattaaagtttgtattatttacatgcttaccacaagtgaattagttaaccgtaataaatttctaaaacaggttcattt

SEQ ID NO: 15644 - DNA, 2622 bp, Gossypium hirsutum
  Predicted polypeptide sequence is orthologous to G388
ccaaccatttcatcagctcatccaaatcccatattgccatgggcgtcgtcgacatgactaacccacccaccaaagatttctttgcttctcccgctctctcccttagccttgccgggatattccgggatgccggtgctacggcggcagctccgactgcgagtgcgagtatggaggtggaggaaggagatgaaggaagcggaggaggaggaggatcaggtagtaagaaagatgacactgtagaaatcagtagcgaaaactcgggccctgcaagatcaagatccgaggatgacttgctagatcacgacgatgacgagaatgacgccgataagtccaaaaagaagaagagaaagaagtatcatcgtcacaccgccgaccaaatcagagaaatggaagcgctgtttaaggaatcaccccatccagatgagaagcaaaggcagcaattgagtaaacaattaggccttgctccaaggcaagtcaagttctggtttcaaaatcgtcgaacacaaatcaaagctatacaagagcgccatgaaaattcgttgttgaagcaagagctggataagctccgagatgaaaacaaagccatgagggagactataaataaagcgtgttgcctcaactgtggcatggctaccactgctaaagatggcttcattacagctgaagaacaacaactacgaatcgagaatgccaaacttaaagccgaggtagaaaaacttagaacagtaataggaaaataccctccgggtgcatcaacgactggttcatgttcatctggaaatgaccaagaaaacagaagttcattgaatttttacactggaattttcgcacttgaaaagtcgagaatcatggagattgtaaaccaagccatggaagagttgcaaaagatggctacggctggtgaaccgctgtgggttcgaagcgttgagacgggtcgggagatacttaactacgatgagtacgtcaaagagttatctgttgaaagttcaagcaatgggaggccaaaaagatccattgaagcctctagagagactggggttgtttttcttgatctcccgaggctggtacaaagcttcatggatgcgaatcaatggaaggaaatgttcccatgcataatctcaaaggctgctactgttgatgtgatttgccatggggaagctccgaataaaaatggtgctgtacagttgatgtttgctgagctgcaaatgctcacacccttggtgcctaccagagaagtgtactttgtccggtactgcaagcaattgagtgctgaacaatgggcaattgtcgacgtttctattgacaaagttgaagaaaatatcgatgcatccttagtgaaatgcagaaaacgtccttcaggttgcatcatccaggataaaaccaatggccattgtaaggtgatttgggtggaacaccttgagtgccagaaaaacactgttcacacgttgtaccgtaccattgttcgcagtggactagcatttggtgcaaggcattggatggcaacattgcaacatcagtgtgaaaggctcgttttcttcatggcaaccaatgttcctaccaaggattcaactggtgttgcaacattggctgggaggaagagtattttgaaattggcccagagaatgacatggagcttttgtcattcaattggagcatcaagttatcatacctggaataaagtctctacaaaaacaggggaagacattagagtatcttccaggaaaaacttaaatgaccccggtgagccacatggggtcatcgtctgtgctgtttcttccgtttggttgcctgtctctccgactcttttatttgatttcttgagagacgaatctcgtcgcagtgagtgggatatcatgtcaaacggaggtcctgtacaatccattgcaaacttggccaaaggaaaggatcagggaaatgcagtaacaattcaagcaatgaagtcaaaagagaatagcatgtgggtgctccaagatagttgcactaatgcttttgaatccatggtggtctttgctcatgtggatgtaactggaatacaatcagtgatcacaggatgtgactctagcaacatggccatattaccttcaggcttctccattcttcctgacggactcgagtcaaggccattagtgatttcttctaggcacgagaaaagcaatgataccgaaggaggatcattgcttactgtagctttccaaatcctaacaaacagctccccgactgccaaactaaccatggaatctgtggaatctgtcaacacaatagtatcttgcacattacgaaacattaagacaagcttgcaatgtgaagatgggtgatcaaatacccttcttgattaggtagacattaactgtaaaacccatagttttttttttttttttattttctttcccccacaacttgcaggtttaagcaatgacctatttttgctatgtgggtttgtttctattccttgtttggttagcacagatggtttggacaccaggcatgttttggagggcaagctggattcagagagttcggatttaaaaatcattttagatgtaggaaagtgaaatattctcatgtatagaattactattcattgattcaatattttgtttgtctttattactttaccaactt

SEQ ID NO: 15645 - DNA, 815 bp, Gossypium hirsutum
  Predicted polypeptide sequence is orthologous to G390, G391, G438
cactcttcttctccttcttcttcttcttcaacatggttaagatttcagtttctcttcacatttccatggtgggttcttgcaggaaaccagcttttttgtgatgcttctccttttgggctctcttttttgagagagagagagagagacagagagagagccttttttaaagctgctgcttcttctctttatttggtgcagtgggtagttgaagctttcttgagaagccatttcagtgatatcgagcttgcttgttagctgtgttcttttgttttggtattgggatatcaaagcttggttctttgtgggcagattttgagacctttttttttttttcatttctcggtcaccagcttgacatcatcagctggaaaaaaaaagccaaaacctcactaaaaggctatccacttggactttacttgaggcttgtttgcaatcaaaatccctcatttaactcccttttgctttatatatatcatactaaaggacggactttactaagctgagctcttttgtttttataaataaacaaagattggttcttggagtcttggtttttagcaagaaaaatggctatggcggtggcccaacacagggtgagcaccagtggtagtagcagcatcaacaaacatcttgatgcctcaggcaagtatgttaggtacacagctgagcaagttgaagccttggaacgagtctatgctgagtgccccaagccaagttccttgcgtaggcaacagttgataagggaatgccccattctttccaacattgaacctaaacagatcaaagtttggtttcaaaatcgcacgtgtagagag

SEQ ID NO: 15646 - DNA, 678 bp, Gossypium hirsutum
  Predicted polypeptide sequence is orthologous to G390, G391, G438
tgttggaccaagcaatctcctagctctccggaagcacttacactggctcactggatctgccggagttatagttaccatttaggggcaaaactgttgcgacctgaaccagctgtgggtgactcgttattgaagaatctctggcaacatcaggatgccatattgtgttgttcattgaagtcgctaccagttatgatcttcgcaaatcaagccggacttgacatgctcgagacaactctaatggctctccaagacatcacattggataaaatatttgatgagactggacgcaagacgttatgctccgattttgccaagttgatgcaggagggattggcatacttaccagccggaatctgcatgtcaacaatgggacgccatgtctcatatgaacaagcagttgcttggaaagtccttgaagctgatgaaagcactgtccattgcttggctttctcttttgtaaactggtcttttgtgtgagaacatttgactgtaatttatatgttctacacctcaggctttccccagtggagaagaaaaaaaaagaagttttgtaatggcttaattcacgatttggccctgaagtatacctcttttctttctttgtacctaaattctttttttgtctcaatttggtatctcaagtatcaatcacttctcaaaaaaaaaaaaaaaaaaaaa

SEQ ID NO: 15647 - DNA, 883 bp, Gossypium hirsutum
  Predicted polypeptide sequence is orthologous to G409
gcggccgccttgacctccagcaagcaactttttgtgtctttttactcgccggaaagttttagacacaaaaatattacacacatacacgaagtttaagatatagaaagacaagtttgtataaagaaaatggagtctggccgtctttttttcaatccctccactacccaccgcaacatgttgcttctcgggaacactgaacccatctttcgaggggcaagaacaatggttagcatggaggaaaacccaaagaagcgactgttcttcagctcgccggaggatttgtacgacgaagagtactacgacgagcagttgcccgagaaaaagcgtcgccttacgtcggagcaggtgtatctgctagagaagagctttgaggcagagaacaagctggagccggagaggaagagccagttggccaagaagttaggactgcaaccaaggcaggtggcggtatggttccagaaccgccgtgcaaggtggaagacaaagcagcttgaaagggactatgacctcctcaaatcttcctttgattcccttcagtccaattatgacactattctcaaagaaaatgagaagctcaaatctgaggtagcttccttgactgaaaaactacaagccaaagatgtggcaacagaagcaatagcaggtgaaaaggatgaagggttagcagctgagatggcctccgccctccaattcagtatgaaggtggaggaccgtcttagtagcggcagtgtcggaagcgcggtggtggatgaggatgccccacagctggtggacagcggcaattcctactttccaagcgatgaatactccagaggcattggccctttcgatggggttcagtcggaagatgaggatggcagtgataattgcgggagttacttct

SEQ ID NO: 15648 - DNA, 550 bp, Gossypium hirsutum
  misc_feature (339)..(339): n is a, c, g, or t
  misc_feature (386)..(386): n is a, c, g, or t
  misc_feature (417)..(417): n is a, c, g, or t
  misc_feature (429)..(429): n is a, c, g, or t
  misc_feature (471)..(471): n is a, c, g, or t
  Predicted polypeptide sequence is orthologous to G419
ttttttttttttttttttttttttttttaataggttaaagttttagcaaaacagattcaacccaaagaggaaacaaatatctgtacaacctagcatcaatagctggtaataattccaagttagcctggtagtaaatagacatgctcttccaattcaaaagagttagctaccagccattaaattaatgcagctatatatatgttttcagtatttaccattgttgcctaaactactgatctaccatttcctttctttcttttccttttctaatacctagctatccattgaaatcatgaagcaaccggggcaccaatcaagctcctgtaagacaaatgctgngcctcaccatcaagaagtgagtactgtactggttgacaatcttcaangtggtctctagggtaaaaaattgaacttcgngctacaggcganaaggctaagctcaccccagtcccaccatgttgttgcaacctnaaagtccataatacacttcctccggcattgaaacaactttggttagccattgtaatcacttccattataagatgctcca

SEQ ID NO: 15649 - DNA, 640 bp, Gossypium hirsutum
  Predicted polypeptide sequence is orthologous to G427
gcttagcgtggtcgcggccgaggtaccaccatcaacacgttggaacttgatgtctaccttttccgcttggacttcaaggaggtgaccgactgagaattgctgtgccaattgcgcttcctttggttgatgaaccagttgttgatttgctttagttgcaatccagtttcctccacaagtttggccttgtcatcttcagttgggtatggccactttgagtgctgttgccaccagttcttgagcactgtagtggtgtcacctggtaattttccagcccttcttttgcgtaatatttcctccctcacatcctcaattcttgatttgaaaccctgtttgagttcaatcttgagctcttgacgaaccctctccattaaagatctttcagattctgtgggaagtaagggaccaaaacccattaaatcatggccttcgggcccagattgatccatggagaagtccatttgaagttcatcctcatcgtctgacattgttgcacctgtgccttcacccaaggttactccagtgagcgcttgtaagttattttcaatttcacggcaagccatgacagcttcaacggcatggactctgacatgttgttgaagctgttctttgaaagtacctgcccgggcggccgctcgaaagc

SEQ ID NO: 15650 - DNA, 768 bp, Gossypium hirsutum
  Predicted polypeptide sequence is orthologous to G427
gcttagcgtggtcgcggccgaggtacacagaactatcaaatattgtgccaagaagttgtcgagctcctgtctttcatggggtgatagggaatgaccatgttgatgatgctgtgaagcataagatctaagaaggttatgagattgtgctaactgtgcgtcaatcaaaggcaactggtcgattggcgttgccacacggagacaagaaacatgagctgctaatagctgctcatatagcggatgaacagctatctcagccttcagctgtcggttctgctcaccggaaaccgacacttctccgctgcttaaccctccaattccaccactcccaccaccactactcatcatacctaaccctggttcttgcatttctcggaaccacaaccccccctatatataaataacgtattagaggaaaactgaaaaagggagtaaagaaaggaaaaaaaggtggtattgatatatgtatatagaaatgatcatcaatcaagtagttaaggaccacaaagaaagacccttgtggttgaaagttgagagtgaagtaaggtgatcagagcctatattgtggagtgtgtgtgtgtgttcttattggaagaaagagaaataatgtttatatgaggttaatggtgtgagtatatcgggatctgagacaagattttctgcaccctccactgctatatatgttgcagggtgtttttttacttttacatacacagagagagccaaagaagcaaaagcatgaaaataatcaaagcagcatgtacctgcccg

SEQ ID NO: 15651 - DNA, 746 bp, Gossypium hirsutum
  Predicted polypeptide sequence is orthologous to G427
gcttagcgtggtcgcggccgaggtactttcaaagaacagcttcaacaacatgtcagagtccatgccattgaagctgtcatggcttgccgtgaaatcgaaaataacttgcaagctcttactggagtcacattgggtgaaggaacaggtgcaacaatgtcagatgatgaggatgatatgcagatggacttctctttggatcaatccggcaccgatgggcacgatttaatgggttttggtcccttgattcctactgaatccgaaagatctttaatggagagggttcgccaggagctcaagattgaattgaaacagggttttaaatctagaatcgaagatgtgagggaggaaattttacggaaaagaagggctgggaaattaccaggtgacacaactacggtgctaaagaactggtggcaacaacactcaaagtggccatacccaactgaagatgataaggccaaacttgtggaggaaacaggattgcagctaaagcaaatcaacaactggttcatcaaccagaggaagcgtaactggcatagcaactctcaatctgtcacctctttaaagtcgaagcgaaaacggtagaggtgaataaattcaatgagaaatggagaagaggaaagtttgagcatgttgatgtcaacttcttgcggtaaatagctgtgggctaacattttgtgaaggtaaagtgggaagtgaggtggtttcaagaaacctaagtacctgcccgggcggccgctcgaagc

SEQ ID NO: 15652 - DNA, 856 bp, Gossypium hirsutum
  Predicted polypeptide sequence is orthologous to G427
gcggccgcgtcgaccaaagacctaattttactctgcattacaatgatctaccatggccgtaaccaagtataaagtttattacactgtacactcccaatttattcacatctatatgaaagagacatacataccaaaaatcataatctaccaacgcaactacaatttcatccaattaaaagtaacactagttataattttcctaaacttccctaccaatacctccgatctcgcatacctgcaaaatggcctaatatcagcttcatcgcccgtgttagccggtttctcatgttgcagcaaaatctgatcctcaccttataagcctctgctgcagttccactaaaagcctatatatcttgtgatctatataagaagtaatgttgggtttaatctttgatttggtttaacacgaaccgatcaccttatgttttcaccttttacgtttgctcttggagacggtggaagtcgatggattgctatgccagttcctcttcctttgattgatgaaccaattgtttatctgttttaactgtaaacctgtttcttgaaccaaccttgccttatcttcctcagtagggtaaggccacttggaatgtgactgccaccaagcttttaaaaccgatgttgtatcgccgggaagttttccggcccttctttttcgcaaaatttcctcccttatgtccacgatcttctccttgtaaccctgtttgagttcatgtttgagttcatgcctcacacgctccatcaaagacctttcactctctgttgggatcaaaggtccaaaccccattgaatctgtaccatccaaacttgtatcaaacaagttggcatcactgtcgacttggtcatcatcatcatc

SEQ ID NO: 15653 - DNA, 920 bp, Gossypium hirsutum
  Predicted polypeptide sequence is orthologous to G427
gaaaaaagggataaaggtgaagggggtagtcatggcgtttcaccataataatcacttttctgatcatcatcaggaccttcctctccatcaccttaccgagcaccaccaccagcaggcgagtcaactgtcggaaaccaacggtccaaattggttgaacaccgcccttctccgttcacagcagcctcaaccggcgcaaccacactcttcccagttctccgagcctaactttcttaaccttcatactacgagagctgcttctgattccaccacgggttcccaagctccgaaccagtggctctcccgtacgtcgtcttcccttcttcatcgcaaccacagcgacgtcatagacgacgtaggtgccgccgcggaagctgcgagaggaggcggaggggaatccatggtcgccatggaatcgggcggcagcggcaacaacaacggtattatgaacaacaacaagagcgaaggtgttgtggtggaaagcggagggggcggtggggatggggtcgtgaattggcagaatgcaagatacaaggcggacatactagctcaccctttgtgcgagcaactcttgtctgcacacgtggcgtgccttagggtcgctacgcctgtggatcagctcccgaggatcgacgctcagctggctcagtcacagcatgtggtggctaagtactcctccctcagtggtgggtcccagggcgaggttgccgacgacaaagagctcgatcagttcttgacacattatgttctgttgctatgttctttcaaagaacaattgcaacaacatgttcgagttcatgcaatggaagcagttatggcttgctgggaaattgagcaatcattacaaagcttaacaggtgtttctccgggtgaagggcacgggtgcaacaatgtctgatgatgacgatgaccaagtagacagt

SEQ ID NO: 15654 - DNA, 873 bp, Gossypium hirsutum
  Predicted polypeptide sequence is orthologous to G427
tcgcttcttcaacgtaatcacagtggcgtcgtcgacgacgtggcagcggtggcagcagcaggaggaggagttggtagggaaaccatggtcgccgtggaatcgggagaattgaagagcagcaacagcgagtcaatgaataacaacaacaagagcgaaggtgtagcagtggaaagcggaggaggaggtgatggggctgtgaattggcagaatgcaaggtacaaggcggaggtactagcccacccgttatacgagcaactattgtctgcacacgtggcgtgcctgaggatcgccacgcctgtggatcagctaccgcggatcgacgctcagctggctcagtcactgcatgtggaggctaagtactcggctctgggtggtggggcccaaggcttggttggtgatgacaaagagctcgatcagttcatgacacattatgttctgttgctatgttcatttaaagagcaactgcaacaacatgttcgggtccatgcaatggaagcggttatggcttgctgggaaattgagcaatctttacagagcttaacaggagtttctctaggggaaggaacaggtgcaacaatgtcggatgatgatgaagagcaaatagacagtgatgccaatttgtttgatggaagtatggagggtccagattcattgggatttgggcctctggttccaacagagagtgaaaggtctttgatggagcgtgtgaggcaagaactcaaacatgaactcaaacagggttacaaggagaagattgttgacataagggaggaaattttgcgcaagagaaggcaggaaaacttcctggtgacacaacttcggttttaaaagcttggtggcagtcacattccaagtgggccataccccactgag

SEQ ID NO: 15655 - DNA, 920 bp, Gossypium hirsutum
  Predicted polypeptide sequence is orthologous to G427
gtcattcttctttgtctctcaaactctctatagcacgtttcttacagtaatttaatactaataataatcatatattttcttcctttctcttccaacatatatcctctcttaaagccgtagcctttattttttttgctagacaaagagtgtatcttttaagttaatgagactgtaatttttttttctgaaagctgtctttgtcatcattttcttcgtttttctctctctctctatcagaccatgaattcataatcatcgtcgtcgtcgtctccttcatcgatatatctctttcgaatacgtttagaggaaaaaggaaaaggaaaaagggtacatacatggcgtttcaccatagcagcacccacctttctcaagaccttcctctccatcactttaccgaccagcaacagcaacagcaacaacccaaccaaacccagcaaggcgaccaacttcaggaaaccgccgctcccaattggttaaactccgcccttctccgtccccaacagccgcacccaccgcaaccccacccgcacttctccgaccctaactttcttaaccttcatactactacaactgcttccgactccaccgcggcttcccaagctcctaacccgatgttctcccgttcatcctcgtcgcttcttcatcgaaaccacggcaacgtcatcgacgacgcggctgctgcggcagcagctgcggtaggaggaggtgttatggccgtggaatcgggtgatttgaagaacagcatcagcgagactatgaataacaataagagcgaaggcgtggtggtggagagtggaggaggaggaggcggagatgggattgtgaattttcagaatgcgagatacaaggcagagattctagctcacccattttacgagcaactattgtcagcacacgtggcgtgccttagatcgccacgc

SEQ ID NO: 15656 - DNA, 890 bp, Gossypium hirsutum
  Predicted polypeptide sequence is orthologous to G427
ttctttgctaaagaccatcgaatccttccctctctttccagttttccgatcaacacaacatggctttcgatggttttgtctccgacaataccaaagacatgcaaacccttgctctaaacgaaccaccgccatcagctgctgacatcgatcattgggaaagagctaaatgcaaggccgagataatggggcaccctatgtacgaccagttgctggaagctcatgtcgcctgtctacgtgttgctacgcctgttgaccagctcgctcagatcgatgctcagttagctaggtcccaagatgtgttggctaagtactcctcggccgctgctgccgccggttctgctgaagaagaactcgatcacttcatggcaaattatgttctattgcttggtttcttcaaagaccaattgcaacaacatgttcgtgttcatgcaatggaagcagttatggcttgttgggatcttgagcaatcacttcaaagtttaacaggtgtatctccaggtgaaggcactggtgcaaccatgtctgatgatgaagatgaagttgtagatagtgataccagcttgtttgatggaagttttgatgggattgacagcatggggtttggccccctcgtcccatccgagactgagagatcactaatggagcgtgttaggcaagaactgaagcacgagctgaaacagggttacaaagagaaaattgtggacattagagaggaaattctacgtaagagacgagctggaaagctaccaggcgatacgacctcgtttttaaaagcttggtggcagtcacattccaaatggccttacccaactgaagaagacaaagcaaaattagtacaagaaacaggattgcagttaaagcagattaacaactggtttataaaccagaga

SEQ ID NO: 15657 - DNA, 881 bp, Gossypium hirsutum
  Predicted polypeptide sequence is orthologous to G427
cccgtctcttttatttcacaattctccaacaaccctgctttggtgtttttttctctcttcatagctacatctctctctcctttgatcttcttctttaccaaaacttaaacctcttcaaacatggcttttgatggttttgtctcccaccatagtgaacacatgcaaacccttgcttttaaccaaccctcttcacctcccaacttcgacccagctaaatgcaaggccgagataatagggcatcccatgtacccccagttgttggaaggccacgtggcttgtctacgtgttgccacgcctgttgaccagctccctaagatcgatgctcagttggctaggtcccaagatgtctcggctaagtactcatcatcacctactgctggggctgctcaccatgaactcgatcacttcatggcaaattatgtgctattgcttggtttctttaaagacgaattgcaacaacatgttcgtgttcatgcaatggaagcggttatgtcttgttgggatcttgagcaatcacttcaaagtttaacaggtgtatctccaggtgaaggcacaggtgcaacaatgtctgatgatgaagatgaagttgtagataatgatcacagtttgtttgatggaagcttcgatgggattgacagcatgggatttggccctcttgtcccatcagaaactgagagatccttaatggaacatgttaggcaagaacttaagcacgaattgaaacagggttacaaagagaaaattgtggacgttagagaggaaattctgcgcaagagaagagctggaaagctacctggtgacaccaccttgattttaaaagcatggtggcagtcacattccaaatggccttacccaacagaagaagacaaagcaagattagc

SEQ ID NO: 15658 - DNA, 494 bp, Gossypium hirsutum
  Predicted polypeptide sequence is orthologous to G428, G1594
tttgggagtcatattagcagcttgaagttggaattctctaagaagaagaagaaagggaaactaccaagagaagcacgacaaacattgctcgagtggtggaatgttcactacaaatggccataccctacggaggcagataagctagcattggcggaatcaacggggctagaccagaaacaaatcaataactggtttataaatcaaagaaagcggcactggaaaccatcggagagcatgcaattcgcggttatggataatctgtcggggcaattcttttcagaggactgagggcgggggcaactaccgactggcttgctttctcataaatgtatatgccacatcattaattaattatatggttttgttttgcatatgccttctatgccatgatgtatattctgaatgcaaaatgtattataggacttaaaactcagatttgaatctctccctcccgtcgacttggaatatttggataaaaaaaaaaaaaaaaaaaa

SEQ ID NO: 15659 - DNA, 627 bp, Gossypium hirsutum
  Predicted polypeptide sequence is orthologous to G440, G864, G1421, G1750
gtcccactgagaagaatatcgttgagagaagtaaaacgacgtcgtcgttgtcaaaagcttctcggaaacggccggcggctgttgctgaagctaaaggtaaagcgccggcgaaagcaccggctggaaagaagttcagaggagtgaggcaacgaccttggggaaaatgggcggccgaaataagagatcctcttagacgtgtacggctttggttaggcacctatgacactgccgaagaggcggcaatggtttatgacaacgcggcaattcagctgcgtggaccggacgcgcttacaaactttacaactccccaacaaaaatcgattcaagaaaaaaccagccaaaaaccgttatccaactccgattataactccgacgaagaatctcataaaacagatccctgctcaccgacttccgttcttcgctgccattcgctttcccgtcgatgaagccgactctcaaagcgccaaagaatcgcgcgaaatcggaagcgaagctcgagatgttgtcgatgattcttgctgcttatcgggagaaaacctgtcgggtttctccgactattcctctttgttttccggcgacatgtttttgttcagtgcccgacttttttgacgatgatacgagtttaca

SEQ ID NO: 15660 - DNA, 811 bp, Gossypium hirsutum
  Predicted polypeptide sequence is orthologous to G446
gcggccgcttcgaccaattggcttcattcactgagcaagatccatgcagtcttaattctggtggggtgagggatttgtctgatgacagcaacaatcaaagtgggatatatagtagctgtcttaacattgatgttagcaatggttgcagcaccgtgattgatccttttgtttccagtgccattctagatgagttttgctcattgaaagatgctgattttcaaaacccttcagattgtttggttgggaactttagttcttgtcaggatgttcagtctcagattacctctgctagccttgcagattctcaagctttctctcgacaagacttgcctgacagctccggtggcaatatcgattttgatgacagtggccttctgcaaaacaattcctggaagcaaacagctccacgcgttagaacatatacaaaggttcagaaggcaggatctgtaggaaggtcgattgatgtcacgagttttaagaattatgatgaactaatctctgcaatagaatgcatgtttggactcaagggtctgctggatgatcccagaggttcaggctggaaattggtgtatgtggattatgagaatgatgttcttctcgttggagacgatccttgggaggaatttgttgggtgtgttcgttgcatccgaattctatcccctacagaagtacaacagatgagtgaagaaggaatgaagcttctcaacagtgctgccacagtgcaaggcatcaatggctctaactcagaaggttccaatgcaaatgcttaaagaatccaccaagctgagttatcatcgtggttccgggattt

SEQ ID NO: 15661 - DNA, 638 bp, Gossypium hirsutum
  Predicted polypeptide sequence is orthologous to G447
tggaaatgtgccagttcccaatcaagcttgtagtgagatcgacagtggaaatgcatggagaggacattatgatgatacttcagctgcctcctttaacagataaaaaagtcaaaaacaaattgattggactttacataggctcattggtggatgcctttccattaagaagatcaatttaatgaagttcttccaaattcagaggtgttaaaaccactgccatggaattggcagaaggatggatcttgttctaactttagcatccactttttttgactttgccctttaatcactagttttactacgaggtaaggtgcaaaagggagctttggggcaagtttatcattgatgtataatataaccatattttaaaagccggtctgacattttcagcaagatttgtagggttagtaactattgctcaattaaagatacatttagcatcaataaaaattagatatatagatataactcgagggggggcccggttcccaattcgccttatgtgagtcgttttacaattactggccgcgctttacaacgttgtgattgggaaaccctgcgttcactaattaatgccttgtgcaattccttttccaattgcttatacaaaaggcccttcgttgccttccacattgtcg

SEQ ID NO: 15662 - DNA, 756 bp, Gossypium hirsutum
  Predicted polypeptide sequence is orthologous to G447
gcggccccctctacttttttaatacacaaaaaaaaacgataaattcatgatttttcctttgtacaaatattagagtatagttgaggataatataaagggtcaatcaatccaaaaacaaaagagaaaagaagctggaatatcaatttcttaacataatcaaacctaaggttaagctggattcttaaataaaagctcaaccgccccttccagtccacagttttcctcttctgcttatatgatattgtcatctcttcttttcgcatgagccccggactactgatggaccttagcttgtaactatactagtttatgcattcccattgccagagctgctacagtcttgattaggcaggacagagttcccaaactctccatccatgctcatctgctggacttcctgaggggagagtattttgatgcatcggacacagttgataaactcctcccatgggtcatctcctactagcagaacatcgttctcgtgatccacatagactagtttccagcctactctccctcggtcttccagctgcccctcaattccaaacctacgagccaaatcttgtttgagctcatcataacctgaataacgagttatatctattgatcttccaacagctccacgtttgtaaaccttggtatatgttcgcaatctctgaaattgtgatggtggggtccatgcattgcggtttatgaagctgctatggtttatagtgggatcaatggagttaaacgccatatctggaactctatatg

SEQ ID NO: 15663 - DNA, 728 bp, Gossypium hirsutum
  Predicted polypeptide sequence is orthologous to G450, G456
tttttttttttttttcttttttttttttttttttttttttttttttttttttttttttttttttttttttttttttttttttaaaagcaaatagaaaacacggatttggataaatagtcaaaggcttatgacatccacatatatataaatatatatagtagcaaacttccatcttatgctttcagtagttactgtgacattgaatcgtctaggtacggtttttgcacttctccatagccctcggagctaggccgatagcctctgtactcttcatgatcctcaatctcttaaacgagtccccggccataatggccgaattcccgggtaccaacacaatggcgcgcttcccgagaaaaaaaaaaaaagctcgtccagatctcggagcttggcgtaatcagggtcatagctgtatccggtgtgaaattgttgtccgctcacaatggctagagtactttccatatttggcgcctcgttatcatccaaaatacgccaggaatattccaacgagataacccggttaaatccttcaccgggggaactggtcaaaaataccctccggaaacttcggggaaagcgaaacctgtgaagtaacgcgaacatagctgaaatacaaaagggccccaaaacatgggcaacctggccaacagctccgtgaacaggtacgccacaattcacacaagacagaaaaatggacccacgcgccacaagagacaccaaaaaaggctcac

SEQ ID NO: 15664 - DNA, 769 bp, Gossypium hirsutum
  misc_feature (769)..(769): n is a, c, g, or t
  Predicted polypeptide sequence is orthologous to G450, G456
tgtttcgccccacgcgtccgcactctcctctatttcttaacaaacatcaactccagagatcgccaaacatgctaggaactgagcatgatttgaacttcaaagagaccgagctgtgtctcggcctgcctggtggaagtggtggaggaggaggagctgccgccgccggtggtggtggtggtggtaaaaatgaagtggaaagttccccaaagaccaccgggaaaagaggctactccgagactgttgatttgaagcttaatcttcagtctaaagaaggttgcatggatctgaatcagaacctagaaaatggttcaaaagaaaagaatcatctcactgcaaaaccaccagccaaggcacaagtattgggttggccaccagttcgatcttataggaagaacattatggctaaccagaagaacaacagtgacgaaattagtgacagagctagcagtggcagtgggggtgcagcgtttgtgaaggtttgcatggatggtgcaccatatttgcgtaaagtagatttgaagatgtacaacagctaccaaaagttatccgatgccttggctaagatgttcagttccttcaccatggggagttatggatgtgaaggaatgatagacttcatgaatgagagcaagttgatggatcttctcaacagttctgattatgtgccaacctatgaagataaggatggcgactggatgctcgtgggcgatgtcccatgggagaatgttgttgaatcgtgtaaacgtttgcgcattatgaaaggatcagn

SEQ ID NO: 15665 - DNA, 785 bp, Gossypium hirsutum
  misc_feature (639)..(639): n is a, c, g, or t
  Predicted polypeptide sequence is orthologous to G450, G456
tacctttttcgcaagccacgcgtccgaaccttcctatattcctattcctattcttatcatcactctctcaatcctttgcttattacaacaaaacctttttcttctttatttttcacctttcagttcaaatcatcaaacccagaaagcgtggctacaacaaactgcaaaaaaaggaaacaattagagaaagaagctatggaagttggcttaaagatgacgatgaaaggaggcggaggagatcatgttggaggttgcgacaaagagaagatggggtttgaagagactgagctgaggctagggttgcctggtggtggtggtggtggtggtgacggtgaagttgtgaggaaaagaggcttctctgaaactgttgatttgaagcttaacctttcctccaagcaagacacctctgggatcgatcccaatgatgagaaagtgaaaggcttgcaccaggagaagaatcttctcctttctgccattgatgctgctaagcctcctgccaaagcgcaagttgtgggatggccaccggtccgatcattccgaaagaacatgttagccaccaccacacagaagagcagcagcgaggagagcggcgagaaagcggcgctggtgaaggtgagcatggacggtgcaccttacctncgtaaggtggacttgaggatgtacacaagttaccaccaactctccgatgctttagccaaaaggttcagttcttttactatcggaaattgtggatctcaaggaattaaggattttcatgatgagaagtagctgatggatctccttaa

SEQ ID NO: 15666 - DNA, 795 bp, Gossypium hirsutum
  Predicted polypeptide sequence is orthologous to G450, G456
cgtcgctcttagccttttactcttttactttactccttgtagtactctcgacaatataacccccccccccccaaccctttttttttcctttaattcaaagccacaaagccaactcaaaacccacaaaagccaaagcctaggtacacagaaactacaaaaagaaatagagaaagaaggtatggaagtaggggtgaagatggggatgaaaggaggaggagatgaagtgggaggtaaggagaaggagaaaatggggtatgaagagacagagctgaggctagggttgcctggtgatggtgaggttgtaaggaagagagacttctcccacactgttgatttgaagcttaaccttatttccacctctccaactgatgacaaggacaaaaatattgtcccttctcaccttgatcctgctaagcctccacctgccaaggctcaagttgtgggatggccaccggtccggtcattccgaaagaacatgttagccacccaaaagagcagcgccagcgaggacagtggtgagaaggccgcctttgtgaaggttagcatggacggcgcaccctatctccggaaagtggacctgaggatgtacaaaacttaccaacaactctccgatgctctagctaaaatgttcagttctttcactattggaaattgtggaagccaagggttattgaaggatttcatgaatgagagtaagctaatggatctgcttaatggctctgattatgttccaacctatgaagacaaagatggtgattggatgcttgttggtgatgtcccttgggagatgtttat

SEQ ID NO: 15667 - DNA, 880 bp, Gossypium hirsutum
  Predicted polypeptide sequence is orthologous to G450, G456
catatattcccccctcctacttgcaatttctctagcaaatacactatcaagagagagagaaaagagagatattttgtgacgaaaaaaaaaaaaaggaaaaggactaaagttggatggttgtagggttttgcacgtaaaagctcgtgtttaatcatcataatgactagcattatgggcacagaggatgataagtatagcacgattaacttcgaagagacggagttgcgtttagggttgcccggcgccaatggaaacgacggtgaaactaccaaaaacaacggaaaacgagggttctcagagaccgttaatttgaagcttaacctttcatcaaaggagactgtagccgaggattccgacaagatgaaggagaagagctcaactgaccctgcaaagccacctgccaaggcacaagtggtgggatggccaccagtcaggtcattccggaagaacatcatggccgtccaaaaagccagttccgaggaggaaggtggcagcaagaaggccggaaacagtgcagccgccattactaccaccacggctgcggcgtttgttaaggtcagcatggacggtgcaccttatctacgcaaagtggacttgaaactatacaagagttaccaacaactctctgatgccttgagcaaaatgttcagctccttcactattggtaactgtgggtctcatggaatgaaagatttcatgaatgagagcaaattgatagaccttttgaatggttctgagtatgttcctacttatgaagacaaagatggagattggatgcttgttggagatgttccatgggagatgtttgttgattcgtgcaacgcttacgaattatgaaaggatctgaggcaattggacttgcaccagagcagtagagagt

SEQ ID NO: 15668 - DNA, 1020 bp, Gossypium hirsutum
  Predicted polypeptide sequence is orthologous to G450, G456
ggtgttggtccaataatttagtgcaaaaaccatcttcttttttctgctttctcgtatagcagcctgttttgagaaacttttttttgaggaaattagaaaatgtcatcggagaacgggaaaaggttgctggaaactgatgccggcggcttgaattttgaggctaccgagctgactttagggttacctggagagcctagagtaacatcggacggtggagctaagttgggcagtaaacgtggattttcggaaaccgttgatcttaagttgggtgacaacaatcaagaggttaagctgggtcactccctccaagaagctgccaagtctcccgtttcaaagacacaagtggtgggttggccgccggtgagaggctttgcaaagagaggaaagaagagttgcaaatatgtaaaagtggcggtggacggtgctccatatttaaggaaagttgatctcgagatatacaatagttatcagcagctgttaacctcccttgaagacatgttttcatgtttcaccataagaaactatttgaacgagaagaaaatagaccaagtgaatggaattgagtatatgcctacatatgaagataaggacggagattggatgttggtgggagatgttccatggcaaatgttcgttgaatcttgcaaacgcttaaggttaatgaaaagttcagaggcagtaggattaggtctaaagacggctcccaaatattcaagcacaaattaaagaaaaagaagcctttttaattcaagcatccaagaaagaaatcataaagaattgtacagaggctttttgctttgtttgaactatttttacctgacgggcagggtttttgactaagatatagactgccaaattgcaagaaacataaaataaataagctgtaattgtagtgcattgatgttgtgggcttttttctccacattacttaaagttaatcatctcttcttcctttttcaaaaaaaaaaaaaaaaaaaaaaaaaaaaaaaaaaaaaaaaaaaaaaaaaaaaaaaaaaaaaa

SEQ ID NO: 15669 - DNA, 476 bp, Gossypium hirsutum
  Predicted polypeptide sequence is orthologous to G451
ttttttttttttttttttttttacccatataagttttaattgtacatacatagataaacagctgatatacagtacaaattttgtttctttgttttaacatttcataatcaaaactttgggataatccacatctatttgctgaatttcttcaatcatttctttgcttacaaatttgcactttgaacccttcatattatctggatttctttaataagtccttcaagaactttcccagtccattgaatctctgagatgactatctattgaagccaaaaaaatatccttcgagaacccaagctgatgatacctctccgtgaaggagacatcaatggagatcttcagtgtttttcatgttcttaggcaaagtgttttttttctcatacaccacaacctaatcctctagcttctgatcctttcatgatccttaatctcttacatgatgtgatgaacattctgtaacaaaaaaaaaacgtaag

SEQ ID NO: 15670 - DNA, 860 bp, Gossypium hirsutum
  Predicted polypeptide sequence is orthologous to G451
gtacaattggattggatcttaactattctttaatatcgtgcctttttgtttttgtgctataaaacaagtatagatatttgacatgcatagaggaggctaaaaaggccagccatgttgtcaaatctttgagaaatttttctctagcaaatagccccctcactttccaggaagaccaaattgatcttccttgtagaatttggattatccaaagccaaagaaaactttccttcttgttaaataatttggtggctcatacacagcccaaccctctagcttctgatcctttcatgattctcagcctcttgcaggaggaaatgaacatctcccagggaacatctccaacaagcatccagtcaccatctttgtcttcataagtaggagcatagtcagatccattgtagccttccctctttgagtatgcaccaatggtgagcttgaacatattttccaaagctttgaggagttgaggatagcgcccataaaccttgagatcaatctttctgagataaggagctccatcaacgcttactttcacatacatccccatcccttcaacttcatttctcttggaactttgtaagcaatttttcctgtttgatcggattggtggccatcctacaacttgttccttggcaggagggggactgtcttgatcatcactcccagacattgtaatgctagaattgctctcagaactcgatacctcagaaatctcaggtacagttcttttattatttctgatactgggatttgtttttctttggggctcatcatcaccacaaccagggcatcccaatcttggctcagttgccatgagattgagatcattctcgtaattcactctcctttccattgctata

SEQ ID NO: 15671 - DNA, 479 bp, Gossypium hirsutum
  Predicted polypeptide sequence is orthologous to G451
gcacgaggctcagagagggaaggctacaatggatctaactatgctccaacatatgaagacagagatggtgactggatgcttgttggagatgttccctgggaaatgttcatctcctcttgcaagaggctgagaatcatgaaagggtcagaagccagggggttggggtgcgtatgagacgcccaaaaaaagaacaaacaaggagattttctttggcttggataatccaaattccacaaggaagatgaagcctgctcttcctgagaagtgagaggtgccatttgctagaggaaaaattcagagactgcatccttttcaatccaaccatggctggctttcagcctccattatttcaaatacatgtacttctttataaatagcatataccacaaaaccaaaaggcagaaaaacaatgtagaaatacttgagagacccaactgtacaaaggaaatactatttgctttaaaaaaaaaaaaaaaaaa

SEQ ID NO: 15672 - DNA, 550 bp, Gossypium hirsutum
  Predicted polypeptide sequence is orthologous to G464
aaacaacaacaacaaacttgccgcttttatttacaggcatcaaagcaaagaacaacactctcactagctgttatttgtattaaatattacattcataacctatggtgactatatttcttcaacactgtaattgacattgaaaccaaaaacaaaaaaacatttctacattggctttcttctctgtctctggttttgtttcttgttaccttggagctaatccagttgcctcagatttcctcatgatcctaagccttttcactgaagtaaggaacatctcccaaggaacatctccaacaagcatccagtcaccttccttgtcctcgtaagtaagcacgaaatcggatgatccatccagcagtttcgagcgtcttgtcatcctgttcaacatatcaagctgcagcgccgttgatccagatggattgacacttggggcggtttcgagaaacatatcttccaacgttttcgctaacttttcatacgattcatgggcattcagatcgaccttccttcctattggggttccatccatattcaccttcacaaacgtgga

SEQ ID NO: 15673 - DNA, 554 bp, Gossypium hirsutum
  Predicted polypeptide sequence is orthologous to G468, G2866
cctttaaaattcggcttagcgtggtcgcggccgaggtacccctggatgtatacagtatttccttctctttctggttatttaaaccaaaggtggtggcttttgttcttcggtcttagttcccacatctcagaaaatgagaagggcaattagttattgttcatcttctatagggagcagcaaccactttgattcctcaagcactgctactgctgcttcttcctcctcgcagagggaccataacaccgatcttagccttggtcgtagcatttcaacctctcctctttatgcaaggaagcaaagatcgccaataaagccgctgctaaggctggagcttgccgaacaagatgagtgcaacagcgctactttttatgtcaaggtttacatggaaggaattcctattggtagaaaagtagacctgttggatcgccggagttactgtgacctgataaaaactcttgaacatatgtttaatacaaacctcatatggggctgaggctgaggtgaatggtgatcatttcgaggaatatcatgtacctgcccgggcggccgctcga

SEQ ID NO: 15674 - DNA, 373 bp, Gossypium hirsutum
  Predicted polypeptide sequence is orthologous to G468, G2866
cctttaattcggcttcgagcggccgcccgggcaggtactcccttttgaagacaaggaaggggattggatgatggttggtgatgttccttcgcagatgttcttgtcggttgtcaggagattgaagataagtagatccaatgccgaactttgataaacaacattgtttttcttttcttttctttttcgtggagtgaaaatcaataggagatcgcgtacgcagaaaatatatggtcagatatgtttagggttttttctcaaaaaaatgtaccatggacatactagaatgattgagcaacacgcaccagtcttgtctttcggctgcaactcttttattggtgatcgattgtgatgttttaacttaaaaaaaaaaaaa

SEQ ID NO: 15675 - DNA, 549 bp, Gossypium hirsutum
  Predicted polypeptide sequence is orthologous to G468, G2866
catctcagaaaatgagaagggcaattagttattgttcatcttctatagggagcagcaaccactttgattcctcaagcactgctactgctgcttcttcctcttcgcagagggaccataacaccgatcttagccttggtcttagcatttcaacctctcctctttatgcaaggaagcaaagatcgccaataaagccgctgctaatgctggagcttgccgaacaaaataattgcaaaagtgtaatttttaatgtcaaagttaccttggaaggaattcctatgggtagaaaattagacctgtgggctcgccggagttagtgagacctgataaaaactcttgaacatatgtttaatacaaaccatcatctgggctgaggctgaggtgaatggagattatttcgaggaatatcatgtactaacatatgaagacaaggaacgggattggatgatggttggtgatgttccttggcagatgttcttgtcagttgtgaggagattgaagataagtagatcaagtgctgaactttgataaaaaaattgtttttcttttcta

SEQ ID NO: 15676 - DNA, 450 bp, Gossypium hirsutum
  Predicted polypeptide sequence is orthologous to G470
ttttttttttttttttgttctcatgtaataacatgatatatgttcaatctgattagttttcttcttcctatttaaaacaaggttcgatacttatatgcaattatacacacccattatattacccggaaatattagagccgagctttaacaattctctgtactagatgctggtgtacatttcacgtcttttgcatctgggccttccacagaaaccggattgtcctcgccctttgaattcaatgacccgggctttatcttctgaacctcttccctagtgtagataccgatcttgcgaaccatggagcaaaattcctgccagggatcatctccaacaagcatcatatcaccctcatcatcggtataaacgacaagccaattctttttaggggccattaattcaccaccaaattcaaataactgatccaattcagcaatcagttcatcgtagtt

SEQ ID NO: 15677 - DNA, 870 bp, Gossypium hirsutum
  Predicted polypeptide sequence is orthologous to G470
gcggccgcgtcgacaattgaacatgctttgtctcctcctgcacttaatccccttccaatgccccggccaaaaaggcctcgaactaatgctgtatcttcatcccctgattcctctgtacttactagggaaggttcttccaaagttactgtagaccctttgccggccagttcattttcaagggtcttgccaggtcaagaattctcgaccttgagaggcacatttgctgagagtaatgattctgacactgctgataggtcagtgatgtggccaccttcaatagatgatgagaaggttgatgtagctcatggtgaaagaaaatttgggtcagagaattggatgccctctaggaggcatgaaccaacttacacagatttgctctcaggttttgggtcgaatgctgatacatcacgtggatattatccgtcctttgttgatcaaacttcagtagctggtaattcggggaaaaaacaattactagatcaagaagggaagcttggcgcttggtccctcctgccatctggtctctcactcaagttgtctgacagtagtacagaccctcctttgcaaggttctgatgtgccttatcaggcacggggaaatggtagattttgtggttttggtgactaccctatacttgaaggtcgtaggattgaatgcacacgtggtaattggttgatgcctcccccatccacttcttgttatgataattcagtccattcaagagatttaatgccgaaaacatcattggttcaagaacataagaatggaaaatctagagaaagaaactgcaagctctttggtattcctctcataagtatctctagcgcttcagggcctgcagtctcccatattagtgctttcgccaagcct

SEQ ID NO: 15678 - DNA, 891 bp, Gossypium hirsutum
  Predicted polypeptide sequence is orthologous to G470
ccaaaaaagaaagaaaaaaaaaggaaaccagagagaaaaaagagattcagcttttttaattttttggctttgattattatatttttttgcaattctgttgttgtgatttgattgatttacgtgttaatcaacgagatttggtggtgaatttgagtgaaatttaaggttttttagggatttttcgtggatattatgatttttttttcgagagttaatcagatgagagatctgagctaaaaaagagattttgaaaaatgacgaatacggaggtagctatgaaagggaattgtgtgaacggaagaggaggagagagcttttcttctggttatagtgagccaaatgatggtaggaataccgtggaagggcaaaatggtcattcgactcgtcaagctccggctacagaccccgaatcggcgttgtataatgaactatggcatgcatgtgctggacctttggtcactgttcctcgtgaacaagatcgtgtgttttactttcctcaaggtcacatagaacaggttgaggcgtctactagtcaagtagcagacgaacagatgccagtgtataatcttccatcaaagatcctttgtcgtgtgattaacgttcagttaaaggctgaaccagatacagatgaagtctttgctcaagtgactttacttcctgagcctaatcaagatgagaacactgtgaacaaggagcctcctgcgcctcaaccaccacggttccatgtgcattccttttgcaagaccctcactgcctcagatacaagcacccatgggtgggttttcggtgctcacgcggcatgcagatgaatgtcttccaccattggacatgtcacggcaacctccaacccaggagttggttgctaagatttgcatggaaatgagtggcgat

SEQ ID NO: 15679 - DNA, 953 bp, Gossypium hirsutum
  Predicted polypeptide sequence is orthologous to G478
aaaaaaaggagagacaaagattatggaacatgatgatatgttcatggggaaccgaagccaaactggtaataagtataaccccaacaatgcaaccaccaacagtttcaacttcgagaccacgctcactgagtctcacgcgctgaaccacccgcaccaacaacaacaacgatactctctttacgccggcgatgggtcgagtcgtattcaccaatcggcagatcctcatcttgtttgtttgaagcttgggaagagacattactttgagggttcaacagatctgaacaacaatcgtcactccgccggtgggttctctattggaaagaaaggtaaaccctattatgataatcttagcggcgaaggaggtggaccttcttcgtcgacgggaccgaggtgtcaagttgaagggtgtaatgttacactagtcaacgctaaagactatcaccggagacataaagtttgtgaaacacactctaaagcacccaaggtggtggtgttagggttagagcaacgcttttgtcaacagtgtagcagggttcatttagtgtcagaatttgacgactctaagaggagttgcagaaggagattagcaggtcataatgagcgtagaagaaaaacctctcaagattctgctaccaggaactttgctcatgataataaaccgatgactgggagttttccgtatgtatcgtcgccaacaggacgtgctctctctcttctgtcatccaaggttgattcttggatctccccgtctaatctctccacaagatctagtgccgccttgcgtgagctgattgtggaaaaccgtgctgctgtcctcgcacggcagctcgtactcgagcgtgactggcactatataggtgagccccagcctgcagggtccaatcctatattagttcagcatcactcaatgcttgaccctcatcgttgggactttccgttcccggaaatcggtg

SEQ ID NO: 15680 - DNA, 787 bp, Gossypium hirsutum
  Predicted polypeptide sequence is orthologous to G478
agggaacccaaccttcctctctccgttttcttactgtgattttggcccccactcatatgtaaccatcatgtgggtgttactgtaatttcactctctcacctacactgtgtgaagttggagttggctttcacaacgacagagactagagagagaaagagggggggtgttttgtattttaaggcgtcaaaaatgtgcgaccttgcctttaatcaacaaatattccagagggtccttaaatgaagcttcctcccgtaagtgtagggaattttacgagttgaaccaactccctccctgggaatcccaaatcccccactgcttcttctatgtgtttaagcttgtaagatcatcaatggtaagcaatcatacagacaagaaaaacgacaccgtagcctcgccggaaacaagggggaaaagggtttttctttgaaattttgctgcttccacaccatgttggaatacgaatggggaaacccctcttcaatcatgttatcgggtgaagagaccgcccaagaacccgaccccaatcgtcagcttttccatcactatgccaccaccaccaccaccaccaccacccaccaccaaccttacaacgaaaccctcctttctcatcacaaccccactgttttttctcaccaaaacctcttccataaccctaaccaagctcaacccccacaacaccctgctactcttcattccttgtacgacccgcactcctactctgccacctccgcttactccactacccacgcttccttgctctcactggacccagtttctgccgtcggag

SEQ ID NO: 15681 - DNA, 995 bp, Gossypium hirsutum
  Predicted polypeptide sequence is orthologous to G483
cttttggtatcattgagaagcaaaacttctttgtcatggtggcgaaactggaaaagagatgcaattatggtgtttttcacccgagttgtatgaagaatacatatgttagcaatgttacacctatacggtatctgcttgatgtatactttgttatctcgattcgtgacagcgtggggtatttcaggatagaacgaaggcaaagggatcttttgggaaattaccatggaccgatctgagcaaactgaacaacagcagcagcagcaacagcctgtgatgggagttgtagccggtactggaccaatgggttattctactggtccttatcaagctgctcctgtggctgcttccggcactccagcaacggcggtcccttcaccaactcagcctcaggctactttctctggttctccgcaccaacttgcctaccaacaagctcaacaattccaccaccaacagcaacagcaacaacaccaacagcttcaaatgttttgggccaaccaaatgcaagaaattgagcatgcatcggacttcaagaaccatagtctcccgctcgcacggatcaaaaaaataatgaaagcagacgaagatgtgcgaatgatatcggcggaagctcctgtgattttcgcgaaagcttgtgaaatctttgtcttggaactgaccttacgttcttggatccatacagaagagaacaaaaggaggacgctacaaaagaacgacatcgcagctgccatttcacggaccgatgtctttgatttcttagttgatattatcccgagggacgagttaaaagaggagggactcggggtcaccaaggccaccattcctttcgttggttcacctaccgatatgccgtactattatgtcccgcaacatccggtggggcatgcagggatgacaatgggaaagcccggttgatcaagctgcattgtatcccggccacagctcgacgctgtggctttcgttccatggccccatggtcagccacagccaccgca

SEQ ID NO: 15682 - DNA, 890 bp, Gossypium hirsutum
  Predicted polypeptide sequence is orthologous to G483
gaagattcaactgctgaagggaaggtagatcaaaggttggaataaattagtggcattcaagtgtttggttatctgctttattttcttttcaaggtgtggggtaatgagaagatagaagaagatcaaagggttcttttttaaatcatggatcaacgggaaaaaacacagcagcagcagcaacagcctgtgatgggagttgtacctggtgctgggcagataggctattctactgcttaccaaactgcttccatggtcgcttctggcactacaggagtagctgtccctatacaaactcagcctcctgctactttctctagttctccacatcaacttgcctaccaacaagctcagcacttccaccaccaacagcagcagcttcaaatgttctgggctaaccaaatgcatgaaattgagcaaacagcagatttcaagaatcacagtctcccacttgctcggataaaaaagataatgaaagcagacaaagatgtgcggatgatatcagcggaggctcctgtaatttttgcaaaagcttgcgagatgttcatcttggaactgactttacgctcttggatccatacagaagagaacaaaaggaggacactacagaagaatgatatagcagccgctatttcgaggactgatgtctttgatttcttggttgatattattccaagggatgagttgaaagaggaaggacttggggtcaccaaggctactattcctttagttggttcacctgctgatattccttattactatgtcccacagcaccctgtgggatccccagggatgataatgggaaagccaattgatcaagctgcattgtatcctggccagcagcctcgaccgcccatggctttcatgccatggcctcagggtcagccacagca

SEQ ID NO: 15683 - DNA, 941 bp, Gossypium hirsutum
  Predicted polypeptide sequence is orthologous to G489, G714
cccatttagggttccaatttatgaacaaaatcaactgatccaaagctaaacaacgagcagcagcataagtttgtggttatggatcagcaaggccatgggcagacttcggccatgggcatagttggtagtgcagcggcagttccttatggtataaccggctatcaagcgaatcaaatgatgggaacctcgactcctggatcagtcggttcagtccaaccccctactcagcctgctggcccctctgcttcatcggcccagctggcacaacagcaactagcttatcagcatatccaccaacaacaacagcagcaattgcaacaacaactccagcgcttttgggcgaatcagtatcaagaaattgagcaggctacggattttaaaaaccatagcttaccgttggccaggattaagaagatcatgaaggcagatgaggatgttaggatgatatcagctgaagctccggtcgtgtttgctagggcctgtgaaatgttcattctcgagttgacactgaggtcgtggaatcacaccgaggaaaacaagaggaggacccttcagaagaatgacatcggagcagcaataacaaggaccgatatattcgattttctggttgatatcgtcccgagagaggatataaaagatgaggttctcgcatctgttccgagagttgaaggatcggctgatggtcttccttactattacatgccgcctcaacttgctccccaggctggtgctccgggtatgactgtaggtaagccgggtgatggatcccaccttttatggccaaaagtctggccctcatgccggtcagccggtatggccgccacagcagcagcagcaaccgcctccggattcataaatgtgatcttaatgtctacttaagagcttaaaggacagtgcaagtgaattaatcatcatatccgtagtatattaatatgtgattg

SEQ ID NO: 15684 - DNA, 906 bp, Gossypium hirsutum
  Predicted polypeptide sequence is orthologous to G502, G519
cattaaattgttttacacctcacacacgttcaataacgacattcaaaaccgatcctagaccacacaattattcctttcccatttaggaaaatattcctccttatcattaaaaataaatgctgaatttaaaactgtgattatttttaatatttcagttaaattgatttttatttttcgtttatgcagttggacgattgggtgctttgccggatttataacaagaaaggcgccatcgagaaacagccaccgcaaggaagcattggcaaaagctctgctgtgacggagattgaagacaagaagccggatatagcgacacttggcgtggacacgcgccatctgcccccgcctcctacggggttagttaacgattacgtgtacttcgacacgtcggagtcggttcctagactccacacggactcaagctgttcggagcacgtggtgtcaccggagttcacgtgcgaggttcaaagcgagccgcaatggaaggactggggaagtgcgaccaacaccaccaccaccaatgcccttgacttcccttataattacatggatgccactgttgataacgggtttcctgcccatttccagagtaataatcagctgtccccgctccaggacatgttcatgtacctgcagaagccattttagacggggaaaaaataaaataaaaaggggttatattgttggaagtcaaaacggtgatggtgaactgcgtttcaggggttacacgagactgaaagtctatgagtgtaactgagaagggttgcgcatagattaaataacgaattgaaaaattgaaattgataatattgcagtaaggtagggggagctgttggatttttgcagatgggaatggatggacggtggaagttggatcttatgcaatctagaaaagtagagattaga

SEQ ID NO: 15685 - DNA, 981 bp, Gossypium hirsutum
  Predicted polypeptide sequence is orthologous to G502, G519
agaccacccggtaccaacagccaacaacacaaagaaggcatatttacagcttttttaaagaggagcttaagaaagttaagtctaaaaaggaagaagagtttaaagagttcagagaatgaagggagagttagagttgccacctggtttcagattccatcctacagatgacgaattggtgaatcattatttgtgtaggaaatgtgcttctcagcctatttctgtgcccatcattgctgagattgatctttacaagtttgatccatggcagcttccagatatggcgttgtatggtgaaaaagagtggtatttcttttctccaagggatcgaaaatacccaaatgggtgtcggccgaacagggcggctggaaccggatattggaaagcgaccggagccgataagcctatcggaaagcccaaggcactgggcataaaaaaagcactcgttttctacgctggtaaagccccacgcggtgtcaaaaccaactggattatgcacgagtatcgcctcgccaatgttgataggtccgccggcaagagaagcaacaacttgaggcttgatgattgggtgttatgtcgaatatacaacaagaaaggaagcatagagaaacattttccgagtgaacaaaaatcgttaagttacccagaaatggaagatgagaaactgggcatcataatgaatggtcaaaacatgcaacaaccgtggtcggtgatggcgatgaagaacgatgcaatacaaacggatggttcggagtcgagttggtcggagcacgtgccgtcaccggaaatcacgtgggagaaagaagtgaaaagtgaagggagatggaatgagcttgatttcgggttggatttcatagatgaagacccgtttgccagtcaagttgattaccaaatggagcagctgtcaccgttgcagacatgttcatgtatctacccagacattttaagccaatgtagaccaaaatcctacaattgtggggtcca

SEQ ID NO: 15686 - DNA, 894 bp, Gossypium hirsutum
  Predicted polypeptide sequence is orthologous to G502, G519
gagaggaaaaaaaaaaggggtcaggtatacctgaaaggttaaaaacgtcagaaaaaaaaatgactgcaacggagttacagttacggttacccgctggctttcggttccatccaacggatgaggaactggtgatgcactatctctgccgtaaatgtgcgtctcagtctatcgccgtccctattatcgccgaactcgatctttacaaatacgatccttgggatcttcctgatttggcgttgtacggtgagaaagagtggtatttcttttcaccgagagacaggaaatatccgaacggttcaaggccgaaccgtgcggccgggtctgggtactggaaggcaaccggagctgataagccgattgggcaaccgaaaccggtcggtattaaaaaggctttggtgttttactccgggaaagctccgaaaggagagaaaactaattggattatgcatgagtatcgattagccgacgtggaccggtcggttcgcaagaagaacagcctaaggttggacgattgggtgctgtgccggatttacaataagaaaggttgcatcgaaaaacaacctccgcgaggaagcgttacgaaaaaagctagcgtgacggagattgaggagagtaagccggataatgggacactaggcgtggaggcgtgtgaatttccgccggcagcgacggcggtgggtaacgattacgtatatttcgactcgtcggagtcggtcccgagggttcacacggactcgagctgttcggaacatgcggtgtctcgggaattcatgactgaggttcaaagcgttcccaaatggaaggaagaattgggaatggccaacaataatgccctggatttcgcttataattacttggataccaatatggatatcggatttgcttcacagatgc

SEQ ID NO: 15687 - DNA, 841 bp, Gossypium hirsutum
  Predicted polypeptide sequence is orthologous to G509
atttgtaaagaataattatatgctttgtatatagtttttacaatgcccgatgttgaagacaaaaataaataaaccctaaactagaaaatacacaaatcttctacccatccgtttcaacatgagttgcatttatcttcgaaggcaaacaccacagattcctttttccctcccttaaatattcaatgtcttccataggaaactagactgttattaatctcaaatctcatgtcctccaagttggaagccaccccatgaacatcccaagctgttttcttccatgtcccacaagaattcatagccatcatgaactttggagctaacttcattgctgttgttctcttgatgggaattatattgaagcaggtttagcaagcattgggcgtggctttgataggtaggtgtggtggtggacaaagagctgatatgttggtaggctgtttcgtgggcatgatgagttgatgaggtctccaacatcattggggagctgagtttggcgctgttctcttctttgctcttgtgaaacactctacataaaacccactcttccttaggaggcaaatgtggagtgtggaggcggaattcatgcatgatccatccagttttgataccattgggagctcggtttctataaaacaccaatgttttcctcatcccaaccacctcttccgttgttgggtccaacaccattcgatctttccctgttgctttccagtaacctgatgtcgtcgcccgattcgttcggaaccccgtcgcgtatttccggtctcggaagctaaagaaataccattcatttgcattcaactttgccacctcaggaagctgccatggctcgcatgtatgc

SEQ ID NO: 15688 - DNA, 861 bp, Gossypium hirsutum
  Predicted polypeptide sequence is orthologous to G521, G2887
ctcaatctccctcggtgctctctctcgctcgcggctctcttctctacgggctttacattgcacaccaaatgaattttgagctcaattgggaacagccgccttctgtttttggttctgatctggggtttacgaaccgtgggagattgaggtatttttcacaaaagattttcttttggcattggacttggcctgttttttacgcgtcaggttttttgttttgattatacgatttgattctgctgctttacttgaagaagcggaatcacaaattttgttgttcattttctcgtgagccatatttgtttgttattggatactgagactccaagttttggatttttctgatggggaaaaacgcattacccccggggtttcgatttcaccccaccgatgtagaacttgttatgtattatttgaaaagaaaagtattaggccaaaagctcttgttgaatgtgattgctaaagttgatgtttataagtttgctccctgggacttgcctgatatgtcctgtatgaagactggggatcttaaatggtacttctattgtcccatcgagaagaaatatgctagaggggatagggtgaatcgagctactatattcggctactggaaagccacgggaaaggatcggcccgtgaagtacaatgacgaagttgttggaatgatcaaaaccttggtatttcacaaaggtaaagctccacgtggtgaccgaacagactgggttatgcatgagtataggcttgaagaaaaaatattggctgacagagggcctgttcaagatatgtatatgctttatgttgttttcaagaaggatggtctgggcccaagaaatggttcccaatacggagccccattcaagg

SEQ ID NO: 15689 - DNA, 795 bp, Gossypium hirsutum
  Predicted polypeptide sequence is orthologous to G526
ccaaaagaaaatgttgccgcctggttttcggtttcatcctaccgatgaggagattataactcattatcttttagagaaggttatgaacagcaacttcagtgccgctgctattggggaagctgatttgaacaagtctgaaccttgggatttgcctgacaaagccaagatgggggagaaagaatggtacttcttttgccaaagagataggaagtacccgaccgggatgagaacaaaccgagcaacccaagctggatattggaaggcaactggaaaagataaagagattttcaaaggaaaaggttgccttgttgggatgaaaaagacccttgttttctataaagggagagctccacggggagagaaaactaactgggtcatgcatgaatataggcttgaaggcaaattctcttactataatcttcccaaagctgctaaggatgaatgggttgtttgtagggtttttcataagaatacagcagggatcaataaaagtccaattgcaatggcttctcttggggatgaatttatggactatgcttcattgcctcctctcatggatcctacttttgattgtgaatctgaattcaaggccatcaataaaaccccagtttcaagctctattttcaaccctcaaattccaacccaagaccccgttttcttccatctagagacctcggattccggcactggcagcttccgaaccgaggacgaggcgagtataagagcattggcaggcaattacagtggtgatcatatcgggcagaggcagtgcaacaaagtggagcagttttcatc

SEQ ID NO: 15690 - DNA, 767 bp, Gossypium hirsutum
  misc_feature (546)..(546): n is a, c, g, or t
  Predicted polypeptide sequence is orthologous to G526
atcttctgcaagctagcttcacatattctatagttcttctgctctctataacagcgcccttttgtgtatttatacttgtttgtttctgggttttttttttgtttaatatttccatggaagaagctattgttgtgaacaaaggagacgaactcatcgatttgcctcctgggtttcggttccatcccactgatgaggagatcgtaactcattatctcacagagaaggtgatgaacagcaacttcagtgcaagcgctattggtgaagttgatttgaacaagtgtgagccttgggatttacctaagaaagctaagatgggagagaagcaatggtacttcttttgtcagagagacaggaagtacccgacggggatgagaacaaaccgagcaactgaagctggttattggaaggcaactggcaaagacaaagagattttcaaagggaaaggttgccttgttgggatgaagaagacccttgttttctacaaagggagagctcccaaaggagagaaatctaattgggtcatgcatgaatacagacttgaaggcnaattctcttactataatctccccaaatgtgcaaacgatgactgggttggatggagggtctctgataagaatcatccgggcacaagaaagtccatccctatacacacactgtgagaagaatctatggcagatatggataggtacagcccctttggacattattccaagctttaccgactttgagagggaaaataggcacaaaacattgttcaattcgactta

SEQ ID NO: 15691 - DNA, 770 bp, Gossypium hirsutum
  Predicted polypeptide sequence is orthologous to G536
ttttttttttttttttttttttcctaaagtgtgctatatattgggatgcgtaaacactatttaagcatataaccacatgaaaaccaaacaaatccctgtccactaataaagcgcatgtatactccatcggaccgtttgatcccaagtgctgattacagaagaaaaaaaaagtacaaggaacacttctacaacctagattgcatctataaaaaactactagatgaagtacagagtacatatcctatgagcttgactcgtaactgctgtccctcccctgactcaggctcaaaaggtgcttccttgatctcatctccagcttcctccgtgatgtcagatgtccagagggtcagatggtcccggagaacttgcatgatcaatgtactctccttgtaagattcctcacccaaagtatccacctctgaaatggcatcatcaacagcctgtctggcaagatggcaggcacgatcaggtgcatcgaggatcccacagtagaaaacagacaagtcagcaacaagcccgagtcaaatagagagagtagaagcaagtcaaaacaggcaaatcagcgcagagtgtaagcaacaaagtgaacagcggaaccatccacgaagccggccaacaacaacaacgggaaacaacccacggacgaacacccgagccacgagagcgaaaaaaagaatcaaggcaacgcagaaacgacgcaaaacacaacagaaagtcgagcacgcgacacaaccccgacactgaggcaaaccaacagcacagaactgcca

SEQ ID NO: 15692 - DNA, 775 bp, Gossypium hirsutum
  Predicted polypeptide sequence is orthologous to G536
ttttttatttttttttttttcctaaagtgtgcatatatatttgtcatggtccacactattttagcatatcccacatgaaaaccaaacaaatcctgtccaataataaagcgcatgtataatccatcggaacatttgatccacgtgctgattcgagaagacaaaaaaagtaacaggaacacttctacaacctagattgcatctataagaaactactagctgaagtacagagtacatatcctatgagcttgactcgtcactgctgtccctcccctgactcaggctttagaggtgcttccttgatctcatctccagtttcatccgtgatgtcagatgtccagagggtcagattgtcccgaagaagttgcatgatcaatgtactatccttgtaagatccctcacccaaagtatccaactctgaaatggcatcaacaaaagcctgtacggccagatagcaggcccgatcaggtgagttgaggataacgaactcaacaccagagcagtccggagcaacgccgagactactcgagcgcaacggacccagcccagaaccgcatatcctgagcgacttgaggcaagaacgcgataagaggaccgacatacaagcggtatcactacgaagcacggggaagcaccacaacgaggaaaccctgcgccctacacggcagggaacagaccaagagaaacccaaacggacacaagcagcgaaacacggcagcaccggaacacgccacaacaaaccgaagcactagacaccaacacgacacggaagaagaac

SEQ ID NO: 15693 - DNA, 1032 bp, Gossypium hirsutum
  Predicted polypeptide sequence is orthologous to G536
tttttttttttttttttttttttttttcctaaagtgtgcatatttatttgtattggtaaacactattttagcatattaccacatgaaaaccaaacaaattcctgtccaataataaagcgcatgtataatccatcggaacatttgattccaagtgctgattagagaagaaaaaaaaagtaaaaggaacacttctacaacctagattgcatctataagaaactactagatgaagtacagagtacatatcctatgagcttgactcgtcactgctgtccctcccctgactcaggctttaaaggtgcttccttaatctcatctccagcttcatccgtgatgtcagatgtccagagggtcagattgtcccggagaagttgcatgatcaatgtactatccttgtaagattcctcacccaaagtatccaactctgaaattgcatcatcaaaagcctgttttgcaagattgcaggcacgatcaggtgagtcgaggattacgtagtagaaaacagagaagttaggagcaagcccgagtctaattgggtgactaggagcaagttcaacaatagccatatcctgagcagacttgtaagcaacaaagtgttggccagtaggatcattcaacggacgcggccaaccaggtgaatctgggtacaatcttcactataggaactccaggaccaccgcgaggcgagggggaagacacaaagtgacgacactacatgaacagagtagaagggcaaaacaacggtaaggacgagctacagagccggacaacacaacatgagagtgtgggtatgctcacgagccagcacaccgcccggcacgttcagaacctgagcagcagaaacaagtcagactacaagagaggcacgacgagacactgcaggacacacgacaggacgtcggagcaatacgaagaacaacaacgaacaaacaatcataagatagaacaacgagaacagacgcaacaacaacaaaatactctacagagactaacaccaaacaaagcacacagtgacagcgagcacagcacaga

SEQ ID NO: 15694 - DNA, 1021 bp, Gossypium hirsutum
  Predicted polypeptide sequence is orthologous to G536
aggcggcgacatgttttgttctttttttttttttttttttttcctaaagtgtgcatatttattggtatgggtaaacactattttagcatattaccacatgaaaaccaaacaaattcctgtccaataataaagcgcatgtataatccatcggaacattggattccaagtgctgattagagaagaaaaaaaaagtaaaaggaacacttctacaacctagattgcatctataagaaactactagatgaagtacagagtacatatcctatgagcttgactcgtcactgctgtccctcccctgactcaggctttagaggtgcttccttgatctcatctccagcttcatccgtgatgtcagatgtccagagggtcagattgtcccggagaagtggcatgatcaaggtactatccttgtaagattcctcacccaaagtatccaactctgaaatggcatcatcaaaagcctgtttcgcaagattgcaggcacgaacaggtgagctgaggataccgtagtagaaaacagagaagttaggagccagaccgagtccaaacgggggagtaggaacaagtccaaccatagccatatctgagcagactggtagcccacaaacggttcacacgagacctcccccgaaacggggtaaaacggagaaaccgtgtaataccccattaggagaacacggcacaccgcggaggggagaaaaccaagcagagaccacaacagacaaaatacaggcaccacgcaacagcaagaacgacagcacgaacaaacaaaaacaactgcggtgcgtgctcgtccggtttccagcagtgcagaatgaatagacaacaaagaccagccgaaacaacaagagaacaaaagacacagacaaccaacacgaacaaacaaacagaacagcaagaacacagaaacaacaaggaaagaacaaaacagaaccaacaatacaaaacgagaaaaatcgatacaaaaacaaaagacaacaacgaaccacgcagcaatcacgcaaaaacacaacacaacagt

SEQ ID NO: 15695 - DNA, 784 bp, Gossypium hirsutum
  misc_feature (438)..(439): n is a, c, g, or t
  misc_feature (446)..(448): n is a, c, g, or t
  misc_feature (456)..(458): n is a, c, g, or t
  misc_feature (467)..(472): n is a, c, g, or t
  misc_feature (475)..(475): n is a, c, g, or t
  misc_feature (481)..(481): n is a, c, g, or t
  misc_feature (492)..(492): n is a, c, g, or t
  Predicted polypeptide sequence is orthologous to G536
gcacgaggctaaacaagcttttgatgaggctattgctgagcttgatagccttaatgaagaatcttacaaggatagcaccctaattatgcagcttctcagggataatctcaccttgtggacctcagatctgccggaggaaggaggtgagcaatcgaaaggagatgagcctcaggcagagagttaattcgatggaagagcattgttctaagactggtttgtcgaggtaggaaagagtttgccgttagagtgccttactttcaactcgcagtaatacccggatttgtgacctatggcttgtatccaatttgttggccaaaatgtttgcagactgtgaccctgctttctcttatgtttaaacacgattgaatatgtttttttctcatattttgttttcaaaaaaaaaaaaaaaaaaaaaaaaaaaaaaaaaaaaaaaaaaannaaaaaannnaaaaaaannnaaaaagaannnnnnaancccttngggggggaccnagtaccccaattcccccttggggggggggctttgcactaaccgggccgttgttgtaaacgtctaaccctgggaaacccgtggttgtccccagctaatggggcgtgaacacagttcgcccttcataccaattgggccgcaaaaacaaacaagcgcccaccccgattggcgctttccaaaaaggggggccaccccccgatggcgccattgccaaaattggagcccccttttatatcgtgttaagacatcaccctgtggaaattttttgttctaatgaggccagaaatctttaaa

SEQ ID NO: 15696 - DNA, 748 bp, Gossypium hirsutum
  misc_feature (299)..(299): n is a, c, g, or t
  misc_feature (404)..(404): n is a, c, g, or t
  Predicted polypeptide sequence is orthologous to G536
acttgcttacgctcctcgctgtggaaagaaaaaaaaaagttctctatcagatcaagtattagattgatatagtaaagatgtcgccaaccgaatcatcacgagaggaaaatgtttacatggccaagctggctgagcaggccgagcgctatgaggaaatggttgagttcatggaaaatgtagcaaaaactgtagatgttggtgagctgactgtggaggaaaggaaccttctttctgtagcttacaaaaatgtgattggggctaggagggcttcttggaggattatctcttctattgagcanaaggaagagagcagaggaaatgaggatcatgttgcaaccatcaaggagtataggagcaagattgaagctgagctcagcaagatatgtgatgggattttgagcctncttgagtctcacctcattccttcagcttcatctggccggtccaaggtggtttacctttaaaatgaaagggggattaatcataaggtattcttgggtggagtttcaaagaactgggtggcttgaaaaagggaaagggaaaaccttggcttggaaaaaccaacttttgggttggggcttttaccaaaaggttttggcacaccacaggaaaaaatttgggcttccttccggggggggaacctctataggggggccaaaaaattttaaccccccaaaattttaagggcgctttgggggaaactctttggcggttcttttaaaaacacctttcccccctggggggtttt

SEQ ID NO: 15697 - DNA, 839 bp, Gossypium hirsutum
  Predicted polypeptide sequence is orthologous to G536
ctttgaattcggcttagcgtggtcgcggccgaggtactatctttgtaagattcctcacccaaagtatccaactcagaaatagcctcatcaaaagcctgttttgcaagattgcaggcacgatcaggtgagttgaggatttcatagtagaaaacagagaagttaagagcaagtcccagcctaattgggtgagtaggagcaagctcagcaagagcaatatcctgagcagacttgtaagccaacaaagtgctctcggcagcttccttcctctcagcaccagtcttaaactcagcaagatacctgtgataatcacccttcatcttaaggtagaacaccttcgactcagcagatgaggccaaaggaatgaggtgagattcaagaaggctcaaaatcccatcacagatcttgctgagctcagcttcaatcttacccctatactcctttagttgtgcaacatgatcctcatttcctctgctctcttccttctgctcaatggaagagatgatcctccaagacgccctccttgccccaatcacatttttgtaagccacggagagaaggttccgttcctcaacagtcagctcctcaacatcaacagtttttgcaactttctccatgaactccaccatttcctcatagcgttcagcctgctcagccagcttggccatgtaaacattttcctctcgtgatgattcagttggggacatctttacaatatcaatcaatctaatacgtgatccgatcgacgactttttcgttggtggaagtgagaaagagaaaattattgtagggagtgaagactaaattctccccgcgtacctgcccgggcggccgctcgaagc

SEQ ID NO: 15698 - DNA, 955 bp, Gossypium hirsutum
  Predicted polypeptide sequence is orthologous to G536
ctccttttagcattttctctcaaaactcaacctcccaaatcctctgtacctttttttttcttccaatccagacagcacccaattccatggccacctcttccccacgtgaggataatgtctacatggcgaagctcgccgagcaagccgagcgctacgaggagatggtgaagttcatggagaccgtcgtctccgccgtcccctcctccgacgagctctccgtcgaggaaaggaacctcctctctgtcgcatacaagaacgtcatcggcgcccgacgcgcctcctggaggatcgtttcctccatcgagcagaaggaggaaggacgcggcaacgccgaccacgtctccgtcatccgtgagtacagggccaagatcgaggctgagttgtccgagatttgcgccggaatcttgaagctcctcgacgagaagctcgttccggcagccaagaccggggattccaaggtcttttatctgaaaatgaagggagattaccataggtacttggctgagttcaagactggcgatgacaggaaagccgctgccgagaatacgctcacggcgtataaatctgctcaggaaattgcaacttcggagctggctccaactcatcctattcgattagggttggctctgaacttctctgtcttctactacgagatcttgaattctcctgaccgtgcttgcagtcttgccaaacaggcttttgatgaagccatctccgagctggatactcttggagaggattcatacaaggacagcactttgataatgcaactccttcgtgataatctcaccttatggacttcagatatgcaggacaatgcaaccaacgagatcaaagaagctcccaaacgcgaggaagagaaacaagagtgaaatcgccaatcttcacggtacgattttacttctctggttatttttgtatggagaagttgctcggttccgctatccccatgatc

SEQ ID NO: 15699 - DNA, 946 bp, Gossypium hirsutum
  Predicted polypeptide sequence is orthologous to G536
ctcaaatccctctgaaaaatcctctcagattttctttccatcccaacatcccccaaaatcaccatggccgctacttcaccacgtgaggaaaatgtctacaaggcgaaactcgccgagcaagccgagcgctacgaggagatggttaagttcatggaaaccgtcgtttcctccgtcgttgctcccgacgaactcaccgtcgaggaacggaatctcctctccgttgcctacaagaacgtgatcggcgcccgccgtgcttcctggaggattgtttcttccatcgagcagaaagaggaaggacgtggcaacgccgatcacgtctccatcattcgtgagtacagggccaagatcgaggctgagttgtctgagatttgtgccggaattttgaagcttctcgaagagaagctcgttccggctgccgggaacggggattccaaggtcttttatctgaagatgaagggagattaccataggtacttggctgagttcaagactggagatgaccggaaagccgctgctgagaatacgctctctgcgtataaatctgctcaggacattgcagtttccgagctcgctccaactcatcctattcgtttgggattggctctgaacttttctgtcttctactatgagatcttgaattctccggaccgcgcttgcagtcttgcaaaacaggcttttgacgaagccatctcggagcttgatactctcggagaggattcatacaaagacagcactctgataatgcaacttcttcgtgataaccttactttgtggacctcggatatgcaggaggatggaacggaggaaatcaaagaagcctccaaacctgaggatgagaaacaacagtaaaatccgtaatcttcgagttagtattttacttctctggttgtttttgtatggagaagttgattggtcccactatcccttcagtttgccttatattttt

SEQ ID NO: 15700 - DNA, 995 bp, Gossypium hirsutum
  Predicted polypeptide sequence is orthologous to G536
aaacaacaaagcaaaaaacaaatataaaaaaggtcaaaagaggaaaaaaaaatggaaaaaacgaagcctcttgattggcccggcatagctggctccttcataaaacaaacgacgatgacattgtgagtgaacctcctttcctatttctcaaatatcaaatccctcgaaaaatcctacccatccaatcaccaccggaaaccatggccactccttccccacgcgaagaaaatgtctacatggccaaactcgccgagcaagccgagcgctacgaggagatggtcaagttcatggagaacgtcgtctccgccgtccccgctcccgacgaactctccgtcgaggaacgcaaccttctctctgtcgcctacaagaacgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaaccttgttccggctgctggaaacggggattccaaggtgttttatctgaaaatgaaaggagattaccataggtacttggctgagttcaagactggcgatgacaggaaatctgctgccgagaataccctcactgcctataaatctgctcaggacattgcagtagctgagctagccccaactcatcctatccgtttaggattggctctgaacttttctgtcttctactatgagatcttgaactctcctgatcgtgcttgcagtcttgcgaaacaggcttttgatgaagccattgcagagctggatactcttggagaggattcatacaaggatagcactttgataatgcaacttctccgtgataacctcactttgtggacctcagacatgcagatgatggcactgatgagatcaaagaagcttccaagcctgaggagagaaacaaccgtgaagttcccagtc

SEQ ID NO: 15701 - DNA, 918 bp, Gossypium hirsutum
  Predicted polypeptide sequence is orthologous to G536
ctctaaaattttcaaaaaaccttttcttccctctaacttgatttgaaaatccacaatggccgccgccactcgcgaagaaaatgtctacatggcgaaactcgccgagcaagccgaacgctacgaggaaatggtcgacttcatggagaaagtctcggcttccgccgccgacaacgagggactcaccatcgaagaacgcaacctcctctccgtcgcttacaagaacgtgatcggcgcacgccgtgcttcgtggcgcatcatctcctccatcgagcagaaagaggagagccgtggtaacgaggatcacgtggccgttatacgtgattaccgggctaagatcgagtccgagctctcctcgatctgtggcgggatcttgaaactccttgacaccacactcatcccttcggcttccggtggagattcaaaggtcttttatcttaagatgaagggagattatcacaggtatttggctgaattcaaaactagcgccgaacgcaaggaagctgctgagagtactctcactgcctataaatccgctcaggagattgccaacgccgaattggctccaactcacccgatccgactcggtctagccctcaatttctctgttttctactacgagattctcaattctcctgatcgcgcttgcgaactggctaaacaggcgtttgatgaagcaatagctgagttggatacactaggggaggaatcatacaaagacagcaccctcatcatgcaactgctacgtgacaatctcactctgtggacctccgacatgcagggtgatgatgagattaaagaagcagcgaagcgcgaggaagaagaacaacaatagtcaaagcagtctctggtgggctctttctattataatttgccaagttagggtttcaatcaaaccaaactgtatctttttatgtgttt

SEQ ID NO: 15702 - DNA, 987 bp, Gossypium hirsutum
  Predicted polypeptide sequence is orthologous to G536
ccctttctctctatctgattcctatcgacaatggccgccgccgccacttcttcaccccgcgaggaaaatgtctacatggcgaaactcgccgagcaagccgaacgctacgaggaaatggttgagttcatggagaaagtctctgcctccgccgacaacgaggagctcaccgtcgaggaaaggaacctcctctccgtcgcttacaagaatgttatcggtgctcgccgtgcttcctggcgcatcatctcctccattgagcagaaagaggagagccgtggtaacgatgaccacgtcgctacgatccgtgattaccgggccaagatcgagtccgagcttacttcgatctgtaacgggatcttgaagctccttgacactaggcttgtcccctcggcttcctctggagattccaaggtcttctatcttaagatgaagggagattaccacaggtacttggccgagttcaagactggagctgaacggaaggaagctgctgagagtactctcactgcctacaaatctgctcaggacattgccaacgccgagttggctcctactcacccgattcgacttggactggcactcaatttctctgttttctactatgagattctcaattctcccgatcgcgcttgcaatctcgccaaacaggcatttgatgaagcgatagctgagttggatactctaggcgaggaatcgtacaaagacagcaccctcatcatgcaactcctccgtgacaatctcactctctggacctccgatatgcaggatgacggggctgatgatattaaagaagcaccgaagcgtgacgaggaggagcaacaacaaaagccacagcagtagtgagagactgagagtcagccgggctcttactttcaattatataatttgccaatttagggttcaattcaaaatgaaacttctaccgatttgatgtgtttgatagaagaagatttggtgctacttaggcaattcttgcctttgttttaactc

SEQ ID NO: 15703 - DNA, 1007 bp, Gossypium hirsutum
  Predicted polypeptide sequence is orthologous to G536
gtttacctggcgaaactcgccgagcaagccgagcgctacgaggaaatggtcaagttcatggagaacgtcgtctccgccgtccctgcccccgacgaactcaccgtcgaggaacggaacctcctctctgtcgcctacaaaaacgtgatcggcgctcgccgtgcctcttggcggatcgtttcctccatcgagcagaaagaggaaggacgtggcaacgccgaccacgtctctgtcatccgtgagtacagggccaagatcgaggccgaattgtccgagatttgcgccggaattttgaagcttctcgacgagaagctcgttccggccgccgggaccggtgattccaaggtcttttacctgaagatgaagggagattaccataggtacttggctgagttcaagactggcgatgacaggaaagcggctgccgagaatacgctcactgcgtataaatctgctcaggacattgcgaatgctgagctggccccaactcatcctattcgattaggattggctctcaacttttctgtcttctactatgagatcttgaactctcctgatcgtgcttgcactctcgcaaaacaggcttttgatgaagccattgccgagcttgatacacttggagaggattcatacaaggacagcactttgataatgcaacttcttcgtgataacctcactttgtggacctcagacatgcaggatgatgggacagatgaaatcaaagaagctcccaaacaagaggatgagaaacaaccgtgaagtctctaatcttcatggtagtgttttacttctctggttgtttttgtatggagaagtcgcttggtcctactatcgtcttcaattacttgtttttagtagatcaggcctcaatttatgaaccttgggaagtactcctaagaatttcttagtgtttcactgggtattggttttgagtttgagccttctagctttctatggcagtgaagtatgtgcacacatgctatggtttcatgacaataatggagctgatg

SEQ ID NO: 15704 - DNA, 971 bp, Gossypium hirsutum
  Predicted polypeptide sequence is orthologous to G536
cggaaaaaaaatattcctctctttctctccatcggaagctcaccaatttctgcaaaaatggcgacgatggtgcctgacaatctaagccgtgaccagtacgtttacttagccaagttagcggaacaagccgaacgctacgaggagatggttcaattcatgcaaaagctcgtcctcggctctactcctgcctccgagctcaccgtcgaggaacggaaccttctctcggtcgcttacaaaaacgtgatcggatctctacgcgccgcgtggaggatcgtttcttccatcgagcagaaagaagaaggtcggaagaacgaggaacatgtggtgctcgtcaaggagtatagatcgaaggttgaatctgagttgtcggatgtttgcgctagtatcttgactttgttggactcgaatctgatcccatctgctgctgcgagtgaatcgaaggttttctatttgaagatgaaaggggattatcatcggtatttagcagagtttaaggttggtgatgagaggaaagctgctgctgaggatactatgctgtcttacaaggctgctcaggatatcgcactgacggatctagcaccaacgcacccgatcaggctgggacttgcgctgaattactcggtgttttactatgagattctgaatcagtccgataaggcttgtagcatggctaaacaggcatttgaggaagccattgctgagcttgacacgctgggagaagagtcttacaaggacagcactctcattatgcaactcctaagggataaccttactctctggacttcggatgttcaggaccagttagacgagccatagaaggtggtgtaacccgtgttggtcctagtcttcttccggaggaggtgggctttgaatgtcatttgtttatgttgattaaagtgtgtaatttaaaatgggaagtaatccatggcatgatgctatactctacccccgactagatttctgaatttggg

SEQ ID NO: 15705 - DNA, 875 bp, Gossypium hirsutum
  Predicted polypeptide sequence is orthologous to G536
cttctcccatcctctcaatcccacaccccccaaaaggtctcagatctagattttttttttcaaaacctacccttcttccattccccctttcgcttccattctctctcagccctttccaatttccaaatatggccgccactagtccttcgtcccgcgaggaattcgtttacatggccaaactcgccgagcaagccgagcgctacgacgaaatggttgagctcatggagaaagtctcctcttcttccgagagcgaggaactcagcgtcgaggaacggaacctcctctccgtcgcttacaagaatgtaatcggtgcacgccgtgcttcctggcggatcgtctcctccattgagcagaaagaggagagccgtggtaatgaggatcacgtcactctaatccgcgattatcgggccaagatcgagtctgagctctcctctatctgtggcggtattctgaagctgctggactccaggcttatcccttcggctgctgctaaagactccaaggtcttttatcttaagatgaagggcgattatcacaggacattgccaacgccgagttggctccaactcacccgatccgactcggactggctctcaatttctctgttttctactatgagattctcaattctcctgatcgcgcttgcaatctcgcaaaacaggcatttgatgaagcaatcgctgagttggatactctaggcgaggaatcatacaaagacagcaccctcatcatgcaactcctccgcgacaatctcactctctggacctccgacttgcacgatgacggagctgacgagattaaagaagcaccgaagcacgaggaagagcagaaaaagcaaccggaacagccaaagcagtagtgagaatctactcaat

SEQ ID NO: 15706 - DNA, 489 bp, Gossypium hirsutum
  Predicted polypeptide sequence is orthologous to G536
ggccgagttgccccctacccaccctatccgtctcggactcgccttgaacttctcggtcttctactacgagatcttgaacagccccgaccgagcttgtcaccttgccaagcaggccttcgacgatgccattgccgagctcgacaccctctcggaagagtcttacaaggactctaccctgatcatgcaattgttgagggacaacttgaccttgtggacttcggatatggacaacgccgagaaggaggaggctcctgccgccgagaccaaggccgagcccagcgcataaatccccgtagtccaggtgcaaaaggaggaacgatgagcgttttgtgatgttacgggctttttgtttctaccctttatgtttcttctcgttagaacctcgggcggtcttgcacctccttggagagttcaccctcatgtcttctttctctgtgttttgagataatgaatatcggattcgatcaacgaaaaaaaaaaaaaaaaaag

SEQ ID NO: 15707 - DNA, 848 bp, Gossypium hirsutum
  misc_feature (414)..(414): n is a, c, g, or t
  Predicted polypeptide sequence is orthologous to G536
gcacgagcaaagaacgtgaaagattcgtttacatcgccaagctcgctgagcaagcagaacgctttgatgatatggtgacttccatgaaaaagctagcggagcttgatgtggaactgaccgtagaagagcggaacctgctctctgttgggtacaaaaacgtgatcggtgctcgaagagcatcgtggaggatcctgtcttcgattgagcaaaaggaagagagcaaagggaatgagcaaaatgttaagaaaatcaaaacgtctaggcagaaagtagaatcggagttgtccaatatttgtaaagatattatgggtgtcattaatgagcatctcattccttcttgctcgggtggagagtctactgggttttattataaaatgaaaggagattattataggtacttggcggagtttaagntgggtgatgagaggaaagaggccgctgatcagtccatgaaagcatatcagtctgcaacaactacagcagaagctgagttgcctcctacgcatccaatccggttgggtttggccttgaacttctctgtcttttattatgaaattatgaactctcctgaaagggcctgtcaccttgctaaacaagcttttgatgaagctatctctgagttagatactttaagcgaggagtcatacaaagatagcacattgattatgcagcttttaagggacaaccttactttatggacttctgacatcccagaggatggagaagaagccgcaaagcttggtgctgctaaagtgggtgaaggagatgaatgaagctacttaaatggattgggacctgtatcatgaaaggaatagtacaatctgaaactgttggaaatgccctgttgt

SEQ ID NO: 15708 - DNA, 684 bp, Gossypium hirsutum
  Predicted polypeptide sequence is orthologous to G536
cagagggcaaattaaagatcaagactcaagagaaagaagcggccatggagaatgaaagagagcaacaagtttacttggcaaggctcgctgagcaagctgaaagatacgatgagatggttgaggccatgaagagtgttgctaagttggatgttgagctgactgtggaggagaggaatctgttatctgtgggatataagaatgtgattggagcaagaagggcatcctggcggatactgtcttcaattgaacagaaggaggaggccaaaggtaacgaacaaaatgtgaagaggataaaggattataggcaaagggtcgaagatgaactctcaaagatatgcaatgacatactctcagtcattgataagcacctcattccatcttcctccaccggggaatcaactgttttctactataagatgaaaggagattattttcgttatttggcagaatttaaggcaggagatgatcgtaaagaagctgctgatcagtcacttaaggcttatgaggctgccacttccactgcaagctcagatttgcctccaactcacccaattagacttggcctggctttgaacttctcagttttctactatgagatattaaattctcccgagagggcttgtcatctggctaaacaagcatttgatgaggctattggtgagcttgatagacttaatgaaaaac

SEQ ID NO: 15709 - DNA, 550 bp, Gossypium hirsutum
  misc_feature (538)..(538): n is a, c, g, or t
  Predicted polypeptide sequence is orthologous to G550
gggcccccgcaacaagcactctggagaagaggagcaagtgaaggaaaataatgcggagagaagcctttggattccaaaaacattgaggatcgatgatccgggagaagcagcaaagagttctatatgggcaacactcggcattaagaatgataaatccgattcaataggtggtggaggactgttcaaagcatttcaatcaaagggtgatgaaaggactgaggttcctgaaacctctccagtcttgcaggcaaatccagcagcattgtcgagatcaataaacttccgtgagagctcataatcgtgtaactttatgacatttacttgcttatggtgctgcatacagcttggtggtgttaattattatacaaatccaaacctactctgttagccgcttggtcatattcactcaccatcccctctatataccaattctcaaagtatgctaactgaggagaacagaagaagagtcctatcatatggtttgaaggcagagtgtctagctagcttaagtagaaactgatttttcttccttttgttntggggtttaatt

SEQ ID NO: 15710 - DNA, 550 bp, Gossypium hirsutum
  Predicted polypeptide sequence is orthologous to G558, G578, G629, G1198, G1806
acgtataattctttggcttccaaacaatataaatacaaaacaagaaaatctaactttgctgacctaaaattattcttgatacacagcaataaggattcatacttacatgtctcatgctcaggaagaatataagcttatatatatttattgatgtttcatacaacaagacccgcaaaagaccattttcttactggttgaggaacaaacttctggcgtctgcaacctagatataatattgatggtagtctaagtttctatcttcacttcagaatttaggaaggttcgcgtggacgtgcagaccaaagtgaactgagagcacgtaaacgatggaagtattcccccaaagcaagtaaacctcgagctgcttgacgggttgttaagattcgagccatctgttgcaaagtctgctggcgaaggtgatcagcctgtttcgggaaagaacacctgcttcacaaagccctctagggcctgcaatttatctattgcagcagctagttcgagctttgtagtttcctgaactcaaaatctgttgctaacactctcgggataa

SEQ ID NO: 15711 - DNA, 932 bp, Gossypium hirsutum
  Predicted polypeptide sequence is orthologous to G558, G578, G629, G1198, G1806
cactgggggtattaaggaagtggaataatgatgaatggatggtagaacagtgagatctagtgcaaaagatgagaaaaaagcagcaaaagggatgccgggttttgactcacaattaccagttaccaacatactttgctcagagagaagcacaatccatccattccctgtttcaaactttgggacattcgaccaatctgttggatttcgcctagaggttgctgttaacctgagtggaaacggcgctgtgtttgattcagcaaaagtaagtcggcaagaagttccttctgattgtgaccttattggcacttcagacaagactccaacttcatttactaattatccatccaccaaccaagttgaatctccgaggttgcagttagaaaaaggtcaagaaacaaacctagtctcaatacctagtggtaatacagaaaactggggagaatccaatatggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagacttgctcaaaatcgtgaagctgcaagaaaaagcagattgagaaagaaagcatatgtgcaacaactagagagtagtcgtttaaagttgacacaattagagcaggagcttcagcgggcacggcagcagggtatattcatatcaagctctggagatcaaagccattcgatgggcggaaacggtgccatggcatttgatgtagaatatgcacgatggttggaagagcaaaaccgacaaattaatgagctgagaacggcagtaaattctcatgcaagcgatgcagaacttcgtattattgttgatggtgtaatggctcactatgatgaaattttca

SEQ ID NO: 15712 - DNA, 916 bp, Gossypium hirsutum
  Predicted polypeptide sequence is orthologous to G558, G578, G629, G1198, G1806
caaaagataaaacagaccagaagacattgcgtaggctagctcaaaatcgggaggctgcaagaaaaagccggttaaggaagaaggcgtatgtgcaacagctagagagtagccgactgaaactgactcaacttgagcaagaactgcagcgagctcgtcaacagggtatattcatttcaagcacgggagatcaatctcattcgatgagtggaaatggtgccttggcatttgacgttgagtattcacggtggctagaggagcacaataagcatataaacgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatccttggccgagacattggccaatggctcacctgctccctcgggaccatctgggaatgtggcaaattatatgggccaaatggcaatggccatgggaaagctaggaaccctcgaagggttccttcgtcaggccgataatctacgccagcagacacttcaacagatgcaccggatcttgacgactcggcaatcagctcgtgcccttcttgcaataaacgactatttctctcggctccgagctctgagttctctctggctggctagacctcgcgagtgagaagcaagataataaaatccatctcctatgaacaa

SEQ ID NO: 15713 - DNA, 869 bp, Gossypium hirsutum
  Predicted polypeptide sequence is orthologous to G559
gtcgttgacaacgactgctccaaattctggtccatcggctgcggtgagtatgggagcagggacggcaacgtccggtgaggaaaatgcgagtgttggtgttgggtcttctgagaagcctagaattaggcaccaacatagccagtcgatggatgggtcgacaagtattaagcccgaaatgctcctctctggttcggatgaggttacgcctgctgattctaagaaagcaatgtccgctgctaagcttgctgagcttgctcttattgatcccaagcgtgctaagaggatctgggcgaataggcagtctgctgcgaggtcaaaggaaagaaagatgcggtatatagctgagcttgaacggaaaatacagacattgcaaacagaagcaacgtcgcttgctgctcagctgactctactacagagagactccagtggtatgagtgctgaaaatagtgagttgaaactgcggttacaaacaatggagcaacaggtttacttgcaagattcattgaacgatgcactgaaagaagaaatccaacatctgaaggtgctgactgcccaacctatgccaaatggtggaccaatgatgaactttgcatcttttggagctagtcagcaatacatcccaaataatcatgctatgcaggctcttctaacggcccagcagttccagcaactacagattcaattgcaaaagcatcagcatcagttcccaccgcatcaactgcatcaacttcagcagcaacttcagctgcaacaagagctccaacagcaagcaggggagatgagagttagaggatccatgccttcccccaaccgaagagatggtccatcttcatcagatgtcagctcaacggcatcaaatgattgaggag

SEQ ID NO: 15714 - DNA, 840 bp, Gossypium hirsutum
  Predicted polypeptide sequence is orthologous to G561, G562
gtggatgttgtcttccctttggcactccctctcttttttcttctcccacaccctcctcctcctcctgcatctctctcttattctccgcgaattttaaaagaaaagaattcccgatatttttcagtgaagaagataatgcagtctttttgacgaatatttcttttcaaattctcttctctacttctcttttccctaattgaagataatctaatattgatttgtattattgttttccagccaagagaaggaagaatctcgggtttcagattttaagttgacagagagaggtgaaccaacttctataaaaggtttcacctttggtgctttgaccatgggaaacaacgaggaagggaagtcttctaagtctgacaaatcatcttcaccagtgccaacggatcagaacaatattcatgtctatcctgattgggctgctatgcaggcatattatggtcctcatgtcaatatgccaccgtattacagttcagctgtggcatcaggccatgctcctcccccctatatgtggggtccaacacagcctatgatgccatcctatggagcaccttatgcagcaatctactctcatgggggagtttatgcacatcccgcagttcctctggcatcacacagtcttggtgttccatcatcaccggcagctgcaggtcctgtggagacacctacgaagtcccctggaaatactgaacaaggtttaatgaagaagctgaaaggatttgatggtcttgcaatatcaataggcaatggtactgctgagaatgctgaaggaagagctaaacctagaccatcccacagtgtggagactgcagttcagctgatggtagtgat

SEQ ID NO: 15715 - DNA, 884 bp, Gossypium hirsutum
  misc_feature (879)..(879): n is a, c, g, or t
  Predicted polypeptide sequence is orthologous to G561, G562
tctttctccgtctctgcgaatttgaaaaaagaaatcctaaaattttctctttgtttttcagtgaagataatgcggtctttttgagtattttgttttacaatatctctttctgctccttttttttcccaattgagagttattaatttcacgctgtaaagctgctgagagaagggaggtttctagatttggattttcgagttgactgagagacgtgaaggacattctagaaaataggttttccgctttagtgcttggtaatgggaaacaacgatgaaggaaagtctaagtctgacaagtcatcttcaccagtgccaacggatcaggccaatattcatgtctatcccgattgggctgctatgcaggcatactatggtcctcgagtcactatgccgccatattacaactcagctgtggcctctggccatgctcctcccccttatatgtggggtcctccacagcctatgatgccaccttatggggcaccttatgcaacaatctactcacatgggggagtttatgcccatcctgcagttcctataactgcagcccctgtggaagctcctactaagtcatcaggaactacagaacgagggtccaacaagaagatgaaagggtttgatggcctgctatgtcatacgcactgcgtcctgccacacatgatgaggtggaggtgaactttactgtccaaatgttgagatgacgtccatgcgggttgatggatacactggcacgccagtggcgaccaacaggggaacaagcgttcgatgttaatggagcatgagcagaagggaacaacccaacagagagtgtcagacacggaggaaccgtatctctcggtgtatcctacgagaactctggacatacacacaaggaagagangagac

SEQ ID NO: 15716 - DNA, 955 bp, Gossypium hirsutum
  Predicted polypeptide sequence is orthologous to G565
ggaaaatatttcaacactcagctctctaactgagatctgaaatctgagaagaaacaccaaaatgcaggatccgcgaaatctaaatccaaacccggatcctgcatttccctccttcacccaaaatatgccgtctttttccaacccaatccaatatcgtggttcttaccacaggcgagcccaatccgaagtccagtttcggattccagacgacttggatctcgtgtccgactccttcgaaggggtaggatccgaagacgacatgttttgtagttacatggacattgagatgccaggggaatcggcgaagggagtcgaggtggctgctgggtcttggagtcagaaccggaaaggagaggaagtgagtggtgggtcggggataggggagaagtataatggaggagggaaaggaaggcataggtatagcaattcggttgatggatgctccataatggagtccattgaagctaagaaagccatggctcctgataaacttgctgaattgtggacaattgacccaaagagagctaaaaggatcattgcaaatcggaggtcggctacacgctcaaaagaaaagaaagccctatatatgtctgaattggagaggaaagtccaaacacttcaaacggaagcaacgactctttctgcacacctaaccctattccagagggatacgacaggcttgactactgagaacgctgagcttaagctccggctacaagcaatggaacaacaggctcagctatgtgatgctctaaatgaagcattaaagaaagaagtagagaggctcaagactgctactggagaaataacgacgccgactgataccttcaatttaggaatgcaccatatatcatacgcccaatcttccttctttcctcctcagaatacacaactgccaccgtttcatcctttccattctaacttattgacatctgcctcgaacaccaactcgcat

SEQ ID NO: 15717 - DNA, 992 bp, Gossypium hirsutum
  Predicted polypeptide sequence is orthologous to G567
aatggtagaacgacaagaaaaacaagaccaaacgcaaattgcaaatcgccgaggaaagaagatttcactgaaaacgatgaatagcgtgttctcagttgacgatttctccgaccctttttgggtggcttctgctacaggcgctgcggcggggatgagccgaagccaatcggagtgggcgttagagaagtttctagaagaattttctggtgctggtgcggcgatccaggggtcacgtgcgggtgagaatgtgattggtacgtctttggcggcacctcaagcgccggtttcgaaatctgaaaatggtgacggggatggtggcgcggtggaggtaaaaaagcctaataatcttaatcctccgccgtccgattcgacaccgacggtaccgattgacgcggatgagtaccgcgcgatccttaagaacaagctccatcaagcctgcgctgctgttgctctctctcgtgcgtcggctgtgaaggcagaaggttcgtctgcgcaagctgaaaatcaagcgcttcagtcgggatcctatgttcaaggttcctcaaagacacaggaacagggtgaacctgatgctggtatttcggctgtttcaactacacaaaaaaaatcagggacacaaatgaggcaagccacaagtgggtcatcaagagaagattcagatgatggtgaacttgaaggagatactgaaaccaccgaaaacatggatccggctgatgcaaagcgtgctaggagaatgcggtcaaatcgagaatcagccagacgctctagaagaagaaagcaagcacaaatgaatgaacttgaaacacagttggtcaattaagagctgagcattcctcattacttaagcgtctaactgacatgaatcacaagtatgatgaagctgccgttgacaatagaattctgacgctgatattgagacattaagagcaaagtaagcaagccatcatccttgtccaagttgcattttcttatcctggtagagttactctgca

SEQ ID NO: 15718 - DNA, 952 bp, Gossypium hirsutum
  Predicted polypeptide sequence is orthologous to G567
tctcagttgacgatttctcggactccttttgggcggctccgccggggatgagccgaagccaatcggagtgggcttttgacaattttattgaagagttttctggttcgggcggggcgatcccagtgtcgcgttcgggcgagagtgtgatcggtccatccttggcggaacctcggccgtccgtttcgaaatctgaagaagccgatggtgaaggtgacgtggtggagatcaaaagacctggtaatcagaatcataacagtccgccgtccgatctggcaccgacgttctcgattgactcggatgagtaccgcgcgatcctcaaggacaagctccatcaagcctgcgcagctgttgctctctctcgcatcatctgtgaaggcagaagttttctctgcgcaagctgaagatcaagcgcttcaatcgagatcccaagttcaaggttcctcaaaggctcaaggacagggtgaactagatgctacacctagtgaagtcttggctatgtctactacacagacaaaatcaaaggtacaaatgaggcaaacaacaagtgtgtcatcaggagaagattcagatgatgatgaacttagagatactgaaactactgataacatggatccggctgatgcaaaacgtgcaaggagaatgcggtcaaatcgagaatcagctagacgctcaaggagaagaaagcaagcacatatgaatgaacttgaaacgcaggttggccaactaagagttgaacattctacattactcaagagtctcactgacacgaatcacaagtatgatgaagctgctgtggacaatcgaattctgaaggctgatattgaaacattaagagcaaaggtaaaccatcagcatcagttcgtcatcatcaccattgcctaagttgccttttcttactttggtccagttattcttcagttagtttggcttatggttcctgctgaaagttcaa

SEQ ID NO: 15719 - DNA, 851 bp, Gossypium hirsutum
  misc_feature (41)..(41): n is a, c, g, or t
  Predicted polypeptide sequence is orthologous to G568
gcggccgcctctactttttttttgctaaaagtgaataacanatgaatctcgttttaataaatggtaggtcaactatatatttacaattcaacagaaaagaatggatgtgattcttgcatgaatgatccaaaatacaaataaaatatctctcgaaaaaaaatgttacaattattctacacttgtatacagtctacaacaaggcaataattatagttgttctaagagagaaatagaattcagtctttcttgaaatgccataaatgagaccatggaagggtcgctttgatgcattaagtagaaagaagatatgtgattagagggtatcaacgaactacttctcccaacttcaaaacctcagtgcaccctccctcgcttccgggaagtggcagattccagttctattcccatctccagttctctctctatccaggcttcactgtctacctcgtcatctctaactttcgttcgcttcaaatttgcagccctatcgcatctcctcctcttaaagatctctcgaatccggtcggcgtcgctcttactgaaagtattacaaattgatacaatcttaatacttgggtttagatgatgagattcctctgttcttagctcacaatcgccttcagcattgtcgacaacagtacttgcaccactatcactggtttgacttggtaaactttcttttgcacttgcttgcttgttgtcacaggcaacggatgaaacaatattcaaactttggttctggtcagattcctctgttcttggctgacccgtaccactgccatcctcaacaccaccacttgcgccatcatcacttgttcgatgtgggaaaactctttcacacaatcttggct

SEQ ID NO: 15720 - DNA, 550 bp, Gossypium hirsutum
  Predicted polypeptide sequence is orthologous to G583
acgtagaacatatataggaaatgttaaatactaatgcacgaataaaacaagaaagaaacatgatcaaacaaaaaaacaaaagaaggcaaaaaaagaaaaagtgcatctcactgcagggctacctagctagctacctaattcaacgtgcatctctgaaggattgcagtactaagcatctcgtcggttatgaatattccagtagggactctgacaacaacatcttgtagcataagatcattgacgtttgatacactggcatggtgaactggtagctctaggtctcgaagtgcatccatcaatcgtgcagctggatgatcgatatctggacttcgaacccgaatcatggcttcggatcctactatcttcacatcaacttccactgtcttggccaataagtagaggattgtttcatggtattgtcgaatgcggatttggtagttggttttcgaaaacatttatggggttcaacttggatttttcagattgtactaggagttgagcctctagtttatcgattttgatcttagttccttgatgtaggctactggat

SEQ ID NO: 15721 - DNA, 957 bp, Gossypium hirsutum
  Predicted polypeptide sequence is orthologous to G583
atccccccactcccagcttccgtgctttattttcctcctcctcattcacctccaccaaaacaaattccaaggaaataaatctggcgaaatcttatggaatgacggactatcagttagcacccaccatgaatctttggaccgacgataatgcatctgttatggaagctttcatgacctctgatctttcttctatatggccacttccacaatcctctgcttccacttccactccggttgttgctgctgctgctcctcctcctcctcctgctgggctcgacccatcaaagtccttcctcccccactcccagccctccgtttctctcctcaatcaagagtctcttcaacaacgtctccaagccctcatcgaaggggctcgcgagagctggacttacgccattttctggcagtcttcttacgattgctccgccactaccgtgctcggttggggggacggctattacaaaggcgaagaagacaaagggaaggcaaagttgaaagcttcttcatcttctgttgctgaacaagaacaccgtaaaaaagtgcttcgagaactcaactccttgatttctggatccgcagctcccaccgacgatgccgtcgacgaagaagtcaccgacaccgagtggttctttttggtatccatgacgcagtcttttgtcgacggcagcggccttccgggccaggcttttttcaattcaagtcccgtttgggttgctgggccggatcggttagagagttccatgtgcgagagggcgaagcaagcgcaagtttttggtttgcaaaccttggtttgtataccgtcggcaaatggggttgttgagttagggtcaacggaactcatcacgcaagctcagatataatgaacaagttcgggttttgtttatttcaatatcgagatcgagctggttcttggtgtatgagtaacaacactgctgatcaaggcgaaaatgacccctc

SEQ ID NO: 15722 - DNA, 550 bp, Gossypium hirsutum
  misc_feature (46)..(46): n is a, c, g, or t
  misc_feature (237)..(237): n is a, c, g, or t
  misc_feature (335)..(335): n is a, c, g, or t
  misc_feature (459)..(459): n is a, c, g, or t
  Predicted polypeptide sequence is orthologous to G584, G1136
tttttttttttttttttttttttttttttttttttttttgggctcncaatctcaaacactaagaattaaggtctgaaagtgaacaacagggtaccaagaacccagatcttcatctaggttctaatctatgtaacaacatatatatatactgtatacatggatgacatacactacaacattgaacaccaaaaataaggcctatttgagcttattacactactaagagaagagactagntgggatgatcgtctatctgggatctccaacttgggatgttagagcgatcctaagtggttctgggttgtaaaatcggttccccatcttcacattaaccntgtgtatcatcaagtcgttaacgacggaaacgctgcgtggtgtacgtcgaggtctaactctgtgtaaggagccattaaccgtgatgctggatgattctttttattgggatgggattcgaatcanggcgtctaatcggatagtcttaacgtcgatatccaattctagtaatttgtgggacgtggtgaggcctcctcgctgactttctttctggttt

SEQ ID NO: 15723 - DNA, 848 bp, Gossypium hirsutum
  Predicted polypeptide sequence is orthologous to G584, G1136
agatttgtgggcatatgctatattatggcagacactgaacgatgacctgggtcgtctgttcttggcttggggagatggtcatcttcaatgcactaaagatgcttctccaaggttgagttccggcttccacagcgaacgaactaaggtgattaaaggaatccaagccctcattggagaccaacatgacatcgatttgtctatgatcgacggaaccgatatcactgatgtcgaatggttctatatgatgtcaatggctcgatccttctctgctggcgaagggattcctggcaaggctcttagtactgggtctttggtttggttaactggtgctcatgagttgcaattttacaattgtgaaagagctagagaagcccaaatgcatggccttgaaacactggtttgcatacccacttcttgtggtgttcttgaactaggatcctcagagattatcagggaaaactggggtttagtccagcaagtgaaatccctattcgaatccgatctcattggtctggttccaaaacaatcgactcctccaaatttaaccacagcttcggtccagttccttaacagaaatatctcatttgcagacatcggcataatagcgggtgttcaggaagaagacggtgcaagccaggatattaaaacacagcaagagcataacaataaccaaaccaagaaagattcctcaaaacttgggcaaccttcttatgtggactcagagcattcggattctgattttccattactagccatgaataacgtggagaagcgaaccccaaagaaacgaggaacgaaacccgggctcggacgagagacaccgttgaatcatgtggaagcggagaggc

SEQ ID NO: 15724 - DNA, 2328 bp, Gossypium hirsutum
  Predicted polypeptide sequence is orthologous to G585
cccacgcgtccggtgaaataaagagtcgccactcaccattgtccagtatagttggaatctatttgcatctgatctaattgttggtggacacacacacacacacacacatacatgtagcttttagctttgaaatgtctactggagttcaacatcaagagagagtaccaatgaacctgaagaaacaacttgctcttgctgtgaggaacattcaatggagttatgcaattttctggtccatatcaactagacaaccaggggtgttagaatggggagaaggttattacaatggagatataaagacaaggaaaacagttcaatctgtagaactcaacactgaccaattgagtttacagagaagtgagcaactgagacagctttatgagtctctttcagctggtgaaagcagtcctcaagctaaacgaccttcagcagcattatctcctgaagatcttactgatactgaatggtattacttggtttgtatgtcatttgtattcaacattggccaaggattacctggaagaacattgtctagtggtcaacctgtttggctttgtaatgctcattgtgctgacagtaaagtgtttggtcgttcactactagctaagagtgcatcgattcagactgcagtatgctttccgttttcaggaggtgtggttgagctcggtgtgactgatttggtatttgaagatttgagcctcattcagcgcgttaaaactttgctcttggatgatccacagccgattgtttctaagagatcgattcaagtcgatgggatgaacaacgatcttgcttgtccagctcttgatcctttgatccttgccaccaaattgagtccaatattaggctgtgaacaactagaaacggtttctcctgatgatagtccggacggcttggagcctaagcaatcaagagaagattcattattgattgaagggataaatggtggagcttctcaagtacaaagttggcaattcatggatgaagagttcagcaattgtgttcaccattccttgaattcaagtgactgcatatctcaaaccattgcggatcatcgaaaggtcgttcctctttgccggggagaaaatgataatggtttgcaagatgttgaagagtgcaatcagactaaactaacatcttttgatcgtcaaaacgatgatcggcacttccatgaagttctctcggccttattcaagagctcacacccgttgattttaggaccacagtttcgaaactctaacaaggaatcgagctttatcagatggcagaaaaatggcttgaagcctcaaaaagaaagagatgaaacccctcaaaagttactgaagaagatattgttcttggttcctcatatgcatgatagaggattgattgaatctcctgaaactaatgctgttcgagatgcagcttggagacccgaagctgatgaaatttgcggaaaccatgtgttatcggagaggaagcggagggaaaaaataaacgaacgacttatgatgttgaaatcacttgtccctgcaaataacaaggctgacaaggtttctatactagatgtcacgatagaatacttacaaaccctcgaaagaagggttgcggaattggaatcttgcagaaagtcagaagcaagaacgaaaatcgagcgaacatcagataacaacggaaagaaatcgtccctaagtaaaaggaaagcctatgatgttgttgatgaagctgatcaagagatcggctatgttgcatctaaagacggttcaacagataaagttactctcagtatgaacaacaaggagcttctaatcgagttcaagtgtccatggcgagaaggaattttgcttgaggtaatggatgcattaagcattctcaatttggattgccactcagttcagtcatctaccactgaggggattctctccctgaccataaaatccaagtacaaaggatcaagtgttgcaaaagcaggaccaatcgagcaagcattgcaaagaattgctagcaagtgttgaagctatttgttctagattttaccagtttcttttgtaagatcccatgtcataaggtgccagaagcaagattgatcctgcatgcaagtagtaaaagtaaaggcaattaaaccttgtttggagccttgtaacaaagcttgaccaaggacatcaatctttttcaccatgcattaactttgagaaatatcaacttttccttgcaactgtaacaggaaaacagctttgagccttgttcgaacatggaaacaggattggtaggggttcgaatttcaacaactatggtataataatggtattaatctaggtttccatgatctcaaaaaaaaaaaaaaaaaaa

SEQ ID NO: 15725 - DNA, 2080 bp, Gossypium hirsutum
  Predicted polypeptide sequence is orthologous to G585
atcatcttcagctatatagcaaatgtttctgttcatatatgtatgtataaatatatatagtttttaaacatagataaaccttcaaatggctactactggggttcaaaatcaagagaaggtcccaatgaacttgaagcaacaacttgctcttgctgttagaaacattcaatggagctatgggattttctggtccatttcagctaaacaaccaggggtcttggaatggggtgatggttattacaatggagatataaagacaaggaaaacagttcaatcttttgaacctaaagctgatgaccaactaggtttacaaagaagtgagcaattaagagaactatttgaatcactttcagctggtgaaactagtcctcatactaaaagaccttcagttgcattatcccctgaagatctcactgctactgaatggtattatttggtctgtatgtcatttgtattcaacattgaccaaggattgcctggaagaacattatcaattggtcaacctatttggctatgtaatgctcaatatgcagatagtaaagtgtttagtcgttcactggttgctaagagcgcgtctattcagacagtagtatgctttccatatgcaggaggtgtgattgagcttggtgtgactgatttggtatcgaaagaccccggtcttattcatcgtgttaaaagtttgttgttggatgctccggagacgataacagggaacatcaatgatgttgcttgtccaggtcttggtccgaacgaaattgagtccgaattgagtccgtttttaggctgtgaacaactagaaagaggttctccaaacgagatttcggatggttttgagcctaaccaaccagcagaagatccgttcgtgaatggtggggcttctcaggtgcaaagttggcaattcatggatgaccaccattctttgaatacaagtgactgcatatctcaaaccttttctgatcatgaagatgttgttcctctgtgccagggtgaaaatgataatgacaatgatttccgagatgtcgaagagtgtgatcgtataaaccgggctgcttttgatcctataagcgatgatatgcactaccgaaccgtcgtgtcggtcctattaaagagctcgcaccagtttattctgggaccgcattttggaaactcgaacaaggaatccgggttcattagctggaagatgaatagctcagtgaaatatcggaaagcaaaggttgaaatccctcaaaagttattgaagaagatgttgtttgaagtccctcggatgcatgataaaggattgcttaaatctccacaaggcggtgatggtgttggagatgcggtttggagaccagaagcggatgaactttgtaaaagccacgtcttatcagagaggaggcgtcgggaaaaaataaacgaacgacttatgatcctcaaatcattggtccctacgaatagcaaggctgataaagtttctatcttagatgatacaatagagtacctacaagacctcgaaagaagagttgaagaattggaatgttgcagagaattaaccgagtctgagactaaaacgaaacagaaacatcatcgggatcgtgctgagcgaacatccagtaacaaagtcaccaacggaaacaaatcggcttcctcaaataaaaggaaagcgtacgatattgaggaaacaaaacaggatatcgaccatgttgcatctaaagacggctcgaccgaaaatctaaccgttagtacgaacaacaaggatttaacaatcgagtttaagtgtcgatggcgggatggaattctgttcgagataatggatgctctaagcgtacttgatttggattgccactctgttcaatcgtctaccatcgaagggattctttctgtgactataaaatcaaagtacaaaggatcaagtgttgcaaaaccagggacaatcaagcaagcattattacaaaaggttcaatctttaacctttgtgtaatatttcagttcgattgaagggaaatttagcctagtttatatcccttgtaagttctgaaaaaaccctaagttattcaatcttttgaactttgtgcaacatttctgaaaaaaaaaaaaaaaa

SEQ ID NO: 15726 - DNA, 1005 bp, Gossypium hirsutum
  Predicted polypeptide sequence is orthologous to G591, G793
aaaaaaggaagaggaaagccaaaactccaaactttctattttgcttttatattatatttttttttggttcaattcagtttcgccatttcctttgcatgtagatgctctttggttagtctctaacgccgctacttggactcactttccgctgctatctttttttcggctttctcatggctaataacaccaacgaggcccccgccgccgatgatttcctcgagcaaatcctcggcctccctaactttgcgccctctgaaacgggcttagctggatccgacgctggattggctgcaaccgctcctggagctggagctccaatgtttttgcagctcagctccggtgatggcgccgctcatatcggcggaatcggcggcggtggaggcggtgcgtttcatgggcaggttttccccttgggcttgagcttggagcaagggaaaggcgggtttttgaaacccgaggaagcttccggtagtgggaagcggtttcggaacggggtcgttgatgaccgggcttcttctgtaaaaaatgttttccatggccaacctatgcaagcaactgtttctgcagcaccacatccaccgacaatgcgtccaagggtgcgcgctagacgaggacaggccacggatcctcacagcattgctgaacggttgcgcagggagagaattactgaaagaatcagggcattgcaggaacttgttcctagtgtcaacaagactgatagggcagtcatgcttgatgaaattgtagattatgtcaagttcctgaggctccaagttaaggttttgagcatgagtaggttgggcggagctggtgcagtggcaccgcttgtaacagacattccactatcatcagtagagtatgaaagcggtgagggtggaagaagccagccagcatgggagaagtggtcaaatgatggcacagagcaacagtagctagctgatggagaaacgttggagctgccatgcatcctccaatcaaagtctctttgcattatgcctatctcac

SEQ ID NO: 15727 - DNA, 920 bp, Gossypium hirsutum
  Predicted polypeptide sequence is orthologous to G591, G793
ttgaaaaaaaaaattccctcttttcctttctgttactttcacagagctgaaagtacagaacagaaaagaaaccccaaacctcaaaattttctctttctcacgttgatagaaggatttaagctagaacggcaaagatatgaaataatatcgtgttttttgtctataaatattttgttgggttttcaattcttttttcgccatttcttttgcatgttgatgatctttggtggctttaactcggtacttggactcacttccgctactacttcttcgggtttcacatggctaataaccccaacgaggcttccgctgatgatttcctcgagcaaatcctcggattccctaacttcgcgccttctgagacgggtttggcgggacccgacggtggactgacaggaacaactgctggtgccggaacgccaatgtttctacagctcagctctggtgatggagccagtcatctcggcggaatcggcggcggtggaggcggcgcgtttcccggacaggtttttccgttggggttgagcttagaccaagggaaaagcggcgggttcttgaagccggaggaaggttctggtggtagcagcaggcggtttcgcgatgaagtcgttgatggcagggcttcctcagttaaaaacgttttccatggttcaccaatgccggctaccgttgctccatcaccgcatccaccaacaatgcgtccaagggtgcgggctagacgaggacaggccacggacccgcatagcattgctgaacggttgcggagggaaagaattgccgaaagaatccgagcattacaggaacttgttcctagtgttaacaagactgatagagcggtcatgcttgatgaaattgtagattatgtcaagttcctgaggctccaagttacgttttgagtatgagtagtagcggggcggggc

SEQ ID NO: 15728 - DNA, 1004 bp, Gossypium hirsutum
  Predicted polypeptide sequence is orthologous to G591, G793
gtttctctttcagaaaaaggaaagttcaagctaagctaaaactctgaactttccccttctcagtctcctcagggacggagaaagattaaacgaaaggaaaagaaaaagacttcttctttttttccctaaaagaaaagttgatctttttttgtttggttcgattctctttagccatttcctttttgcatgtagatgctctttggtagccttaactcgccacttcgactcacttcaatccatggctaataaccccaacgagtcccccgctgatgatttcctcgagcaaatcctcggactctcccactttgcgcctactgagactggcttagcggggcccgacggtagattgtctggaaacgccacgacggctggagcgccaatgcttctgcagctcagctccggcggtggcaccggacacatcggcgctataggcggcggtggaggcggtgcgtttcacggacaggtttttccattgggattgagcttggagcaaggaaaaggtgggtttttgaagcccgaggaagcatccggtagcagcaagcgcttccgcaacgaggtcgttgatggcagagctttttctgttaaaaacgttttccatggacaaccagtgccagctactgttgctgctggaccacatccaccagcaatgcatccgagggtgagggctagacgaggacaggccacagatccacatagcattgctgagcggttgcgcagggagagaattgccgaaagaatccgggcattgcaggaacttgttcctagtgttaacaagactgatagagcagccatgcttgatgaaattgtagattatgtgaagttcctgaggctccaagttaacgtcttgagcatgagtaggttgggcgcagctggtgcagtggcaccactcgtaacggacctcccactatcgtcagttgagatgaagtggtgagggaggagagccaccagcctgggagaaatggtcaatgatggcacagagagacagtagctagctgatgggagga

SEQ ID NO: 15729 - DNA, 948 bp, Gossypium hirsutum
  Predicted polypeptide sequence is orthologous to G592
gttccttaatggtatcaaagctgagaaaagaacaaacaaaagggtttcaacaagaaaaaaagaatggagaccgctgattattactatctgcaacaaaaccagcagcagagttgtggtctaatgcggtatcggtcgatgccggccgagaaccgtgtcgggtacgacgagtacggtagcgattttcggtcatcttcgagttccgaaatggaaacattgttcatgttgtgtggtaatggttcatcagggaatgtttcagaatatgaagagaaatcagtgaagcaacaggaggagatgatgtatcaaattcaaagcttgccattggagaatgttgagagttcatttggtgttggtacaaatttgggattggagaattcaatgcaaagaaatgggaatggttcaaatcttgttaggcaaaccagttctccatctcagtttttctctagccatggccttgataatgggcttgcaatggtatcaatggtgaaccaacatctacgggtagattgtataaccatatcagcttctcctctgggccaaatcctcaaatagctcaagttgagaatgaaggcttagcaagcaatggtaatggtagaaatgggatgaacttcatccccaacttgatgtctgattcaaggaataatgcttcacttagtgggttgaaaagagcccgagagagagacagcgacttgttgagtggtttaagccgattgcaaactcggaaccaggattgcagagactgttctactgctttaacacaccagttgagtttacctacaacctatgagaagtggatgtttggcagtttcaaagctcggtcccttgcaagattcgagcgaaacgaggttgcgctactcacccacgtagcatcgctgagaggatgagaagaacactgatcagtgaacgaatgagaaactgcaagtcttttctcgaacatcgacagcaaacaaa

SEQ ID NO: 15730 - DNA, 472 bp, Gossypium hirsutum
  Predicted polypeptide sequence is orthologous to G594, G1496
attttgttgagcgacgaagcttagaaaatctttggtttgtgcttatgatgcgtcgctctgcttatgcatccaaaaaaacgggtcaacccaattcaaccaacccaatttcctgttctccctccgatctctttcgcaccaattcagagcgattataaggtcataaacttggatcaatggatgggctttttttgattctgcaatgaggttagaagggagaaaatcagtgaaagaatgaagtatctgcaagatttttaccagggtgtaacaaaatcacaggcaaagttggtatgcttgatgaaatcatcaattatgttcaatctcttcaatggcaagtagaggtaaaaaaataatggagaaagaacatatggatttgtgtatgaacacaaaaattctttttcatttctagtaattacttaactgctttaagattttgtcctccatgtgaggacatatttaaaaaaaaaaaaaaaaa

SEQ ID NO: 15731 - DNA, 797 bp, Gossypium hirsutum
  Predicted polypeptide sequence is orthologous to G597
ctaaaactgaaaggattgcaacagttattagggttttaatttggcgatgagtaaattctacttttttgcatatagatttttcaccctgggatttaagagcaaggtagcttgttaggctcaaggtttttttttttcagtgaattttgaaagcttgatcaactgacagttcctcgctcaagttgaaatttgaaactccattttaatttatacaaacattttcaaaaatctgcacttctcgagttcgagttcgagttcgagagagttcagtgcaccaaacagtgagttctttttctgctgctgctgctgctgctgcttcttgatctaatgaattacttaggtatgagcaaaggaaagaactgaaaaagcatatataattcaattttaaacaccaaacagaaaaaggagaagaatgtcgggatctgagacgggaatgatggcgagtagagagccctacagcttgggcatgcaacagaagagtccggtggcgtcacaaccggcgatacagaacatgcgtttagcctttagggctgacggaacagctgtgtacaagcccatcactcccgcctcactcacatatcagccagcttccggcgatggtggggcggaggggtccgctggtggacctgcagtcactcaagaacaagggcaagctctgaacatgagcatgagcatggggagcgaacccttgaagaggaagagagggaggcccaggaagtatgggccggaaagtaccatgcctttggctcttataccagctccttcctctgtcagcgtaacccaatctaatagtggaggag

SEQ ID NO: 15732 - DNA, 885 bp, Gossypium hirsutum
  Predicted polypeptide sequence is orthologous to G597
tcaaaattaaatatacaagaattagggttctctaggcttagttgtccttgctattattcttcatggttttctatgtaaaaaaacactgttgttgattttgttgtattttgagtattttttttttaaatatggtagatcacttctttcagttgtgctaggcatgagggcgttaagttttgtttaggtttttcattgtttctctaacaaaaagtagatattctgtcttgaagcttactttttgaggtaggttatcttgtaatggaagaaatttctttttttttttcccttgagaattactttttactttccctgcaggacattgcaacaaaattaatgtcattttcacagcaaggaccaagagaagtatgcattttgtcagccaatggtgctgtctctaccgtaactcttcgacagccgtcatcgtcgggtggcactgttacgtacgagggacgatttgagatattatgtctgtcaggctcgtacctgctgacaagcaatactggctctcgcaatcaaactggtggtcttagtgtttctcttgccagtcctgatggccgtgtcattgggggaggtgttgggagggatgcttatcgcagcaagccccgtgcaggtgattgtggggagttttatatggggtggatcaaaggcaaagaacaaaaaaggagggcaagaaggggtaaaagattcagatgatcagatggttgacaatctagtagctcctccaggcatatcaccaagtcaaaatatgactccaagtgcaccggcaggggtgtggcctgggtcgagatcaatggatatgcgtaacaatagccatgtcaacattgatctaatgcgcggatgatgactgtttcctggtatagttggggagaatgttatagtttggtg

SEQ ID NO: 15733 - DNA, 550 bp, Gossypium hirsutum
  Predicted polypeptide sequence is orthologous to G600, G2768
gcaaagcaagcaaaaagcttttatgtcatataattattaaacgtataagtccaaaagtatgagattgcgactgctccttcacagcactcgcagcgttacaaactctaatattattatttacccttttatctatgtttattatagctgctacgctcgcgttccttggatcctctagagtgccgtggttgttctatccactcagccgatggtgaccgtgaatacctcgacggcttccttttgaaatgtctatcatcatcactagattcgtaatctacagcattgctacgactgctcttcctaccacccccgctggtaccagaaattgcctttggggctgctgaactagtcttgtagtcatcatagtatccattggaagttgacttgtgatggccagaagatgcaggtgcatccgaagatagtctgcgtttcttgctgtgttcttcaggaaagctaatgcgagaaaacacacttgtcttttgactcttatccattgctgcagtagcagtcgtggaagtggctttggtgactgtttccggggcaagcttggaag

SEQ ID NO: 15734 - DNA, 640 bp, Gossypium hirsutum
  Predicted polypeptide sequence is orthologous to G602
caaaaccttgagtatcacttcattcctaacgaaattatcgagtatttttttcacaaacccataaaattgtctaagttatggcggaggaagtgaagaagcaggctgaagctgaaacgacggcggctccaccgccggcagtggaggttccaaaagctgaatctgaggaaaaaactgtatctccaccgccagcagaggagaaacctgaagagtccaaagctcttgttgtagttgagaaggctccagagcctgaaccaaagaaaatctcaggaggatcacatgatagagatattgcccttgcagaggttgaaaaggcaaaaaggttgtcattcatcaaggcatgggaagaaagtgaaaagaccaaagcagagaataagtcccagaaaaagctctctgctattgtagcatgggagaacagcaagaaagcatctctggaagcaaaactgaaaaaaattgaggaacaattggaaaagaagaaagcagaatatgcagagaaaatgaaaaacaaggtagctttgcttcacaagggaagcaaaaaaaaagaaggcaatggttgaagccaaacgaagagaatatgttctcaaggcggaagaaatggctgcaaaataccgtgcaaccggacaaactccaaaaaaggtcctca

SEQ ID NO: 15735 - DNA, 797 bp, Gossypium hirsutum
  misc_feature (601)..(601): n is a, c, g, or t
  Predicted polypeptide sequence is orthologous to G602
tgttttagacgaaagttttactatatattcttcttcaacctgagttttctttttcctccatggactcaaagaaagcccctgagccagcaccaaagaaaagttcgagtggatcacatgatagagatgttgctcttgcggatcttgaaaaggaaaaaaaattgtcattcattaaggcatgggaagatagtgaaaaaaccaaagctgagaacaaggcccagaaaaagctctctgctattgtagcatgggagaacagcaagaaagcagctcttgaagcaaaactcaaaaaaattgaggaacaattggaaaagaagaaagccgagtacgccgagacaatgaagaacaaggtagcttcaattcacaaggaagcagaagaaaagagagcaatggtcgaagccaaacgtggagaagaggttctcaatgccgaagaaatagccgctaaataccgtgcgaccggacaaagtccgaaaaagctccttgggtgtttctgaaagtttccggtccggtattgaaatgaatttcattaaaatttgtttgcttgtcaacacatttttttttcctgatttgtaactccatgttttcaattgtgtataactatcttgtntgtatctatgttgtgcttgtgtcttgagcacgttggcagacatcatttccacttttttttactggaactgtgctctgggatacacactacatatggtgcttgcggacacactttcgggcttctcaactgggagtagaacagattctataaaaaaacacactcaggggggccggaccattgcgcatgtagtcatcag

SEQ ID NO: 15736 - DNA, 888 bp, Gossypium hirsutum
  Predicted polypeptide sequence is orthologous to G605, G1944
gtgataggagcagaagctccatcagcttatcaaatggcacctaggaccgaaaatgttagccagattggtgtcggctcaacaacagaggatgtttcaccagttagtgtagggttaactggtagtatagaaaagaaaaagagaggtaggcctaggaaatatggaccagatgggacaatggcgagggcattgtcaccaatgcctatttcctcatccgtcccgcccagcggaggtgagttctcaagtggtggcggaaagcgtgggagaggacgaggtagcgggtaccagattaaacatcagaagggaatggacttggagaatttaggtgaatgggctgctacttctgtcgggtcaagttttacgcctcatgttatcacggtcgatgccggtgaggatgtgacaatgaaggtgatatcattttctcaacaaggaccaagagctatttgcatcctatctgccaatggagtaatttcaaatgttacacttcgtcaacccaattcttctgggggcactcttacgtacgagggtcgctttgagatactttccttgtctggatccttcatgcctacagaaactcaaggaacgagaagtcgatctggtgggatgagtgtatctttggcaagtgctgatggccgtgttgtaggaggaggagttgctgggcttcttatagctgcctgccctgtacaagttgttgtcggcagctttttacctggcaaccagcatgatcaaaaacccaaaaagcagaagatcgagtccataccagctactgttgcaccaaacccgagtattgccgctgcaccagcttcaaatgctgagaaagaggatggcatagatgttgtttcgccgcaacaaaattcgaatgccctgaaacaagcctcaccggtgctacct

SEQ ID NO: 15737 - DNA, 936 bp, Gossypium hirsutum
  Predicted polypeptide sequence is orthologous to G605, G1944
gtccatgtcactaggcaactctgacactaactcacctcatctgccactgggtagcttggtgttatctcaagtcatgaacatggacttggagagaaacctcgataatgcagcaacaggcgagggagccacaataagtaccacagcaacagcagttccaggaccaagtggaggtggggttgattctttaggaaagaaaaggagagggaggccaagaaaatatgatgcagatgggaaccttaggttaccatataaattagcgacgacttctcctactgacttctcctcttccaagagaggtagaggcaggccccctgcttcttccaactgccaccttctagcttctatagttcagttgtttgctagcacagctggaggggactttacgccacatgtggtcacagttaaccctggggaggatgttgcaggcaaaattctttcattttctcaaaagggacctcgtgggatttgtgttctgtcagcaaatggagctgtttccactgtttgtattcgacaacctggttcatctggtggtattttaacatacgagggtcggtttgagatattgtccttaactgggtcatttacagacagtgaccgtggtggtggaaaaagtaaaactggtgggttaagtgtttcattggccggaccagatggtcgtgtaattggcggtggacttgctggttccttggtggctgctagccctatacaagttgtggtaggaagcttcatgccaaacggttacaaattgcataaaaagaagtatcaagctgagcacacggcgacagccgcaaggccaatctcacaagcggaacctgatggtgatctcaagttctgcatgacacccacatccccatttcgaaaggaaagcaatggggaaccaaatcataccacaatggataaacatacaaatgttggatcctctcatgctgttagttg

SEQ ID NO: 15738 - DNA, 837 bp, Gossypium hirsutum
  Predicted polypeptide sequence is orthologous to G605, G1944
gttagagtggtaggatccgattctccatcggactaccacatagctccaaggtccgaaaactcaacccaaaacccgaacccgactcccggatccgttccaccgccgcagccccatgcggcacaaccaggacctccgccgccggtttcagtttcggggatgccagagaagaagaagaggggaaggcctagaaaatatggaccggacggttcagtcactaaagcgctctctccgaaaccgatatcaacatctgcgccagcgccaccttcggttatcgacttctctgccgtgaagagagggaaagtgaaatctccgatatcgttttcaaaggccaagaacgagccggagaatttaggtgaatgggttccatgttctgtcggagctaattttacgccgcatatcatcactgttaatgctggtgaggatgtcacaatgaagattatatcattttcccaacaagggcctcgagctatatgtattctctctgcaaatgggatcatctcaagtgtcactcttcggcaaccagattcttccgggggtacattgacatatgagggtcgttttgagatactgtccttgtctggttcgttcatgcccagtgaaagcggaggaacaagaagcagatctggcgggatgagtgtttcattagcaagtccggatggacgtgtagtaggtggtggagtcgctggactcctagtagctgctggtcccgtgcaggttgtagtaggcagttttctggccgggaaccagcacgaacagaatctgaagaaacagaagcacgactccgtaacaatatcagctgccacaccaatggctgttattcccatttctagtgccgat

SEQ ID NO: 15739 - DNA, 895 bp, Gossypium hirsutum
  Predicted polypeptide sequence is orthologous to G605, G1944
ggcattgtcaccaatgcctatttcctcatctgtcccacccggtacagctgagtttccaagtggaggaaagccagggagagggcgaggcagtgcttaccagattaagcatcataaaggaatggacatagataatttaggtgagttggccggcacttctattggaacaaattttatgccgcatgtcatcactgtcaatcccggcgaggatgtaacaatgaaggtgatatcgttttctcaacaaggaccacgagccatttgcatcctatccgctaacggagtgatttcaaatgttacacttcgtcagcctgattcttccgggggtacgcttacatatgagggtcgttttgagatactgtccttgtccggttccttcatgcctactgaaactcaaggaactaggagtcgatctggagggatgagcgtctcgttggcgagccctgatggacgtgttgtaggtggaggcgtagcaggccttctcatagctgccagtcctgtacaggttgtcataggaagttttgtaccaggcaaccagcacgaccaaaagtccaagaagcagaaaaatgagtccttaccagcaactcttgcaccaaacccggccacagtcgatttacctgcatcgaatgcagaaaaagaggacggcatcggtgtgcaacattcacaacaaaattccaataccctgaaacaaaactttgctactactgctagtttcagaacagaaaattgggccaacatacaggagccaagaaattcagccactgatataaacatttctttgcctgcagtttaattttataacttaacaaatcattcatgtcttaatgtaggataaagtaatttcctgacattcacctaggttttaatttttcagacatgacatagacaatatatgtttttt

SEQ ID NO: 15740 - DNA, 931 bp, Gossypium hirsutum
  Predicted polypeptide sequence is orthologous to G605, G1944
ccatatctgggtcactaggcaactcggacactgactcaccacctgcaccagtgagtaaccttcaagtgttgcctcaggtgatgaatatcaacaacatgagctcggaaacagcgacgacaatgacttcaacagtgattccacgaccaggtggaagaacactaagtgattctttggggaagaaaaagagagggaggccgagaaaatatgatgcagatgggaaccttagggtaccatatcagatagtgacgacgacgatgaattcacctcctggtttcactttatctccttcatctcctactgagttctcatcacacaagagaggtaaaggaaggtccccagggaactggcagcttcttgcttctctaggtgagttgtttgctcacacggccggcggagacttcacggcacatgtggtcaaagttaataccggggaggatgtagcaggaaaagttgtgtcattatcacaaaagggtcctcgtgggatttgtattctatcagcaaatggagctgtttctaatgttacccttcgacaacctggttcctctggtgggattttatcattcgaggggcgttttgagatattgtctctaaccggttcatttacattcactgacaatgggggtgtaaaaagcagaaccggtggtttgagtgtttcattggctggatcggatggtcgagtaataggtggtgggcttgccggtgtactgttggctgctagccctatacaaattgtggtgggaagcttcatgctaaatggctacaaagtgcataaaaggaagccttgccgtgagcagcacacagtggcagcttctgcagtcaccaccgctccttcggccatggccattacagaagaaggaaggccaatcatctcacaagcaaaactagattgtgaaaacaacgtgaaaccaacatctccattccaagtggggag

SEQ ID NO: 15741 - DNA, 927 bp, Gossypium hirsutum
  Predicted polypeptide sequence is orthologous to G605, G1944
gttttagctccaaaatcaattttcaaaacctgtgttagtgccaaaaactaaatcttttgctgagtttcaagttaaaagttgatatctttcaactttgtctgttttgggttcttttttattgttaaaaattagccttgtttttagctggttgagcttaaaatccaaatgcgtttttgataaaatctcagaaagtttttagttttaactatggagtcaagagaagctgttactaatactaatattagtactaatactatcaccaccaccaccaccactactactactaccactgctggcgtaacggtggtaggatccgatgctccatcggactaccacatagctccaaggtctgaaaactcgacccaaaatcctaacccggctcctggatccgctccgccgcagattcctcaacaaccggcggctcaacaagtccctcagcctgttgtggtgccggggatgcccttgaagaagaagaggggaagacctaggaagtatggaccggatggttcagtcactatggcgctctctccaaagcctatatcaacggctgccccacctccagtaatcgatttttcagccgggaagagagcgaaagtgaagtcgccgatatcgtttccgaagactaagtacgagctggagaatttaggtgaatgggttgcatgctctgttggtggtaattttgcgccacatatcatcactgttaatgctggtgaggatgtcacgatgaagattatatcattttcccaacaagggcctcgagctatatgcattctttctgcaaatggagtgatctcaagtgtcactcttcgtcaacctgattcttccggaggtacattgacatatgagggtcgttttgagatactgtccttgtctggttcgttcatgcctaatgacactggaggacagaagcagatcgggtgggatgag

SEQ ID NO: 15742 - DNA, 888 bp, Gossypium hirsutum
  Predicted polypeptide sequence is orthologous to G616
gcaattattgctgttctttagcttaacagtgaagcagaaaaaagggtttctttctcagattcaagactgtggctgccatttttcgggctatgcttttgaaagtactgaagctgcaaaaggcttaaacgagagagagagagagagagagagagagaggggaggggaaggctggtctcctgacttggaccgtatatcaaagcgtaagaaaggtcctttatcactaaacatagccgaactactgtctatgcaatcgtcatcaatgcataggacatgtcaaccccgtctttctaacatttctcccaaatcccagattttctttctctttaaagctgagatagaaggtatattgtttggggtaggtgaagttttgagtttctgagaaaggaatgtaagtggtatggagatagatgagattcagacacaacaaggttctaagttctcaagagttggtaatgggagaagtgagtcgagcaggatgggtcagaaaggtagtgacaaccactaccctgatgatgaagaaggtagagaggtcatgaaaagggctagtgcaaatggaggtggaggtgatgctctagctgacaccgctgctgctaatcggcttcgaggctggcaccattcttcgagaattattagggtttctcgagcctcaggtgggaaagatcggcacagcaaggtttggacttcaaaagggttgagagataggagggtaaggttatctgtttccacagctatacagttttatgatctacaagaccggttgggctatgatcagcctagtaaagcaatagagtggctgattaaagaagctgctgatgcaattgcggagcttccttcacttaacacttcatttcccgataccccaaagcaattgagtgatgatggaactga

SEQ ID NO: 15743 - DNA, 877 bp, Gossypium hirsutum
  Predicted polypeptide sequence is orthologous to G618, G2057
gcggccgcgtcgacccaacatgcaagaaaaatgggagatagccaccaccaagctgcaacatcgtcaagattggggataaggcactctggaggggagatcgttgaggtccaaggaggtcacattgttcggtcaactggaaggaaagaccgtcacagcaaagtttgtactgccaaaggtcctcgagaccgacgtgttcgtctctcagctcacaccgccatccagttctacgacgtccaggaccgacttggctacgatcgtcctagcaaagctgtggattggcttatcaaaaaagccaaacctgccattgacgagctagctgaactacctccttggaaccctgaaactttgaatacaaccacttcgatcgctaaaactagtaaccaagaagaccaaaacgcgacaaccgcaaccgacaatgataagccgtatcagttccacaccaaccatagtggaaacctggtggaaaaccttgctgctgggtcgggtactcggagaagaacggctacaataatggggaatgaagttcaaagtcttcagcaacaagaaatgggagataaccccaataataattcgggttttcttccaccttctttagtttctgatgagatagcggatacaattaagtcttttttcccattgggagcctcaagtgagacgccgtcttcttccatacagttccagaattatccgccggatttgttgtcgaggaccagcagccacagtcaagatcttcggctttcacttcaatcttttccggagccgattcttttgcaccaccaccaccaccacgcccaagctgctacagctcaggcacaccacagtgaacctgttttattctctgggtcagcccattagctggtttcgatgggtcttctgc

SEQ ID NO: 15744 - DNA, 732 bp, Gossypium hirsutum
  Predicted polypeptide sequence is orthologous to G618, G2057
caaacatccaagcttaacccaacatgcaagaagaatgggagaaagcaatcaccaagctgcaacatcgtcaagattggggttaaagcatagtggaggcgagatcgttgaggttcaaggaggtcacattgttcggtcaattggaagaaaagaccgtcacagcaaagtttgcaccgctaaaggtcctcgagaccgtcgtgttcgtctctccgctcacaccgccatccagttctacgacgttcaggaccgccttggttacgaccgtcctagcaaagctgtggattggcttatcaaaaaagccaaatccgccattgacgagctcgctgaactacctccttggaacccacaaaccttgaaaacaacgacttcaaccacgaaacaaaataatcaacaagatcaaaacataatcacagcagtagacaatgaaaagcccagaagaacggctacattaatgggaaaccaagttcaaattcttcagcaacaaggaacgggagataacccgaatagtaattcgggttttcttccatcttctttagtttctgatgagattgcagatactatgaagtcttcttttccactgggagcttccagtgaggcaccgtcttcttctattcagtttcagaattatccaccagattttttgtccaaaactagcagccacagtcaagatctgcggctttcgcttcagtcatttccggagccggttcttctccaccaccatcaccaagctgctgc

SEQ ID NO: 15745 - DNA, 792 bp, Gossypium hirsutum
  Predicted polypeptide sequence is orthologous to G634
gcaaaagattactggccagaccatacaattacccactaccgcaactgttattgtacccgcacctgcaccaccaccaccacctccaccgacacaaccgaccgtctccgttgttccaccagaggtccctattgctccaccatcgcatcaaacaccgtcattaacacaacaaaagcaacaagaacaacaacagacgcatatatctcaccatcaaccaccaccaccacaacagcagccacaagttgttcaacagcagcagcagcttcacaatatggaacttgtgaggcatcaacaacagcccattactacagaaatagtaatggcaatcccggaacaacaggtcccaccacaagagattagtgggagtgggagcttggtggagccagcctcgtctagatggcctaaagctgaagttcttacacttataaacctgaggagtgggcttgaatccaggtaccaagaagctgggcctaaaggtcctctttgggaagaaatctctgctggtatgtccaggttgggttacaagcgaagcgccaaacgatgtaaggaaaagtgggagaacatcaacaagtacttcaaaaaggtcaaagaaagcaacaaaaaacgtcccgaagatgccaaaacttgtccctattttcaccagctcgatgccctttaccgtaagaaaatacttggtggtgggactagcagtggcagctttagtgaccataatagacccgatgaagaaacgtcacggcagcatcatgaccccacactaagcacggcagcaccgcaaccatcccaaaacgaaccgga

SEQ ID NO: 15746 - DNA, 540 bp, Gossypium hirsutum
  Predicted polypeptide sequence is orthologous to G636
cctcttcctccttccgaccccgaccatcaacaccgccgcgaccccgaagacttggaaagctatcaaaatcatcaggacgaagacggcaatgacgaagatgaagatgaagatgaagatgaagttgaagggggtgagtatgaaattgtagccagcaaaccagtgtcaatgggcacatgtgagtgatgggtgtcatgctgggttggagtggaagcatttgaattgaatttttaaatggtgagtacacaatattagtgggggtgtagcatatggtcagtggaattttatatgttcattttcattatatttattttttggggctagataaaataagtttaagaggaggtgtagatgagaagagagagagagagaggggttcaaaatctcattccgcataataagaacaagtaataaacagggaaaacgaaagagacctgcgctgtatttattgataatgtgtccatagtagctgtaaatgttagaaatggtaattatatctagcatgtttgttaacaaacaaaaaaaaaaaaaaaaaaaaaaaaa

SEQ ID NO: 15747 - DNA, 492 bp, Gossypium hirsutum
  Predicted polypeptide sequence is orthologous to G636
agcataagaacaaagtaaaaaaaaacataacaccttattccctattcggccgaacactaatcctcttttactcaaacaccgatccaccaccacagtaggcgaccaatgtattcgagctctagcgatcattttagccttaggattccctctcagccttgatttcaacaaagtgaaaggaaacccatggagttttcgtaaggtatgtggtgtgcgtggcgcgtgtatggaggcagtgcgctggcgtacggaggtgcaatggaggccgtacgtgggggagcggcgcgaggcaaataggggctaaggttttgactgaatttgttttagtttttgggctgtttgggccttagggttagttttgtttcgggcttgtttattttggcagatttgggctgatgtaataagggacagtggacatttaattatttggttaataattgtttatatatatatatttataaattgtttgggcaaaaaaaaaaaaaaaaaaaaaaa

SEQ ID NO: 15748 - DNA, 725 bp, Gossypium hirsutum
  misc_feature (530)..(530): n is a, c, g, or t
  misc_feature (588)..(588): n is a, c, g, or t
  misc_feature (601)..(601): n is a, c, g, or t
  misc_feature (634)..(634): n is a, c, g, or t
  Predicted polypeptide sequence is orthologous to G638
ttttttttttttttttttaaatcaaacccattaatccatatttgaattagctaagaacaacatgaaacacagtttgctgtacataaattttcaagagtcaaagatcagtcaaactgcttgcttacacattctacacagcctctcaaaagagaacttacccatgtgggatggattacaataattgtgaaacctgtcatcttttgtttgaacttactggttttttttcatcagttgctgagtttcagaccatagttttcccacaagttattatctccatcagccatgaagaagcgaaagcaactatcgcttacagcatgagaagagccgtcatttggttggagtctcaatgtctcaggtccttgagtgaaaatggtctcatggggttgataataatcaaagcctcttgagttctcctttctctttttgttactctccttggttttcattagggtatatgaaccaccaatggtatcccatttgtctttgcacattaaaccactcctttcaaatcctaaacaccccatcttagncggcgatttcctcccacaaaaccacctcttctgaataccctacttgttggaaccttgntttccactcgtgnccgaattcggcacgagcttatttcttcattgcnatgtgccttttccctggttgccattggaggtttttgggcttacggtaaccttatgccatcgggagggattttaaacgcactttatggattc

SEQ ID NO: 15749 - DNA, 898 bp, Gossypium hirsutum
  Predicted polypeptide sequence is orthologous to G651
ctaaaacaacccaccaccaactcagtaaccgcaccgactcagcttcttcctcgtcctcttcatctggcgatgatgagcaagagaaaagcagggaaacactactcgaagacaaatctttggtttatgggttaagagagaatcccaagaagagtttcaggttcgaagatcctgaattctcattcgccggtgattccggctccgttgtccaagacagagagagcgagactgagtccaggaacccaactcggagacgatcaaagagaaaacccaaggtgggtactgctaatgcaacaacagcaactgacgaaatcaagaaactgaagctgttgacgagtttccccagtttgatcgactcaccggcggagcctgaaccgttgagctcagtctccgatacctcgcctgaagagaatgtggcggtgtgccttatgttgctgtcgagagatgtttggaaaaggaataatgtggaacaaagatcaggaaaaccaatggagtcaagcaagaagaagatgaatgggaaacatcgatgtgggaaatgtaagaaagcatttggatcttataacacgttggaagaacataaaagggtttgcctttcgtcagctgctgacagcaagagatttgagtgtccattttgttacagagtgttcgggtcaggacaagcactcggaggtcacaagagatctcatttacttgcttcagcttcttcatccaacacggctgcaaattttactaaattcgacaacaatttcatagatctaaacttgccagctcccttggaagatgatgagtttagtgtggtatccgatgcataaaccagcagttaaagcaattcacgtggatctgatgctattctattcaatgtttttcatttttttacttggctggtattctttctattatt

SEQ ID NO: 15750 - DNA, 429 bp, Gossypium hirsutum
  misc_feature (117)..(117): n is a, c, g, or t
  Predicted polypeptide sequence is orthologous to G652, G1335
tgaaactaaactttattattctgatgtatagtttgattgaacggtattgatacagaattgacttccttgaacaaattgatgataattaggggcttccctccccccctccttcccatnccttataccaaattcttccattagagcaaataactttacaaaaagtgcccattacaactattttaaaacatcacaatataactaacatttaaaagctttaataatccttggaaatactcaaaaacctaacaatacttcataatagactgcagggattaaggctcaacggttattgccaggacattcccgggcaaagtgaccggcgacaccacagttgtaacaagccaacccaccgtatccaactccgcacccccatatcttccaccaccgccgccgctgccaccttgtccacagtcccttgccaacaggaca

SEQ ID NO: 15751 - DNA, 700 bp, Gossypium hirsutum
  Predicted polypeptide sequence is orthologous to G652, G1335
catttctgtggtttgtgagtgttgttttgggattttgaagatgggtgagaataggatgaccggcaaggtgaagtggttcgatgaccaaaagggttatggcttcatatcccctgacgacggcggcgacgatttgtttgttcaccagtcttccatccgttccgagggtttccgtagccttgctgatggtgaagaggtcgagtacgttgtcgagtcttctgaaggtcgccccaaggctattgaggtcactggccccaacggcaaccctgttcgtggatcatctagatccggacgcggtggcggtggtggtggtggttatggcggttatggcggtggatccggtggttatggtggagggggaaggagaggcggttatggtggaggaggcggtggtggaggcgccggatgttataagtgtggtgagatgggccatttagcacgggactgtgggcagggtagcggtggcggtggaggcagatatggcggcggagggggcggaggaggcggcggtgcttgttacaactgtggaggctctgggcatttcgctagggagtgtcccaacagtggtcgctaattttgaggggggatttaaatgtgtcattcgcatctcctccgatccatccttttttcctcttccgctactgtttgtgtcggtttcgttattatcgtatggtttgctttttatgttttccttttccagttt

SEQ ID NO: 15752 - DNA, 622 bp, Gossypium hirsutum
  misc_feature (281)..(281): n is a, c, g, or t
  misc_feature (369)..(369): n is a, c, g, or t
  misc_feature (424)..(424): n is a, c, g, or t
  Predicted polypeptide sequence is orthologous to G653
ccttcttcaacaccaatctcctctctctctctctctctctctattttgtttgataaatacccagaaaaccccttcagtcttctagctctcaatttctttttattttttaccttcttatttcatagatccagggtgctcttcttcttagttcacattggcatagataaaggaccgtacggtcagatctaagccgtattctagcgatgtcgtttaccggtactcagcagaaatgcaaggcttgtcagaagaccgtttatcctgtcgaacttttgtcggctgtngggatcccttaccataagtcttgcttcaaatgcagtcattgcaaagggacactaaagttgggtaattactcctcgatgaaggtgtcgnttattgcaagcctcatttcagcaactattcaagagtcgggggaattcaacagatnttcagtcactgccaagtcagctgagagttaactccgagctgcaagatcacctacaagctgcagcatgttttcgggacacaagaaatgcgctactgtgaaaactgttatcactcagaggtacgtggaggcgtcgacacagtatgttcaatgcttatgtgctgccatactcataattgcgactgaagcatgatgaactcc

SEQ ID NO: 15753 - DNA, 848 bp, Gossypium hirsutum
  Predicted polypeptide sequence is orthologous to G653
catagatccaggccttcttcttcttcttcttcttctatcaaagttaatataggcaaatataagagaagaaatcgaattaaagtctatctgtggaactagataaagaacagtacgatttgttttgatccaaagcacattcgagccatgtcgtttattggtacccaacagaaatgcaaggcttgtgagaagactgtttatccagttgaacttttgtctgcagatggagttccttaccataaatcttgctccaagtgcagtcattgcaaagggacactaaagttggctaattactcctcaatggaaggtgttctttactgcaagcctcatttcgagcaactcttcaaggagacgggtaacttcaacaaggatttccaattgtctgcaaaggcagctgagaagttaactcccgagatgacgagatcaccaagcaaagctgccagcatgttttctgggacagtcgaaaaatgtgctacttgtggcaaaactgcatatccacttgagaaggtaacagtagaaggacagtcttacctcaaatcatgtttcaagtgctctcatggtggctgctctttgagtccatcaaattatgcagcacttgaaggcattttgtactgcaaacatcacttttcccagctcttcaaggagaaaggaagctacaatcatcttatcaaatccgcatcaatcaagcgtgccgctgcatccgttcctgaagcttgaatacctatttcatgttcttcgtctattcccatgtttgccggtgcgttttcgtattgatttcttggatttatgctcgggaggggaactggaaagaaagaactcgggtttctctccgtttgtttgaggctttggta

SEQ ID NO: 15754 - DNA, 713 bp, Gossypium hirsutum
  Predicted polypeptide sequence is orthologous to G653
ataattctcattatctatttcttctctaattccttagaacacccttttgactcttttacagggttgtgaactttctctttaatttgatttcatttttttgttaatcttatttcatagatccaatacttccttctttcaaagtattaaacaacaaaatattgaattgaagctctagatctaaagcatatattggagccatgtcttttattggtacccaacaaaaatgcaaggcgtgcgaaaagactgtttacccagtggaacttgtatcagtagatggggttcctttccataaatcttgcttcaaatgcagccattgcaaagggacattaaagtggggtaattattcatcaatggaaggtgttctttattgcaagcctcatttcgagcagctattcaaggaggcgggtaactacaacaagaattttcagtcacctgccaagtcagccgagaagttaactcaactgacaagatcgcctagcaaagcggctggcatgttttccgggacacaagacaaatgtgctacctgtgggaaaactgcttatccactcgagaaggtcacagtggaaggtcaatcttaccacaaatcatgtttcaagtgctctcatggtggttgacctataagccttcaaattttgcagcacttgagggcattttgtattgtaagcatcacttttccaagcttttccaacagaaaggaagttacaacctttgac

SEQ ID NO: 15755 - DNA, 857 bp, Gossypium hirsutum
  Predicted polypeptide sequence is orthologous to G669
cctacccacgcgtccgaaaaatctgggccactaaagaatggagaaaaatttgtcgcttaagagattcgatgtcaacaagggagcatggacagctgaagaagatagaaaattggctgaggttattgcagttcatggtgctaaaaggtggaagacaattccaaccatagcaggtttaaataggtgtggtaaaagttgcaggctgagatggatgaattatcttaggcctaacatcaagagaggaaatatatcagaccaagaagaggacttgatacttaggcttcataaactccttgggaacaggtggtctttgattgcaggaaggttaccaggaagaacagataatgagatcaagaactactggaattctcatttgagcaagaaagtgaaccagaaggagaaacacagtggagcatcagctaggcaaggctgcaaatttgctcaacagagattagtggagaacgccaaagaacaagtgagacaagagaatacatctactggatttgaggagtcgaatataagcttcgatgtggatgacttctttgatttctccaaagtggatacccggaactttgaatgggtgaacaggtttcttgaagttgacgacggttttaagttttaactgaaactttatggatggaaccccaagagctttttgttgtttgtttatcttctatcatcatgattcatgaatttgatgcaatccatgttaatatgtaaaaccttgttatctatccctgaatttggctacatacgtgttttgtgtcggctatatgccctagttgccgacatagtgaaacggtagcacagactcttgttattggtgtcaatcaattagacccaacagttgaaccccgtac

SEQ ID NO: 15756 - DNA, 991 bp, Gossypium hirsutum
  Predicted polypeptide sequence is orthologous to G669
caattataataataagaacaaacccggtactcgacccacgcgtccgctgtgtgtctgtgtaaaaatatggggaggaggccttgctgtgccaaagaagggcttaacaaaggagcatggactgcaaatgaagaccaaatcctcaaaaactacatcaccatccatggtgaaggcaaatggagagaccttcctcaaaaagctgggttgaagagatgtgggaagagttgccggctccggtggctgaattatttgaggccggacattaagagagggaacatctctattgaagaagaagagctcattattagactacacaagctccttggtaacaggtggtctctgattgctggaagattaccggggcgaacagacaatgaaataaagaactattggaacacaaatttgagcaaaaggatggaaggccagaaaaggaatatttctccaaataccccccaagtttcttctcacaatgtgatttggaccaaagcagtgaagtgcaccaaggccgtcaatgttgatactttagaccccaaatccgaaactctagtcaacagtcctagtgagaccccttcttcttcagccatcaatgaggataatactaacaacaattccatggatttcttagtcgatttcgatatcgatgaacttctcgcattcgaatacaacccgatcccggagttgtatcgaactcaaaaccgcggtgacaaaatgggcaataatgtggcggacaacggggagtacagtcatggtaccgagttttgtcaggcatgtgaacacttggatcttcgaggtctagaatcttatttgaatcttgaagatgaatggatcaactaattaataatccaaagttcgcactttgttgtattaagatttgactgttaggtttgttagtgtttgaatcatattgtatcctataaatatccatgagaaatagcaataaaatatgggtccatttttgtaatttcaaaaaaaaaaaaaaaaaaaaaaaaaaaaa

SEQ ID NO: 15757 - DNA, 1133 bp, Gossypium hirsutum
  Predicted polypeptide sequence is orthologous to G669
gaagtctttttaagttgatgcatggggtcatcctccatttttatgggtttataaatagagggagagagagagagagagagagagagagagagagagagagagtttaggagaaaatatgggaagaagtccatgttgctccaaggaaggactcaacaaaggagcttggactgctttagaagataaaatacttgcatcatatattcatgttcatggtgaaggcaaatggagaaacctccccaagagagctggtttgaagagatgtggcaaaagttgcagacttagatggctgaattatcttagaccagatattaaaagaggcaacatctctcatgatgaagaagaactcattataagactccataatcttcttggcaacagatggtctttaatagctggaaggctacccgggcgaacagacaatgaaatcaagaactactggaacactactttaggtaagagagctaaagctcaagcatccattgatgctaaaacgataccaaccgagtctaggctcaatgaaccctcgaaaagttcaactaaaatcgaagtgattcgaactaaagctattaggtgtagcagcaaggtgatggtcccattacaaccacctgcaactcatcaacatggtcaacatcactgtacaaataataatgaagaaatgggtggtggtattgcaacaattgaagctcacaatggaattcaaatgctcgagtcattgtacagtgatggcggctcaaatttgttgagcttcgagatcaatgaactgttgaaatcacacgatggtggagaatttgaggagaatcctatgcagcagcactttccgttgggtgaggcaatgcttaaggattggtctacatgtcattgtcttgatgacaatggtgccactgatttggaatcattggcctttttgcttgacactgatgaatggccatgatacgaatatcagtactgctacagtgaaatataaaggcaatcatttcaccgtatatcttttttccttaagattagaaaaaaaatgcttctttttgcttgttggaaggatgcatgttatgacaaaattactgtaattttgggtgttgaaaaataaataactcatccacgtgtctggttaatgctaaaaaaaaaaaaaaaaaaaa

SEQ ID NO: 15758 - DNA, 1168 bp, Gossypium hirsutum
  Predicted polypeptide sequence is orthologous to G669
cccacgcgtccgaaaaaagaaagaaagaaagaagtgtgaaaaaaaaaaatgggaaggagtccttgttgttctaaggaaggccttaacagaggagcttggactgctcttgaagacaaaattcttaaagattatatcaaagtacacggtgaaggtcgttggagaaatctccccaaaagagctggtcttaagagatgtgggaaaagttgtaggcttcggtggttgaattatttgagacctgatattaaaagaggtaacatatcacctgacgaggaagagcttatcatcaaactccacaaactcttgggaaacagatggtctttgatagctgggaggcttccaggacgaacagacaatgaaataaagaattactggaacaccaacttaagtaaaagagtttccgatcgtcaaaagtcacccgccgctccttcgaaaaaacccgaggcggctcgacgaggaactgctggtaatggcaataccaatggtaatggtagtggtagttcctcgacacacgtggtgcggacaagggcgacaaggtgctccaaggttttcataaaccctcatcaccacacacaaaacagacacccaaagccttcctcaacttgttcaaatcatggggatcaccgggaacctaaaacaatgaatgagttgttattaccgataatgtcagaatccgagaatgaagggacgaccgatcatatatcatcggattttacatttgacttcaacatgggagagttttgtttatcggatcttttgaattccgatttctgcgatgtaaacgagcttaattacagcaatggttttgattcgtcaccctcaccggatcagcctcctatggatttctccgacgaaatgctaaaagagtggacggccgccgcctccactcactgctgtcaccaaagtgcggcttccaatctccagtccttgcctccatttattgaaaatggaattgaatgaccttgaaaaaataaaagacgaaaaatattttctcatgtaaactaaataaacacatcttccatcaataattctgctcttcttcttcttcttcttctttgtgtgtgtggggtttaagtctctcaaaggactgttttgtcgacgaattttccataagatttccacgtgggaatgttggcttgttaaaaaaaaaaaaaaaaaaaaaaaaaaaaaa

SEQ ID NO: 15759 - DNA, 952 bp, Gossypium hirsutum
  misc_feature (414)..(416): n is a, c, g, or t
  misc_feature (615)..(615): n is a, c, g, or t
  misc_feature (704)..(704): n is a, c, g, or t
  misc_feature (809)..(809): n is a, c, g, or t
  misc_feature (903)..(903): n is a, c, g, or t
  misc_feature (910)..(910): n is a, c, g, or t
  misc_feature (912)..(913): n is a, c, g, or t
  Predicted polypeptide sequence is orthologous to G670
agggtttttctcggttttcaattaggtggtctcaaattgctgcacgattaccaggaagaaccgacaatgaaatcaagaacctatggaactcttgtttgaaaaagaaacttaaacagaaaggcatcgaccctgtcactcacaagccactatccgaggtcgaaaatggcgaaggaaatggaagcaacaagccatctttggtgggtcatcatccaattcaccaatatacatcgccgcccccaccaccaccaaagctctcctctaactggttcaaccctgaattttcaccacccatgaccgcctcttacggacccttatactatggaaccaccaccggtggctcagccaataacaccacttggggattggttcaaacacaaactgaagaagaagaagaagaagaagaagaagaaaccnnntggactgagttgcttaatagccctttattaatggcggctgctttacaaaatcaaaccccacaatcttattacaatatcgagatcaaatcagagccttgttacttaactaatagttcatcatcatcatcatcatcaaacgatatgtggtggcctcagacccaacaacagcagttaccactacgacatgaacctttacganatccagacatatgtgggtaagatatgcaaacactcacagcagcagctttttggacataattaaggggttgtgtctggtaacccaatttnttttttttaaaatttttttgccttccggtgttcatggtataatggggtcgtgagtacaaaaaaaaaagtgtgatccaagggttcggtttcctttttggtaccgantttgttgaaccaaaaaacaaccttctggttggtttggttaatttaaaccccttttgggttttcaagttttccaaaattttgggtgggttggtgnttaaaanannagagaagaaggaaaagattttcttggggggccgggccaa

SEQ ID NO: 15760 - DNA, 865 bp, Gossypium hirsutum
  Predicted polypeptide sequence is orthologous to G670
ccacgcgtccggttgaacatggtgaagacaagagtcaaccacgcaccaacagcaaggatatggcttcaagtgaattgaacatcaacaccaacaatcctaaacctggaacatcaccagttactccacgaggttaccaactggaaatggaaggttctcccaccaagacagtgaacagcagcgataacaatggcaacaccaccaccaatttgatggcatctactactacagccagcaaaggcttctttctggataaattctcgaccaacagccagccttctgatttggtggggcatcttccagttcaccaattgaactatgcgtccaatgccaggctctcatctacctccaaccctactccctggttcacccaaactacccaagctttcgatatcaattccgaattttcttcagcagcgatgtccagttttctcccaccattaacggcttcgtttctgtctgcttctatggggtacaagccttccgtcgctgatagtccttcaatggcctcgttcaccgtgaatggttcccgctattgggaaacgggtgcctccgctaacaacaacagtaacagcagcagcaacagcactgagctgcaaagcaatagttccttctacgacaataatagctcctcttggggattaccagattgtagcacaccagagaaagaggctccactccatctaatggaaagtcaagcagaagatataaaatggagcgaatatctgaataacccattgctaatggccgctgctttgcaaaatcaaactccacagtccttgtacaacatggacatcaaatcagaaacacatttcctcactaataactcatcaaacagtatgtggactcataatcaacagcaacagca

SEQ ID NO: 15761 - DNA, 669 bp, Gossypium hirsutum
  Predicted polypeptide sequence is orthologous to G675
ggtaaaagtcataaaatgaccccagaaaccctttaatccttttatacccctgggataccagaaaccccttttggaaccctggaaaaccctgaaaccaaaccctaggggcttatgtgcaaaattagcccacttttgggttaaagtgcaaaaaccaagccaaataagtattttaagtcaattggttcacaaatatgtggacttgaaagccaaaccctaagttttggacttaaatgcaaaatggacctcatttgagttctatactaagtctgaaatttagtgttgaaggctccactttggggctttgtaactttcaaagcatagggtttttgccctaggtcaccacatcaaggttgaagaccaatcataggagaacaactttgtttaagggttcaagccatgatcctatgagaaatttggagaaaaacccaatcaaagtttgactgtcaggctagtttcattctgaaattcagaacttcagtgaaaccgagctagttttggacttggatttaaacatgatccaatgcaagtttgggtatgattcccataacaactttgtagatggcatattgctctacaaatttgctgcatagtgtggatcacgttgccatagaaaatcgggagagaatgaagctccattatgctctgtcagtccgctctgaatggggtgtt

SEQ ID NO: 15762 - DNA, 976 bp, Gossypium hirsutum
  Predicted polypeptide sequence is orthologous to G715, G1646
cccatccatatctgacccttaaaaatatccaccgccgccaccaccacgacgatcaccaccgccacatcccaatctcccgccatttgttcaccagccaatggacagtaacctgcaaactcaatccaccccatacccacctcagcctcccacatccgccattacccctccttcatccgccacagcaacagcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactgctttggctccgatggtcggtgctaccgccagtggggtaccttacttttatccccctatgggtcaacctgctggtggtggtcctggtgggatgatgattggccggcctgccgtcgatcccaccggagttatttacggtcagccaccttctcaggcttggcagagtgtttggcagacggcggggactgatgatggctcgtatggcagtggagttaccggtggtcaagggaatcttgacggtcaaggctaacctaaaatcatgggtccgatatcgtacagtggatggtgtggaaaacgcgtggaactcagtgatctactggggaatttatgcttttgtgcttattgatttatgaatgcagttgtgttggtattgtttatgggaaaaaagaaaagctaccttgaatttgatgacacttctatagtaact

SEQ ID NO: 15763 - DNA, 977 bp, Gossypium hirsutum
  Predicted polypeptide sequence is orthologous to G715, G1646
ctttgatcaagttcatccatctgccgttgattcttcatccaatggacggcaacaagcaagcccagtcctcctcttaccctcctcagcctcccactacttctattacgccttctcctccttcctcctccgccgccatcgccgccactccgcctgctcctttccaccacctcctccagcagcagcagcaacagctccaaatgttctggtcttaccagcgccaagaaatcgagctagtcaacgacttcaagaaccatcagcttcctcttgctcgcatcaagaagatcatgaaagccgacgaagatgtccgtatgatctccgctgaagcccctattctcttcgccaaagcctgcgagcttttcattctggagcttaccatccgttcctggcttcacgccgaggagaacaagcgacggacgcttcagaaaaacgacatcgcggcggctattactaggaccgacattttcgatttcttggtggatattgtgcccagggacgagatcaaggatgaggccggtctgggtgggatggtgggtcccaccgccagtggggtgccatatttttatcctcccatgagtcagcctgctggcgctcctgctggacctggcgggatgatgattggaaggcccgccgtcgatacaaccggtggtatttatgctcagcctccttctcaggcttggcagagtgtttggcagacggcgggggctgacgatgggtcgtatgccagtggaggtagcggcggtcaggggaatcttgacggacaagctaagcaattcattggtccaatttgggtgctcgatggcatggcaaatggcgtgatgcactggggtattgcactaggaattttggttgcttatgatttatgaatatggacctgtctgccattgtttgtggaaaactaccttttaaatgtgatttatttagaaacatctcaaagacacttaactcatttgatgtgcagcaaaacaaatagcttttgc

SEQ ID NO: 15764 - DNA, 473 bp, Gossypium hirsutum
  Predicted polypeptide sequence is orthologous to G718
cagagccaacagaagccacgagtgtcaaggaagtactggttgtctcaatccctgaaacttctttcttattgcttatatcatctgggatagcttcagaagcctccaaagtaaatttggtcaattttgcctcccccatagataaagaatcaatggatgccgatttcaaatttttagacaaagacacaaggcctaaatccgagccagaaccaccactacaaccagcaacactggaagaattgacagacacagagtccaatcctccttccccttcatcaatatcccactctacgggtcttagccttctcgggatttcagttgcttttgcgtttaacattaggttttcccagtcccattgcaacggggtctgttcgttccactccatcagagagataaaactcatagaacacttcacacaatcatcattgtataaactggaaaatttagtccccaaaaaaaaaaaaaaaaaaaaaaag

SEQ ID NO: 15765 - DNA, 745 bp, Gossypium hirsutum
  Predicted polypeptide sequence is orthologous to G728
cccctttgcagctagggtttcgagacccatcctcgctgccgtcgcccttgctccaccacggacggtggtaaaaaccgtataggatgggctttttcagccccgtttcgaagcgactcgagagccacttcctttttagcccaaaaacgaaggagaagaagatcctttttgttcccttttttgaagtcgacgccgtgaatggagatgaggctccgacagtgcgactccggggcgatccaggtgagtgttttcttcttattgttatttaaaacagattttgcaaacaaaaaaataaaaaaaataatgaagaagcaagaaatcgaaaaaagagaaggaaaaaaaaaggaaatcaaatcaacctttacttttttgcttctattctgcttttgcgattgtttaatgtctgtaaaaaatacaaaaaagatcgagaatggcttttatagacgagtacacactcgttctatttctattttctgtttgtttcttccttgtttttttgcttttagtttcctgcttcttttttgttttttccttctttgttttttcttgtgttttgcgtgctttgatctgtttgcaggtggtgtcagacgcgcgtgccgcggtggtggcgtgaggtggccaatggtgaagaggctggtgccgtgcgaggtggccaatggtaaagaggctggtggctgaagggacggcggctgcaacttggggctaggggtttttttatttgctgaaaatgtttaagatagtttgggct

SEQ ID NO: 15766 - DNA, 900 bp, Gossypium hirsutum
  Predicted polypeptide sequence is orthologous to G728
cttttctctcagcttcaacagataccataaaggaatcagaaggaaaaataaaccataggaagcaaaagggtaggcttgtgagaggaaaacccagaaggataagaaatgggttcggttcccccagaactgagcttggattttagacccacttttgtacccaaaacgatcagtacttttctcaaggaggtttcactaatcggcaacgttcctgataaggtttcaaaactcgatgcttttgttaaaagattggaagaagaaatgagaaagatcgatgcttttaaacgtgaacttcctctttgcatgctccttctcaacgatgccattgtagctttaaaagaggagtcagtgcaatgtatgtcaagaaatgttgaaccagttttagaagagttcattccattgaagaacaagaaggagaataatcaaagtgaagaagatggtgccttaatcaccaacaaaaaagaaaaagattctaacaacaacaactgcaataataataaggacaagaaaaattggatgagttctgttcagctttggaacactgatgatgattatagttccattagtcacaaactagattctaagagaaaggacggagattcatctcaaggatgtaaaaacaggggaacagcaacagcctttacgccattcaagatgaatttgggttttgcagtgaggaaagaagagaaagaggagataccggttcatggattaacgcttttgactcctggaatcaagaatctgaaagaggaatcatgttctacggggtctaggacaagttgtagcagagcagtttcttcttctgcccccaatgctcagtccacttttcgctctgtaccacagccgctgtcccatcaccagcagcagcagcaacaacaacaacaacagactgctaggaagcaa

SEQ ID NO: 15767 - DNA, 870 bp, Gossypium hirsutum
  Predicted polypeptide sequence is orthologous to G732
gcggccgcgtcgaccgcaggacccatctcgttcaatctttctcagttgtcttcctctactggttctatgttttttcataaatgacatgcttattttttttactatatatatatatataattatctgttgctagtataggtgtccagtcgcctttgaggttagattatcctgaaatattagtaatttatatttgaagttttagcagtgagtttggtgtaaaaatattaacatggcctcgtccagtggaaactccaattcctcaagctcctcgcagcttcagaactctgggtctgaagaggacctgcaccagcagaacatgatggaccaaagaaaaagaaagagaaaggaatcaaacagggaatcggcaagaagatccaggatgaggaaacagcagcacttggatgaattagtggcccaagtggctcagctcagcaaagataacaaccaaatcctgaacagcatcaacttcaccacccaccactatctcaacattcaggctgagaactcagttctgagggctcagatgatggaactgagtcaaagactcgactatctgaatcaaatcctcagttatctcaacaccatgagcgccagtgagttggtgtacgaaactgatcagtgctttgaaacaagtacttgtgaccacggtttcaccaaccctttcaatctaccttaccttaaccaacccatcatggcctctccagacatgttccagtactactgatccataataatcctcaccatcatcatccctcatttactgataaaacgagggtattaatattattgttatggttaattaatttaatgaaatattagtgttattggcagctataggtctaggaagatgatgtaaagggatgatgattg

SEQ ID NO: 15768 - DNA, 692 bp, Gossypium hirsutum
  Predicted polypeptide sequence is orthologous to G732
cccccttatagagtttagtcaatttctgctctcttcctgtttttcattttcccttgtagagctaacgttctgctggtttcggttcactaattttttcagctgtgtttctttcaaatcgttttgatatgtttttcaaatcgttttgagattcatgtctccagttgtgagtgaaatcctccgatcggggtttatgataaattcctcactcagacgcaggacccatcttgttcaatctttctcagttgtcttcctccactggttctatgtttttcataaataaattctctgtaattgcttgactttcatttcctttacataataaacccaatatataagaaaacgttgcattagctacacgtagttagtatctgggtcctgtcgtcgtctttctatcagtgattttagtgtacatacatcaacatggcatcgtccagtgggaattccaattcttcaggttcgactctgcttcagatttcaggctccgaagaggatctgcatcagttgatggaagaaaggaaaagaaagaggatggaatcaaacagggaatcagcaagaagatccaggatgagaaaacagaagtatctggatgatttaatggctcaactcacactcctaaggaaagataataatcaaatcttaacaagcatcaatttcatcacccatcattacttcaacattgaagctgagaactc

SEQ ID NO: 15769 - DNA, 858 bp, Gossypium hirsutum
  Predicted polypeptide sequence is orthologous to G735
gcggccgcgtcgaccaaacacataatggatagagttttctccgtcgaagaaatctccgaccacttctggccgtcctcctcctcctccgccaccaccaactccgcttccgctgatgacgataacaagtccggttctaaaatgaaccgtagtgcttccgaatgggcttttcagcagtttattagagaggaagttgataaggaaggtgaagatgaaggagtgactgagggggatctaaagaagaagaatgggacgccgtcgtttaacaatgggtgtttagagagtaatggtaataacaatgttctggtagattcagatgaataccaagcttttcttaagaacaagcttaacttggcttgtgctgctgttgccatgtcaagggcatcttttgtaaaaccgcaagattcggctgttagagctgacagcggatcacaggcatccgatactccccaatcgggatccatagctacttctaaaggggctggtgataaggacggtaatgcacagtcgggatttccttcagtggttaatggacaaaagaagattggagctcaggtgaggccaagcacaagtggatcatcaagagagatgtcggaagatgatgaagtagaaggagagaacgaaacaatggagaacatggatccagctgatgcaaaacgtgtaaggaggatgctttccaatagagagtccgctaggcgctctagaagaagaaagcaggctcatttgacggaactcgagacacaggtttctcaactaagagtcgaaaatgcaaccttattgaagcgtcttactgacattagccaaaagtacaatgaatcagcggtcgacaatagagttctgaaagctgatgttgaaacattg

SEQ ID NO: 15770 - DNA, 550 bp, Gossypium hirsutum
  Predicted polypeptide sequence is orthologous to G736, G2432
ttttttttttaatgaaagaaaaataaataataaataaataaataaatatacccaccatataattaatagtaacgtcagaagactaattaatcaaaaaccatcctgtatttacatgatctgtaattcaaacaatttttttttaatattgttgaaacttctgccacaaaaaagagaaaacgggagagagaacagataagaattactaggagtgaaaatcagtaaggttgaagttgagcagctgagcagcttattcgcctccgcttcattggaaaaacttgctggaaacctccaccattggtggcggcaatatgccactcggtccaacaccatcccttccacctcaaactgttgcaccgcactagacccatcatataaacacccttcttggaacccaccaagaccaagaccaggacccggtggttggctttccggcggccagccccaacggggacgttccgtaggctccacctgctgtccagtacctttggcaacctttgcagaaatgtctaggctggttaacgttgtagttattgaagtaacaaaatttggt

SEQ ID NO: 15771 - DNA, 864 bp, Gossypium hirsutum
  Predicted polypeptide sequence is orthologous to G740
tgtaaccgtaagtgaggaggactgagagagtcgaagagggaaacgtagaattcggacattgggcttcttttcctcatataaattcccccacttctttcttttaccatcaaaaccctaataacaactccaaagtttcttcctttaacgtcccaactttatcgctaatggctgaacaacaacaagatcaactgcaacacagatccgccggaaaggttctctggttcaatgaccaaaaaggctttggatttattcgaactggcgatggaggcgaggatctcttcgtccatcattcttcaatcaaatccataggctatcgtagccttgctgagggcgaatccgttgagttcactatctcccaaggcaacggtggcaagactcaggctgttgatgtcatcgccgtaggtggctctgccatcagtaagaaggacagtcgcagtggtggcggttggagaggcggaaacgatcggaggaatggcaccggcggttgctataactgcggggatttgaatcatcttgccagagattgtagtaacaacgttaacgatgattacaatcattcccctagaggcaatggcggtggctcttcttgttataaatgcggcgagccagggcattttgcgagggagtgtaggagagatagcggcggcgctgccggtggtggaagtgggaagtgttacaactgtggaaaatttgggcactttgctagagactgtaacagaaacagtgggggatgctgttttacgtgtggagggtttgggcatttggcgagggattgtaacagcaacaggggaacggaatgttttaaatgcggtgaggcagggcattatgcgagggagtgtccaaacctgaaggctttgtcttaat

SEQ ID NO: 15772 - DNA, 753 bp, Gossypium hirsutum
  Predicted polypeptide sequence is orthologous to G740
ctcactttctctcccatcactatcgccactaccttccatggctgagcaactgcaggaacatcagcaatcaagatccaccggcaaggtcctttggttcgatgaccaaaagggtttcggctttattcatcccgacgatggtggcgaagatctcttcgttcatcaatcttccatcaaatccgaaggctatcgtagcctcgctgagggtgaatctgttgagttcactgtttcccaaggcaacggaggcaagacccaggctgttgatgtcaccgcaattggtggctcacaaatcagcaagaaggaccgtcgcactggcggcggcggttggagggctggaaacgatcggaggaacggaagcggcggttgttataactgcggggatctgaatcatctcgccagggattgcagtaacaaccttatctctttagacaacaatgataactataacaactctgcttacaacagtggtggtggcggttcttgttataattgcggtgaggcggggcattttgcaagagagtgtaggagagatgccggcggatctgctgctggtggggctgggaagtgctacaactgtgggaaatttgggcattttgccagagagtgcaatagaaacagtggcgctggcggtggaggcagaggctgctttaattgtggagggtttgggcatttggcgagggattgtagcaataacaaaggatcagaatgttataaatgtggcgaggcagggcattttgcgagggagtgccctaactt

SEQ ID NO: 15773 - DNA, 521 bp, Gossypium hirsutum
  Predicted polypeptide sequence is orthologous to G740
tctctgctatggccgcggcctacgatctgcccgtggtccctcacgcgagtggtccttacagttaccactttgtcgtctcacaagccaactcgcccttccaggaatacctcgcaaactctcccgatggccgcagtgtgctcccggtgtttggcaacttgttcagcaacgagccaatcccaaccaagggctaccttgacatcagcgagctggacaagcctggcttcgggttggagctgaacccagctgcgccgctcattgacgcggcaggcgtcctcaacccagcacccatgaagtcgttggcaccgcctcctcaggaacaagagaaggatcatgccgtgaatggggatgtgtcggcacagtaaaaacgggatcgtccaacgcgaggcagccgcaacgaccctgttacacccatcgagcgcgttcgcgtgatcgtacgtacctacacacagcacagcatttagcgaattgaattgtcagtttaatgaactcgtccaaggctaaaaaaaaaaaaaaaaaaaaaa

SEQ ID NO: 15774 - DNA, 606 bp, Gossypium hirsutum
  misc_feature (584)..(584): n is a, c, g, or t
  Predicted polypeptide sequence is orthologous to G760
caagtatccatttatgaaacgggctagtcacatgttgggtagcctccctgctcctcctgcatttgcctcagagttccctccaaaagacgctgcgatcaagctaaattcggcgtcacatgcttccagttctgttcatgttatggctggcatgataagaataacagacacaacttcttctggcaaccggttggactggtcatatggcaaaaatgggaatctcaacattgttctttcttttagcttgccacaaggtgatataaactcttccagttttctgccgatggctagcctactaaccggcaagacggggcctgttttggcaagagggtggttcttcttgatgttattttcggtcctaattatttctgcgagtgtaaagattgggacctgcttttgcacaaggtatgggctatgattcactccacacatgaactgattacaaatgttgggtaatatattagttaccactataggttgactaggatggtagaccaggcaatgtttcatcatttattttgttcctttttctttcttttctttttttatgatgattgccgaaacagaaatcataagctatatagatntatcttctcattacagtccttc

SEQ ID NO: 15775 - DNA, 892 bp, Gossypium hirsutum
  Predicted polypeptide sequence is orthologous to G772, G776
tttgtaaacgaaggaacctggtttcttcatcatcaatcaaaaatactcgatatatgtttcttcaattcatttcctttcatttcgtatcgcccacgaaaacacactgttttttgtattttccgtttccccaaacaactatctctctatgggtcgtgaaacttctttagttgcagatccaggaccgaccgcggtggcgacggcgacggcgacggcggcaaagactggcagttcagcgacggccttagcacctgggtttcgattccatccaactgatgaagaattggttagctattatttgaaaagaaaagttacgaacaagcctgccaggtttgatgctattgccgaagttgatatttacaagcatgaaccttggaacctttcagacaagtcaaaattgaaaaccagagaccaggaatggtatttctttagtttattggacaagaagtatggcaatggggggagaatgaatagggctacaggccaagggtattggaaggccacggggaaggaccgagaggtccgtcataattcgcagcttattggaatgaagaagacattagtctttcatagcgggaaagctcctgatggattgcgaaccaattgggttatgcatgagtaccggctcattgaagaggaattggaaaggattggagcattgcagggctacgtgctatgtagagtaattcataagaataatattggaccaccaaatggaaaccggtatgcacctttcattgaggcggagtgggatgatggttcagccgctttggttccaggattagacactgaggatgatgttgcagctggtaatgattcgatagccacaaatgatgtggcagctaccgagaatgcagcaactgaaagcaatggcgtcctaaatgatcagttctga

SEQ ID NO: 15776 - DNA, 797 bp, Gossypium hirsutum
  Predicted polypeptide sequence is orthologous to G772, G776
caaatttatcattttactcgtctctgctaaaccccaaaatgttgttttgaaatttcttgccatcgaagctatagtgacagcaccatctgcggcggcggagacgggaggttcagcgacggccttagcacctgggtttcgattccacccaacagatgaagagttggttagctattacttgaaaagaaaagttacaaacaagcctgtcagatttaacgctattgcagaagttgatatttacaagcacgagccttgggacctttcagacaagtcaagattgaaaaccagagaccaggagtggtatttttttagtttattggacaagaagtatgggaatggaggaagaatgaatagggccacaaaccaagggtattggaaggccacggggaaggaccgagaggtccgccacaatgatcagcttatggggatgaaaaagacactagtattccataatgggagagctccagatgggttgcgaaccaattgggttatgcacgagtatcgacttgttgaagaagaattagaaagaattgggacattgcaggggtatgtgctatgtagagtatttcataagaataacattggaccacccaatggaaaccgatatgcccctttcattgaggcagaatgggatgatggttcagcagctttagttccaggaatagatattggggatgatggtgtagcttctgagaaggcactggttgaaagcaatggtgttcaaagaagtggttttgagcaggagattcaaaatgcagatgaggaagctccagctaatgataaagttcggagggagttac

SEQ ID NO: 15777 - DNA, 857 bp, Gossypium hirsutum
  Predicted polypeptide sequence is orthologous to G773, G1412
gcggccccgtcgacttttaaactgaaactagatcttatatttgatacaattttaattatgctaaaaacacagagcaaaatttcaaattttggccatctttttaaactcttttggtttctataattccaaaaggttagcccaaaagaattcaaaatatttacacaatttctgaaattcctttcctggtccttctacctatactttctttttattgtctaaacccaaatccacccgattgagtcgggcaccgaaacccatacgggtcaatcgagttagagaagttgtgactgttcaacacattcgagttttgttgaaatatccccgagttatcagctcgctgagttctgagtccactctgtacttcctcttccaccgagttaccaatcttatttgtcgacacgtccatctgacaaagtgtaggcggcattgtgctgacatatacgttactatttccataactagtaatcccctgactctgagtttgagtttgagtttgtccactcggtaccagctcaggcaccgagctaagcccaccaagactcccccaatccaaattcccgatacccagactttgaaaccccagtttcacatcgttttggagcgttttgaacgagttaacgcgtggcaaagcaaagaaacgatcgtccaactcgggcaatgactcaagcatgtcatccagttgtgaagaagacgatgatgatgacccattcgtgctttgctctctgcttgaaacacttgacaaaggtttttgaccacttgaattcttcttgtatattcgacacaaaacccaatcatccaacttggagctaccacttttacgagaagtttcaatgagtcgatattcatgcataatccaa

SEQ ID NO: 15778 - DNA, 458 bp, Gossypium hirsutum
  Predicted polypeptide sequence is orthologous to G778
gaacttcatgggccgaccaaacatcattggtatctcacctgttttgtctaatcctttcatgacaatgaatacaccttgggatggttctaacaacaatgatcggttacaacaagctgcttcaatgacagaccctttatctacattccttgcttgtcaatcacaaccgatgactatggatgcttatagtagaatggccgctatgtatcaacaaatgcaacaaccgccagcttctagttcaaagagttaagctttcaatgtgcctttatttatacacaaaaagaaaaagaaaaaaacaacaacatgaactcggattataattctttagtttcaagtggttggttatatgttctttattttattttattacaaagctttgttttgtttgcaaattattgtctttgaatttgtaatattattaaatggttctcccatgagctaaaaaaaaaaaaaaaaaaaaa

SEQ ID NO: 15779 - DNA, 896 bp, Gossypium hirsutum
  Predicted polypeptide sequence is orthologous to G791
aattttctctcttgccaaacagaaactccattttctttgccaaaagccggaaatcaaaccaaacccttccaactttccggctaaaagcaagttcagtggagaatggtatcacctgaaaacgccaattattggtctagcttcgattatgcaaccttgatcaacgatatccctgcccctgacggaacttattccggattttcttggcccactcagccaatcaatgcctcttctaatgttttcagtgtggacattgacggctcgtttgaggattcagatggccttaaggaatctggttcaaagaagagggttagatccgaatcttgcaatgtttcaagctccaaagcatgcagggagaagttgcgtagggataggctaaatgagaagtttatggagctgacttctattttggaacctgaaaggcctccaaagacagacaaggctgctattttggttgatgctgtccgaatggtaacccagttacaaggtgaagcccagaaattgaaggattcaaattcaagtctccatgacaggattaaagaattgaaggctgaaaagaatgaacttcgtgacgaaaagcaaaggctgaaggcagagaaggaaaagctggagcaacagctgaaggccataaatgcacaacctagcttcatgcctcctgcacctgcattccctactgcatttgctactgcccaaggtcaagttccaggaaacaagttggttcctttctttggttatcctggagttgccatgtggcagtttatgccgcctgcatcggtagacacctcagaggatcatgtactccgccctccggttgcctaagccggcaacctacaatgatttgcgtttgcattttgatacaaagaagcgtatgcatttggtcattattctcagatgttcta

SEQ ID NO: 15780 - DNA, 862 bp, Gossypium hirsutum
  Predicted polypeptide sequence is orthologous to G791
ccaaatccaaagaaaatattccccacctttcctcaccatcacattcttccctcacagattcccccaaatcaaccaaattcactcgttccatatctccaatctatctctctgttctcttttgttttgttttcttcactttctgcatcaaacatcttccgctgtctggcataactgaatcctcgccgggaaaaatgatatcccggcggcaaccgggtgcggaggacctggtctcctctgacaatcccaatgcttggatttttgatgattatggtttgttagaagacattcctgtccctggtggtgatcttccctcacttgacccttcagccccaatctggtcatctccctcccttacttgctctgctcctctcagtgttgaattcactgaatcgtttgggaattcagacagtcttaatgaaacaggctcccgaaaaaggatgaggtctggatcatccagtgcatctgggtccaaagcttgcagagaaaagatgcgaagggataagctaaatgacaggttcctagaattgggttctattctagagcctggaaggtcttccaaagtggacaaggctgtaatattagttgacgctgctcggatggttactcaattacgggatgaggcccagaaactgagggagtcaaatgagagtctgcaggagaagattaatgagcttaaggctgaaaagaacgaacttcgtgatgagaagcagaggctaaagaccgagaaagataatctcgagcggcaagtaaaggcattaggttctcaaccaggattcgtacctcaggctcctgctattcctactccattttctaccccaagccaagttgttggtgggaaactggtgcctttcgttggctatcc

SEQ ID NO: 15781 - DNA, 938 bp, Gossypium hirsutum
  Predicted polypeptide sequence is orthologous to G791
ccaagatcaaagttggcggagaatggtgttccctgaaaactccaattattggtctcacttcgattatgctaccttgatcgacgatatccctgtccctgatgatccttatgccggttttgcttggtctacgcagccaatcgacgccccttctaatgttgtcagtgtggaaattgatggctcatttggagattcagacggtctcaaggaatctggttcaaagaagagggttagatccgaatcatgcaatgcatctagctccaaagcatgtagggagaaattgcgtagagataggctaaatgacaagtttatggagttgggttctattttggaacctggaaggcctcccaaaactgataagtctgctattttgattgatgctgtccgaatggtgacccagttacgaggtgaagcccagaaattgaaggattcaaatactagtctacaggaaaggattaaagagttgaagtctgaaaagaatgagcttcgtgacgaaaagcaaaggctgaaggcagagaaagaaaggctggagcagcaactcaaagcaatgaatgcacaacctagcttcatgccgcccgcaccaccagcaatccctgctgcatttgctgcggctccgggtcaagctcctgggaacaagttggtacctctcattggctatcctggagttgcaatgtggcagttcatgccgcctgcagcagtggatacttcacaggaccatgtcctccgccctccggttgcctaagttggcaaccaacaatgattggggttgcattttgatgcaatcaagggtataagttaatgttctgggctgtttagatttcactgaagtttttctaactggctttgttgggtgactgtcattgtactcctacgatttggtgctggtaatcacatgtaaatttctaataagttaatctggcaacctttgtttctctgtgttc

SEQ ID NO: 15782 - DNA, 380 bp, Gossypium hirsutum
  Predicted polypeptide sequence is orthologous to G791
agctgaatgcatgaatcacaaccagcttctgctcctgcactgcatccctgctgatttgtactgccaaagtcagtccaggaaacaagttggttcctttctttggttatcctggagttgccatgtggcagtttatgcctgctgcgtcgttagacacctcagaggatcatgtactccgccctccggttgcctaaggtggcaacctacaatgatttgggtttgcattttgatacaaagaagtgtatgcagttggtcattattctcagatgttctagttttaactgaagaaactaactggatttattgggtgactcaattgtaatgtaatgatttgaagctggtaaatcacttgtaaatttttagtaaaaaaaaaaaaaaaaaaa

SEQ ID NO: 15783 - DNA, 965 bp, Gossypium hirsutum
  Predicted polypeptide sequence is orthologous to G801
gttgtgtccattaatcttctccagcaattaccccataacagctagacaaagcttttatagtctttgaagcgaaaactaaagctaaactacataaagggtaagagtgtggtagtcctgctcctgcccccacgatgtccaattcagagactgctgctactaacggatcgttaatggacccacagagacatcaggcgccggcagccaatggttcacttgccgttaaaaagcctcccaccaaagaccgtcacagcaaagttgatggtcgtgggagaaggatcaggatgcccatcatttgcgccgctcgtgttttccagttgacccgcgaattgggtcataagtccgatggtcagactatcgagtggctgttgcgtcaggctgagccttctattatagccgccactggtacagggacgactcctgctagtttttccaccgtgtcggtttccctccgcggagctaattctacttctttgtcgtcgaccacttcttcgtctttggatcataagcctcttttgggtcctaccccgtttatactggggaaacgcgtccggtccgacgacgataacgccggaaaggacgatttcggagggctcactgttggaccaggcgtgggttccattgtgggaccgaacgggacacatccgggtgggttctgggctcttccagcaaggccagactttggtcaattgtggagcttcgcggccccgcctccgccggatatggtagtacaggcggctgctcagcaacccgctgctgctgctgcgttgttcgttcaacaacagcaagcgatgggagaagcgtcggcggctagggtcggcaattatcttcctggtcacctaaacttgttagcctcgttgtcagtgctccgggaggatcgggtcgaagagacgaggatccgcattaaaatttggtggaccattttacccttcctgttgttgggagtatatatagattctataaatatt

SEQ ID NO: 15784 - DNA, 895 bp, Gossypium hirsutum
  Predicted polypeptide sequence is orthologous to G801
agtttcagtccacaactgaactagaagggctatacaaacaaacaaattctgggtaagagtgtgctactcctgctcccaccatgtctaattcggagggtggtgccaccaacggagctataatggaccctcagagacagcaagccacggttaatggttcccttgccataacaaaacctccttctaaagaccgtcacagcaaagtcgacggtcgtggccgaagaatcaggatgcctatcatttgtgccgctcgtgttttccagttgactcgtgagttgggtcacaaatccgatggtcagacaatcgagtggctcttacgccaggctgaaccttccatcattgccgccactggcaccgggaccactcccgccagcttctccaccatgtctgtttccgtccgtggcggagccaattctacttctctatcgtccaccactgcttctccgtctttggatcataagcctttgttgggtcccaccccatttatactcgggaaacgtgtcaggcccgacgatgataaccccggaaagtatgataccggaggagtcatggtaggaccaggagttgtggggcccgctggtggattctgggctcttccaggcagggcagactttggtcaattgtggagtttcccgcccccagcggagatggcggctcatcaacctgctgctgcgttgttcgttcagcaacagcaagcgatgggagaagcgtcggcggctagagttggtaattatcttcctggtcatctgaacttgttagcctcgttgtcgggtgctccaggaagttcgggtcggagaggcgaggatcctcgttgaatttggctggacaagtttacccctgttatcgggagtatatatatagcttggttttgatgtgtgtgatgtggaagagggttttt

SEQ ID NO: 15785 - DNA, 976 bp, Gossypium hirsutum
  Predicted polypeptide sequence is orthologous to G801
cagccaatcttttcagcttaaccccccccccaaaaaaaaaagaaaaagaaaaaaactaagtgagaacattttcagtgagcctagttgaaattgtatacagttttggggttttgtttggtgccgcatgtcaaattcagaggctgctgctaaaaacggagcaacaatggatacccagagacaacaagcgccggggaacggtgcccttgccgtcaagaaacctccctccaaagaccgtcacagtaaagtagacggtcgtggacggaggataaggatgcccatcatttgcgccgctcgtgttttccagttgactcgcgagttgggtcataagtccgacggtcagaccatcgagtggctgttacgccaggccgagccttccatcatagccgctacaggtacggggacgactccagccagcttctccacagtgtcagtttccgtccgcggcggagccaattccacttctttgccgtcaacgacttcttcgtcgttggattataagcctttgttgggttccaccccttttttactcggaaaacgtgtccggcccgacgacgataacgccgggaaggacgattccagaggggccacggtgggaccgggcgtggggtctatcgtggggcccgctggaacggacacgggtgcgttctgggctgttccagctaggcctgactttggtcaaatatggagcttcgcgcccccgcctcctcccgagatggtggtacaaacagcggctcagcaaccagctgcagctgcgtttttcgttcagcaacagcaagcgatgggtgaagcgtcggcggcgagggttggcaattatcttcccggtcatctgaatttgttagcctccttgtcgggtgctccgggaggttcgggtcaaagagacgatgaccctcgttgaatttgggtggactgttttacccttgttgttgggagtatatatatttatatgaatacatagattctataaatatttgtgtat

SEQ ID NO: 15786 - DNA, 866 bp, Gossypium hirsutum
  Predicted polypeptide sequence is orthologous to G802
ccctcacgcgtccgcttttgatggcaccaccaccacatcttcagctccttcttctactagcaacaacaacaatagcccttttaatataacctccatatctcaccttcaccgccgtcttcttcatcctactacttcttcaacagccaccgttataaccactgcaacgccgcctctttcttcttcttcttcttcctcctcttccactactaagactaaccctgctcagccggttgatgcttcactagctattgctaccagatctagcgcttcccttaacatcgatgattctacaaagaagaatcaacccaacttgccaccgtcgtcgaacccaccggcgaaacggtccactaaagaccgtcacacgaaggtggatggtcggggacggcgtataagaatgcctgcagcttgtgcagctagggtttttcagttgactagagagttgggtcataaatctgatggtgaaacgattgaatggcttttacagcaggctgagccggcgatcattgcagccaccggaactggtactataccggccaatttttcgactcttaacgtttcgttgagaagtagtgggtctacgctttcagctccaccgtcgaaatctgctcctcactcgttccatggtgctttagctttggcttctcatcatcacccatatgaagaagggtttgctcatagcgctttgttcggtttccaccatcaacagcaacagctgttaagggcaggtcaaatagctgaaactttacctgcaggtggcagtggtagcggtggtggtgggaattcaagtgagaactatatgaggaagcgttttagggaggacttgttcaaggatgataaccaacaacaaggagaaaccggtgacggcg

SEQ ID NO: 15787 - DNA, 861 bp, Gossypium hirsutum
  Predicted polypeptide sequence is orthologous to G802
ccctacgcgtccgtgatcagcaacaaggtgaaagtggtagtcgtggcggcgatggatcccctattaaggctttcaaaagtggtttaactcaattgtctaaaccacaacaagatgctggatcttcggctctacctcgaccctcaaatatcctgcccggcacagccatgtgggcagtggcaccagcaccaagcagtggggcgggaagtacgttttggatgctgccaatgagtgctggtgctggtggcccatcagtggcgccttcagctgcaactggggctggtccatctgatcaccctcagatgtggccttttgggacagcaaatcaagctagtggaaatacactgcaagcgcctttacattttctaccaagattcaatcttccaggtaatgttgaattccaaggtggtagagctagtcctttgcaattgggttcaatgttaatgcagcagcaacaccaacaacaacagcctcatcatcaccttggtttaggaatgtctgattctaatttaggcatgttggcggctcttaatgcgtattctagaggtggctcaaacgttaactcagaccaaaacaatccactggaacatcatcaccaacaacaccagcctcaaggtacagacagtggagatgaccaagaccctaatacttctcaatgatgctcagagaattaaatatacagaacttggttagtaggctttttaattccctattgagtgcctgccttccatttatttctttttttcccttgagaaattgaatgcgttccagcatataaacagcaactggaaactagagagtgttgggtttgttttgtgcagatatggaacatcaagtttgtgatcatcagctgattacttgaaa

SEQ ID NO: 15788 - DNA, 940 bp, Gossypium hirsutum
  Predicted polypeptide sequence is orthologous to G802
ccccaccaaatggaacttacagatttgcaaagcaataagcaaaccaaaaacaacagcagcagcagcaacaataacaacaacaattctgcagaaccccaccatcagtctctccagcagcaccatctgcaacaccaaaaacagtcggcttctccccagcttgtggtcccttttgatggcaccagatcttcaggtccttcttcgggcaacccttttaatatgggctccatttctcacctccatccccaccacccttttcatcatcttcttcttcatcctgcttcttccacaactaccaccaccacaacaccgcctctcccgtcttcatcttcttcttcttcctcctcttcttcagcttctacgactacaacgaacccacctcaactcgttgacgcctctctcgctattgctaccagatctacttctctcaacatcgattccaagaatcaaaccgacttgccaatttcatctacgacgacaccagcatcgacgacgacgacgacgactacagctaacccgccagtgaaacgctccaccaaggaccgacacaccaaagtcgatggtcgaggccgccgtatcagaatgccagctacttgtgcggctagggttttccaattgactagagaattaggtcataaatctgatggggaaaccatcgaatggcttttacaacaagctgaaccagcaataatagcagccactggaactggtactataccagccaatttttcgactcttaatatttctttaagaagtagtggatccacgctttctgctccgccttcaaaatctgctccacactcgttccatggtgctttagctttggcttcccatcatcatcaccatcacccttatgaagaaggtttgctcatagcgctttgttggggtttcagcagcagcatcttttaacggcagatcaaatagctgaagctttacccggagt

SEQ ID NO: 15789 - DNA, 993 bp, Gossypium hirsutum
  Predicted polypeptide sequence is orthologous to G805
gggaattccaagctacacaacacaacatcatatagcaaaaatgaaggagacccactaggccatcaaagtcactgaattgagggtcaccttcagatcatgtactaggagagccaaaccaccaaaaagatataatcccactctctcatacatgatcatggatgaaaatgggatccgcaggccgaactttcctcttcagctcctagaaaagaaggaacaacctcgttccgaccctgccgacgtcgacaccagctccaaaccaaccttggaacctccctccaagaaacctccacctaagaggacttcgaccaaggaccggcacaccaaagtggaaggccgaggccgtcgcatccgcatgccggctacgtgtgctgctagggttttccagctaacaagggagcttggtcacaaatcagatggtgaaaccattgagtggttgctccaacaagctgagcctgcggtttttgctgccacggggacaggtactatccctgcaaatttcacgtcccttaatatttcactaagaagttcaggttctagcatgtcggcttcatacttgaggaacacatatttcaatccaaattttaccacacaaaaattgaggacggggagtgaatgggatcaaaggaatgtccttgacgattcatctcaacaacaacaacagcaacgaagggttttatttcctggtgttgctttatcatctgaagattcattgaactttcctggtactagtagcactactttgaacgcgttcttgcaagctaagcaagagattcgggacgccgagtccgcggatactagtatagggaagaggaggccggagcagcaagaatcgccacaaaatcagggtgggaagttacttgatacaatctaatacgggttcgattccgacaagtcataatccgatcccggcgacattttggattggcaaccaagttatcagtgggagtggcactggggatcccatgtggacatttccttcaacaataacactaa

SEQ ID NO: 15790 - DNA, 414 bp, Gossypium hirsutum
  Predicted polypeptide sequence is orthologous to G807
tttttttttttttttttctacaagtgagaatctatatcctaaaattcatcaatggctaaaagagggatgtcacataacatactcttcttaaatgatatatattactattatgggtgtttcattggataacaaccatttggaagacatgttatgctattagaacaatgacattgtaaataactccttttaataacaaaagttcctcttttctacccaacttcacagatcattatcatcatcagcagcattaacctgcatacacagtttgtggggcatcagcctctctggctatctgttgtaagaaggcccatttgctctgtgagatgattcgtatgttgaatcctatcccatccattattcttccccaacagtaattcaggttcacaacttgctccattttctggagaactcgag

SEQ ID NO: 15791 - DNA, 909 bp, Gossypium hirsutum
  Predicted polypeptide sequence is orthologous to G807
ctcttgccatggcaaattcactcactcgctgatcttcaaatccatatttattttcttcgaaaactcttttccttaatttttcttatcactaaaatcctgtaatggattctcttcatgattcaatatcagcggcgaacgcggcggccactgccaacggcaacaccgtgcccccttttctcagcaaaacctacgatgtggtgaatgacccatcgaccgactccgtcgtgtcgtggagtagcggtaataacagttttgttgtctggaaagtgccggagtttgctagggatcttttgcccaagtattttaagcacaataacttctccagctttgtcaggcagctcaatacatatggttttagaaaagttgaccctgaccgctgggaattcgctaatgaggggttcctacgaggtcagaaacatctattgaaaactatcagcaggcggaaacctcctaacgtccagagtaatcagcaacctcaagttcagaactcatctgttggagcttgcattgaggtcgggaagtttggtctcgaagaggaggttgaaagacttaagagggacaagaatgttctcatgcaggaacttgttaggttgaggcagcagcagcaaacaacggatagccagttgcaaactgttggccagcgtgtacaggtgatggagcagaggcagcagcaaatgatgtcttttcttgccaaggccatgcaaagtccgagtttcttaggccagcttgtacagcagcaaaatgaaagcaacaggcgcattactggagcaaacaagaagaggagactccccaggcacgatgaagaaaatttagctggtgaaaatggtgccgtatctgctaaagggcagattgtaaagttccagccttcactgaatgagcagcgaagcgatgctgcaccagataatgaga

SEQ ID NO: 15792 - DNA, 629 bp, Gossypium hirsutum
  Predicted polypeptide sequence is orthologous to G839, G1196
gaatcagttgaaaatttctattatcatagttctctaaggcactaaagaacataaacttcctatagatctttaatggtgtatgtataagtttggttaccttcatcaccagaggataggttatcaaacaagttatccctggcaacagtagtagacagaagcagagaagagttataagttttactcgcaagaaatccttaccgatataatcacaatttcctatacttgtaggggccaccatctctcaaagaagatgacgatgatgatgaagacaaaccgttgcggttaaactcggccttgtccttcttaaatgccctttgaacgtcctccttaagctccctgaagcgtgatctctctatcttttgctcttccggggtccctgtctcaaggtaagacaaatcaggaaggtcatcctccatgaacttatcgagcacttctgagcaatgagggaaatagcgccgacccatctccactgttttcataagggcttgcatcctagcaagaagtctttgcttctgcataatgggtgtctcattcaaatcaacctgccttaagtttccatttgaaccttttgatggaaagccagtagctaactcggaggttgtttcggcatgtgctatgtcaatggcaag

SEQ ID NO: 15793 - DNA, 332 bp, Gossypium hirsutum
  Predicted polypeptide sequence is orthologous to G849
aatctcttcacgtaatgtgttttacacaactggcatatcttgtcagaaatagtcacatcggctgttactaaactatgtcactgttgtcaccaggataaatggaaaacattggttcacacagcaaaaatttcgccgcagcaaagacgaggggaaccggtaccccaagaactattggatcgggtcatggctgctcatgcttactggtctcagcatcaaactaaacaacaaggaaagcatcatcccggaactttgagaattactgactcccaagctgacagaatcggatttgcggtcgccattccgaccattacaatgtaaaaaaaaaaaaaaag

SEQ ID NO: 15794 - DNA, 772 bp, Gossypium hirsutum
  Predicted polypeptide sequence is orthologous to G849
aaagttctttgaccgtagctcgatagtaaattctgatggaggaatcagtagtgaaagtgtttgtaattcacccgagaaggttgctgatggagataagggtagttccgcggcaatgtcacatggagcatgtgggataccccccttgcttacaggtaacaaagcatctcaccagtccaaggattctcatgtgaaattcagcattaagtcctttagaattccggaactttatatcgaggtgccagaaagtgcaactgtcggttcactgaagaggacggtaatggaggcagtgactgccttacttggaggtggaattcgtgttggggtactacttcaagggaagaaggttcgagatgacagccgaactttatcgcagactggtatttcctgtgaagaaaatctggattctcttggtttcactttggagcctggtcctgcgaaagctcctccgccagtgtgctcggaagaaccacatcttctgatgtcatgtgaaaaaggccctcaacaactaacaagccttccagccactccggttgtagatacagcgattcccgatgccacacctgacccactgttactaaccgatacagcacatcctgtggatagtaatcatgaaccggtttcctcccaaactgacgttctaactgatcaaagtctatcggagtctagagctatagttcctgttccagcaatgaatgtcgaggcactagctgtcatccctgccagcccaaaagtccgaaaaaccgaacttgcacagcgtcgaactaggaggccc

SEQ ID NO: 15795 - DNA, 895 bp, Gossypium hirsutum
  Predicted polypeptide sequence is orthologous to G852, G2633
gttcgcctacaagatgtctcttcttgccagataagagattacttggaaatccaaagcccagatacactagactctgatttggataagatgaaactgaagcttaaagaactggagagagctctgcttgctgataatgatgttgatggggatgatgacatgtttggcactggtctaagcatggaagtagatggtgagtggtctgatcctatcaggatgggttctcatcacgactcgccaaaggagtcatcatcctcgggtacttatctcgatagcgttagtggtaacaaagaggtttcacatgtttcatctcagactcctaagcaaatgctgattgaatgtgctgctatactctcagaaggtcacattgaaaaagcttcagccataataaacgagcttcgccagaaggtctcgattcaaggagatccgccccagagaattgcagcctacatggtcgaaggccttgcagctcgcatggcagcatccggaaaatgtctttacaaagctttaagatgcaaagagcccccttcttctgataggcttgcagcaatgcaaatcctctttgaagtgtgcccttgtttcaagtttggatttatggcagcaaatggtgcaattattgaggcatttaaaggtgagaaaagagtacatataatagattttgatataagtcaaggtagtcaatatattacactgattcaaacaatagctaagctgccgggtaagccacctcatttgaggttaaccggagttgatgaccctgattcagtccaacgtcttaatggagcctcgaaattgtcggactaagacttgagaagctagcagaaatactcggtgtacctttcgagtttcgagcagttccctcaaggacttcacttgttgctccatctatgctggattg

SEQ ID NO: 15796 - DNA, 851 bp, Gossypium hirsutum
  Predicted polypeptide sequence is orthologous to G852, G2633
ctatttctaaatatgctcgtggtggtggattggaagcagttaaaagacgtttggaagcaatatctgagaagttcaatattccagttgagtttcagggaatgccagtttttgcaccagatatcacaagggacatgcttgatgtcaggcctggggaggctctggctgtcaacttccctctgcagctccatcacacccctgacgagagcgttgatgtgaacaatcctagggatgggcttctacgtatggtaaagtcactgtctcccaaggttaccacattggtagagcaagaatcaaacacgaacacggcccctttcctccccaggttcatagagactctggagtactacttggcaatgtttgagtccatagatgaaacactgccaagggacagaaaggaacgagttaatgtggaagaacattgcctggccagggatattgtgaatatcattgcttgtgagggaaaggagagggttgagcgtcatgaactctttggtaagtggaagtctagattaacaatggcaggatttcgacaataccctttaagctcttatgtcaattccgtgatacgaggcttgctgaggtgttactctaaacattataagctggtagagaaggatggtgctatgttgttggggtggaaggataggaaccttatatcagcttctgcttggcactgtgacagctgagtgagattcatacaaaggcagaaacgaaataatcagttgattttttctaataggtgacggatgataagataacttcatcccatggtactaatggacaatgatactgttgtatcagctgttgaaatatgttgaataacatccctatgatccaaaaggtgacatttt

SEQ ID NO: 15797 - DNA, 932 bp, Gossypium hirsutum
  Predicted polypeptide sequence is orthologous to G852, G2633
aaacaaatcatatgctgtctcatttccaacctgctttccatctctcaaaccctctgttttcttcaacttcaatttcaccaaaagctgaagattccttagaataaggtgcggtgcccccattgatttgatgttggaattgaatttgtcctttttttgaatttaagatcataaagagacagatggaaagaatctgggctgtcaaggctgaaggatcatgttggaaacagtcctgccagtctcgaatcctttgattgctccaacccccacaaggggacagaaactgttctggcaagctgtccatcaatgcaagcatcccagcaacacagaagctcagtcatggctagcagattgtaccatcaaataaagcaagaagtcgagcctgagccctactggttccctcaactcccacctactgacccctctctctgctatagtgacggattccacttctctgttgagagttccaatgaaaatttttgcactttggagtcatcctctgcaaatggcagttatactgcctacaactctacatcacttgtcggtttctcaccaaatggaagcccaatgtcacagcaagattctcagtcgtatccatccgacttgcatcactctcctgacaataatggtggctctcctattagtggttcctgcgtgaccgatgatgtaagtgatttgagggataagctgaaagagctggaaactgtgatgttgggccctgattctgatgttattgacagtaagacctcactagagatgggcacctggagacttgtaacagatgcaatctccagaggggacttaaaacaggtccttgtcttttgtgcaaaagccctgtcagataatgatctcttgatggcacagtggttaatggatgaattacgccgaatggagtcgtttctggggagccaatccagagttgggagcctacatgt

SEQ ID NO: 15798 - DNA, 954 bp, Gossypium hirsutum
  Predicted polypeptide sequence is orthologous to G852, G2633
caggatatgcttcttgtaactcttctctggaatccagcacttatttccatcaatcgagtccctcagtggactgcaggcgtgaaagcttactgatccattctgatggaacttcttatatagaagatgcaaattctagccacgaaatagtatatacttcgcaagagctaggaacagcagtcatggcacctgatggggccaatgaagtaaccaatacaccgcagacaaatggccagcgatacagggcatcgagtaaggactgccgaggatcttccatgtgtcaacctcagacaacctttgtttctaaccgtaggcagtcaactgaagctgctcatgtagagaaacgtttgactgcaatagaggatttatctttgcagagtattccaccagggaatctaaagcagttgttgattgcatgtgctaaaactctctctgaaaacaatatcgataaattcaatatgttgattgcaaaggccagggttgctgtgtctatctacggagaaccaatccagcgtcttggtgcttacatggtggaagggttggtagcaaggaaggaggcatcgggatctaacatatatcgagcccttcgttgccaagagccggaaggcaaggacttactcacatacatgcataccctttatgaaatttgcccgtacttgaagtttggatacatggctgccaatggggccattgctgaagcatgcagaaccgaagatcgcatccacattattgatttccagattgctcaggggaacacagtgggtgaccctcttgcaagcacttgcagccagaccaggcggagctccttatgtgcggattacaggaattgatgatcctgtttctaaatatgcccgtggtggtggattagaagctgtcgaaagacggctgatggcactatccgagcagtttggtgttccagttgagttccatggaatgccagtttttgcagcagatatc

SEQ ID NO: 15799 - DNA, 593 bp, Gossypium hirsutum
  Predicted polypeptide sequence is orthologous to G852, G2633
cttgaaaccttggtattcaacctggtgaagccattgctgtaaattttgccatgatgctgcatcacatgccagatgaaagtgtggacactcagaaccatcgggacagactgttgaggttggccaagagtttgtccccaaaggtggtgacgctcgttgagcatgaagcaaatacaaataccgcccccttcattccccgtttcctagagacaatgggttatttttcgtctatctttgaatcgattgatgttagcctgccaagagaacacaaggagcgaatcaacgttgaacagcactgtctggcccgggagattgtcaacattatagcatgtgaagggcaagagagagtggaacgttatgaactttttgggaaatggagatcaaggtttattatggctggctttacaccctctccattaagtccatttgtaaatgctaccatcaaaactctgctgcaaagctattgcgataagtatactcttgaagagagagatggcgttctttatctcggctggatggatcgagctataattgcttcttgtgcatggagatgttaaccgaaggatagctgtatttacatttcatctttggcatac

SEQ ID NO: 15800 - DNA, 837 bp, Gossypium hirsutum
  Predicted polypeptide sequence is orthologous to G852, G2633
tgagcaactggtggacatgattcctagattaacttgaaggatgtgcttattgcttgtggtcaagcgctttacgacaatgacatgtcgagagtggcaggtttaatgcatgtattggagaaaatggtttcagtatgtggggaaccactccaacgattgggcgcttatgttcttgaagggcttagagcgatgttggaatcatcggggagtaatatctacaaagccttaaaatgtcaagaacctacaagctcggaactaatgtcttacatgcatattctctttcgaatctgcccgtactacaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcccccatttatccgtgtaactggtattgatgattctcagtcaaatcatgctcgaggcggtggacttagtattgtggtgcagaaactatcagaatttgctaagtcgtacattgtgcattcgagtttcatgatactagcgtgtctactaccgagattcacgtacagaatctcaacatttgtcccggggaagccctagccgtgtaattcccttttgtttggcgtccattgccgacgggagcgtatactttctcgacactagaacacctgtgttggttgtgtgatagttgtccccaaatttgcccttgttggccgtgttacccaccttcccttttctccgtatgggacttatttacagttttcgatctacgtattgcagggtaccaggctgtgaactgtgctg

SEQ ID NO: 15801 - DNA, 940 bp, Gossypium hirsutum
  Predicted polypeptide sequence is orthologous to G866, G883
cttctacttttcgccaggcttcaatgttttgttgacctctcaacttgcttagtttcctttggttgtcgtcgttgtttttcgtgaaaatggcggtggatctgatgagttttcctaagatggatgatcagatggccattcaggaggctgcaacgcaaggtatgaagagcatggagcacctgattagcctcctttctcaccagtctaaccgactcgactgcgctgaggttgccgatctcaccgtctctaagttcaaaaaggtcatctcactaattaacagaaccggtcacgctcggttcagacgtgcaccgattcagtcctcttccttttcctcatcgtcatcatccgctgcttctctaactgttactgattcccacaaggctctaactcgaactcctgccccggttgaaacaccgccgctgaccgtaaatccggcgccggttgaagctccaagtacggatcctgctagtttcgttcctttgcaaccccagagtttaacactcgattttacgaaaccttatttgtttagttcgaacactaaaagcactgagttggagttcacaaaagaaagcttcagcgtgtcgtcgaactcttcgtttatgtcttctgcgatcaccggagacggcagcgtttcgaacgggaagcaaggatcatctctatttttgacaccggcggcggccgtttccgcgggaaaaccaccactatcctctgctccattcaagaagaggtgccgcgaacatgagcactccgagaacgtctccggcaacggcaagtgtcactgctcaaagcgaaggaaaaacagggtgaaaaaagtaatcagagttccagccatcagttctaagatcgccgacattcccggcagacgagtattcatggaggaagtacggtcaaaaaccgatcaagggctcaccatacccacggggatattacaagtgtagtacgg

SEQ ID NO: 15802 - DNA, 893 bp, Gossypium hirsutum
  Predicted polypeptide sequence is orthologous to G866, G883
ctcaggcttcaataacttgctgacctctcaagttaccttccctgcaaagcttcgtttctgtttctttgacctcaaaatggcggtggatctgatgagttttccgaagatggatgatcagatggcggtacaagaggctgcatcgctaggcttgaagggcatggagcacctgatccgtctcctttctcaccagtccaacaacgtcgactgcaccgacctcgccgatctcaccgtctctaaattcaaaaaggtcatctcacttctcaacagaaccggtcacgcccggttcagacgcgggccgattcaacccctttcttcctcgtcttccccctcgacatcatcctctgcttctctgtctgttccgaattctcaaaacaatctaactctaacttctgctgcgatctcaacgccggcgaccataaatacggcggtggtcggtacttcggttatcagtccttctagcttcgttcaatcgcagccgcagagtttgactctggacttcacaaaacctaatttgtttggctccaacggtaaaagtaccgagttggagttcacaaaagaaagctttagcgtttcctctaactcttcgtttatgtcttctgccatcaccggagacggcagcgtctcgaacgggaagcagggatcatctctattcttggcgccggcgctggccgtttcgacgggaaagccgccgctatcgtcgacaccgttcaagaagagatgccatgaacatgaccactccgataacgtttccggcaagatatctggctccggcaacagcaagtgccattgctcaaagcgaagaaaatagggtgaagaaagtaataaagggttcctgccataagttcgaagatcgccgatattccaccagacgagtattcatggaggaaatacgg

SEQ ID NO: 15803 - DNA, 789 bp, Gossypium hirsutum
  Predicted polypeptide sequence is orthologous to G872
attaaaacaataaacagtaatccatccaattactacaaaaaattacacacgaaaaagaagaaaaataaaaaattttataaactttacattcgttttacggagtaagctattataattgctgcttttaaggatgagcaaagaaggatggccgtacaaaaattggccctctcgaatatccggatccaactctggatactaaaatgcccaggtcgacccgattttagaaattccaaagaaaagattctggaactaaaatcccatccaaataatcctcttcgtacccgatgctgggcaacgatgatccgagaaaagcacttgagaaatcctcaaatccagggaatagcaacccataatccgattcataattacccgaaccgattgtcaaaagatccagaaacgacccgtccataggcaactcactatctaactgaacagtcccgtccgaaaccgacggtgatggggactccgtttggaacccagagttggattgctcggattggatcctgggaggctccgagttcgcaaactgtgctgcagcggcttgaatttggggcggcgttaaagacctagctccagctatctcgggagggttatcagggaagttgaatttggcagagaggccgcgtaagcaaaaaagagcggcgtcgaaagcacgcgctgctttctcggctgagtcataagatcccagccaaatcctttccctgctgttgggtagtctgatttcggacacccatttcccccattttcgctttcggacacccttgaaccgtgaatcgcttcgctccactg

SEQ ID NO: 15804 - DNA, 854 bp, Gossypium hirsutum
  Predicted polypeptide sequence is orthologous to G872
gcaacaaattgactttcaattgatggtgaagccaatctgcacaacacattcttcagcatcacaaacagagtatgcctccgacataaacaccaacagctgcagcagtaatagcagtagcagtagcagtagttccaagtataagggagtacggaagaagaaatgggggaaatgggtgtccgaaattcgacttcccaacagccgtgagcgtatttggttaggttcttacgactcgccggaaaaagcagccagggcgttcgacgcggctctttattgtttacgtggccgtgatgccaagttcaatttccctgaaaatccaccagaaatcgccggtgggacgtcgcttagcccgccggaaattcaagtggtggcagctaggttcgccaaaggggtggaactggaaaccccggggaataacaacagtattttagggacagaagagtatacatcgtcttcgtcgggcgggggagcgacaacgcaagtggagagtcgtcatcatgaaaaagacatgatggactggtcgtttttgagcatgttggataataacaacaccaatgatggagggatgtccgattatggcttttattcaaatttgggccatttgcctggtggtgatgatgatcaactctatcctccgccgattgatgatgatgaaaacggtggcagcgctttttcaccgtcatcgtttctttggaacttttaagccaaatttagatttctttttaaaagcaaataaggttaacttttgtgtttatttgtttgatgggataaatcaaaggcgtttggcgaatattagcagccaggatcggtgattttcccacagatacagtgagatgatgagattccattgatagaaa

SEQ ID NO: 15805 - DNA, 627 bp, Gossypium hirsutum
  Predicted polypeptide sequence is orthologous to G872
tccctgatacccacccgagatagccggcggtacgtctttatctccccatgaaatccaagccgccgcagcgaggttcgcgaactcggagccttcgacgatccattcggagcaaactgattctgcgttccaaatggagtcaccgtcgccgtcagtttcggacgcgacggtacaattcgacgggtcggctatggatctattgacgatgggttcgggtaatggtgtttcggattatgggattttccctggatttgatgatttttcaagtgatgttttgggatcatcgatgcttaacattggtgatgaagatgaaaattttgatgggattttgattccgggatcatttctttggaatttttagaacggatcaacttaaatccggggatttttagtatccggatttggacccggatatttggatgggtcaaatttttttcacggctcattcttttttttattaaagaaaacaaaacaaaataaaaatcaagtattaattaatttgtagagaagaatgtaaagtaaagcattgtagactttttgggtaattttttgtaataattgatttttttagtgtcaacgttaaatatattttaaatagttattttatggaaaaaaaaaaaaaaaaaaaaa

SEQ ID NO: 15806 - DNA, 550 bp, Gossypium hirsutum
  misc_feature (20)..(21): n is a, c, g, or t
  misc_feature (441)..(441): n is a, c, g, or t
  misc_feature (460)..(460): n is a, c, g, or t
  misc_feature (485)..(485): n is a, c, g, or t
  misc_feature (539)..(539): n is a, c, g, or t
  misc_feature (541)..(541): n is a, c, g, or t
  misc_feature (547)..(547): n is a, c, g, or t
  Predicted polypeptide sequence is orthologous to G878
gggccccctcgcgttttttnnttttttttaaaagacactaaaacaagcttatcagcagttctaccccacactcaaaagagagaaaaagggctaacaaaatcgtttgctcacaaaatagtccaaaagcaaaagtggataaatttttgtatcagattcagcccctatatacatgagaatgagttaaaatatatgaaaaagaagggagagaaatctgttgtacacacctgatattgagaatgccatttttttaaaaatctcttttattttttttttgaaggaaagtcacccttcttttacttctaagaagaggggtcctttcataaatgcaaagcaaattaagctaaatatgtccataagctgctgtaagtctttggatgtccttcgcacacatatcggaattttgtaaagctgcttcttgttgttgctgctgctgctgctgtnggttaagagaccacacggntgtttgatgaagtattacgtgcacncgaaatctgtatctgattattatctcgatattgcacgacaggactgtggggtancngatttngca

SEQ ID NO: 15807 - DNA, 255 bp, Gossypium hirsutum
  Predicted polypeptide sequence is orthologous to G881
gtggatactacgctggacctcaacatcaatcctttccatcaccggaacaaagctctgaggaccgaatctgagggagaaatggctgactctgatgtgaagctacccttcaaacaagagaatgcagttttggtggaggaattgaatcggattaaagctgagaacaagaagctaactgagatgttaacagttttgggtcactgctacaacgatttgcagaacaagttcatggaattagtgaccattaactctgaaaat

SEQ ID NO: 15808 - DNA, 863 bp, Gossypium hirsutum
  Predicted polypeptide sequence is orthologous to G881
gcggccgcgctcgacaaaacctttcactctctcttcctcatcgtttcttcagagcttcagctccatcgcctgcctctttgcttcttcttttcttgttctatagtgtaatttcggtgatggaatcggcttgggtggatacgactctcgacctcaacatcaatccttcccataataccatcaaagttctgaagagagaatccagtggaaaactggctgattctgatgtgaaagtaccagttaaacaagagaccggagctttgttggaggaattgaaccggattagcgctgagaacaagaagctaactgagatgctaacagttttatgcgagcgctacagctctttgcagaaccaatacatggaattggtgagcaggaactcgggaagtgatgcaacagctgcaacatcaaaaaagagaaaagccgagtgtgaggattatgccaccatgattggattcagtggaaaagctgagagcagctgcagtgatgaagactcgtgcaaaaagcctaaggactgcatcaaagcaaaaatttcaagggcttacgtgcgcacaaatccttctgataacagcctgattgtgagagatggatatcaatggagaaaatatggtcaaaaggttacaagagataatccctctccgagggcatacttcaagtgctccttcgccccaagttgtcccgtcaagaaaaaggtgcaaagaagtgctgaagatccatcaatcttggttgctacttatgaaggagagcacaaccatgaacaacactctccaccagcattatcatcattaagccccaacagtggtaccagtaaccctcgttcagctcctgtttcttctttctcttctgccccccgccaatcttcacct

SEQ ID NO: 15809 - DNA, 793 bp, Gossypium hirsutum
  misc_feature (785)..(785): n is a, c, g, or t
  Predicted polypeptide sequence is orthologous to G881
gcttggtaccgagctcggatccactagtaacggccgccagtgtgctggaattcgccctttcgagcggccgcccgggcaggtacacatacacaccttaacctaatgctttaaagaaatgttattttagtttgttggtggtttagggtgctcagtaatggagctgagcgacagcatgcggctaaagctagagtgaagctaggatcttttgctaaggatgctgcaacatggtcttccattgatctcttgttgttataatcgtcatcgttgccgatgccgcagctgttttcgcttgaaagattgagatcaagagcgatggcggatcgtaacgggttatcaagaactgaattgggaaaaccggagatggatgtcgtggcggagctggtgggggaagacaaagattgtcctattgaaggattaacttcatggttgagtcgtccttcgtatgttgccatcaagaaattcttgtcttccatgcatcgctgaaccttctttttgacagggcatgcgggagccattgaacacctaaaataagctcggggaaaaggattatgtttagtaactttctggccatatttcctccattgaaatccatctttaactatatggctctagtgcctagggtcagtttccacaaaaacttgtgaggaatttgctgctaactgaagttgaggtattagaatatttttgtgggagtgctgatcttcgcacatatcacatcgcgttaagcctaggcagatatgtgtacctcggccgcgaccacgcttagggcgaattctgcagatatncatcacat

SEQ ID NO: 15810 - DNA, 410 bp, Gossypium hirsutum
  Predicted polypeptide sequence is orthologous to G896
cgcaatgcgttccaacattcgtcatgtgccttagagcggatttgttacctctcttctcacaatgctcttaacaggcggcagcctcggtggcagatcaagaccggagccacagttaacagccaccgagccatttgatgtgtataataaacctttttccttgtaattggtaaacatgtgcgcggcatgcttttcattcttttgacgaagcctaagcccgagctttgtacagtttttgagggacaaaaagaaaaaggaaataaattcatcttctatttatcataaataattttattatttaggcgaatgttgatgcgactgacactgacatgaatgtgttggacacggttattggacataaatcttttaaagaaaataaagagcacggttaattttaaagtcgacgcggccgc

SEQ ID NO: 15811 - DNA, 949 bp, Gossypium hirsutum
  Predicted polypeptide sequence is orthologous to G896
ctttcaacatcatcaacacccatgttaatgcaggtcaactgttctaattgccacgcgccactgcacctcccgccggctgcaaactccatatgctgcgtcctctgccaagctatcaccctcatagctgaccctcgctccctacccctacctcttccctcttcctcccaccaacaacaacctcttccatctccttacaaccacgcgccgcccggtcccccaccgcaggctcatggccgcaagcgcgctgttatttgcggcgtgtcttacaaaaacacccagtatgaacttaatggttgtattaacgatgccaactgcatgaagttcttgttggtgaatcgcttcatgtttcccgagtcctccattattatgcttacggaagaagaaactgatccttacaagcgtccaacgaaacgcaacataagaatggcattgcgttggcttgtccaaggttgtcagcctggagattccttagtgttccactactctggtcatggctcgcagcaaaaggacgacaatggagatgaggtggacggatacgacgagaccctttgtccattggacttcgagtctcagggaacgatcatagatgatgaaatcaatgcaaccatcgtcaggcctctaccttgcggtgttaagcttcacgcaatcattgacgcttgccatagtggcaccgtattagatttaccatacctctgtaaaatggacaggaaggggagatacgtctgggaggatcaccgtcctcggagcggaatgtggaaaggaacaaatggtggggaagtcatttccttcagtggctgtgccgatgatcaaacctccgcagacacttcagccttatctaagattacttccaccggtgcaatgacttactccttcatccaagctattgaatatgggcatgcgaccacttacggtaacatgctaaacgcaatgcgttccaacattcgtcatg

SEQ ID NO: 15812 - DNA, 933 bp, Gossypium hirsutum
  Predicted polypeptide sequence is orthologous to G896
gaataatgtatccgccgccagggccaggaggcatgtactacaattacccgccgcctatgctggtcaactgctccggctgccacacccctttgcagcttccgcaaggtgcccgatccatccgttgtgccatctgtaaagccgttaccaacatcgctgaccctcgatccctccctcccgcgtcccaatcacctgctccttccacccacgcgcttccttctccctccccttacaatcatgctcctcccggggcacctccccacgcccacggtcgaaaaagggcggtggtctgtgggatttcgtatagatactcgaggcatgagctcaaaggttgcatcaatgacgccaagtgcatgcgttaccttctcgtcaacaagtttaagtttcccgaggattccattcttatgctcacagaagaagaaactgatccctacaggcttccaacgaagcataatataaggatggcattattttggttagtacaaggttgtcaacctggtgattctctgttatttcactattccggtcatggttcacggcaacgaaattacactggtgatgaagttgacggctacgatgagactctttgccctttggattttgaaactcaagggatgattgttgatgacgagatcaatgcaactattgttcgacctctacctcatggtgttaggcttcatgcgattattgatgcttgccatagtggaactgtattggatttaccattcctttgtagaatgaatagggctggacagtatgtatgggaggaccatcgtcctgcatcacgtttgtggaagggaacaagtggtggagaagtgatctcctttagtggttgtgatgatgatcaaacctctgctgatacatctgccctatcaaggattacatctaccggtgccatgacattctgcttaatccaagccatcgaaagggggcatg

SEQ ID NO: 15813 - DNA, 707 bp, Gossypium hirsutum
  Predicted polypeptide sequence is orthologous to G898
gatttttccaattcctttttggtagaattttttatttctcgattcgatttcgtctgtgcttcttggtttattgagactgcagtccttggatggtacattgagaaatcataagcagagcatgagcactcttgagataagggggccttctcttaggggatatcgaaggagaaaggcagtgcttgatctgaatgctccacccagtgaaatcagggagcaggagggtacatctcaacaggctgggtatgaggatcaaacgaatcaatctgtacagtctggtccacctgcaaccattgatgttgaggctattgatgatgatgtaattgaatcttctgctagagcttttgcagaggctcagaacaattctaggaggagccgtggaaggactgtggttgatgttgattcagctcacatttctgcccttccaggctggtcagcgaggtcaagtaataacaatcagaatatgcacagaagacttcctccgagctcaagcattattaatttggaaatctcgccacagtcaattcaggttgaggaaatcacaaagccacagccacctccaaaggaaccaaccttcaattgtccaatttgcatgggtccattaacagaggagatgtcaacaagaatgtgggcatattttctgcaaggcatgcattaaactgcaataactacacaggcaaaatgcccaacttgcaggaaaagagtcacag

SEQ ID NO: 15814 - DNA, 843 bp, Gossypium hirsutum
  Predicted polypeptide sequence is orthologous to G904
cttcctttacccccccaaatacaattctgttccttacacgtcatcctcctccacttgtgatacagtaaggaccaagaacccatcaatggcgtcgccgccacctttgttatacggagttattggaggtcctgtggcctcctcggaaaataatagcagtgaacgctcccattcttcttcttcttcaattgagagtgcaaagccgagtattataataatcattttgatcctttctataaccttgcttgtttctgtttctctttgtctcctcttgcgtcatctcaaccgccgttgcttgcgtcacctctctcgttcctctacctccactattgtcgcctccgctgccagccaccgtgtcagtcccgaacaatcaccgacggctttgttgcttgattctcttcctctttttactttctcttccattactcgccgccgctccaacggtgattcaacggtttccggagattgtgccgtttgtttgtcgaaatttgaacagcaggatcagctcaggcttctccctatctgttgtcacgcatttcacgcccagtgcattgatacttggcttacttcaaatcagacttgtcctctatgccgctctcctctcttcgcttccgagtccgatctcatgaagtcgttgcttcagtcttctaacgcagccgcaccgatcggaagtggcggaagcgatagtttccggcttgagatcggttctgtaagtctccggcaaccaggctcagaatcaggtgagcaaagaacgtcgtattccattggctcttttgattatatcgtcgaggaagaatcagaggtgactaggaatcaaactcatcagagaaacgtctccgataaaga

SEQ ID NO: 15815 - DNA, 905 bp, Gossypium hirsutum
  Predicted polypeptide sequence is orthologous to G912, G2107, G2513
ctcaacaacttcatatacatataaacccctttcatttcacacttcaaattcataaacttatcttttattttacaactttgggtttgattttattctactgggagtgaaagttcaatgtcaagctccttgttcaaatgctaaaagtcaaatatttgtttaattgaaagttgaattcacggttttattccttgttatggattctttgagtttagattatgggtcggtttcgtcaccgatgtcagatagtgggagtggaaatggagcttctcgtccgccgaatttttccgatgaagacgtgatgttagcttcgtgttaccccaagaagcgagcgggaaggaagaaattccgggagactcgacacccggtgttccgaggagttcgccggaggaactccggaaaatgggtttgtgaagtaagggaaccttacaaaaagtcaaggatttggctcgggacttttccgacagaagagatggcggcgcgtgcccacgacgtggcggcgttagctctgagaggaaggttggcttgtttgaacttcgcggactctgcttggagactccctgtaccagcttctaccgatccaaaagacatccagaaagcggcggcggaggcagcggaagttttccgacctgttgattccgccggagatagctcaaagacagctgaaaacacggcggtggagggaactaaagagtcggaagaagtgttttttttggacgaagaagcagtgtttgggagagaaaagtttttggcaaacatggcggcggggatgatgatgtctccgcctcacagtggatatgaaaaagatgaacaagaacttgagtttgtcgatgattgtgtgcagctgtggagctattctatttaaaagtataaatatatcagactcaatagaatttgatcaatccttt

SEQ ID NO: 15816 - DNA, 928 bp, Gossypium hirsutum
  Predicted polypeptide sequence is orthologous to G912, G2107, G2513
tccaaatccaaaaccaaaagattcaactcccaaaaccgaacccagacaccataatctcgaaaccgttttgaaaagtactttactgctccttttgctgcttaaaaacccaacacccataacttgttttttactcaattcaatggatattccaagtcaaacgtgtgacgtccccttctccaagtcttattctatgcgtgctgaaagggtagagccatcttcatcttctgaagggggcattggtggccagcgagctgttcactctgacgaggaagtgcttttactagcgaccaacaggcctaagaaacgagcagggaggagggtattcaaggagacgcggcatccggtttttagaggtgttcgaaggaggaataatgataaatgggtatgcgaattgcgggagcctaataaaaagactcgcatttggcttggaacgtatcccacccctgaaatggctgcccgggcacatgatgtagctgcattagcattcagaggcaaggctgcttgccttaacttcgctgactctgtttggaggttacccgtgcctgcttccaacgatgccgccgatatcaggagagccgcagctgaggcagctgaagcatttaggcctcaagtattccaggaactctccggtagcgacgtcaggcagggaagcttcaaggcttccgattgtgaagtttcgagcagtgacgtcaagttggaaaacaagaaaaaaatggcagctgaaggtgaagtttcgacagagaaaattcacttcatggatgaagaagaaatgttctacatgcctaagctgcttgacagcatggctgaagcgcttctactttcaccaccaaggaatcgcgatgaagctgacagtgatatcgatgtgtctttatggagttactcaatctgaagtgtacaaactacaaactactgcaagtgtttgttttgt

SEQ ID NO: 15817 - DNA, 1102 bp, Gossypium hirsutum
  Predicted polypeptide sequence is orthologous to G912, G2107, G2513
ggccattacggccggggagaaaaagaaagctcatttagttaatattttcccttgcatttccaaattcggaagttcatacagcaagtgatttcctaaaatacttggatcctaagtacgaatatccttttcttgaaatatactctttttaagtcaaaagctttgtttaactgaaacttaaactgattactgtttgggttttttttttaaatggattttgtagttcaagattatgatatggttgattctgggtcggtttctgaaagtggaactgatcgtccggtgaatttttccgatgaatatgtgatgttagcttcgagttatccaaagaggcccgcgggaaggaagaagttccgggagactcgacacccggtgtaccgtggagttcgccggaggaatcccgggaagtgggtttctgaagtgagggagcctaataagaagtcgaggatttggcttggaactttcccgaaggcggatatggcggcgcgtgctcacgacgtggcagctatagcactgagagggaagtcagcttgtttgaacttcgctgactcagcttggaagcttccggtcccggcttcttccgacccaaaggatatccaaaagacggtggcggaggtggcggagactttcagaacggctgagcattcgagcgggaattctagaaacgatgcaaagagaagtgaaaacacggagatggagaaagggttttacttggacgaagaagcgttgtttgggacacaaagattttgggcaaatatggctgccggtatgatgatgtcacctcctcgttccggtcatgacggaggatgggaggaacatgaagtcgatgattatgtacctttatggagttattctatttaaaagtaaaatttttcagacattttcaagcattcattggaatttttagttcacagaaatcgccaccggcaattgccctttatgttttgtacgtacaacgatttttttggattgtacgggtagtgctgtaagtaaaaagattaatgtgtatatatacgatgtatatatacttcatagcttctccaaacaataaatttatagcttcatatctattttaccatcaaaaaaaaaaaaaaaaaaaaaaaaa

SEQ ID NO: 15818 - DNA, 647 bp, Gossypium hirsutum
  Predicted polypeptide sequence is orthologous to G913, G976, G1753, G2514
ttttttttttttttttttaagagataactttaaacttggaatataaataataaaataaatatgaaaaataaaacaaatagaatgatgtataccactgagtctaacctaatccaaatcatatactatggatttaaaagtaatatgaggttgatgtaaatcctaaccttgtatgactagttggttaattggtatactttttctactattttttttaacagaaactggaaaaatgaagcgaaaacaaagaaaatagaaaaaaacacaacatagcaaaagcaggcttataatttagtaatgtccccataaatcaatgttaaaggtggaagctacgttatcgtcgcaatcataaacttgtgcctgcaaagcagcaggtgaagagaggagcaaaccttcagccatgctatcgattaagcctggcatgttaaacaatgcctcctcgtccatgaaaccataattccactcattatcattaatgttggtggtctccaagctccaactacgatccaacatcgagccataatctaaaacgctcttttcttcgtcgttctcagtggaaactgaggttgatgatgagcatcccactggttgaggatcaatatccgttgaagttactggtttaaaagcctcggcagcggcaaacgcagcga

SEQ ID NO: 15819 - DNA, 876 bp, Gossypium hirsutum
  Predicted polypeptide sequence is orthologous to G913, G976, G1753, G2514
cacaaacatgactgaatctgattcttcttcaaccaatgtgcccccaaaagaccagccgccaccaccaactgttcccatccctgacgctccgccgcaagagcagtcgccgaaaccatcatctactccattgatctcatcgaaagaaggcgtaagtgggaattccacatcgagaaagttgccggcggtttatcgaggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaaggctgtaaccaacactgggtcatcatcaaaaaacgaggacaccacatcgactactgctatggagattacatgttcaggtcaagaatttatcgacgaggaagagcttttaaactttcccaatttgatggtggatatggcagggggaatgctagtaagccctccaaactggataaactcaccaccttctgatgattcaccagataattcagatgtagatacactatggacttacacttaaaatagaaaaattcactgtaaaagtgatgaatgagagagagtatacagtacaatgaaatgtagaagaagaagaagcatggtttaaaaactagggtctagatgcttctgatgattcagtaatatgaaatgcagaaggtactgtcatttgtcctctttttttaactctgtctcttctggtttttatctctt

SEQ ID NO: 15820 - DNA, 586 bp, Gossypium hirsutum
  misc_feature (451)..(451): n is a, c, g, or t
  misc_feature (457)..(457): n is a, c, g, or t
  misc_feature (492)..(492): n is a, c, g, or t
  Predicted polypeptide sequence is orthologous to G916
aaacatgtgaagggaaggggtctcccatgcaaagcaaccttgacgataatgatgatggccatggttcttttactcggtcagcaggcatcagcattttcagccacaaccagcaacaacaacaatagcagcaacttggctacccattgcggtgcctctaccatggaggaatgcttggtggacatcggccatgcagatcatgtgttcttcgctgagccagagacgagcctgcagaaagatccacctaaattcatcgatgtttctaagaacaacttgattactccaaatgataaatgtgggagaccaagatcaggtcagccctataatccttgcgtcccagactctaatgatagcaaaaaaggtaacactgtacggcaatttacaaagacaacaatagaaatcgcggatgcaagtagaattatcttgccgactatggattttttctagctactgnttatgnaaactaaataaagattgcattctaatttgcttagnttatacaagctaaattttgctattaatttttgtacttttggcgaaaattgcgaatttaatctttttactttaattaaaaaaaaaaaaaaaaaaa

SEQ ID NO: 15821 - DNA, 675 bp, Gossypium hirsutum
  Predicted polypeptide sequence is orthologous to G921
tttttttttttttttttttttttttttagctaagcagcgtgccgccgttcatatttgcaccaaagcatatacaaagtacaaaagtgtttgatattcactccattatctatcttctctctttttcaccaaaaaaaaaaaattaccatagtgttttagtttgtttttgaagttcacgggggtgatggtttagggtgttcagttttgatggagcgagcaaccgctgcagctaaagctagagtgaagttaggatcttttgttaaggatgcaacatagtcttcgatcttcttcttcttattatttccgtcgtcgttactggtgctataatcatgcataaagcttggaaggtttctgtggttttgtaagtcggagcctgaaagagtgagatcaagggtgatgggtggtggaaaagggttatccagaggtggaaaaggaatgcttctcgtcccggaaaatatcgccgagctgcatgatgctaacattgattttccggcagctgtggaatcaacatcatggttgtgttgtccttcgtatgttgccacaacaatagatttgtcctccacgcatcgctgaaccttctttttgacagggcattccggagccataaagcacttaaaataagctcgaggcgagggattatcttttgtaactttctggccatattttctccattgaaat

SEQ ID NO: 15822 - DNA, 556 bp, Gossypium hirsutum
  Predicted polypeptide sequence is orthologous to G921
ttttttttttttttgcgttaaaacgtattttcttttatttataagttaggaagggaatgtgaatttacagaccaatttattcaaaaacaaaaacaaaatgaaaagaatatttacatgaagctgatgcttgaacagatttcctgtcctattctgtttttaaattgtgtgtttccccaattcttctgcaatgtcgtatttacaacattctaagttcataacaattactacttatagttgacaaaatcatagaaacaactctttgtccgccggtatattttcccagcaagacagatataaatcctaaaatagaaacgagaaaaaaaaaactctaaattgatcttatattttgagatattaattccatcccattttttttattcaactggactttgctgaaacattcttcctgaaatggcagctgccaatgctgctgtgaattttgggtctttcgtcaaagaagtagccatctgttccaccaaatattgtctgacttgcggtgaatccatttttggcagaccggagctgcagattctagctacatcactaccactgggct

SEQ ID NO: 15823 - DNA, 949 bp, Gossypium hirsutum
  Predicted polypeptide sequence is orthologous to G921
atgaatatattagatctggatctttgcttaaagattgaaaaaaaagctatgaattcttcttcgtcttcatgggttgattcgttggatcttaatgcttcttcaacaaagtcccttcaacttgaaactcctgtaagtcatcccaataccagcaacagcttaattgtatttggaaggaaactttcagtcaaagaagagagtggtgctttaatggaggaactgaaccgtgtaaatgcagaaaataagaagctaactgagatgttaaaagcaatgtgtgagagctataatgcattgcaaagccagttagtggatttgatgaacaagaatactgagaaagaacttagtcctacaaagaaaagaaaatcagaaaccagcaacaacaacaatgggaatatcattgggaattcagagagtagttcaactgatgaagaagaatcatgtaagaaacctagagaagaaatcatcaaagccaaaatttcaagagcttatgtcaggactgaactatctgataccagccttgtggtaaaggatggatatcaatggaggaaatatgggcaaaaagtcaccagggataatccctgtccaagagcttatttcaagtgttcttttgcaccaagttgccctgttaaaaagaaggtgcaaagaagtgttgatgatcaatcagttctagttgcaacatatgaaggtgaacataatcatcttcccccttctcaaatcgaggcaacatcgggttcgagccgccttggttcggtccctgttggttcgaccccagttaagtcatccggtccaaccattactctagacctcaccaattcaatcaagtcaagtgatgaagctagaaactcaaagccaaaactagattcaccagaagctacgcaatatttggtggaacatatggcatcttctttaactaaagaccctaatttcactgcagcactggcagctgctattt

SEQ ID NO: 15824 - DNA, 961 bp, Gossypium hirsutum
  Predicted polypeptide sequence is orthologous to G921
cagtaatggaaccagcttgggtggatactactttggatctcaacatcaacccttgttttcgcaccaacaaagctatgaaacgagaatttgagggagatgtggctgagtcggcaccagttaaatatgagagtggagtgttggtggaggaattgaatcgggtcagcgccgagaacaagaagctaactgagatgctaacagttctatgcgaacagtattactctttgcagcaccaattcatggaattggtcaacaagaaccctgaaattgaaactactgctgctgcaacaacatcatcatcaaagaagagaaaagctgagtgggaggattatggtgccaacatgattggatttagtgggaacactgagaccagctctagtgatgatggctcacctaaaactcccaaggactgcattaaacctaaggtttctagggttcaagtccgcacaaatccttctgataatagcctgatagtaagggatggatatcaatggcgaaaatatggtcaaaaagtcacaagagataacccctgtcccagagcatacttcaagtgctcttttgccccaagttgtccggtcaagaaaaaggtgcaaagaagtgctgaagacccatcgatcttggtggcaacatatgaaggagagcacaaccaccatgagcaccaccgttctccacctgctgaaatatcattaaactccaacaacaacacccctagttccaacactggttcgggtcctgtttcatctgccccaaccaaagctttagcttccactgtaacactagagctgcttcaaccagctggtttgggcggcgatgaaaccgaaagggcagccctacaaatcgacgcaccagcaatccaacagatttagtcatcaaatggcggcttcttgagcagagacccatttcacggcagccctgctgcagcattcaggagagctgtgtagacggaaatagatgaaagtggtga

SEQ ID NO: 15825 - DNA, 550 bp, Gossypium hirsutum
  misc_feature (42)..(42): n is a, c, g, or t
  misc_feature (88)..(88): n is a, c, g, or t
  misc_feature (148)..(148): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (181)..(181): n is a, c, g, or t
  misc_feature (199)..(199): n is a, c, g, or t
  misc_feature (214)..(214): n is a, c, g, or t
  misc_feature (282)..(282): n is a, c, g, or t
  misc_feature (291)..(291): n is a, c, g, or t
  misc_feature (321)..(321): n is a, c, g, or t
  misc_feature (324)..(324): n is a, c, g, or t
  misc_feature (520)..(520): n is a, c, g, or t
  misc_feature (547)..(547): n is a, c, g, or t
  Predicted polypeptide sequence is orthologous to G922
tttttttttttttttttttttttctcaagctgccatcatgtnctcattaattgcttcctttgcaactcaaactccaacagcagcccanggaaatgaatgagatacatgtttaaaattttttctcaagtaactatagaatgaaaaagtntttcntntncatacaaattaaactacaatcaanggaagaaagaaagagacncctaggaggagggtncagggcaggcataaataaaatgagtcgtaatcctagcgtctaaacccccaggctgatattgaatatanaggtctttnttgccagcacataaccaaacacccattctnttntttcatcttataaccatcgtagttattggtctgcagcaaccttcctgcctgcaacatgccatggtagcttaatggcacccttccaaacccggccaattcaagtctcaggatccatttctccagcttttcatgtctctcctttctctcaccaccctcacatgctataatattcttaatttcctctccgaaaagcatnttctcaaccttttgtcgctctattggngct

SEQ ID NO: 15826 - DNA, 921 bp, Gossypium hirsutum
  Predicted polypeptide sequence is orthologous to G926, G2632
cccgggagtgagaggagtgaactcattaaattcatcttcgatggaatgcactaatgcatcagagtcgaatgatgggcagtcactgtccaatggtgcactaaatgaagaggatgatgttaataaagaaacacaaactactgcatcctctcgggcagttggaactggaggacaagaacatcacaatttgcagcatgttggatctagcatgcctgctgtgcgtgatgaaggcctcacccaacctcccctgcttgagcttgttggtcattcaatcgcatgtgcatcaaatccttatatagatccactttatggaggaatgatggcagcttatggacatcagcctatgggttatcctccgtttgttggaatgcctcatgcaagaatgactttgccgattgaaatggcacaagagcctgtttatgtaaatgccaaacagtaccaaggaattctcaggcgaaggcaggcccgtgccaaagcagaacttgagaagaaggttgttaaatcccgaaagccttatcttcacgaatcaaggcaccagcatgctttacgtagggcgagaggtagtggaggacgttttgcaaagaaaacagataccaatccaggagaagaaaaaggatcaggttcaggtcccacgttatcatcccaatctccaagttcctccggttctgaaccattacaaactgattccaacgaaacctggacctcctccctcacccagcatggcatccaccatgtcaacggcggcagccattatcagaagctaggtggtaacatctccaatcacgccgctttctatccggtgaatggaggacaatcctttcaaagctgatggttgactccagagacgttacagtcatggcatgcattagcgagcggcaatcattcttggctcgtatatggaagggagaagagattgtacgagac

SEQ ID NO: 15827 - DNA, 814 bp, Gossypium hirsutum
  Predicted polypeptide sequence is orthologous to G926, G2632
taaaaacctcttattaaaattttaaacatataaataaagataatttattaagcttgatagatttgtctttctctatgtctctgttatggttgcagagagagagccaaactgaatcaatctctaggcatttgcttctccaattccaatcttctttttctttttcttcttttactaataagtcgtgagaaatgccagcaaaaccagggaatgatgatcagcagatagaccatggggctcaaagtgtgttgcagtcaactgcctactctgaaccctggtggaaaggagttgggactaacccctttgttgaagctgcctcgaagtcgccttctgtagaacaactaaatggttcagtggcaaatggagctgtgcattcacaggctcatggggacttgggcaatgaagatgggagaaacggacaagatcgccaacatctcaaacacgttccttccacaacaccccttactttgggtgaacaccatgaaccaaattcccaaatggaactagttggtcactcgattgtcttgacatcatatccttattcagatcctcagtattgtggaatgctgacttcatatgggccacaaatgatggtgtcaccacatctatatggaatgcatcatgctagaatgcctttgcctcttaaaatggaagaggagcctgtttatgtaaatgcaaagcaatatcatggcattttgaggcgaagacagatacgtgctaaggctgagcttgaaaagaaagccattaaagttagaaagccataccttcatgagtcccggcatctacatgctatgagaagggctaggggttgtggagg

SEQ ID NO: 15828 - DNA, 372 bp, Gossypium hirsutum
  Predicted polypeptide sequence is orthologous to G927, G1334
gcttagcgtggtcgcggccgaggtactctacaagctgggagagtcactgaacaaggactgaacaaagggaatcctgctcacttcactatattccctggtgatggcaaatgttcaggggatggacaaaaatctccgaccgtcatatctctgcaatcagttccatcagaacagcattctcgctttgaactaggatgtggtcagccgcccatggtctgtgcaaaatatccttacatggatcaatgctatggagttttctcaacttatggacctccagtttcgggtcgtgttatgctgccattaaacatagcatcagaggatggaccgatatatgtaaatgccaagcagtacctgcccgggcggccgctcgaaagc

SEQ ID NO: 15829 - DNA, 856 bp, Gossypium hirsutum
  Predicted polypeptide sequence is orthologous to G928, G931
gtccactcacgcgtccgaacggaactcatgggaagcttgtaggaaatcatgctaaattagcctatgtaacgggaactcaggaccatgtctttcctccttcacaaggttatagaaaaccaatcgttcacattccacaccattatgccaacccatactttggcagtgtagcggctactgcttatggatcacaagctatgattcatcatgctcatatgatggctatgcttcctgctcgagttccgctgccactggatcttaaagaaggtgaaccgatttatgttaatgcaaagcagtatcatgctattctccggcgaagacaatatcgtgcaaagctcgaggcacagaacaaactcataaaagttcgaaagccgtatatgcatgagtctcgacatcttcatgcgataaaacgagctagaggaagtggtgggcaatttctcaacacaaagaaactccaatccaaaagcactccgacaagccacggaccggacatgtccaggtctcctcagctgcatttgtctgcaaacatctctgtaacagatgttcatcagccagaaaatttcaaagattctggttcagctaactcttgctctgatgtcacaagtgcctccaacagtgatgaaatatttcagcagccagatttcaggttctatagctatccttccggtcatactggtgaagccatgccgggtcatgctggtcatatcctgctctcttccgatagtcgagcgaactgattcttgtccacgcagtctgtattcgatgatgctgcaatgaaaatacggctgctctgttcctctggggagtcatccttggctctgtttattatatttggactgtcatcacagattgttacaaa

SEQ ID NO: 15830 - DNA, 344 bp, Gossypium hirsutum
  Predicted polypeptide sequence is orthologous to G937
accttgttttgggtggtggtcatgcatgaatgtgtcaagatcagtttggagaatcctcgaaagggagcagttcgcagtcgggtgcccttaagggcctctccagttagccacaaacaccggagggacctccactacatggtgtgagagcatggaagatgatgaagatgcaaaatccgagtgctatagttggaaaagccatgttcaaaaacccataaaaaacaatatatagagtttacccaccatgaattttgcagataaaaaaaaaaaagaaagaatgtattatgaggaaatcatttatctggagaaattttcatttctgaaaaaaaaaaaaaaaaaaaaaaaaa

SEQ ID NO: 15831 - DNA, 609 bp, Gossypium hirsutum
  Predicted polypeptide sequence is orthologous to G938
ggtgttgaagatgagccgaacttcgatgtgcaagagcgcaaacccaggactatcagttctaatatggtcatggagagaatgagggctatccaacaaccaccttattcgattaagggggaagttgttggtaatttggatttcacgcgaaagaggaaaccatccaatgatttaaacatggttgaacaaaaaatctacacttgtgagttcctccagtgcccttacagtgaatttcgtttgggttttcatgataggactgccagggacaatcatcaattgacttgtccatatagaaattcctctgcacagtttggtggttcgaatttcagtgttaatgaagtaaaaccagttattttccctcggcaattcggacaatccaagccagctgcaccgcaggttacatctgtctcaacaccctttgatctatccggacttggagttccagaagacgggcagaaaacgatcggcgaactcatgtcagtatatgataacaacattcaaggcaacaagaacatgaatcctagtaacaatcttgttaccaaaggtcaaaacgttcttcagccgaaaatacaacatcagcaagatgaattcttccgcggtcaaggagtcatt

SEQ ID NO: 15832 - DNA, 898 bp, Gossypium hirsutum
  Predicted polypeptide sequence is orthologous to G938
caacaggggaagcaagctaaagcagccaccccccttcccctttttctccaattattatctttattcatccattattctctctctgtgtctatgcttttgttcttctcatagtcttcttagtgttgcctaaatggcgtctttgagcttctttttcccttctggttaatggagtcctttggttattggatgatttgaggttatatcagttctaagttgtaacagatactagtagaaactcaaagcttcagtttgatttcggagatttcctcgagtttcggatttgttctgagtcctgtattggaacgatgatgatgtttgaggagatggggatttgtggggatatggatttctttggtgcttctttcggggaaaaggatgtgacggctgcttcacaggtcgaaatggatgcactagttgatgacgattatagtgatgaagaggtcgatgttgatgaacttgagaggagggtgtggagggacaaaatgcgattgaaacggcttaaagatcagagtaagggaaaggacggggttgatacagccaaacaacgccagtcgcaagaacaagcaaggaggaagaagatgtcgagggcgcaagatgggatattgaagtacatgttgaagatgatggaagtgtgtaaggctcaaggttttgtatatgggattattccggaaaagggaaagccggtaactggggcatcagacaaccttcgagaatggtggaaggataaagtgaggtttgatcgtaatggtcctgctgctattgcgaagtaccaggcggataattcgattcccgggaacaatgatgggtgtaacttgatcggtcctacaccgcacactttacaagaacttcaagatacaactcttggttctcttttatctgcactgatgcaacactgcga

SEQ ID NO: 15833 - DNA, 843 bp, Gossypium hirsutum
  Predicted polypeptide sequence is orthologous to G938
ccctctctctctctctctctctctctctctctctctctctgtctgaaaatcttctgtttgttgctgaatttacttctttcagctttttggaataaacccaaactgtgggtttttcctggcttatcttggaacaatgatgatgtttgatgatatgggaatttgtggggatatggatttcttcagtgctccttttggggaaaaagatgcggccacggcaacgttggcggctttgcgtactgaaccagaggccacagtggaagatgattatagtgatgaagagattgatgtggatgaacttgagagaaggatgtggagggacaaaatgcgtctcaaacgacttaaagaacagaacaagagcaaggatggggtcgatattgtgaaacagagacagtctcaagaacaggcgaggaaaaagaagatgtcgagggcgcaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggtttgatcgtaatggtcctgccgctattgccaagtaccaggctaataattcgattcccggcaacaatgatgggtgtaacccaattggtccaataccacacaccttgcaagaacttcaagatacaacgctcggttcccttttgtctgcactgatgcagcattgtgatcctcctcagaggcggtttcctttagagaaaggtgttcacccaccgtggtggcctactggtaacgaggaatggtggccgcatctcggattgcctaaagatcaagg

SEQ ID NO: 15834 - DNA, 943 bp, Gossypium hirsutum
  Predicted polypeptide sequence is orthologous to G938
caaggttttgtttacgggattattccggaaaagggaaagccggtaactggagcatctgacaatcttcgagaatggtggaaggataaagtccggtttgatcgtaatggtcctgctgctattgctaagtaccaggctgataatttgattcctggcaagaatgatggctgtaacaacattgggccaacgccacacaccttacaagaactccaagatacaactcttggttctcttttgtctgcactgatgcaacattgtgatccccctcagaggcggtttcctttggagaaaggtgttcccccaccatggtggcctactggcaacgaggaatggtggccacaactgggattgcccaaagatcaaggtcctcctccttataagaaacctcatgacttgaagaaggcatggaaagtgggggttctcacggcagtaatcaagcatatgtctcctgatattgccaagattcgcaagcttgtaaggcagtctaagtgcttgcaggacaagatgacagcaaaggagagtgcaacttggctcgctatcattaaccaggaggaggccttggcacgagagctttaccctgattcctgcccacctttgtcctcaggtggaggaagtgggtcttttgttataaatgactgcaatgagtatgatgttgaaggggctgaagatgagccaaactttgatgtacaagagctcaaacccgggcatctcaatacatctaatttcagcatggatacaatgagggctgtccaacaacaatcgtatcctattaagggagttgtcaataatttggatttcatgcgaaagaggaagccatccgatgatttgaacatgatggaacacaagatctacacttgtgagtcctccagtgcccttatagtgactccgcctgggtttcgtgacagactgccaggacatcatcattacttgtctttcagaactcttc

SEQ ID NO: 15835 - DNA, 519 bp, Gossypium hirsutum
  Predicted polypeptide sequence is orthologous to G938
tttcttcagatgctccacttgtgggaaaaagatgtggcagcctcacaaattgaaccagaggcgagggtggaggatgattatagtgatgaagaaattgatgtggatgaacttgagaggaggatatggagggacaaaatgcgtctcaaacggcttaaagagcagaataagtgcaaggaggggattgatattgctaaacagcgcctgtcacaagaacaggcgaggagaaagatgtgggggttctcacggcagaataagtgcaaggaggggattgatattgctaaacagcgccgatcacaagaacaggcgaggagaaagaagatgtgggggttcacacggctgtgatcaagcatatatgctcgttttctttagttttggaatgggtcagaagatttctttctgaccattttcaaattttttgatgttgtaaaactatataacatatggattatgatgtagaatttaattttaaccttttcttaatataagataattatgtttatgtaaaaaacaaaaaaaaaa

SEQ ID NO: 15836 - DNA, 868 bp, Gossypium hirsutum
  Predicted polypeptide sequence is orthologous to G987
cggttttcatctcattctcaaaatggtagtgctaataatgggaatggattcatgggatgtcctgcgagtgagtttttagttccaaattattttagtcaaagtgaattagcattgcacttcaagagggggtttgaggaagctagtaagttcctaccaaaagctaatcaactgaatgtcggtttcaagagcaatgcattgatttcagagttgaagcagaaggcttcaaacacggtagtcaaagtggagagtgacaggaaggagtgctcaccacctcgtttgatgagaaagaagagtcatgaacgagaagatgaagatttagaagagaggaataacaaacagtcggcagttttgggggacgagagcgagctatcagacatgttcgataaggtgttgatttgtgctaggagaagagggcagtcttcttcatccactgcggatgagactttgccgaatggaccaagcaagacgctgctgccgaatgagcaaacaaatggatccaatagtgggaaggcgcgtggcaagaaacagggtaagaagaaagtagtggatttgaggactctcctgatcttatgcgcgcaagctatcacttccaatgacaatgtgactgctaaggaactgataaagcagattaggcagcattcttcgccctatggtgacgggtctcagagattagctcattactttgttgacgcccttgaagcacgcttagctggcactggaactcaaatttatacctctctggttgctaaaagaatgtcagccgctgatatgttgaaagcttaccaagtttatatttcagtctgcccattcgtgaagtgcctattatttttgcaaacaactacatttcgaagcagcagagaaagcaaca

SEQ ID NO: 15837 - DNA, 870 bp, Gossypium hirsutum
  Predicted polypeptide sequence is orthologous to G987
ctttgactactcttcttcaccaccttctgggtttcctttcttctttgtttcatatatcatttctgggtgtccttcaattccttcatttttatcactctttcaataacccctttctcagccaattaagtttccatggatactacccttttccaagattttcccagttccatgtatgggttcaaactcgatcatggagcagtaccagtatattcaattcacgacttcgtcagtaataataatgggtttattaaagatagtcctccacaggttgttccgagtccagactcacctgttgagtcagggacaacaacgaattcagaggcacatccccttgacagcatcccttttgccaatgagatgctcaagtacataaatgagatgttaatggaagaagacatggaagaaaagacctgtatgttgcaggattgcttagctctccaagccgctgaaaaatcattctatgaagtccttggccatgaatatccactttcaacggatcccatccctgcatatacagatcaaaatggtggtagtccaggtgatttcaactcctctttgatccaaacatctcttgttgatactcttgaaaggacctctttgttcccagatttacaaagagggatccccccatcaatagagccttctggcagcagcttattagggtcaaagggaaggaaaaattatgaacgaggagatgttgatgacttggaacaaggtaggagcaacaagcaatttgctgtttcccttgaagattcagagcaaacagatatgtttgatgatgtactgctttgcaaaggtgaaaacgaggatgatccaaggtgttctcttaataagagttcgcaacatgtttggccgcagaaagggacatcc

SEQ ID NO: 15838 - DNA, 863 bp, Gossypium hirsutum
  Predicted polypeptide sequence is orthologous to G987
caaggtgttctcttaataagagttcgcaacatgtttggccgcagaaagggacatccaaaggtggaacagcacgcaggaagaacggcaagaaaagtgaggtggtcgatctgtggagtctcctcactcaatgtgcacaagctgtcgccattaatgaccaaaggaccgcaaatgagctgttgaaacaaataagtcaaaactcttctacaactggagacggaacccaaagatttgctcattactttgcagatgcacttacgacacgtttggctgggatgggggcaccatcgtattcaccattggtaagcaataggacgtcagctgctgatatcttaaaagcttacagagttcttgttttagcttgcccttttaagaaaatgatgcatttctacgcgaataagaagataatgaaggttgcagaaaaggcaaccacactccacatcgttgattttggcatttgttatggttttcaatggccttgcctcatacagcgtctctcagcaagagctggtggacctcccaagcttcgtattaccggcatcgagttcccacaaccgggattccgaccagctgaaagggttgaagagaccggacgtcgcttgaaaagatattgtgagagattcaaagtcccatttgagtacaatgtgatagcaaagaaatgggaaaccatccaactggaagaactaaagatcaagaaagatgaagttgtcatcgtgaactgcatgtatcggctaaagaacctccccgatgacacactgtcaccaaccagtgcgagggacattgttctgaaactgatcagaagcatcaacccagagttttcatccatgggatttcaaatgggacttataatgctcccttctttgtca

SEQ ID NO: 15839 - DNA, 890 bp, Gossypium hirsutum
  Predicted polypeptide sequence is orthologous to G989
ttcaaagcttagttcctcaatctccaatcagttccaacactactagctctaatcctagctcctccatgaagtcaaagcgcgtcgaaagagacgtctccgcagctaccggcgaagattccactgctgatgatccttccaacaagcgtcctaactactcctccggcgacaaagcagctgccgccaatgaacatgacgaaacggtgatagaaggtgagtctacagggttaaggcttttaggtctcctgctccaatgcgccgaatgcgtcgccatggataacctcgaggacgccaccgatcttttacctgaaatatcccaactctcttctccgttcggttcatctcccgaacgtgtcggcgcgtacttcgcacacgctttgcaggcacgcgtggtgagttctagcttaagaacctattctccactggataacaaatcactgaccttgactcagtcccaaaagatcttcaatgctctgcaatcttacaattcgataagtcctttggtcaaattctctcacttcaccgccaatcaagccatcttccaagcattgagtggtgaggattgtgtccacgtcatcgatctcgacatcatgcaaggtctccaatggccaggattattccacatcctcgcctcccggtcaaaaaagatccgatcgatgagaatcacggggttcggatcctcgtcggagctcctagagttgaccgggaaaagactggcggatttcgcggcatcgttagggttaccattcgagttccatccgctggagggcaaaatcggaaatttaacagatctgagccaactgggagtccggtcaagtgaagcggtggtggtccattggatgcatcattgcttatacgacataacggggagtgatttggcgacgttgagattg

SEQ ID NO: 15840 - DNA, 550 bp, Gossypium hirsutum
  Predicted polypeptide sequence is orthologous to G1017, G2567
ttttttttttttttattccaacatgatgcgagcaccatttcttccataaatatacagtttctaggactgggatttaataaacatgacaaaggacatagatcctttttatgtggaaagaaaaattcgagttaaccaacaaaacgtggttttacagttccatcaaaagtgggtcaagtggagatttctcacaactaccgtagaagaaatgaaaatcggaaaccgacggctgggaaaactgtacaattggcgcaaattcatctctctatctttctaagtgtcactgcttgaatccatgagaatcgttagcctccttgctgtcttcataaactcgctgaagggctcatctccaggtgtttttaactgaaccggcagcatcgcggtagagcacacgtgctcagcatctctgaactttctatgccaaacatgttggccagcttcccaaacagctcttcatatgatcccagaactgaaagatcaagggttctacctacattctctgattccataaacacttggcaatgaccagtctccaatcctagatcagtttttg

SEQ ID NO: 15841 - DNA, 852 bp, Gossypium hirsutum
  Predicted polypeptide sequence is orthologous to G1017, G2567
cttccctcaaggccacgccgagcactcactcgcagccgtcgatttcccctcgtctccgccggtcccggctctagttctttgccgagtggcttcgctcaaattcatggcggataccgaaaccgacgaggtatacgccaagatcctcctcatgccgttacccaacacagagctcgacctagaaaacgtcgccgttttcggctccgataacgcggagaagcctgcttctttcgctaagacattgacccaatccgacgccaacaacggcggtgggttttcggtcccgaggtactgcgccgaaaccattttcccgccgttggattacacggaggaccctccggttcaaaccgtcgtcgccgtggatgtccacggcgaaacgtggaagccaggcatgctcaatttgggttatctttatccgatctccatcttaataataaactgcaatccggactttttctgcccagtttccagcggttcgatccccactctagaatttccgatggcatcatgatggcaaggcgccctaatggtactgataatctttcttgcttgttaacaatcgggaattctaatgtgaatgagaaatctggcaacacaaaaagacaccagtttttactctttggtcagccgatacttactgagcagcagctctctcgtagctgttcaagtgaagttgtctcacaagttattaacggaaatagttcgttagatggcagtgccgaaaaaacaaaagatacttctgatggttctcgatcttctcttgagaagtcatctactgctggatttttgtggcaccaggattatagaagcgcggaaactggccacgatattggccattgcaaggtattcttggac

SEQ ID NO: 15842 - DNA, 621 bp, Gossypium hirsutum
  Predicted polypeptide sequence is orthologous to G1020
gaacccgagaaaaaaggcccgagtctggctcggtaccttcgacactgccgaggaagcagcgcgtgcttacgacgcggcggcacgagaattccgtggcgcctaggctaaaacaaatttcacctacactaacatcaatgacttcacgctaagccccagccagagcagcaccgtggagtcctcttctccgccgccgttggacctcacactcgctagcggatctatttcgctccccatgacggcgaatcatccggtgtttttcgttgatgtctttgcttccgccggtaagcgtctctccgatgccggcggagcccagagcgattcagattcctcgtcctcggttgttgattttgaacgaggggtgcaaccgagagtgtttgaatttgatcttaatcagttgcctgctgagatgatctgaattcttttccccgtttgtaccggatgtcgttttaagcttcggttttctgcgttttttgctttcctcttttatggtaaaagctgacatgtaacgtgtataaaagaaatgtaactcttctagggacctatttttagcaacttgaggaaatttcgaatttcctcaatgttgtttctacttacttataattgaagtatttccttttcttt

SEQ ID NO: 15843 - DNA, 823 bp, Gossypium hirsutum
  Predicted polypeptide sequence is orthologous to G1020
agaggagtaaggaagcgtccatggggtcgttacgccgctgagatcagagatccagggaagaaaagccgtgtttggcttggaacttttgatacagctgaggaagcggccaaggcctacgacgccgccgccagagaattccgcggcgccaaggcgaagactaatttccccctccctggtgaaattctcaacaatggtagtaactgtaacaacaatggcgataccaactgcaacaacaacaataacaaccacagccctagccggagtagcaccgtggagtcatcaagccacgagccgccgacactcgtcaagtgttcaccgttggatctcaatctcggacacgctgcggtcaccgggtacggatctcctgcggtcaggcttcctttccctcaaatttcgccggtcgccggttttttcgccaacggcgtctcggcagttgcagccccccaagttttttacttcgacgctttggtccgacccggtgttatgaaaggacagcagtatcaacaacggttgagattcgatcaccgtgattatcacgaaacttttaacgctggtgtacaaagcgactcagattcatcctccgtcgttgatttaaaccaccacgagatcaaacggcgaccgcttctcaatatcgatctcaaccaacctgctccggaagtcgcctgattatgattttttaaaatcgccgatatcaagaaccggaaaagaaaacccacaaattttcaattttatctctttaaatcgttatcttcttttagtcccaattttgaaattagacgagaaatatacccaaaagaattacgcgagagcgcgtaaattgtga

SEQ ID NO: 15844 - DNA, 922 bp, Gossypium hirsutum
  Predicted polypeptide sequence is orthologous to G1020
ttcgccctcctccattctatctcaaccccacacataaatccccttttaccaaaggagaacattaaaacatcgccctactcttcgttttcttcaagcggaaaacaggaaactgaggctttcccttctcaaatggcaccgagggagaaaacggcggccgtcaagggtactgggaataataacgaggttcattttagaggagtaaggaagcgtccatgggggcgttacgctgctgagatcagagatccagggaagaagagccgtgtttggctaggaacctttgatacggccgaggaagcagccagagcctacgacgccgccgctagggaatttcgcggcgccaaggccaagactaattttccggtcccttgtgagaatctcagcaaaggtaataactgtaaaagtaatggtaacaacaaccaacatagccctagccagagtagcaccgtggaatcctcgagccgtgagccggcgctcatggttgactcttcgcctttagatctcaacctcgtacaaggtgaggcggttaccggttacgtgcctacggctgttagatttcctttccagcaagcttcaccggtgccatatattgcgggccgcaaagttttctactttgaaccattcgttcggcctggtgcagtgaaaggacacccatttgaacggtttggattcgatcatcatgatcttcatgcgacgtttaatggtgtacaaagcgactctgactcatcatccgtcgttgatttgaaccaccatgaggtcaagtcgcgcccgcttctcaatatcgatctcaaccaacctgccgttccggaaattgcctgattttttttttaatattcgcagatcgtcaaagaggaaggtcaaaaaaacgagttttttaaattttcgttgtttaaacatatttttcttagcagtcccacgaaatatc

SEQ ID NO: 15845 - DNA, 855 bp, Gossypium hirsutum
  Predicted polypeptide sequence is orthologous to G1020
ggcacgaggttcatctcactactgttcaagaaaagttacttaaagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggttcgggttgccccgcatccggattcgctcaaagcgactccgattcgtcgtcgtctgttgtagattttgaaggaggagtgcggcggagagtgtttgatcttgatcttaaccagttgccagctgaaatggattgatttgcctccttttttcaatatgtcgttttcagcttcaattctcagcgttttgggctttcctctttttttatttttcccttaatttttgggttaaaatttaaaactgacatgtaatgtatgttgtgtgtaaaaaaaaaattgtaactcctagagatctatatttttggcaacttgagaacattttctcaatgttgtttcccctttattataattaaaaaaattaataacataaattaaatgctttttcataaaaaaaaaaaaaaaaaaa

SEQ ID NO: 15846 - DNA, 475 bp, Gossypium hirsutum
  Predicted polypeptide sequence is orthologous to G1020
ctcgagcggggcggccggggcaggtgcaaagcgactcagattcgtcctccgtcgttgatttaaaccaccacgagatcaaacggggaccgcttctcaatatcgatctcaaccaacctgctccggaagtcgcgtgattattattttttaaaattgccgatatcaagaaccggaaaaaaaaacctacaaaatttcaattttctatctttaaaatcgttaatcttctttttagtcccaaatttggaaaattagacaagaaattatacccaaaaaaaaattacgcgaggaggcggcgtaaattgtggaatacgtagatgaaaaacctcccttttttgcagcagagaaacgttagtttgtagtctgttgtttcatattaatttctggtaattcttttttattttcaatgaattaattagtaattacgaggaaaaaaaaaaaaaaaaaaaaaaaaaggcttgtacctcgggccgcgaccacg

SEQ ID NO: 15847 - DNA, 550 bp, Gossypium hirsutum
  misc_feature (507)..(507): n is a, c, g, or t
  Predicted polypeptide sequence is orthologous to G1023
agaaataatagaaaataaaaacttcgttcgctgcaaatagacaaatatagttgtcttaacatgtgaggatgagcagccaaaaattaaaaaaatcatctaaacacttttctcagatagcttaatcccttggatggctctttagcacaagaaaacccaaaggatttttcgtcgctcattcctctcaactcaccaaacaaatcatttcgactcactcacaaaaattgaactacccaataacccatcttggagagccccccaagtaccttcaactttgactaagaactcatgacaacaaggtttatattattaaaccactactactattacctaaccgcaaaacttatgggcacaaaatgttgaggggggctacttttttgcaaaaaatcgaagtcatcagtgctaaaatcacaatcaggtagttcactgggttcatttccttcgatcccacaaatgctcaggtcttcaatgctgcaataatcctccaaaatcacccgagaatcattgacnaaaagataatcggatggctcttcatctaagttcagctcttgtc

SEQ ID NO: 15848 - DNA, 803 bp, Gossypium hirsutum
  misc_feature (743)..(743): n is a, c, g, or t
  Predicted polypeptide sequence is orthologous to G1023
gcggccgtcatcgacatgcaaccgattcatcttcaagtgaagatgaatccgagggaagtgctgctagaaaggctccaaggggaaggcgttttgttcgtgaaattagagttcctgttttaggcttggctcctcaggtaaagcctcttgaatccgagacatcttcacaagacagtaactctaaaacccctactagcaggaaaagggttttgagtaaaacccttgaagacaaacctctggtggctaaaaccaaaaaacctgttggggttcgtcaaaggaagtggggcaaatgggctgctgagatcaggcatccactcaagaaaaccaggatttggttgggaacttacgatacccttgaagaagcagccaaggcttatgaagctaagaagctcgagtttgaggctctcactgttgctgccgccgcctctgcttcatctgataaaaccaacgacctttcatgttctgcagctgcttctcacaacaacactgttccctctgcttcagaagagtctgagagccttgtatcgcatacttcaccatcctcgatgcatgagttggatacttctgcatctgtttcagtctctaataacaatgatgattgcggtgatgccaacaaagaggtgttcgatgcgaactttgctgatataccgatacctgacctctgtttcattgatgatccattgctatctggctcagttggacaagagctgaacatagatgctgaggctgctgattacctgtttgtncacgattttggtatgatgttggaagattattgcagcattgaggacctaagtatttgcggg

SEQ ID NO: 15849 - DNA, 807 bp, Gossypium hirsutum
  misc_feature (483)..(483): n is a, c, g, or t
  misc_feature (517)..(517): n is a, c, g, or t
  misc_feature (549)..(549): n is a, c, g, or t
  misc_feature (563)..(563): n is a, c, g, or t
  misc_feature (595)..(595): n is a, c, g, or t
  misc_feature (625)..(625): n is a, c, g, or t
  misc_feature (755)..(755): n is a, c, g, or t
  Predicted polypeptide sequence is orthologous to G1033
ttctgttctctttcttcccccctccccctttcacatcaaccctaaccctacctcaccaatcaggatacaacatgaagggaggtaaatccaagtcagatactaagggctctaggctcgccgtgaacaaaaaatctagcgccaaagctggaaagaaatcggggaaggcggctaaggatccaaacaagccaaagaggcctgctagtgccttcttcgttttcatggaggagttccgtgagcaatacaagaaggaacacccaaaaaacaaatctgtcgctgctgtgggcaaagctggtggagataaatggaagagcttgtctgatgctgaaaaagcaccttatatagcaaaggcagagaagcgaaaggtcgagtatgaaaagaacatgaaagcctacactaagagacagactgaggctcccaaagaaaaaaatcggagtctgagaagtcagtgtctgaggtgaatgatgaggaagatgaagacgatgnaaaaagccgcggagaagaagaaaatgatgactancaaagaaggaagacttgttggaagagatatancataacaagtatangctggtgcttaattggttatatgttaatgctnttgatgttcccatgttattctctctaaatnggcatatgcatgttcatttaagggaaaaaaaaattgtacctcttaatcttctgattttctttccaacgtttaatagattaatagcctcaaaaatgttcctttgattccaacgtcgaggaatggcttgtanacatatccttttagatgataacttgatgccttatttagaaaaaaaaaaaaaa

SEQ ID NO: 15850 - DNA, 836 bp, Gossypium hirsutum
  Predicted polypeptide sequence is orthologous to G1033
ttttttttttttttttttatcggactaattctctacaaaaggatttatctaagccattcaactttaaatcaaaaagtacatatagaagcagattatcccatctacaactattaatttcagaaggtcaaaaggaaccaacaggattcagaggtacatttctcccttagatggcatgcgcatctaaaagaataacatggaaacatcgaaagcattaacatatggttttgatcaaacactatcacagcctacattgattatgctatccaccacggaccttcctactcatcatcttcttcgtctccgctgccttcttcatcatcatcctcatcattcacctcagacactgatttgtcagactcaacatcttcgtctttaggaccctcagcctgtctcttattgtaggccttcatgttcttttcatactcgacctttcgcttttctgccttggctacataaggtgctttttcagcttcagacaagctcttccatttatctccaccagctttgccgacagcggcaacggatttgtttttagggtgatccttcttgtattgctcacggaactcctccatgaaaacgaagaaggcactagcaggcctctttggcttgtttggatccttggcagccttccccgatttctttccagctttggatttcacggatagcttggcactcttagtatctgacttagattttcctcccttcatgttgaatcctggttggtgaggtagggttagggttgaaaaaagagagagaaaaggggaaacaaaggagagatatgagattggggattgaggattgaggggtgagttgaaaggccgaaaggcggagatatt

SEQ ID NO: 15851 - DNA, 550 bp, Gossypium hirsutum
  misc_feature (7)..(7): n is a, c, g, or t
  Predicted polypeptide sequence is orthologous to G1033
aatatcngactttcacatcaaaacaattagtcgtgtgaacatgtccaaagaacatatcaaacagataaaccatatcacgcaaaaccactaccacttcaggaagcgataagcataaccacacgcacaaaaagaagaaaaaaaaaccccttagtcattcatctttaagagaaatttaagtacaatatccatgaaaaaagttactgcttcaactaacccgtttatatccttctcttacctaatctaaaagtacgactgttggatatcaatatcaagtcaactgttcatctctaagtagcaaaacaattcctgaatcaatctaaccacttctgcaaattagttcatctagtcttcatcctcatcctcatcctcttcatcctcgtcattgacttcagactttgacttgtcagattcatcatcgtttcctccgccagccagcttcagactatatgcctgcatcttcttattgtattcacttttgcgcttctctgccttctgtacaaaaggagctttctcagcatctgtcatgcttttccatttttctccaccagct

SEQ ID NO: 15852 - DNA, 834 bp, Gossypium hirsutum
  Predicted polypeptide sequence is orthologous to G1033
gcggccgcgtcgacattctcaacacatctctatttctatcgcacttttattcccctattcctctctccctctctcatccgtaactctaaccctagccctctatcaggtatttccccgtcgatttttatcgaatttccacttctttctatcgatttcatctgctttttcactcatctgcgatttcatttgcaggattcaaacatgaaaggaggtaaatccaagtcggatgccaagagcgccaagctctccgtgaataagaaatcaaccacgaaagctggaaagaaatcggggaaggcagctaaggatccaaacaagccaaagaggcctgctagcgccttcttcgttttcatggaggagttccgcgagcaatacaagaaggagcaccctaaaaacaagtccgttgctgctgttggcaaagccggtggagataaatggaagagcctttctgaagctgaaaagcgaccttatgttgataaggccgagaaacgaaaggtcgagtatgaaaagaacatgaaagcctacaataagagacaggctgagggtccccaagaagatgaggaggaatctgagaagtctgtatctgaggtgaatgatgaagaagaagatgatgatgaaggcagtggagacgaagatgatgagtaggaaaaatccagggaggatagcataatcaaactaggctgtgatagtgtttgatcatcttatgttaatgctttttaaatgcaaatttcatttaagcaaaaatgtaactctggatgctgttggtttcttttgacgtttcgaaattaatagttgtagatgggtaatttgttgctacatgtactttgcatttgaagt

SEQ ID NO: 15853 - DNA, 629 bp, Gossypium hirsutum
  Predicted polypeptide sequence is orthologous to G1033
ctcctaaggaccccctcacaaatatcttctttgctttgctttagttagtgttctcttttctgcaattctctgttttttctacatttcttttccattgaagaggaagctgtcttgtaagaatgaaggcaacaaggggcagagaagatgcaacaatgaaggacaagaaggaagcaaaaaagcctgctgagaacaaggtcgtcggtaagcgaaaagcggcgagccgggccgataagagtgaccgaaaacgcgcaaagaacatagcatcatcgaccaacaaggacccgaataaaccgaagagacccgccactgctttctttgtgtttatggaagagtttaggacaagttacaaacaagaacatcctaaagtgaaggctatctcagctgtgggcaaagcgggcggagagaaatggaagtcgatgtcgaatgcagaaaaagctccgtacaaagtgaaagcaacggaaaggaaatcagaatacgagaagctcatggcagcctacaacaagaaacaagaaagttcagatgatgaggaggaagctgagtccgaatcatcaaaggatgatgaagaaagtgaggacgatgattgaatccaggatggttttggattaggttctgtaaatgaaaccatgttt

SEQ ID NO: 15854 - DNA, 871 bp, Gossypium hirsutum
  Predicted polypeptide sequence is orthologous to G1043
caaatagggaacatggcttataatattaactgtacaaagaagccaaagttttactaagcaaaatcagggtcatcaaactgcaaaccattttcaagctcaacaggttctaaatccaaacaagtgatttcagtgcatgaatacatgttggacaccacatcagcttcaaaaccaacaccacccatcattacatccgtccacatggtcatcgaatccaaatccgtaacatcgcttggtgtcgtcgtttgttcctcagattcgagttttgatatcagactcagacggtcgattcgtggtgtagccatggatgagtactggcctctgcaagtgtgggtaccaatgtatgtgatgtggtacatttgggtatcatcttccattctttgaacttgtttgatagcactacagccttgatcatgcttgtgactgcacctaaagtaactccttggatgtttagaatttaagatatttttttgtccatatttcctccatgcatgcccatcttctattttatcagacaccactgtgcttgtttgagcaaacctctttctcttgtaacagcccctcttatccttggcgaatgctgaaagtgatctcttgctgctctcactagaatcttgagacttacaatcatcattacaagttgcctgattctgggaaatcacttcatcatgatgaccagcttcagctagcatagaaattgtttgattaaatgaccacaagatcttttgcacaagctcctcagcttgttgagagggcttgttgttctggagtacaataacttgaagctcagtagcacactgttgaccttccgcaagttgttgtattacccttttcttgttgcttgatagtgtttcaggttcaggccatggataaa

SEQ ID NO: 15855 - DNA, 861 bp, Gossypium hirsutum
  Predicted polypeptide sequence is orthologous to G1043
gcggccgcgtcgacctccgctgaggaacttgtgcacaagatcttcgcatctttcgaccacgcactttctttgctgactgctgttgaatctgctgaggattctcagaatcaggcaacttcctacgatgattccccttgttgcaatggcaggtctgaagattccactaacagcaggaagaaacttgcttctaaggaaaagagaggatgttacaagagaaggagagatgaacatgcatggacagtagtttcttcaaccgtggaagatggtcatgcatggagaaaatatggacaaaagcagatccttaattctaagcacccaaggagttactttaggtgccctcgcaagtacgatcaaggttgtagggccactaaacaagtccaaagactggaagatgatggctcccaaatgtttcagaccacttacattggaacccatacctgcagaccagactcattcaaggctccccaaatcatcatagattctgaacctcgggaatcttacagcaagttcagttatggcagcagcaaccccaaaatgccaaccaaaaagctgcacgaaatcactccacctgtaaagcaggaaaccaaagaagaaacaccaacaacaagtggtcttacagacatggattctgttgtgatgtggaaagacataataggtgctgaatacggggatgtggcctctaacgtgtatacgagcactgaaatcacttcccagaatttggaactggaccttgtaattaagcctgtagagttcgaagacgattttcagtttgatgaaagtgagttcgtctagtcatcatcatattaactgtatctacgatagtttgtaatcagtaatgtggaataataataataaccattg

SEQ ID NO: 15856 - DNA, 977 bp, Gossypium hirsutum
  Predicted polypeptide sequence is orthologous to G1048
caaagttcaaaaggtgtttgtttgtatattctgatcggttcaatttcatgtgtcactcactttcctttcccatcttaaacatgctccctcctctgtaaatcctattagacgtcaatttcccctttcataaatctttgggttttcatggaggaaatcaattgggatacccttctgctcgaggttgacttacccgatttcgggaatatcttagataatgaaccggtaacggaacctcctcctcaaccttgttcaacccagaatcccgatgaagaaccggcggtgtcttcgtggatcggggcgatcgagaaggttttgatggaggatgataattttgatcctagggttgagactcaacctgtctccgatgatgatttcttggccgatttactggttgattcacctcctagtagcggcggcgatgtggctggcgtcgacggtgctgatttgcacaaacagagccagacccacaccgacgtcgataaagacgatcccattattaagaaacagagaaggcagttgagaaacagagatgcagctgtgagatcaagggagaggaagaagatgtatgtcaaggatcttgagatgaagagtaggtatttagaaggggaatgtagacgactgagccgtgtgcttcagtgcttcattgctgagaatcaagctcttcgtcttacgttgcataagggttgtgcatttgatgcatcctcggccaagcaggagtctgccgtgctcttgttggaatccctgctgttgggttccctgctttggttcctgggcatcatgtgcctcttcaccctgccaatactgcccaagtcagttctggaggcagttccaatggcaaacgaggaaacacaagtcccgaaagagtggctccaagaggggcaggagtaaccgggtcggaccatcttttgtgagagtagagatgcaaggcgtctaggggaaagatgaaagaaatttcatgttttatgggaattttaatt

SEQ ID NO: 15857 - DNA, 804 bp, Gossypium hirsutum
  Predicted polypeptide sequence is orthologous to G1048
cagaatttcttggaagcctgcctgcctgcctgcctgagttttctcttttaattcattcaattcgaataaaattcaagcacctttgtaaattgtacatgatttctcttttcttcttcctctgcttgtaaatatttgataaaattgcaactttgtttgccttattctttgggtaatcatggaggaaaccaattgggaaagcctgttgtttgagtttgactgtcccaatcttggaaatatcttacaaaatgaatcagaatcggtaactccaccaatctccacccactctcccgatgaaaaaccgatttggacatcctccattggtgagatcgagaagcttttaatggaggacgatcgttttgatgacaaggttgagactcaacctatccccaatgagtttttggcggatttattggttgattcatctcctagtggctgcggcgatgaggtcatcgatgatactgcttttgacaaacaaaaccagacccttttcaacgttgataatgatgatcccattgataagaaacagagaaggaaattgagaaatagagatgcagctgtgagatcaagggagaggaagaagatgtatgttaaggatctggagatgaagagtaggtatttagaaggggaatgtaggagactgaactgtttgcttcaatggtccattgcggagaatcaagctcttcgttttactttgaaccagcgttgtgcatttgatgcttcctcggccaagcaggagtctgctgtgctcttgttggaatccctgctgttgggttccctgctttggttcctgggcatcatgtgcct

SEQ ID NO: 15858 - DNA, 911 bp, Gossypium hirsutum
  Predicted polypeptide sequence is orthologous to G1050
gtttgtgtatatgtgtgtgagaaaggtagcagtatagcacttgttctttgtttttaaggaaaaatgggagatagtgaagaaggtaatactgatttgatgcaaaggattcaatcatcatttggaacatcatcttcttcgattcctaaacaagttttatcaatgaatcatcttgaaatacctccactgaaccctaatcaaatcagggctgttaggcatttctctcattttggacaaaactttaacggcggcggcggtggaggtggcggcggtggtgatggtaataaaagagttggtattcctccttcacaccctaaccagatcccacccatttcgccttattcacagatccctgtgtctcgtccatcgagccatcaaatgggttcttctcagggttttagtcccggaccgactcattctcggtctttgtcacaaccttcgtcgttcttttcgttcgattcgttgccgccgttgagtcctgcgccggtgagccaaatttcgaacgatgtgtgtatggaagattcgcattcgttgttaccaccctcgccttttccaaaggcgagttctcctcgggttggagaaagtttgccaccacgaaaatcacataggcggtccaatagtgatattcctttcgggtttaatacggtaatgcaatcttcacccccaccgttaaggggcagcggtttcgagaattcgggtgtgcctaggccagttcagttggttaaaaaggaaacgagttgggaaagaggtattgatggtaacgttgaaggaatgggtgagaggaaatcggaaggggaagtcatggacgatttgttttcggcatatatgaatttggataacatagatgcattaaattcttccgaggataagaacaacaataacgagaatcacgaagatttagatagccgagcgag

SEQ ID NO: 15859 - DNA, 945 bp, Gossypium hirsutum
  Predicted polypeptide sequence is orthologous to G1050
gtgaaattaagagagagaaagcgcctgccgctaaattcggcggagattttggtggtgttgccaccttgctaacttgcacctccgctgccccatttgtttttttgctaaattacgccggacggccattgtttttgctcatttctttccccttgctttgacctataattacaagattctggtgagtttgatttgctcatattgttgttgtttttctgttttggagtgaactgggttaagcttttaattgtccaaagttttcatctttttgagtttttgtgtcatcattgtttgtaagaaagaaaagaagaaattatgggtgatggtgaagaaggtaacactgatgtgatgcaaaggattcaatcttcatttggaacatcatcatcttcaatccctaagcaacctttatcgatgaatcatcttgagatacctcagttgaatcctaatcaaatcagaggagctgctagacatttctctcattttggccaaaactttaacggcggtgctgctgctggtaccggtgatggtgctactaacaaaagagttggtatccctccttcacaccccaaccagatcccacccatttcaccttattcgcagatccccatgtcccgcccttcaaaccagcaaatgggttctcagagttttaactcgggaccaactcattcgcggtctttgtctcagccttcatccttcttttcactcgattcattgccccctttaagcccttccccgtttcgtgattcttcatccatggcagtctcagaccaagtttccaccgatgtgtcgatggatgaaagggatgcagctgcttcacattctttgttgccaccgtcgccttttcaaaggcgaattctccacggcttggggaaagcttgcgcgcgaaatcgcatagcgctcagtagtgatattccgttgggttatacgatatgcaatttcgcgctctat

SEQ ID NO: 15860 - DNA, 659 bp, Gossypium hirsutum
  Predicted polypeptide sequence is orthologous to G1050
accctgcaactgaatctaccacattatcggcccaattaacacttctacagagagattccgttgggcttaccaatcagtacaatgagttgaagtttcgtattcaatccatggaacaacaggcacaactccgtgacgctctaaacgaaacattaaccgcggaagtccatcgattaaagcttgctactcaagaactaggcggcaattctgatccatccaaaggcatggtctcgcagcagcttcccattagccgccagatgttccagctacaccagcaacagttccaccagcaacagcagaacgggaacacagctgcaaaatccgagtcgaatcagtagctcccaagtcccggcatttgtaagatttgaaaaaaatcaccgtatgcctcattatttcataacttcatctgcatccattcattggtttctgatttccaagtttgacgagtttcatggtcgtggtaaaatcacggttcaacctgcctcaggtatccatctcggataacggaataaagtaatatatatagcttaaacaattatatatcatatatagctatagttctttacttatttatggtagataaattatattggaatgtaagcagcaagtttgacatgatttgttgcattgacaacacaaaatattggctttctctttgtttg

SEQ ID NO: 15861 - DNA, 965 bp, Gossypium hirsutum
  Predicted polypeptide sequence is orthologous to G1051, G1052
atcattggcttcaaaggacttatatcatatgatgttggtgtttgggtttgggtttgggggtttgagttgatatatgtgtgtcgtgtaatatttttgtgtgtttggttgtatagttagttgttggttagtttaagattagctttgtttttcgtgctctttttatttatttatatatatttttgagtttttggggtttgtgacattggcgtagaatggcacaattacctccaaaaatacccaacatgacccagaattggccttcttttccacatcaaagattgcctacaatggcaaacttcatttccaccactgccaacaccgccactatgaacgcctcccacaaccaccagccttcttgggtcgacgagttcctcgacttctcctccgcacgccgcggggctcaccgccgttccattagcgactccatcgctttccttgagcaaccattggtggaggaatgcagggactccaacaccaaccacaacaacaatgccatgataacggaaaccaatgtgttcgatcgtctcgacgacgaacagctcatgtctatgttctccgacgacgttgccgtcaccatggctgctgcaccgacgttatcctcgtccaacccttccactccgacgtccgatcaaaacagcaacaatgacgagaaaccagtgccgtccctggatctgcagcagcccaagaacgaaccaggagaagtcgagagctcatgcaaacctgaaccacaagctgctcaacctccatcaacctctaatggcgatcccatcgttgatcccaaaagggttaagagaattctggcaaaccggcaatcagcacaaagatcaagagttagaaagctgcaatatatttctgaacttgaaaggagcgtcacaacattacagactgaagtatcagcattatcaccaagggttgcattcttggatcatcaaagactgattctcaatgttgacaatagtgctttg

SEQ ID NO: 15862 - DNA, 918 bp, Gossypium hirsutum
  Predicted polypeptide sequence is orthologous to G1051, G1052
atggctgaactacctcctaaaatacccagtatctcccaaaattggccttcttttcctcatgacaagatgccttccatggcaaacttctttccctccaccatcaccaaccacccttcatgggtggacgagttcctcgacttctcctccgcccgtcgcggcgctcaccgtcgttccatgagcgactccatagccttccttgaacaaccattggtggaggaagaatgcagggactccaatgccatgcccatgatgactaccacgacggtatcaaatttaaatatgttcgatcgtcttgacgatgaccagctcatgtcgttattctccgacgatgtcgccgtcaccatggcagcgcctgctccaacggtatcttcgtccaatccatcgacgccgacgtctagcaacaatgaggagaaaacagcaccctcaacggatctgcagcagcccaaaaatgaaccaggggaggtcgagagcacacgcaagctatccgcctcagaagctccaccatcctccaacggcgattctatcatcgatccaaaaagggttaagagaattctggcaaaccggcaatcagctcaaagatcaagagtgagaaagcttcaatatatttcacaacttgaaagaagcgttacaacattacagactgaagtatcagcattatcaccgagggttgcattcttggatcatcaaaggttgattctaaatgttgacaatagtgctttgaaacaaagattgctgctttggctcaagataaaattttcaaagatgctcatcaagaagcattgaagatgaaattgagagactaagacaagtctatcaacaacaacaaatctcaagaacatgaacaccacaaccaccaaccgccatgcactaccatcacacaacacaaccgcctccgtcatccgcacgcacaaatgaaga

SEQ ID NO: 15863 - DNA, 1432 bp, Gossypium hirsutum
  misc_feature (1333)..(1333): n is a, c, g, or t
  Predicted polypeptide sequence is orthologous to G1064
aaaccattagagaaacaacttactactttgatgctatcatggaaggaggaggcagtgatgatcatcaccaccaccaccacagccaccaccatcaccaccaacaaccactccaccatcatcatcatcaccaccaccgccctactttcccattccaattactagagaagaaagaagaagataaccaaccttgttcctcctcttcttcccttcctttcccttccctaccggtttcatcttcctcggccgatcaacacacctcgactcgttccatttcaacccaccagatctcgccggaaacttccaagactccaccgcctaaacgtacttcgactaaagaccgacacaccaaggtagatggacgtggtcgtaggatccgtatgccggctctttgtgcagctagggtttttcagcttactcgcgagttgggtcataaatacaatggtgaaacgatcgagtggttgctacaacaagctgagccggcggtgatcgccgctacggggactggtaccatccctgcaaacttcacttccctcaatatctcactccgtagctccggttcaagcatgtcggttccttctcagcttcgttcctcgggttttagctctaacttttctatgcaacaacgtagaagcttgttccccggaatcgggctcgaaacgacgccgacgccgacgacgttccttaacttccaatctagtagtacttcgttgggaatatcggaagaagccgaagaaagtagtttaggaaggaaacgaagacccgaacaagatttatcttcacaacatcatcagaatggggagttacttgttgcatcaagcaccgtacattccggcgagtcaccacgctcaagttccggtaacttttggatggtaactaattctaataatcaagctatgagtggtggtgaccctatatggacattccttcagttaataacagtggtttgtataggggaactatgtctagtgggttgcatttcatgaactttccaacaccaatggccttgttaccaggccaacaattgggttcaagcagtagcggtgccgatggaggcggcggcggaggtggcagtggtggaagtagtggcataagtgaaggrcatttaaatatgttagctggattgagtccttattagacaagactccggtggtaccggcgtttcggaatctcaagtgagtggctcacattcacaccacggtggtggaggtggcrgcgatgaatgacgtgatttacaaaccaatagtgtcatgcgatcgtagagatgatgatgatgatcatcgaacaaagcatcatctttgctttcttttgatcacttgtgtagtttgatgtgtancacacgtgaggtttgattgctccttttaatttttttttccaaaaaaacatgaattgagtttttattataccaaaaaaaaaaaaaaaaaaaaaaaaaaaa

SEQ ID NO: 15864 - DNA, 744 bp, Gossypium hirsutum
  Predicted polypeptide sequence is orthologous to G1082
aggctaggaatttggatagagaggatcagaagctgcagaaagatatccaagcattagataagaaaattgttttggtctctggagatggtagcagtctctcggtagctggaaatgttgtatatcagagtgagactagcaacagtagtttgcaggggggcttgcaacgcatatttgaggcaatggaaaagttcagttccgagtcctccaaagtctatgaggaacttttgcagcgtgtgaaagaaaggattgctgaagaccatgagagagtatcataggacccactaaaaaaaaaatgactatggcatcccttggaactgatgatcagtttaggcagtctattgccctctcagaaatggagctcaatgttgggttggacgggtcctgcaaacatacaacttggctggttgctctactgtcagggaagacttgattatgaatgagttggaagagacataagatgggagctaaccttggaattgttagatgattcatcatctgccttacaggagtaggtttcggatgggcttatggcatcgactgtcaagcttgtcaagagccgaagacagatattgcatttccaaaatctcactcaaggtgcaactctagatatcctgtccagtcggcatgaagcagcacccgtatcattgaagaatatcaggcaaaggaaagcagatggtgtgccaaaccattggagtaagcagattctccatcagttttgtaagatgaagagttttaaaaatgtag

SEQ ID NO: 15865 - DNA, 550 bp, Gossypium hirsutum
  Predicted polypeptide sequence is orthologous to G1084
tgagaaaagaatcaataaaaaaattgatagactgaaagtatcaacagattctcccccaccaagattttttagttaaaaaaattataaaaaaggaaggctaacattttaccttaaaacctagtggcaaatacttaacattctttagttacaatcacattttctgttaacttcaacccaacacaaatctagaaacatactcccatcttctattttagaagattggggatgagggggtgataaaaaagatgagaacaggaataagggctctttcgcgcttcgggagggaggagagaaaaagggaataagctgccccacccaggaacaaacacaagttgcttcttcacggatctgtggcaaccatttcttgatattttgatacaatggcatgtgctatgggttttaggggcatctgaaagtgtgagaatcaacgtgtaacctttaactcaccagttttgggggaaaggaaaaaaggagcttttgccatcagcaacccaaacaaaaagttaaccatgcaaatacatttcttggaccatcttttatgcatagtaca

SEQ ID NO: 15866 - DNA, 891 bp, Gossypium hirsutum
  Predicted polypeptide sequence is orthologous to G1100
ctcttgcagccctcactttctcagtgtttgtacccaacaaagtcttttcttttcttccctctctgttcccaacaatggaacagtcatccaacctcaagccctcccactccttgtttcaagttctcactccaactcaaccccttcaatttcatatttaaacactgtcaattcaaaatggatagcctttcaactgcttcagtctcgtttctacttcttgttttaagctggaaaagttgattttctttgctgtcaaacgaagttttttttttttttccttagagaatatatataatcaaaagaggagaaaaatgatatcaggagggctaaatttggtgatgactgttataggtttcacagtgagtattatgttcatagtgtttatttgtacacgtttgatttgtgctcgtattcagctacgtgcttctcggagacccttcgcaatctcttcaagatctgatcttaatatgctcgaacggggtttacacggtattgagcctgttgttgttgcgaatttcccaacaaagactttctgtgatgagtgcttctcagctaacaaagatgctcagtgcacggtttgcctttctgaataccgccgcgaagatgtgttgcgaatcctcccgtattgcgggcactccttccatgtaacatgcatagacctatggctgcaacagcattccacctgccctgtttgccgaatatcgctgcgtgaattgcccgaaaagaaaaggttgatgcaaccgttgttcagttcggccgatcgttctcattttggcacagaatcttttaatatgcatacgtacaactgtttgttgagagggcacagatttccctcaagaaccagtgagagccctgagatggacccaaaccaagagaattcatttgcaactggaa

SEQ ID NO: 15867 - DNA, 783 bp, Gossypium hirsutum
  Predicted polypeptide sequence is orthologous to G1108, G2394
gccctgcataatttccatccttggtatccaagaggatttttcaccaactagaggagccaccagggaaattataaatgcattgccaacattcaaatttaaatccaagaaaaccggaaatgtaaacgatcaggaaatttcaactagtgaaggtggtgtcctggctgcagggacggcaaaggaacgtgttatatccggggaagatgcagtttgttgtatttgcttggctaaatttgcagacaacgacgagctgagggagctgccatgcctccatgtcttccatgtggagtgtgcagataaatggttaaaaatcaatgcatcttgtcccctatgtaaaactgaaattggtgagagcagcagtacttcaccattagcacaagactcgcattaacagtgcaggcaagacaatcgtcaatggacgaatgaccggtaatgtcttcaatgttttactttgttctactggttcttgcatttaagtttgagtcgaatcaagccgagttgtcacgagtcccccatgcaagagatacaaatatatagttaggctatcatcaaaaaagaaacttgcaatgctatatactaaaaaagattgttccttgaggctaacctctcatggtcatacaaaaatattttgattgctattgctcttttatactatggtatcgcgaaacatgactgtcttgaattttggtgggaacatttcctctaaagtcggatattttgtgggtcaaaaccaatccctcgtatcgcctctcactctcccctacccccttccccctcggtccccct

SEQ ID NO: 15868 - DNA, 550 bp, Gossypium hirsutum
  misc_feature (83)..(83): n is a, c, g, or t
  misc_feature (238)..(238): n is a, c, g, or t
  Predicted polypeptide sequence is orthologous to G1108, G2394
tttttttttttttttttttttaaaaaattattatcattttttatttaatataaacaaattggtttacaccaacagttgcaatngggggaacgatactgaaaaaaaaaacatgatcacatgaatgtacgaatatctcaaaatcttttgtgacacaacataaaataatataaatacgattatgatataacaaaatacataaaaatagctatgaatacaagatatgaaggtcgaatgtttngggacattgcttcgtctttcaactgtcatttttccggtatgctgttaatttgaatctccggctgatggcgaagtacagtcactggtgttgccaacctcggttttacaaaggggacaacatgcattgattcttaaccatttatctacacactttacatggaagacatggatgcatggcagctccctcagttcgtcatcgtctgcatatgctgccaagcaaatacaacaaaccgatcttctcccgatatcacgcgttcttttgcagtaccggaagccagaactccacatgaaacgtccggatcatcaacatttc

SEQ ID NO: 15869 - DNA, 550 bp, Gossypium hirsutum
  misc_feature (14)..(14): n is a, c, g, or t
  Predicted polypeptide sequence is orthologous to G1108, G2394
aaaaaattatatcntccattattttatttaatataaacaaatttgttaacaccaacagttgcaataaaaaaacgatactgaataaaaaaaacatgcatcacatgaatgtacgaatatctcaaaatatttttgacacaacataaaataatataaatacgatttaatataacaaaatacataaaaactagctatgaatacaagatatgaaggtcgaattgtttaacgacattgcttcgtctttcaactgtcatttttccagtatgctgttaatttgaatctccggttaatggtgaagcactgtcactggtgttgccaacctctgttttacaaaggggacaacatgcattgattctcaaccattatatctacacactttacatggaagacatggatgcatggcagctccctcagttcgtcatatgtctgcatatgctgccaagcaaatacaacaaaccgcatcttctcccgatatcacacgttcttttgcagtaccggaagccagaactccacatgaaacatccggatcatcaacatttacaattttcttaga

SEQ ID NO: 15870 - DNA, 746 bp, Gossypium hirsutum
  Predicted polypeptide sequence is orthologous to G1133, G1137
gcttagcgtggtcgcggccgaggtaccatgactgcccaggatgagcaatttgagggaggtagtgaagaggttgatagctctacaaggctaattaaaaagcgaaaactgcttgatggcagttatggttgtttgcccttgcttatggatactgctaattcagggaattttaacagatattctgaatacgaggatgatgcggattcaagctgtgccaaaggccaaaatcctggatcaggtgatacagattcgtcttcaagctacaagagaatgagaaaggataaaattcgagagacggtgactgttttgcgaagcataatcccaggcggagagggaaaggatgcagttgcggttcttgacgaagctatcaactacctgaaatccctgaaacttaaagccaaaaccttgggacttaacactctatgagctgcagcctgcagctgttctcacaagtagtattagttgttatttttgtcattgttagtggagctgtgttaaataagtgaagtatacacaatcttgaatggtgtttttcatatataatttggagcccttccaaaaatagaagatcgtagacaaagaacatgaacccttcccaatgatatgagttggaaaccagtagcataaggagtcgaaatctcatctctatttcctaaaggaagcaaaggatacatgagtgtatactatgtcccaataaaggaagatgaaccatcattagtcaacatcttgggttgtagagaaagtgaaac

SEQ ID NO: 15871 - DNA, 828 bp, Gossypium hirsutum
  Predicted polypeptide sequence is orthologous to G1146
gcggccgcgtcgacattgtatcctatgatggtctgttgacattttacattttatccgatgttattattgtttccctgtgatctttctggttgcctgtcatcgcaggaaggagcgacaatttaaggttgcaatcaaactggcctccaagccagaccttcattatctgagggagtttttgagcagaaggcattttgaatgccctcaagaagctattcaagttctgaatgttgttcttagagctaaaccatctcagatatatactgaggttggaaggtcttttttccatacatcattaggtcctagaggagatcttggtaatggaatagaatactggtctggatattatcagagtcttcgactcactcagatgggtttatctcttaatattgatgtgtctgctcgatcattctatgagccaattttagtatcagagtttgttgcgaatcattgcagactatcaaacctgtcaaagccgctgtctgttcaagatcatattaaagtgaaaagggccttgaggggagtaagagttaagctcatctacatgatttatgccaaaacttgcaagattattggagtatctagagaccctataagtcagttgacatttactctcgatgacaagagagcaaatgtctctgtggtcaagtatttccgtgagaaatacaatgttgtgcttaaatatccatccttgcctgcactttaaagtggaagtcaagctagacctgtctacctgccaatggagctttgtagtatcgttgagggtcagagatacacaaaaaaactaaatgaacaacaagttagatctctgcttagagcaacttgtcaacg

SEQ ID NO: 15872 - DNA, 1003 bp, Gossypium hirsutum
  Predicted polypeptide sequence is orthologous to G1146
caagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctattatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacaagtttacagctgatgcattacagtcccttacaaataacctttgctatacatatgcaaggtgcacacgatcagtgtcgattgttccccctgcgtactacgcacatcttgctgcattccgagctcgcttttatatggaaccagaaacatcagacagtggatcaatgacaagtggcacagctgcagggcgtggaggtggagctgcagctgctggtgggcgtagcacaagaggacctggtgctagtgctgccgtcagacctctgcctgccctcaaggaaaatgtcaagcgtgttatgttctactgttaagggagtgcttgtattttgagcatctattttgttgggctttgcttattggtatttcgaacaatatctagtttgtttggtgttgcgtggattattgaactaaacttgttgaactttggtgttaaaactatgttaattttatgattatcgctgtg

SEQ ID NO: 15873 - DNA, 884 bp, Gossypium hirsutum
  Predicted polypeptide sequence is orthologous to G1146
actgtctaggccattgtcggattccgatcgtgtgaagattaagaaggcgcttagaggagtcaaagtagaggtgacacatagagggaatgtacgaagaaaataccgtgtttcaggattgacttctcagcctactagagaactagtgtttccggttgacgataactctacaatgaagtctgttgttgaatacttccaagagatgtatagcttcacaattcagcatacgcatctaccttgccttcaagttggaaaccagaagaaggcaaattatttacctatggaggcatgcaaaatcgtggagggacagagatatacgaaaagattgaatgagaggcaaattactgctctcttgaaagtcacatgccaaagaccgagggatcgagaaaatgacattttgcagacggttcaacataatgcttatgatcaagatccttacgcaaaggagtttggaatcaaaattagtgaaaaactcgcttcggtcgaggctcgtatccttcctgccccttggctgaaatatcatgaaactggaaaagaaaaggattgtttgcctcaagtggggcaatggaacatgatgaacaagaaaatgattaacggaatgactgtgagccgatgggcatgtattaacttctcacgaagcgtgcaagagagtgttgctcgagggttttgcaatgaacttgctcaaatgtgccaagtttctggcatggagttcaatcccgaacctgttataccgatctacactgccaggcccgagcaagtggaaaaagctttgaagcatgtttatcatgcatccatgaaaactaagggaaaagaactagagcttctattagctatattgcctgacaacaacggctcgctttatgggtgatctcaagcgaatttgtgaa

SEQ ID NO: 15874 - DNA, 682 bp, Gossypium hirsutum
  Predicted polypeptide sequence is orthologous to G1146
tactcgctttttccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcactgctgacatcttgcaagtgctcacaaacaatttatgttacacgtatgcgaggtgtaccaagtccgtttccatagttcctccggcatactatgctcacctcgctgcttatagggcacgctgttatattgaggatgagatgtcggatagtgggtctactggtggaggccgaaagccgaaagaccaggttgtagaggttaggccgctgcccagcataaaggataatgtgaaggaagtgatgttctacgtctgattaattatgtttggttgattgtgggaagttgcgcaagtatagttgcacggtttgtggaatgatggtggagtcttatttattccattggtggacttagtaatcatctaattttggagtttttgttttggtggttgggcgacttgttgtgtgaagtttgaattattataaatcacacactgtttgtggattacgaaaatttcataaatgtcctttatttttaaaaaaaaaaaaaaaaaaaaaaaaaaa

SEQ ID NO: 15875 - DNA, 484 bp, Gossypium hirsutum
  Predicted polypeptide sequence is orthologous to G1146
cagcctaccgagctcgattctacattgaacctgaaggttccgaaaccgctaaatcacgtcgtacacgcacaaccaatggttcaccggttcggcctttaccagcattaaaagataaagtgaagaacgtgatgttttactgttaaaaaacatcgaagggaaagagtaaccaaaaaaaacatatatgtacatgctttgttgtgttcacagtgtagagagactgccacatccctgactttttgaaagcgcaacaaacaaccgactgtaacagttactagcagactaacaaaaaaaaaaaaaacctcagctttttagagcatatataatctaaatgcatatacgtatatgtatatgtatgtgatacgagatttctaagctgaaaattcaacaacatttaatattactggtccgagagacacaacaaaacaactgttgaacaaaaacgatatatagctgtctttcaatccaaaaaaaaaaaaaaaaaaaa

SEQ ID NO: 15876 - DNA, 556 bp, Gossypium hirsutum
  Predicted polypeptide sequence is orthologous to G1146
cgcactaccatgttctttggggatgaaaacaattttacagcagacggaatacagtctctaacaaacaacctttgttacacatatgcaaggtgtacgcgctcagtctcagttgttcctcctgcatattatgcacatttagctgcattccgtgcacggttctacatggaaccagagatgcaagagaatgggttgaacagctgcagtaatggtcaagcgaaaggtacaagggcagtgggagaatcgggggtgcggccattgccagccttgaaggagaatgtgaagagagtgatgttctactgttagaatggatgagtggagtgggagatttgcaaccatgaatagaataacttttttcagcttattaaaatttccttgtacagtttaaatgaatgattgcaaagtcttccaaagtttagtttaagataaaaatgtgaaacgtgggaggaatgatccacagatgcaagaattgttaaaactaggttattatcttcatgtaaagaaatgctaatttagaatccttaatcatcttattctcaatttaaaaaaaaaaaaaaaa

SEQ ID NO: 15877 - DNA, 270 bp, Gossypium hirsutum
  Predicted polypeptide sequence is orthologous to G1150
cctgcgaaccgaagatcattgatatgatattttgatttaaatagtccagtcttctcaatcactaaacagaatttagagcataacattaagagtagtttaaagagggggatgggggaaatgactcctaagcgcttccatttgacttaaaacttattattacaacactaactgttacatttttggctcaattattgattgctcattcccaccgccactatctcctcatactctatctcaccctaaaccaaacataatatataaatttgactt

SEQ ID NO: 15878 - DNA, 572 bp, Gossypium hirsutum
  Predicted polypeptide sequence is orthologous to G1181, G1850
caacggtgctgtcgccgtctttcactctcttacggtgttgaaacccgtttggattcaacgatcttatcgcatgacggacctggtttcttgtttggttactgagaaaattttcgttgccttttaagagcgttattattctttcgcttacgtttgatgtaaaaggaacgccaaagtgatctgtctccctctctctagagagttcggatctagaaacgaaccgtatggcaccattgccggccgatcaaccctgcgaatctcatgccagcggtgctgtggctgactcgcaacggtctttacctactccgttcctttctaaaacctatcagctcgtcgataattcatccgtcgatgatttgatttcatggaacgacgatggatcaactttcatagtttggcgcccagctgagtttgctcgtgatttgctccctaagtacttcaaacataacaatttctctagcttcgttcgtcaactcaatacatatggatttaggaaggtagtgcctgataaatgggagttcgctaacgattgtttcaaaagaggtgaaaaaggacttctccgagacatacagcgc

SEQ ID NO: 15879 - DNA, 906 bp, Gossypium hirsutum
  Predicted polypeptide sequence is orthologous to G1181, G1850
gcggccgcgtctacctgatagatgggagttcgctaacgattgtttcaaaagaggtgaaaaaggacttctccgagacatacagcgccggaaaataactcataatgcttctggttcggcgacggtgaccatcgcgccggttacttgtaagccatcgccgtcgaattcgagcgatgagcaggttatttcatcgaactcgcctcctgttgctaccgttttgaatcggaccacaagctgcacgacaacggcggagcttttggaggaaaacgagaggcttagaaaagaaaacatgcagcttaaccatgagttaactcagttgaagaggctgtgtaacaatattttaaatttgatgactaattatgcttccggtcaagtggagaaccattcaaacttggctgaagggaaggcattggatcttttgccagcgaggacgaggaacggtggtggttcgaagcctgtcctggcggagacggaggaggaagcagcggaggatttgaggccgaagttgtttggagtttcaatagggatgaagcgcgtgaggagagaaggtgaggaagaggaaggggtgatggatgaggagcagcagcaggagattaagcctggatctgacattaaatcagagccgttggatggcaataatgataatcaggactccacgtgtctggagcttggcaaatgatcgaatgggatttattattattatttatttgattttcttttaatcagtggatggcgatgttgatgatgagaatcggaaaggaacgcgccaacgtggtccctatggagcatgtttcgaagaatcacgtgttgggaaaacagacacgtggcgccatgtgaaatatttgttctggatgcttctagaatgtaaagcccacagacgacagaacatgtaaaatagactaaacgtgg

SEQ ID NO: 15880 - DNA, 954 bp, Gossypium hirsutum
  Predicted polypeptide sequence is orthologous to G1181, G1850
ctgatcatcactcttcccatccaacggctctgctttaaccccgggctcacactctatgtcctgctgttgttcttgattattattctgctcctccaccgaatcctctctcctcacgcgcttcatcccaatcgaaactccgaacaatttcggcgtcacatcctcctccatatccaccgcctccttcggacccacgcctcccgctttcgtacccgaattcttccccggcaaaagatccaacgccttaccttcggctgaatttgaattattttccgactgaccggaagcatagttcgtcatcaaagttagtatattgttgcacaatcccttcaactgagtcaactcgtggttcagctgcatgttctcttttctgagcctctcgttctcctctaaaagctctggcgtcgtgctgctggtggttcggtgcaaaacggtggcaacaggtggcgagttggacgaaatgacctgctcatcgcctgaattggatggggaaaccttgcaaggaatcgccgccacggtcaccgtcgcggcaggagcagtagtggtaggagtcattttccgacgttgtatgtctcggagaagacctttctcacctcttcggaaacaatcgttagcgaactcccatcgatccggcactaccttcctgaatccctaaaaaagataaaaagcaaaataacctgtctaaatcaactaattataatcgaaaacttatctctctctatacgactgatagtaattatagtattcaaatctacactttttcccacttacatatgtgttgagctggcgcacgaagctagagaagttgttatgtttgaagtatttagggagcaaatcacgggcgaattcagcggggcgccaaacaatgaatgttgatccatcttcgttccatgaaatcatgtcattaacggagggatcgtcgacgagttgataggttttggtaaggaacggagtagg

SEQ ID NO: 15881 - DNA, 831 bp, Gossypium hirsutum
  Predicted polypeptide sequence is orthologous to G1181, G1850
ctggtttcttctttggttactgagaaaattttcgttgccttttaaggtacggaatttatttgaacaattttgagtttttttaatggaatttaatctctatgctcatgtatggatgtttataatatttgttcataaagaaagcaagaaatcttttaatattattctgaaactgtctccgtttctgtgcttttgaataatctatataaaatttgatgttgaatttggtgaacttaaaaagatattttcagctctatgcatggaagatatttttttgtttcatttgtttattttctttttctaacactctctcggctgccaatcagagcgttattattctttcgcttacgtttgatgtaaaggaacgccaaagtgacctgtctccctctctctagagagttcggttttgtgtaaggttcggatctagaaccgaaccgtatggcaccattgccggccgatcaaccctgcgaatctcatgccagcggtgctgtggctgactcgcaacggtctttacctacaccgttcctttctaaaacctatcagctcgtcgataatccatccgtcgatgatttgatttcatggaacgacgatggatcaactttcatagtttggcgcccagctgagtttgctcgtgatttgctccctaagtacttcaaacataacaatttctctagcttcgttcgtcaactcaatacatatgtaagtgtttaaaaatttgaacgtgatagtactaataattagttttaattcaacttaattttattttttcttagggatttaggaaggtagtgcctgatagatgggagttcgctaacgattgtttcaaaagaggtg

SEQ ID NO: 15882 - DNA, 928 bp, Gossypium hirsutum
  Predicted polypeptide sequence is orthologous to G1181, G1850
aatcatcataaaatttgaactttctagaatttaacaatcagatttctcatctctggtgaacgaagcaaacaccttctttaaggaattattaattgttgtctctgatggctccgccgccggtggagcaaaacggagatgcaacgacgggaacggcggaatcacaaaggtctatacctacaccgttcttgactaaaacgtatcaattggttgatgatcacacgattgacgacgtgatttcgtggaacgacgacggatctacttttatcgtttggaatcccacggtgtttgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcggcggaagttgtcgtcgccaacagcagcagctgttacggtggctccggtgacggttgcggcgattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagtttgtgcaataatatattcagtttgatgtcgaattacgcaagttctcagtcggagaacatttctccggtgcacaaaccgctagatttcttgccggcgaagcggttatcatgcggagaatcagtcgaagaagaacgagtccgagtattcggcgtcctatagagagcgcaaagcgcgcaggaagagagagcgtagcgacggagcgcgacgcagcagacgaacgcatacactgc

SEQ ID NO: 15883 - DNA, 640 bp, Gossypium hirsutum
  misc_feature (617)..(617): n is a, c, g, or t
  Predicted polypeptide sequence is orthologous to G1190
cacagctgagagccacaggtgtgacatgaagtatgtgctgttggagatggaccgaatcctgcgacccaaggggtacgcattaatacgggaatcaagctattttattgatgcaatagccagcattgccaagggattgaggtggagctgccatagagaagacaccgaatatggtgtagcgaaggagaagttattagtttgccagaaaaagctctggtattccgctagcagcagttcaagatgacaatatatgtcttgcctggttaagttaaaaagtactatataatataatattattgttcttccaagcgtaacgttggagctgaaaagatggaagttgcatacggatacaagcatatccatagaaatcaaagagcctctaaattcatattcgtccattgaagggttagcctccccccaataatagttgattttatagatatatattctttgtaaggcatctatctattctatacacagatttttaatttttttttctatatatattttgtgggccttattttctttctatatgttgtcagtttgggatggctgtggaaatattattattttgtcacttccttcccagttgtgatttttcaagtgtaatgaaaactctntctgctttctaaaaaaaaaaaaa

SEQ ID NO: 15884 - DNA, 567 bp, Gossypium hirsutum
  Predicted polypeptide sequence is orthologous to G1206
ttttttttttttttttttttttttttaagcaaacagaagcaggtatattgtctaatattcatattcaattttttgttcccacatgcatgatatgcatatggtaaatttgggattttacatgtctgacaaaaggaaactgctaactagtcctttgccccataagtatttgcagtcagcaatatcaggcaacaaatgaaccattgttttccagacattatcagatgactttcagatcttatagataaggcccataacccaaagaaacattgttcactgcaacaaaagatgttggcataataatggaagttcctcaaagtcctctgatctgacgtaaagtttctaataatgcaacattaaatatttacagaaaggaggaaaaatgttagcccatataccacatcagacatattgcagtgaagcttggttacagagtctccccgcccaagctcttgagctactccatatgcaagatgtaactctggccccatctctagcttaggaagtacctctgataatttggtatcaaggttaaggccacaatgagagagcgtgtattccttctcgtgc

SEQ ID NO: 15885 - DNA, 550 bp, Gossypium hirsutum
  Predicted polypeptide sequence is orthologous to G1206
aacccaagctaaatcaattaaatccaatcaggtgattctaatccccaagaaaacaccagaatagttcaaagaaatacagagtattgtgctagcctttatcatttagcaggagccaagaaggaattaggagtttatacatacatacatacatacatacatacatacatacatacatacatacagacatatgtatatgtgttacatcttcttgacactgtcaataaatccaatcagtcagtgatgttggaaaaaacagaagccgttgcccacttcgcaattgtaatcgttcagaaaggatgcaactcaattaactttataagcaagttcaacctctgcatttggatccaagtatttcacagcttgctggactgcatgtacagtcattttcttcacctctagtttatcctctttttccctatgatcacggggaagcagacgaaattcctcagtcaagcgaacacactcaccgacattttcaggcgaaacaaaatcgagagcaacctttatgcatgacttaatgttccggacttgatgaggacaaccagcaggt

SEQ ID NO: 15886 - DNA, 982 bp, Gossypium hirsutum
  Predicted polypeptide sequence is orthologous to G1228
atttattacttgtattgatttgttagcttcaatatatggaatgttggtaactgagagagggacacagaaggagaaaaagaaagaatttaaggcatttacttcaactactgctaagctgttatggagaggctccaaggacccattaatccttatgaaaatactaacctctgctactgcactactgcttcttcttactctttcaacattctactctcattctgctttcattctctctttagatgctgagagagactgaaccatgtgccctccacccaattaaatgatattttccttttcaaatatctttacatggagagcatttggaggtggaatgcttagaacaaggttttattagctgtgagagattaaagcttggagaagaagaagaagaagcacacttttcaataccaagctttgaagagaaaatgccattccttcagatgcttcagagcgtggagtctcctcagctttttgcctttaaagaacccaacttccagacacttttgagactgcaacacatgaagccttgggagctaaacaacaatcctttcattcctgaaatggaaacccaagttcaagccctagagctggaaagttgtgtcacccatgaaacagtactcgacttacattcaccagtcaaatccgagaccaaagagcttaagaaaagcccaccttcaagctcatgcgttgaagttctcagctctaggtctaaccaacaccaaccaaagtctgacaattgtagcagagaacccaacttgggctcctcgcctcagaagattttcacaaagtcccctccgattactagagaacgaagaaagcgaaaacgaacgaaggcagccaagaataaagaagaagttgaaagccaacgcatgacccacattgccgttgaacgaaaccgtagacgtcaaatgaacgattatctaaattctctccgctctctcatgcctccatgttatatccaaagaggtgaccaagcgtcaat

SEQ ID NO: 15887 - DNA, 571 bp, Gossypium hirsutum
  Predicted polypeptide sequence is orthologous to G1242
tgaatcgcggacaactcaagagctgctcggagatgtgatacctcatccgattggttgagaaggaaaaccaagaatgtgacgagagggagcgacaagcccgcaaggaaaagaaacttgccaagaacataacaccatcgaagcgcggagggaggcagccaactgagagtcctactcaacaaaagaaacgcaagcagctatcaatggatgattatgcgaactcgggtaaaaagaggaagtgagcgagtaatgtgaactacaaattttgggtctaaaagctctgatatttatttgggtttaaaagcagaaatatcagaacgaggaattgggctgtagtttgcatttggtatttcatggaactcttgaggttgggtgggaattaaccaccattaatggaagttagtttaggttataaaaggtgtataaatgagtatagtaagtttaatcacaagggatttttaagaacaatctattcttacccgtctggatttggaaccatatgtattatgctgaccattattactgaaattatattggagccggatacgattatgaccaaaaaaaaaaaaaaaaa

SEQ ID NO: 15888 - DNA, 835 bp, Gossypium hirsutum
  Predicted polypeptide sequence is orthologous to G1272
gcggccgcttcgaccaaaagagcaaaccattgaccatatttatcacagtataaaaccaaacaggaaaaagccacaaaagccactgcagaagtgagcttagctagacaaccgttcataagttcagataacatacggaacacctaagagtgttgcaacccaaaagtctaaagacatgaaaaagcagcataaatagtttttggtagccaaaatccaaaagccctatacaaaaacatggttcaacggttttcagcagaagaacatggagctgctgacattatccttcaacctgggaagctgaggtacagaaatggctcccggagcagtcaccccaccatggctcgatgatgtctctgaagcatcctcaaacttcataaattgccccaactgtgaagctgccaaatgagcgtagcaaataggggccacaacagatatggctgtggtgctcctttgatacacgtaggatagagaatgaacaagctcctgcagatcatcagctgaaaacccaacctggtctaagagaacatgatagtgggtcggccttgtggtccctatcattccagcatgagcacaaaggtaaaaatcattgttcttcggatggcatactttgttgtcaattacagtaccaggtaaaacattgtcaggagatccctgctggaaaaacttggtatgatggtttttttgtgcaacaataaccacaaacttagggttccaattctcgtcaaggaacttgcaagcctcaataacttgatcaagttctttgttcaaaacttgattgaactgagactcgctaaccccatccctgaaaataatgatctgatcaggcttcctcttccct

SEQ ID NO: 15889 - DNA, 969 bp, Gossypium hirsutum
  Predicted polypeptide sequence is orthologous to G1272
cttgaggatgttacatctaacagaaacaacgggaatgcaagccctgatgtccatgatgactcaaatgggcaagacaggaagaggattaaacggccttatcagtcaaagacctttaaagtggagatcagctttgctgcaaagattcccatgcaagccattcaaaatgctctgcgtggacaggaatcagaaaactcacaagaagccctaagggtgttggatatcattttacggcagcatgctgcaaaacagggatgtctacttgttcgccagtcattctttcaaaataatcctgataattttacagacattggaggtggtgtcctaggctgcaggggtttccattctagcttcagagcctctcaagggggcctttccctgaatattgatgtctcaactaccatgataattcgtcctggtccggttgtggactttttgcttgccaatcagaatgccagagatccgtactccctggactggaccaaggctaaacgaagccttaagaacctgaggataaaagtcagtccatccaatcaggagtacaagatcactggattgagcgagcagttgtgcaaagatcagttgttttcattgaagcagaaaagcatgaagaatgataatggtgaagctgagaatctacagattactgtctatgattattttgtcaaccatcgcaacatacagttgcgctattctgcagacctgccatgcattaatgtcggaaagccaaaacggccgacatatattcctttggagctctgttccctggtgtctttgcaacgttacaccaaagcgctaaccactttccagagagcttctttggttgaaaaatcaagacagaagcctcacgaaagaatgacagtcttatccagtgctttacagagaagcaactatggtgctgagccaatgctgcgttcttgtggtgtttctatcagcactaatttcacccaagtcgaaggtcgtgttctgcca

SEQ ID NO: 15890 - DNA, 856 bp, Gossypium hirsutum
  Predicted polypeptide sequence is orthologous to G1330, G2423
gtttaccctcagttcttccccacagaaagtaacctattctcacaaatggatgtttacgagagcggtttcatatctgaaatgactccacaaagtaaagaagatatggatgtaaggaaaggtccatggactgaagaagaagactacatgctcaaaacttatgtcaatgttcatggcgaaggtagctggaactcagttgctcgcttatcaggattgaaaagaagtggaaaaagctgcagattaagatggctgaactacttgagaccagaagtgatacgtgggaacataagtctccaagagcagcttttgattcttcaactccattctcgatggggcaacagatggtcaaaaattgcacaacaattacccgggaggacagacaatgagataaagaactattggagaaccagggtcctaaaacaggcaaaacagcttaaatgcgacgttaacagccaagaattcagggacaccgtgcgttgcgtttggattcctcgtctgattgaacggatctgtgcttcatccggatccccctcggctcaaccctccaccacctatgaaaagacgagtgtcctgcccgagttatcaggcacttcatcagactcccaggacgcccaactctcttccgtttcagacctcacagattgttacaacccaccaagcaattcaaactacccgaatagcttacagaacgggtgggggtttatggtcggaaaatttaggcggcacttggaatattcaggcgacggaggtgaagagtcgatggagagtgtgtggaacgaagagaatatttggttcctaagacagcagctttatgatgacaagatgatatgattagtttacgtgtgaggtatcaagttta

SEQ ID NO: 15891 - DNA, 1033 bp, Gossypium hirsutum
  Predicted polypeptide sequence is orthologous to G1330, G2423
gtatactcgtaagctatcttcatcacaaattcaattctcaaatcagcttagaggtttatccttgcctctccgactgtaattaacctgttttaagttgagaaatggatgtttacaagagaggtttcatatctgaaacttcaagaagtgaagaagagatggaggctaaggaaaggtccatggactgaagaagaggactccatgcttagggcgtatgtcaatatccacggcgaaggtcgctggaacgctgttgctcgcttatcaggattgagaagaaccggtaaaagctgcagattgagatggctgaactatatgcgaccagaaatcaaacgaggaaacatcagcctcgaagagcagctattgattcttgaactccattctcgctgggggaacaggtggtcgaaaattgcacaacacttgcctggaagaacagacaatgaaataaagaattattggagaacaagagtccagaagcaggccaagcagcttaactgtgacgttaacagcaaacaattcaaggacgccatgcgttacgtttggatcccccgtttagttgaacggatccgtgcttcatccgagtctccctcgagtcaaccttctaccaccaccaacaccacctacaatgatcgtatcagcaacataagcagcagtcaaatgagctacgcaaatgcgagtgggtcggtccaggttgacccaagtcttctgcccgaattatcaggcacgtcatcagactcccttgacacccaagtctcttccgtttcggacctgaccgattgttacaatccacaaagcctttcaaactacttacacaaggggttaggtttggaaaaggagggagcggccacatggggcagagatgaagaattccaggcgacagaggagcatagcaatggttggttggttggtggtggggagtcatcgatggacactgtgtggaatgaagagaatgtttggtttttacagcagcagcttcatgatgatgggatctaaccacatgaattcgtaatcgtaatcatgtcatgtcatagctgtttcc

SEQ ID NO: 15892 - DNA, 934 bp, Gossypium hirsutum
  Predicted polypeptide sequence is orthologous to G1340
tgcacttgatgatggatgaccaaggcggtaacaatgctgtaactagggaatacaggaaagggaactggactgttaacgaaacaatggtgttgattgaggctaaagagatggattatgagagaaggatgaagagaagtggggatcacagtgaagggtggaacaaaccgacagagttgagatggaaatgggtggaagattattgttggggaaaagggtgtttgaggagccaaaaccagtgcaatgacaagtgggataatctcatgagggactacaagaaagtaagagagtaccaaaggaaagtagctgagagagaagggaatgatagtaaggaaagatcatattgggagatggagaagaatgaaagaaaagaaaagaacttgcctagtaacatgttatgccagatatatgaccgtttggaggaggtggtggagaagaaaggagctcaaacggtggccgctacggctggtggtggtggaggctcagatcccaatattcccaacatatcgtatgttatggatagaccaatggttagtacttttcaaccttcattacctcctcttttacaacatcaactttcagctcctatatctgctgcaattccattacctctaccacaaggatcaccacagctgccgccgccaccagcaccaataatacaaccaccacctctttcatttgctcagccactgcccaccatagctcagattctgatacaagtgagcattcagactcaccagcaaagagaaggagaagaggtggtggcaatggtgaaggcaccagtgggactctctaacaacacaaaggaagtaagcactgcaatctccagaagtgcttccattatagcagaagccatccaagctagtgaagaaagagaagagaggcgacatagagatctcttaagcttccatgaaagaagactaaagattgaagaatc

SEQ ID NO: 15893 - DNA, 973 bp, Gossypium hirsutum
  Predicted polypeptide sequence is orthologous to G1341
ccattcgcacaagcagccactactgcttctcgttcagtcactgaagaagagtgggaagctgctacttctacatccgaaacggctgtcaccgccgttactggagctgcaaaagcggtaacgccgccttcgagtggtagtgagctagccatggttgtttgtaggaacagtaaagaactagtggagattgttaaagaagttgatgaatatttccttaaagctgctgatgccggtagccatctttcattactgttagaagcttcaaatcccaatctttcaggcaaagggtataataactatgcctgtaacttaaccccaacaacatggacatggaattggagccccaaaatagtggaaaacaccattgttggacatacaggaaatactagccattgttccaccatagagaggttatatgcttgggagaagaaactataccaggaagtcaagattgatgtgcatgtggagaagcatgtatgagatccaccaagttcacacacacatagttcaacaactcaagtaccttaatttcatcccttctaacgagccgacatccgagattcaccggcaatcaactctccagctcgaactcgaagtccagcaatggcatttgtctttctgcaacttagtcaaagctcaacgagactacattcagtcccttgctggttggcttcggcttagccttttccagttcagcaaaaacccgcttttaagaaacagtcaagaatcgaaaatttactctttttgcgaagagtggcatcttgcagtcgataggattccggataaagtagcgtctgagggaatcaagagcttcttgatggtaatccacgccatcgtagttcaacaagccgaggagtataagcaaaagaagaacgcagattctgcgtttaaagacttagagaagaagcagctgaacttagatcactcgaaagtaagtacagccctttttctgtactggaaacaaacaaagacccca

SEQ ID NO: 15894 - DNA, 2445 bp, Gossypium hirsutum
  Predicted polypeptide sequence is orthologous to G1341
gggattttcatgttcgaagaagctttgtttgctgtgaaagatagtttcttgaagatgaaagaccctccattggtgaaagctgcagtggtaaaagcaatagatctttagactaagtaaaattaactcacagctcattttgtttccctctttactgtttagttgcttcaaattttagaaaaaaaaagttgatctgtggcagaagggtgaagcaagaaaaaaaatggggtgttggtactcaaggatcgatagggaagagattgtttcgcgttgcaaggcgagaaagagatacatgaaacagttagttaaagcaagacaaactcttggtgcttcacattctatgtatctacgctctttacgaggcacaggctcagctcttcttcagttttccagcaatgaaactactacccactcccaccaccatactactccgccgcctcaacagccggcattgccgccgccaatgagtcctagttcagacacttggacatctgctaacacggcctcccctgttctgccgccgccttctcctcctcaatccagtaactgggacttttgggatccatttgttccagctacagagtcacggtcagccacagaggaggaatgggaggcttccacgtcagtgcctgaggtggcggtcaccgctacaaaccccacgaccagggctgcaagcatggcaccgcccccttctgtggtgagtgggttctcgaaagatacgggaagtgagcttgctatggtggtgtcgaggaatagtaaagaactggtggagatcgtgaaagaggtcgatgagtattttattaaagctgctgatgctggtagccagctctcgttgctgttagaagtttcaaattccaattttcctgctcaaagtaaaatgagttatttctctctcattcttttccttttctttttccctcttaacatttctgggtggggttttttttttttccttgttgcaggtaaagtgtataactatggttgtaatctgactccaacaacttgggcatggaatcgaaattcaaaaatggaaggaactgggaagttgggaggcgataggacgggagaaaatggaaatgtaggtggtactattcttaacagtagccattcttctactatagagagattgtatgcttgggagaagaaattatacgaagaggtcaagactgtggagactataaggatggaacatgagaagcgggtggcccaattgaggaagctggagttgaagagagctgactatgtcaagaatgaaaagactaagaaagaggttgaaaaattagaatcccaaatgatggtttcttcacaggccattgagaccatatcagcggaaatcatcaaactgagagaggcagagctttatcctcaactcctggaccttgtaaacgggttgatgtggatgtggagaagcatgtacgaaattcaccaagttcacacacacatagttcagcagctcaagtaccttaactttatgccttctaacgagccaacatctgagattcacaagcaatcaactctccagctcgagcttgaagtccagcagtggcattcttctttctgcaacttagtcaaggctcaacgagactacattcagtccctagcaggttggctccggcttagccttttccagttcagcaaagacccacttttaagaaacaatgaggaatcgaaaatttactctttttgtgaagaatggcatcttgcaattgacagaattccagataaggtagcgtctgaaggaatcaagagcttcttgacagtaatccatgccatcgtggtccagcaagcagaagagtataagcaaaaaaagaaggcagattctgctttgaaagattttgagaagaaggcagcagaacttagatcactggaaagtaagtatggcccattttcctccatgcctgaaatgaacaagtaccctgttgtagaaaaacgaacaaaggtggaaatgttgagagcaaaggctgaagaggagaagaataaacatgagaagtcagcgagtgtaacaagagcaatgactttaaacaacctccaaatggggtttcctcatgtcttccaggcaatggtaggatattcaagtgtatgtatgcaagcatttgaatctgtctacaatcaagccaacggtattgatcaggaacatgatgtgaagagaatacttccttgagaaaagactaacactctggaatcaaaatgatgctaccactgatacgtgttcggtattgggatcaaagtccagacacggaagaaaattccagtcaagtaggagtgtagaattgtataccttgttttatttcgtcattggaaagtgttgaatgctttgcaagtttctgtttaaaacccttttttgtttgccttttgaatcatgaaattatgttttggtaatgaattgctctgagagcaaccaagtgaagcacttgtattgcttgagattaaaaaaaaaaaaaaaaaaaa

SEQ ID NO: 15895 - DNA, 916 bp, Gossypium hirsutum
  Predicted polypeptide sequence is orthologous to G1380
ttcgttttggttgggttgattatttcctcacttcccttcttttttgtttcatcgtgatcttttcatcaaccccttttgtttgtcatatagattgttgctattcttttaatcttttaaatattttttttccatgaggagagggagaggtgccgcagcggcggctcctgccgccgcggcaaacgccgtagctaggagaccggcactgcaacccggcggatctattaaagagccgagatacagaggtgttagaaaaaggccatggggcagattcgcggccgagattcgagacccctggaagaagaccagggtctggttagggacgttcgactcagccgaagaagccgctcgagcctacgatacggcggcgaggacactccgtggacccaaagctaaaacaaatttccccataaattcttcaaatatcccggcttttcctttcgaaaccaatcatcaccacaacgaagggttcatcgaccaacgccggttatatccgatgggcgattttcatgaccccgaagtgaatccacagagacccacgaggagtagcatgagtagcacggtggaatcgtttagtggacccagaccggtccaaccaccgcaaaaatcggcggacttcgcggtggtttcgactaggaagtactatccgaggccgccgccagtagagccagaggattgtcatagtgactgtgattcatcatcgtcggtggttgatgatggggatatcgcgttgtcttcgtgtcggaaaactttgcctttcgatctcaattttccacccttggatgaagatgaagatctccagtgtaccgctttatgtctttgatcacgatgccggtgatgaatgatgatgatcgattattggatctctttttcttttttaaaaaatgttagctttttttaagcggaaaaaaaagatgag

SEQ ID NO: 15896 - DNA, 954 bp, Gossypium hirsutum
  Predicted polypeptide sequence is orthologous to G1380
cctccccctcctaccttggtgccatccagttcccatcccacacctatctccttcttcttcaaattgtttttcccagttattttgtttggttttctttgatctctctctctctctctctttcatcttcaatctttttcttttcttttcttttttaaatttatataaaatttatgaatatattagttttggtttgggttgatttagtcagtttacttccttttttatttataatctttttttcatcatcaatctcctttgtatttctataacatttattaccatttatttaatattttgagcttatacacttgattttcgattacccttttgtgagattcgaaaaaaaaaacccatttttttacttattttccgatgaggagagggaggggtcccgccgccgccgtcatccccgatggagaagaacccaaatactgaggtgttcggaaaagaccatggggtagattcgcagctgagatccgagacccgtggaaaaaaaccagggtttggttaggtactttcgattccgccgaagaagcggctcgagcttacgatacggcggcgatgacactgcgtggaccgaaagccaaaacgaatttcccaatcaatccctcgaatattaccgcttttccgatcgatcaccaccaccgtcggttatacctgatgggtaattttcaagacccgaaaatgaacccacaaagaccgacgaggagcagtatgagtagtacggtggagtcttttagtggaccaagaccaacccaaccgccgctggaatcagttgtgtcggaccggaaacattatcatcatcggaaaccgccggtgttgccagaggattttcacagtgactgtgattcatcatcgtcggttgtcgtcgacgatggggatatggcttcttctccatgtaagcaaaatcaaacattgatgccttttgatctcaaatttccaccgttggatgaa

SEQ ID NO: 15897 - DNA, 1030 bp, Gossypium hirsutum
  Predicted polypeptide sequence is orthologous to G1380
attgatataacaattttgcttttctttcaatctttgaaatttaaaagatctgatttttcattacctttttgagagaattggttgaagacttaacttccgattatttccgatgaggaaaggaagaggagccaccgcggctgccgatgcagcgatgaaaccggcggtagaagccaacggatcggtcaaagaactaaggtacagaggtgttaggaaaagaccatggggaagatttgcagcggagattagagatcccttgaaaaaaactagggtttggctagggaccttcgattcggccgaagaagctgctcgagcctatgatgcggcggcgattaccttccgtggaaacaaagcgaaaacgaatttcccttttaattcctccgatttccctgctttcggaatagatcgtcatcatcgtcggaacaacgaaggatttatcgccgacggccaccggtttcatcagacgggcggcgattatgaagatccggaagtgaacccgcagagaccggcgaggagtagcatgagtagcacggtggagtcgtttagtggtccgagacctacccaaccaccgcgaaaaccatcagatttcgaggcggtttcgacgaggaaataccatcccaagatgccgcggatggcgccggaggattgtcgtagtgactgtgattcgtcgtcgtcggttgtcgatgacggggatgacgataacgtgtcgtcttcgcgtcggaaaatcttgcctttcgatctcaattttccaccgttggatgaagtcgatgatctcaccttatctctctgatcagcggtaacgatcaatttatcaaatccttatgatttaagatgaaatagtacgatttcccttcgctatttatcaaatgataaagatcattgttgttttagaaatatgatcatgaatttagggttttcgattttcatatctcagtctgattatctgatctttctttcttgtataaaacaatttgtctaattcaatccctcaaaagaaaaaatgggtctttgattctaaaaaaaaaaaaaaaaa

SEQ ID NO: 15898 - DNA, 948 bp, Gossypium hirsutum
  Predicted polypeptide sequence is orthologous to G1382
gttttcctctttgacaatggaggaacaaatactagcttcttcttcagctgctgctgctgctgctgctgcttctgcttctgcttctgctactcagcacgatctatcggcttcagctgcttctagtggagctcgctacaagctggtggctccggctaagctaccgatctcaaggtcggcttgtattacgatcccgcctgggcttagtccttcttcttttttggagtctcctgttcttctttcagatgttaaggcagagccttcaccgactactggttctctcattaagcctcaggcagtgcatggctctgttaattctagtacatattcagtgactgctgcgtgttctaatgcttttgatgaaagaaatccaagctgctttgagtttagaccccatcctagatcaaatctggcacctgcagatttaaaccatcttagaagcgaacaatctctgcagatccaaggtcaattccagactatatcatataattcatcagctttggttaagagcgagatggcaggctcctcaaatgagttgagtctctcggtaccatttcatacagctacttctgtggctagtgcttctgctgaaatcgatgtagacgaattaaaccagagtgggaactcaaatagtgggatgctgtcagggcagactgatcatagagtaagtggctcatccacgatatcagatgatggatacaactggagaaagtatggacagaaacatgttaaaggaagtgaatttccacgcagttattacaaatgtacacatcctaattgtgaagtgaaaaagctatttgagcgatctcatgatggacagattacggagataatatacaaaggtacacatgatcatcctaaacctcaacctagccgccggtattcttctggaaatacaatgtctgtacagaggaaagatttgacaaggtgccacctttgactggtagagat

SEQ ID NO: 15899 - DNA, 780 bp, Gossypium hirsutum
  Predicted polypeptide sequence is orthologous to G1420
ggcaaaaagtgggttctcttaatctgttcaaaaaataaatctccccaaagttaaaaaaagttacataccattaattattaactaaaaccccaacttttttttaccctacacttgttcattagcctcgttcctcgtcttaattggaagcacaatatcttgaagaagcccatggtctctaattaatgaagctgaagaagagccattagggctaaaacatggattcaatggagacaatgaagcatacatatagggttgttctacttcttcttgttgctgatcctggtactgatgatggaccataaatgatggggtcaaaccgatattaccgaaaccgcttcctcgaggctgtaccggacacggatgcgtgtgtttgccttcgtaagtggtgataatgatcgtcgtatcatcgaacgatctctcgactcgtttcttcacaccacatccgctactagtgcaacgataatagcttcttggataagggctgtttttgaccgctttttggccatattttctccatctataaccatcatctaagtgatcaatttcagtctttgtgatgaatgcaaatctaggttccttttgcttttttttggttcttctttttatgttttaactgtttctttgtcttgtcttgttcttcatcatcgccggcgttagtactctgttcattaatattcgcagcttcattcgacaacgacgagatggaagacgagttcggcgttgccggcgggttgtttaaacactctgaaatttccgacacggtggaatacggctgcaatt

SEQ ID NO: 15900 - DNA, 864 bp, Gossypium hirsutum
  Predicted polypeptide sequence is orthologous to G1420
gcaaagataagaactttgggtttcttttgtttcttagataaacaaaaaatatggaggagaatatgtgaaaaagtgtatggagaagaagaaagagaatttaatttccatggcgaatttaaggttttccgatgagaatccgtcggcggtggcagcagcagcagcagcagcagcagcgaccagtttcggtggaagcatctttgacatggcaactggagcaggggcatgtgatggagatactaagtgggggtcttctttaggtttcatggacttgcttggcatccatcaagatttcattgccccttctttattcgattcctttcagccaccaccgattcttccaccaccacctccctcaacatcatctgaaccacttcttcaccaacaactggacacgaagcagcttcaagcccttccatcgccggcctccatcgtgccggaatcttctgaagttttaaacaaccctgcaacaccaaactcttcttccttctcttcttcatctaatgaagctgcaaatgatcatgaaccaaccaaagctgaagatgatgaagaagaagagcaggatcaagacaagacaaagaaacagttgaaacccaaaaagaagaaccaaaaaaggcaaagggaaccgagatttgcgttcatgacaaagagtgaagttgatcacttagatgatggttaccgatggagaaagtatggccaaaaagctgtgaaaaacagcccttttcccaggagctattatcgttgcaccagcgctggctgtggagtgaagaagagagtcgagagatcctccgatgatccctccatcgttgtcaccacttacgaaggccaacacaagcatccctacccgataacccctcgaggaagcat

SEQ ID NO: 15901 - DNA, 781 bp, Gossypium hirsutum
  misc_feature (207)..(207): n is a, c, g, or t
  Predicted polypeptide sequence is orthologous to G1435, G2741
gcacgagcctatctggaatcagatattgcactttgccttttctcttcggtttccttattttccttctaccctcttacttcccaaacagcccccgatttccacgcaaatatttgaaaatctctacagtttttactctttcatttccgatccaaacaatcatctctgaaaagtcatttcttattatttttaaatccctattttcaaggncaaaagcaataaatatgggtcaagaagtgaagatgagggactttgaagctaacggcggagacgatgaagaagcaaccgcaaacgccatcaccaccatcgttgatgacgacgacgacgatgttgaagaaagagttatcgaatgggagatgggattacctaactgcgatgatttaactccattatcccaatccttaatcccgccggaacttgcctccgctttcagcatctcgccggagcctcgtcggaccactgttgatgtcaaccgcgcttctcgcaatactctctcttctctccgctctaccggggcccactcctcaaccaccaataacaataacagtaatagcaatttccgtgatacgatagtggttgaagcggaaggatatgggtcggggtcgggctccggatctgacccgaagaagatgaggaagatggatattgcagaggaagcggattcagcggttaggacgacggagaactcggacgatccgtcggggaggacattgaaacgacagcgtttagtgtggacgccgcagctgcacaagagattcgttgatgtggtggctcatctagggat

SEQ ID NO: 15902 - DNA, 844 bp, Gossypium hirsutum
  Predicted polypeptide sequence is orthologous to G1444
cttttatttctctctcaaagcaaaatctgactttttttctttctcttctctttgccttgtaaagattgattatatcttgctttgctttggtttggtgttttgtttttttttattttattttctcgagagagaaagaaagggaaaatcttatctagcatcgatgaggatcaggaaaagacaggttccgctacctttctcttccatttcaccagtacccctttcatcagatcccaactttaaccgccctccggtagcggtggtgcaactcccgctacggcagcaacaaccatccactccttgctgctttgatcctcactacccttctcaatctgatcatccgatcggccaaccactaccaacccaaccccgtgatggaacaacacatggagaacaactcacgaagaacaaacaagactacttggttttgaagactggaggagaagaagaagtggagaacaataatgataccagggagaaaaatgttttgcgtgcaaaactaggaactgcgtctcctccacagtcgagttcttcccatcatcaagctgttgggagatggggtgagggagaaaaagcatttccattgaagaagagaagagggagcgttgaaacaacaggggacgatgatgatacaataatggcgaaagatacaaataataagcggtcgatgaagagcagtaccagcaagatgaagactaagctgagcaagaaacttgtgcagcagcagcagcaaagcaatggtgaagaacaagagagcaaagacattgcttgcactaatgttgattataataataacaattctagtggtgcaaaaaagagaggtcgaggtggtgcactcatggaaagg

SEQ ID NO: 15903 - DNA, 822 bp, Gossypium hirsutum
  Predicted polypeptide sequence is orthologous to G1451
cacatagtttcatgtagttattgtaacttttattctagctaacaaaaagtgagaatcatacatatggtaggtatttataaattcagtgatttttataaaaagaaaacagaaggagctttaattctggtggaaccatttaagatctaacaatgaatccataagatatggaattcagaaccacacaagattcatgttcttgacattattaacacccatataaactctgcaatatttatgtctaatttctggcaatctgaagtccaaggaagaagagtaacctgctcaccgtggccttgaggaaaatacatcactcgactatcgatcgcaggcaatgaaacaagagagccggcacatgcatgccacaactcagaattcaggcacttgtgctcttcaacttgtgaaaaaggcaaaaacatttgagcataagacataactgaatgaagtttacaaataatctcataaattgagtggtagttgtagatctacaaagcatcttacaaacaaatcctagttcatgaaatggtactaagaaagtattattatgagcagaatggaaaggttttttagtataaaatggatataattgttaacaaaaaacatgtttctagaaaagaaattttctgaacagagtctgcatcaagaacctcatatttcattactaatttgcttacgctgaattagacaaagtgctgaacaagaataaaaacaattgcaaaacatgtcaacggcttaataaatcacccaacagaagagtgaggcaagctcagagcccaccacattggatcaaataatgaccgaggaatttaaatcaagaggcagaag

SEQ ID NO: 15904 - DNA, 731 bp, Gossypium hirsutum
  Predicted polypeptide sequence is orthologous to G1451
catgctagctgggcagttaacaccgcggtcctgggctccgaagtatacccattcagaggtaaatgcctttggtagctctacatcacttccacaagtgtttcctggaaaagatgctgtaatagagccagatattggcaactctggtgcccagaattctgctctttttggtaataacaattcatatggccttctgcttcctacaatgatgcctgctattgcaacatcttcatgtgaagctgatgtgccctcaattccattaggggactcctcattccagaatcctctgtatggttgcatgcaagactcttcagagctgtagagcagagggcaagttgacccaccaaccccaactccaacatttgtcaaggtttataaatcagggtcagtgggacgctcgttagacatctccaggttcagcagttaccatgaactgcgagaggagctggctcagatgtttggaattgaggggaagttggaagaccctttaagatcaggctggcagcctgtatttgtcgacagggagaatgatattcttctccttggagacgacccatgggaggcatttgtgaataatgtttggtacataaagatactttcaccagaggatgtgcagaagatgggcgagcaacgggcagagccttttagccccacaaccccaggtcaaagaatgaatagcaccggcactgacaccggcactggtagactctcatctgttggttcccttgaatact

SEQ ID NO: 15905 - DNA, 521 bp, Gossypium hirsutum
  misc_feature (15)..(15): n is a, c, g, or t
  misc_feature (29)..(29): n is a, c, g, or t
  Predicted polypeptide sequence is orthologous to G1451
cgatattcttctccnttggtgatgacccnatggcaggaattcgtgaacactgtgtggtatatcaagatactatccccacttgaagtacagcaaatggggaaaggtcagaatcctgctacttctattccgaaccaaaggcttaacgccaccaccaccgctaccaccagcagcagcaatggcaaccactgcggtgactacatgagcagacaggacttgagaagttctgttgcatcaatggggtctcttgaatactaaatgaaaatcctcaggactgaataaagtttttgatgaattgaaaatggaaagttgaaggagataaatcattaacgttgtaggtgttatatggtactgttagtaatatgtaagcatatgtattgatacaacatcaatttaagatttacccttactgcctgggacctaggttgatattgaagcttttatgtcaagaccactactgtactgttgggaaaattataagtggaaatatgattctccgactcaaaaaaaaaaaaaaaaaaaaa

SEQ ID NO: 15906 - DNA, 926 bp, Gossypium hirsutum
  Predicted polypeptide sequence is orthologous to G1474
cccttttcttttcaccccgtattgtaatggagcaaggaaggtattggatgtggacaaagaggagacatggtttgacttctcatcatcatcatcatcatcatcatcatcatcatgttgaatcatcaacaaaggagggtgcatattatgattcatgggaagaacaagcttttgcagaagatgcttgtggtactcttggtgggtgtatatggccaccaaggtcatattcttgtagcttctgtgggagagagtttagatcagctcaagctctgggtggtcatatgaatgttcataggagagatagagctaggctaaaacaatcccctccatctccatctcctccccaccatgagcaccatcatcatcagaataacattcaggatccctttttgcctttgggttttccgtgccagcctgatgaggtttgtaactttctttataaccctaaccctaattccaatcatggtactactaaacaggattgtccagggcctcctcttttctcttcaccaaaaccatggtcaaacttgacagctgacagatatggaggagacaagagtccaagaaccctagttgttcgagaaacacacaaagaagacatcactgtcggttgtaagagaaagagaaccgatgatcacacacccaccatgaccttattaccattcttcctcgagccgatttcaattcaaaagcaccatcatcatcacccaccagctgatgaagacaacaacatagatctggaactccggcttggtttaaacgcccagagctgaaaaaacatcagacggtcagttggaagagagaaataagatccatgaatgagagaaagacatttttgagagcacaaagaatgtcactattacaacagattctaatttgaagatcatttgaagaattaaatttatttatttgcgaaaaaaaaaaaaaaa

SEQ ID NO: 15907 - DNA, 694 bp, Gossypium hirsutum
  Predicted polypeptide sequence is orthologous to G1478, G1929
gcttagcgtggtcgcggccgaggtacttttttttttttttttttttttttggaaaaaacaaggctaattatgcattaatgatcaagtcaatctggtttacacaactctgggtgtctaatatatatatatagcttatatgtaataattcaggattctctttcatccataactatatctcagacagactaaaatacccccatcaccaaaagacggagaaaaaaaaatgacaatcaaagaaaaagaaaaggaattttaagcgttgttgaatgctccgtttccatctcaaagttacagtgtcgtctctcagaccaactcaccattgttggtagcagcacctcatgtgaagctcccatgaggtatctctgtgttaaattttgacaagtattgcaaaggaaacacctgatgtgtctttgagccaagaaattagcatcatgaacccatttgtcgcatttcctgcacaggtatgcatcatctgcttgacaatataaggttgccctggagttgcagaactcacacttcaccaaccttgttgaaaccctaggatttgcattaggtgagagtgagacaccctgtttcagacaagaacttgatgtgcttccttgttgtaagcctttgcacatggttggaggatgatggagaaaatttgaatgggaaaaatgggtcccgcgtacctgcccgggcggccgctcgaagc

SEQ ID NO: 15908 - DNA, 946 bp, Gossypium hirsutum
  Predicted polypeptide sequence is orthologous to G1480
tccaaacccaaaatcaaaaacaaacacttcaaaccctccacgtttgatccaagcataatattttttatttccattgctttgatttgattcgcgattatgggaatcgaaataagcggcggcacgatcattccaggaggttggggcgccgccgccatggctgtcgcggctaagacatgcgacggatgtaaatcatcggcggcagctatcttttgtcgtactgattgggtctttttatgcttgaattgtgattccaatttccattccggtcacgggagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatagtcaaatcttccccttttagcttccttgtgccgacgacagatcataatggtactaattgtaaacaagaaattgaagctaacaaaggggattcgtttttcacagaaatggattcgtttatcgatttcgggtacccgaattcatctcaacatcttcatgatgccgccatggatagcgttgttccagttcaaactccaaaaccaatcattccactgatcaacgatggaaattgtttcgatactttcagctatcaaactcaatcatctctcagtcatagcgtttcatcatcgtcgcttgaagtaggaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgattcgctaaaagaacagaaacccacaacgatg

SEQ ID NO: 15909 - DNA, 995 bp, Gossypium hirsutum
  Predicted polypeptide sequence is orthologous to G1480
ctgaaaagccttcccaaactcagctcacacccacagaaagagagaggaggagaaaagataacttctagcaaactgggttgttgaaatggcatcgaagttgtgtgactcatgcaaatcagcgacggcgactgttttctgccgggctgactcggcgtttctatgctccaactgtgactccaaaatccacgcagccaacaagctcgcctcgcgtcacgctcgagtttgggtctgtgaagtctgcgagcaagcgcccgctcacgtcacttgcaaggccgatgcagccgctctctgtattacctgcgaccgtgacatccactccgccaaccctcttgctagccgacacgagcgcctccctgtaacccccttctacgactccgtcaattcagtcccagccgtcaaacccaacggagttgttaagtttctggaggagcgttacttctccgacgtggacggagacgctgatgtcagccgggaggaagcggaggcggcgtcgtggctgcttccgaaccctaaccataaggctgtggacagcccggacgtgaactcggggcagtacgtgttctcggagatggacccgtttctggatctagattacgggcatggggatccaaaaatggatgcccaggagcagaacagctccggcaccgatggggtggtccctgtccaaagcaagaatgttcaagctccgtcggctaacgatcactgtttcgacttggacttcaccggatccaaatccttctcttatggctacaaccccaacttcatcagccacagcgtatcatcatcatcattggatgttgggggtagtcccagacggaagtacgatgacggacatatcaaacccgtacggaagagggcctgagtcaacacatcagacggtgcagctatcaccggcggacagagaagcaagggtgctgaggtacagagagaagagaaagaacaggaagttcgagaagacgatccgttacgcctccagaaaagcatacgcggagatg

SEQ ID NO: 15910 - DNA, 819 bp, Gossypium hirsutum
  Predicted polypeptide sequence is orthologous to G1481
tttgtttaagatgataatgcactaattcaccactgttaaatttcagaattacaaaacctcgaaagatatcaaactagtaaaaatcttagatgataagcacaaatgaattacaaaatctctgacagagagagattaaactagtaaaattcttaggtgatgagcacaaactaattactacaagggtcaacaatcccatcaatcatggactaccgttagaataggttagatcatcagaaatatcaggcctaaccaactcaaatctcaaattggactattactaacagaatttaggatatttgttacgggattttatcagagctctaatttttacctaatgactgcgtactcgccgcgcctctcgaatcggattgaaactgaaccgtaccctccgattcgatgatcggttggtcttttagcaccctcatagagtcaacagaaaccgcctcctcctcctcctctgctctattccgagtcgccaatacagtacggtaaccgtacctccgtttaggagatgaaagatccagatcgtcctgagaacgaagatctgaaccattttctctcaaccttttcaacggaaacaaatttgtcgatttatagatctctctttcgccatcagaggattcttcgctactggatgaacttgaagccggcggaggtgtatttgcaactgcagaccacggcacgacctgattatcttcatcctcctgcacatcatcatcggaaacagctcctccatcgttgccttccccgtcctcatcatcgttttctgcttcggtgtcttctcgatcgccgccgtcgacgcagctctcgcagacggag

SEQ ID NO: 15911 - DNA, 767 bp, Gossypium hirsutum
  Predicted polypeptide sequence is orthologous to G1481
gttcatacttccttttcttttaaccaaacgctccacaattttctcggaaaagaaaaaaaaatgaagaagtgtgaactatgtggaaggctagctcgaatgcactgtgaatcagatcaagcaaatttatgttgggactgtgatttcaaggttcatggagccaacttcctcgtagctaagcataatcgaaccctcctttgtcatgtttgtcaaagtcctactccttggctcgcatctggtcggaatctcggctccgcggtctctgtttgtgattcatgcgttgtgaacggtaataataagtgtgagtcatcggagagagagtctggtgaagaggaggagggagattatgataatgacgccatggaagaaacggaggaggaagaggaggccgagattgaagatgctgaaaatcaggtggttccatggtcaggggagtcttctcctgtctcaatgtcgaagcggatatctagcttgaagtctttgagtactaatgaaggggatggcggcggcggcggcaacggcaacggtgacggtgacggcggttctggattgaagagaatgagagaaagtcttagttcttggtctgatgatgagactggttgctcctcatctcaagtaagctcaagaggatcatccaatggagaagcatcatcgtcaatggaatcatcaagattattgaagcaaccaaaaatagctgaaattaatcaatcagctaggaatcaagatcatggtgaaacaaagtcaaggtcaacggctatcatcagttactt

SEQ ID NO: 15912 - DNA, 866 bp, Gossypium hirsutum
  Predicted polypeptide sequence is orthologous to G1481
gcctaatatcatgcgagtggtggtgtttggttggttaattacggggaggattgctaagcttgtaatttaaagctaaaggcaaggctgttcctagaagccactgcaagtttctcgttttttattccctctctctttctctctcaatcgcccattctctgtgacatacacgaaagagaaactaagaaacgtaaacaaaattctccaagaaaacgaaaggagaaggaacttgctgggagattcaagccaaaatatcttcttctttttttttttgcgttggttgaaggaggaaggagatgaagagttgtgagctctgtaagttagcggcgacaacgtcttgtgaatcggaccaagccagtttgtgctgggattgtgacgctgtagtccacggggctaacttccttgtggcgagacatgtgaggtgtctgctctgtcacgcttgtcagtctctcactccgtggagagccactggttccaagcttggtcgcacggtctccgtctgtgagaggtgcatcgacggcggtgatcgaaaagagagcgaagcggaaaatgacgatgacggtgacggagaagacgatgaaggagatgattctgatgatgacgtgtcagttggagatgatgtggaggacggagataatcaggtggtgccgtggtccacagtagcaaatacacctccgccggcgcctagttcttctagtagcgataattattctggtggtgaaagagaggtctctagatcaacaaatttgttttcattgaaaaggtcgagagggaatgcttcagatcttcactctcaggacgatccggatcgtttatcttcaaaacggaggtacggctaccatactgttttggcgactaggtgcagagca

SEQ ID NO: 15913 - DNA, 903 bp, Gossypium hirsutum
  Predicted polypeptide sequence is orthologous to G1493
ctcttatttctttctcctgtagaagaaaagaaaaatcaactcactttggatcaccaaaatttttcaacatcaaagaaaatagattccaatttatccttgttttattcactcgttggtccgatcccggtttaagcctttcaatttaacccctcatttctagggtttctcttcttcctctctgtttctactgtttctcgttttggtggagttcgttggtttattttggtgaattggaatcgttaagagagaaggattgtgattatagggtttctttttaaatgtgtgagtgagttgtgtttttctgactatggctaccatgcatagagttgtacagtccagtgtgagtacgagtgacgctaccaccaccagctacggcggcttgacgtcatgcaaagcagcggatattgtgatctctgatcagttcccggctgggttgagggttctagttgtggacgatgacattacctgcttaaaaatcctcgagcagatgcttcaccgttgccgctatcacgttactacttgcccccaagccaaagttgctctgaaccttttacgggagagaaaagggtgttttgatgtgatactaagtgatgtttatatgccagatatggatggttataaactcctcgaacatgttgggcttgaaatggatcttccagtaattatgatgtcggctgatgggagcacacgtgctgttatgaagggaattagacatggggcttgtgattatttgattaagcccatacgtgaggaagaattaaagaatatatggcagcatgttgtgaggaagaaatggaatgagaataaggagctagaacattcaggaagcttagatgatactgatcagcataaacgagggcatgatgatgctgaatatggttcttccgccaatgatgcaacaga

SEQ ID NO: 15914 - DNA, 881 bp, Gossypium hirsutum
  Predicted polypeptide sequence is orthologous to G1504
tttctctcattttcctttcatccaaacaatgcctctccttcactcttctgcttgaaacccagaagaaaataaaattatgaataattcttggtttgacaaagggtttgatggggtgaatgatgatttctttgatgatgtaataaagtatttggatttcccattggaagatgttgaaggcactgatggtggtgatggtagtagtggagaaggtgtcatagattttcatttgcctcttgatgatgacgtagaacacaacaactccggtggcggcgaagagtgggattgtaactttcagaacttggaaccgccgcctgctaatgttctcgccggcatgtcttccggcttttctggtgattttttcaatgatagttcgccgaaatgccttacggtttcttgtgatggatcttctcagctaaaccagtggtcgagcgttgcagaagcatcctccggcagaagtgttaccctacacagtgagcccaccgatgtcaaaggttcaatccggttccagacctccagtcccgtatctgtgcttgaaagcagtagtacttgctctgccgcaaatctggtacctattaaccctaaactcggttttctggtgaaacgtggtcgaagcaagcgcaggcgagcatctgcctttaatgtgcacttcacattgcctttcacgtcctccacctcctctacctcccaaggatctaattcatcagttggttctgaatctgaatcagaaagccatctcaccgaggaacctgccaaaaagaaactgaagaagaaaatgaacctgacatggctttcggatttcagcgagatgaagaaatcccctcccgacagcctatcgaagttaggaaatgcttgcactgcgaagttacaaaacccacatggcg

SEQ ID NO: 15915 - DNA, 906 bp, Gossypium hirsutum
  Predicted polypeptide sequence is orthologous to G1512
ccgtcccacgcgtccgtggtctttatctttcttagggtctagttgctcgattgttgctcctttattcaatatctggcattttcatgtgttgatcctctttcattttcttttttttcagagatcaagagtgtcctagtggttaaatctgagtttgttcgaactgatccatggattttgagcaatattatgctcgggaatggaggacagtcccaggtgcttcaacacccgagactttgaatggtaacttcaactgcaatatctgcttagattttgcacatgagccgattgttacactctgcggtcacctttactgctggccttgcatctataaatggcttcatgtccagagtgcctcccttgcttcagacgagcatccgcagtgcccggtttgcaaagcagatatatctcacaccaccatggttcccctttacggtcgtggccaatctgaatctgaacttcaaggcaaggcactttataggggtatggtgatacccccaagaccaccggcgagcagttcacatcctctcttatcacctacatccccgaacagtcagcagcttccttatcgcaacccttaccaaaaccaaaactacaacccccatgcttaccacgaacacgattcatcctccccgttgctaaacctcggaggttccagagtgaccggattccatcatccgcttgttgggatgtttggagagatggtatatgcaagggtgttcggaaattcggaaagcatatacgcatatccgaacccaaactacctaacgggaaatggtaataacccgaggttgagaagacatgagatgcaggctgataggtcactgaatagaatttctatcttcctcttctgtttgtttccttttgtgcttgattgtattttgagcttctattttacttgccattttg

SEQ ID NO: 15916 - DNA, 942 bp, Gossypium hirsutum
  Predicted polypeptide sequence is orthologous to G1521
ctcgtcttcaccgaaaccattggggaaatcggacatccagagattcatacgaagagtaatttgtccggccatcgtcgacgaaacatgtcccatatgcttgagaaccatcgacattcctggagcggcagttctcaccgtttgtttccacgcttactgcttggactgcatccgcaagtggagcgatttgaagaggaattgccctctctgcaattccaccttcgattcttggttctacaaaatcgatctctcctctctaagatacctcaaacagcagttacctgctatctctgactgcaaatcggctattccacgacctcggttcaccgtatctgatcgtcgacggatcatcgaaaggaccagaagagaaataaacgatgttaaccggagaacgagaccgttgccttggcggcgatcttttgggcgacctgggactgtgtcgcctcttgttatcgccgaaaggaagcttcaatggcgtgccagtgtgtataaccgacggctgcaagctgtgcctatatatcatggtaatggttttcagcagaatgttcctaggattaggaatgattttgagaaagagaaactactgcaaagaatagaaccatggattcaaagggagcttgaggctatccttggagatccagatccatcaatcattcttcatgttgtgtcctcgcttctcttctctagacatgaaggaaagcatgatgactcttccgcctcttcgacacagctcagttttgtcaatgacaactttcttgcttctttggaaccttttttacacgaccaaaccaacatgttttggcatgaactcagatgctttgtggagagtccacttaccatggaaacttatgatgcagtagttgagtatagatagatggagtagcggcgcttagccgagttgcatattattttaactgtctacccactatatctgtggcgttagag

SEQ ID NO: 15917 - DNA, 2702 bp, Gossypium hirsutum
  Predicted polypeptide sequence is orthologous to G1535
ttctttttctcttcatcttcttctgcaaaagaaaacaccgacaacattagttgtgcaaagactgtaagagcaacaaaaagagggagaaaaatgtatggagattgtgaagctatttcatcaatgggagggaatctggtggtgtcttcagaaactttatttacatcaacatttcaaaaccctaatttcagttacttgcctttggagcctttacctcctatgatccctaaagaagaaaatgggtcattgttgagaggaaaagaggagatgaaaagtggttccgaaagtgaattacaagaaaccactgagcagccattgaagaagaaacgttaccaccgacacactgctcatcagatccaagaactggaagctgtttttaaggaatgtcctcatccagatgacaaacaaaggatgaaactgagtcaagaacttggcctgaaaccacgacaagtcaagttctggtttcaaaaccggcgtactcagatgaaggctcaacaagatagatcggaggatgtgatacttagagctgagaatgattctttgaagagcgagttttacaggctacaagctgaactcagtaaactcgtttgtcctaattgtggtggtccacctgtgcctggtggggtttcttttgatgaacttcgtattgagaatgctcggctcggtgaagagttggaacgtgtgtgtgccatagcttctcgttacattggtcggccaattcaaacaatgggtgcattgatgccaccttcattagaattggacatgaacatatatccaagacaattccttgaacctatgcctcctaccttgtccgaaacaccctcttatcccgacaataacaacctcatcttaatggaagaggagaaaactattgcaatggaactcgctatgtccgccaccgatgaactcgcgaagatgtgtcgaacgaacccctttgggttcgtaaacaacgaaaccgggaaggaagtgcttaacctcgacgaacattcccgaatgttccactggccactaaatctgaagcaacgctcaagtgaattcaggaccgaagctagccgtgatagttcagtggttataatgaatagcattactttggtagacgcatttgtggatgccaacaaatggatggagctgtttccttcaatagtagctagagccaaatgtgttcaagttatatcacaaggtgtttcgggaaccaacggttgccttcaattgatgtatgctgaattgcattgtctgtcgccattggtgcccacgcgagaggcatatttcctacgatattgccaacaacaaaatgtggaagatgaaacatattgggcaatcgttgatttcccactcgatggctttcataacagtttacaaacatcatttcctttatacaaaagaaggccttctggttgtttgattcaagacatgcctaatggctactcacgggtaacgtgggtagaacatgcagagatagaagagaaaccaatccatcaaatattcagccacttcgtacacagtgggatggcatttggagcaaatcgttggttagctgttttagagagacaatgcgaaaggattgctagtctcatggccactaatatccccgacattggagtgataccatcaccagaagcaaggaagaatctaatgagactgtcccaaaggatgataagaacattctgtgtgaacatcagcagttgcagtggtcaggtttggacagctgttcctgattcctccgatgatactgttagaatcaccacaaggaaagtgagtgaagcaggtcaacccaatggtctcattctttgtgctgtgtccaccacttggctgccttatcctcaccaccatgtcttcgatcttttgagggatgaacgccgccgagctcagctggaggtgctatcaaatgggaatgccttacatgaagtggctcatattgctaatggttcccatcctggaaattgcatttcactccttagaatcaacgtttccagcaactcatcacaacacgtagacctaatgctacaagagagctgcaccaacaaatccggcagcctcgtcgtgtactcaaccgtagacgtcgattccgttcagctggcgatgagcggcgaggacccgtcgtgtatcccattgcttccgttaggcttttttataaccccaatgggactggtgaatgatggtgggtgtaaggacgaagcaaatgggcataatattacaacagggagtttactcaccgttggacttcaagttctagccagcacaataccatcagcaaagatcaatctgtcgagcattgcagccattaacaatcatttatgcaccaccgttcaacaaatcagtagtgctttgagtagcaattgcatcgggtcttgcaatgaaggtgacaatggtaaagaaaaatagggtgttggtgattcgtgaattacccataacatccttaattttgttaactaattgaggaagttattggtaattgtactgaaagtcgtgcactgggatttatagtaattttaatgtggtaaataaagagtgtaatgatgatggagggttaaatttgaaaacttgggggggtataggtgaagtcaagagcgcaccaattgtgaccctttgcttttaatggtaaaggccaccaattaacaagggtgggtggttcgggtatttacttcacctttctttcccttttttttttaatttttatagttataataaacctaaatattttactt

SEQ ID NO: 15918 - DNA, 824 bp, Gossypium hirsutum
  misc_feature (790)..(790): n is a, c, g, or t
  Predicted polypeptide sequence is orthologous to G1538, G1545
gcggccgcgttgaccttaaataaaaaaaattcatcatgacaacccaaatgaaagagcttgaagatccaatggctctaatcacccaaatgtacccttgcatatacactcaagttgcaccacaacaaggggaaatatcgaagcctcgacgacgacagaagaagaacaagggaggggaaagcggggcggcaaccgcggcggagacagctaagaaaaggaagcttagccaagaacaagttgatcttcttgaacttaactttgggaatgaacataaactcgagtccgagaggaaagaccgactcgcttcggagctcggtctggaccctcggcaggtcgcggtttggttccaaaaccgaagagctcgttggaagaacaagaagctcgaggaagagtatagcaagttgaagacaatccatgaaggtgttgttcttgagaaatgtcgccttgaatccgaggttttaaagttgaaggaccaacttcgagaggctgaaaaggaaattcaaggattgacagaacgagtagacggagtttcgagtaatagtccgagttcgtcgtcggttctttctatggaagccatggatccaccacctttcctaggggaatttggagtacaaggatttgaggatcaagatgttttctatataggcatggagtggatgaatctatatatgtgactttaactttaatatgtgtaaataattatgatatttaaaaatatattaaatataatgtaattatatcctaattatcctaattaactttaaatttagagattaatgttattaactactanaaaaaagtcgacgcggccgcggtcgacgcgccgc

SEQ ID NO: 15919 - DNA, 760 bp, Gossypium hirsutum
  Predicted polypeptide sequence is orthologous to G1538, G1545
ccgtttctcaatttaagtgaaagccagaggaaaaaaaaaacacacccgaaaagctagaaagaaagagaaaatgagccaagattatgaaatgatgacaagccaaatgaatgaacatgaagatcatattgctcttatctcccaaatctaccctggattttacacccaaattgcaacacaccaaggtactgatcaatgtggcatggacttaaaaccacaaacatatttattcttgcattgttttataattaagccaggcttttggttgagcaggggaaccgaagcctcgacggcggcggaagaagaacaagggaggggagaacagccagtgtgcggtggctaaaaaaaggaagcttaaccaggaacaagtcactctccttgaacttaattttggtaacgaacataaactagagtcagaaaggaaagatcggattgcttcagagctgggacttgaccctcgtcaggttgctgtttggttccaaaatcgtagagctcgttggaagaacaagaagctggaggaagagtatagcacgctcaagtctcttcacgaaactgttgttctcgacaaatgccgacttgaatccgaggtatgtaaatatacatatatcttttatttcccaaatgaaaatcattttaacttgcaaaaaaagaaaaaatccggttttaatcacacttgtaagtttatttggatgtttaaatgcaaaccctttgtttttcttatattttagacataattccttgtggtttcttagaaccaaacagg

SEQ ID NO: 15920 - DNA, 876 bp, Gossypium hirsutum
  Predicted polypeptide sequence is orthologous to G1554
ctagcatgtcaccactattcttccaaacaacaacttttatcagatagttttctttttcttcttctcttgtcttttattacagtcagacaccccgtacaaaaacaaaaacatggcatcatcttcttcttctgaactaacccttgattgtaaaccccatggccattttgcggcgccgtccaagtgttacgcagaccagcagcagattgttgttgttaatcatacattgaagcttgaagactacctctctcgtctcgaggaagaacgccttaagatcgatgctttcaaacgtgaacttcccctttgcatgcaacttcttaccaatgctttggagtcctcaagacaacaactacaggcataccgagcgaatcaaggaccaaaaccagttcttgaagaattcatgcccctcaaaacctcagtgtcggagaacatggacaagttccaaaccatatctgatcataaagccaactggatgaccactgcacaactatggagccaagcaggacattacgaaaccaaaccacaatcctcctcaattactacatcatcccctaaagacactgatattggtctgaatgttgttagtcccaagttaggatcatcattagattccaaacaaagaattggaggagctttccttccattctccaaagacagaaactcatgcagtactgctctccctgatttatcacttgcttcttcagacactgaaaacggaacatcttgtcaacagagagatgatgggacaagtaacaacagaactgatgggcaaacaacgaatggttctaatactaatcaacctcataggaaagctaggcgttgctggtcacctgatttgcacaggagatttgtcaatgctctccaaatgcttggtggctc

SEQ ID NO: 15921 - DNA, 724 bp, Gossypium hirsutum
  Predicted polypeptide sequence is orthologous to G1638
cttaccctataaagattcatcacttataacactccccttctctatatcctctctgtttcttttctcgcttgatggatttcaagtattctttttccagctttaatctttcactttatgagttaagtttctgaattttaatttgcatatagattttcttgttattctgtatgattttagatctgttatggatgtctaaggctttcaagatttgatacttctttgctcatttaacaagtcacttccctgcatttttttacatctttgagttgctccatttcaaagtgggagagaagcaagtttttttttttaatcatgattaatcggggacttcaagttctatctcaaacctcttacttacaaacttggaattggttgtttcaagagagcaatggaacaaaatggagtgctgaagagaacaagtgtttcgaaaatgctctagctttatatgatacagacacacctgaccgatggtttaaagtggcagcaatggttcctggaaaaactgttgaagatgtcatcaaacagtatagagaattggaagaggatgtaagtgatatagaggcgggattgattccaattcctgtgtataacactgattctttagaattgacttgagttaagaatatcaaggatttaaggaattaaaacttttaactccttgtttgtaaaaattgtttggttcttacttctgatctgactgacaatgtttcctgcatgagaaaaa

SEQ ID NO: 15922 - DNA, 563 bp, Gossypium hirsutum
  misc_feature (51)..(51): n is a, c, g, or t
  misc_feature (352)..(352): n is a, c, g, or t
  misc_feature (433)..(433): n is a, c, g, or t
  misc_feature (500)..(500): n is a, c, g, or t
  misc_feature (553)..(553): n is a, c, g, or t
  Predicted polypeptide sequence is orthologous to G1638
caatttcgtgactacccgaacaccgactcaagtggcaagtctatgctcagnaaatactgtcatcaggcaggatcaccggggggtaaagacaagaggaggtccagtatccatgatatcacaacggttaacgtccctggatactccctcttcgtcaccggatcactgcaagcattcgtcttcaagtgattcttctgcagtcatacaggcacagcagcaagctaaactagccacaactaaagagatcgactttgaatgtaagcaacaaaatggagcagctatggttttcaaccggacgagtaattgcaatgctttcctgccccccttctgtgggatttcatcatacggacccaanctggaggaacaaaatttgcttggagaaactcttcccagatctcaattcggatcttacaacactcttttccagatgcagtcnatgcaacaacatcaataaactgagtgataatgtgggaagacttttctcaaggtattattattagttnaaagagatgaagatgaagcctactagtgatgtgtatatcttggagatgcattnttagtccata

SEQ ID NO: 15923 - DNA, 700 bp, Gossypium hirsutum
  Predicted polypeptide sequence is orthologous to G1638
gattttcactgatttttgatgttgtaatgattttgggtttttgaattttgatttatatattgatttttcagtgttttaattcagtgttttagttggattttggatctttttatgtatatctaggtttttttttcatcaagatctgattttcccttggattttggaacttgaggttcttttaaagagattccttcatggattccattaatgcttgaatgatttaaaagttaaaaaaacaaccatttctctgcaatttttttccttggattttctctctctttgaacaagagggagaaaaaaagcagagcttttatttttaggggcaaatcatctttggcaaagaacaatgaataggggacttgaaatcctttcaccagcttcttttttacagacatcaaattggttgttccaagagagtaaaggtactaaatggacaccacaagagaacaagtgttttgaaaatgctttagctttgtatgataaagacacacctgatagatggtttaaggtagctgccatgattcctggtaaaacagttggtgatgttatcaaacaatacagggaattagaagaagatgttagtgatatagaagctggtttgatcccaatccctggttatagtagtgattcttttacgttggaatgggttaatgatggtcaagtgtttgatgggtttagaaattattattatacacctggt

SEQ ID NO: 15924 - DNA, 773 bp, Gossypium hirsutum
  misc_feature (756)..(756): n is a, c, g, or t
  Predicted polypeptide sequence is orthologous to G1641
ccgtcacacgcgtccgcgaaatggacatcagcagagaacactttgttcgagaatgccttggcggtttacgataaagatactcccgatcgatggcagaaagtggctgagatgatcccagggaagacggtgggagatgtgatcaagcaatatagagaattagaagctgatgttagcagtatagaagcagggctggttccaatccctggatatagcacctccccattcacattggattgggtgaatagcaatggctatgatggattaaaacagtcctatggacttggcggaaagagatcctcatcaggcagggctgcagatcatgagaggaaaaaaggggttccttggacagaagaggagcataaattgtttttgatggggctaaaaaagtatggcaaaggggattggagaaatatatcacgcaatttcgttgtcactcgaacaccgactcaggtggctagtcatgctcagaagtatttcattaggcagctttctggagggaaggataagagaagagctagcatccatgacataacaacggtcaatctcaacgacatgagaactccttcaccggacaataagggaactccttcacccgaacagtcttcggtgctcactcagcagccaaattctgctgccatgcccagaacacactttcaatggaatccgccttgtggtggggcaacaatggctttcaattcaacacaaggaagtatgttgatgtcttctccttacggggttccctcctatggattgaanatgcaggggcagagtct

SEQ ID NO: 15925 - DNA, 683 bp, Gossypium hirsutum
  Predicted polypeptide sequence is orthologous to G1655
tccatctccatctccatctcctttctgcaattattcccaactttccatggcttccttcacacccaatctagaacctgcccctgacacctctcttcagttcaagcccaagaaacccaggataacccttcaaaccccttcctcttgtcctcccaatcaacgcatccaaagaattaagcgatggcggacccaacgagaccaacacatctactcctccaagctcttccaggctctccgtcgttctcgtcgtacctccgcctccagggaagtccacgaaacggctgacagggttctcgccgttttggccaagggcaccactcgttggggcagagccattctcaccgctcgcaaggtgaccaaacataagaaagccaagctccctactaataacaggttgaggaagcccgatatttacagagagaggaggaaaacgccggctgttgagcggaagttgaaggttttgggacgtctcgtccccggttgccggaaactatccttctccaaccttatagaagaaactagcgattacatagcggctctagagatgcaagttcgagccatgacggctattaccgagtttctctgcggcggaactggcggtggaccgcagccgccggctgatcgccttccctctaatgtcaactcttgaaaaggtgtttattattaataattattattattttttg

SEQ ID NO: 15926 - DNA, 962 bp, Gossypium hirsutum
  Predicted polypeptide sequence is orthologous to G1660
cttcagctctcaagcaacaagcatggtgtagtaataataatagtagcgatgctgccagttcagtgtttctagcttccgtttctatgttttatctgcggagtgtaatattgaaagtaaatcagttttcattttcatggattacgaaagaatccaaaagcctcagggtggaggtggattttcccctgctaaactaaggactatgctcctaggagtagaaaagaaaagaaaacaagaagaagaacaagttgaatcttcagtagatttaagatctgaactttctcaccttgatgacgattcagggaaaagtggctctgatagttgcaaagatgtagatgtggtgagtgttcttccagaatgttccacttctacaacagctagttctacagctgctatgcaaaatgggaacgagcgaagatcaaaggatcattctttaggcactgctcaaaaccggttcattgaggatcatcctggtttagattatgatagtgggcatgacaatatgagtgtgtcctcgtcgatctttgagtttcagaagactgaacgagcaccgcaaagggttccccttgggccgttttctaagcctgctccatcgaaatgggatgacgctcagaaatggatagccagccctactgcaaatcggccgaagacagggcagggtgggcaaggagtgggatcaagaaaaggaggtaattttggttacgggaggcaatcgtctactaaggtggtcattgaagttccagatcaaaggatggttgctttcgaagaaccggatacaaaacggattgatactaatcatgctaagaaggatgatgggctgcagaagtttgttaattggggagagtgatccatacccagttgtggattcatatgggaagcctgtactaatgatcgggaactctgttgctgagtcagctattagtcttagccagcatgattcatcatatcgatacatagttgctacg

SEQ ID NO: 15927 - DNA, 913 bp, Gossypium hirsutum
  Predicted polypeptide sequence is orthologous to G1666
tttgaatttgtctgtctgatctctcacctgttgctcttttttcttctgctacccttcctcgggctcctcttgtctacccttcttttccttttcctttttgctcctttttaaggggttttggggtttgggtaaagggttttttgtgattttcagctgcagatatcatgatatataggatgattttatgattctgcttctttctgtttcttcactagtatataatatcccattttttccttctcattttctgacattaatatccagctcaaatttggagtgaatggctgtgccgcctagtaacaggcttcggaatatgttgcaggcggcggtgcaatcagttcaatggacctacagccttttctggcaaatttgtccccaacaagggatcttagtatggtcagacggatactacaatggagcaatcaagacacgaaagacactgcaaccaatggaggtcagtgcggaagaggcggctttgcaaaggagccaacaacttagagagctctacgactcattatccgccggagagtcgaaccagacagtccggcgaccatctgcagcgttgtcaccggaggacttaaccgagtccgaatggttctatttgatgtgcgtctccttctcttttcctcctggagtagggttgcctggaaaggcatatgcaaggaggcagcatgtatggcttactggtgcaagtgaggttgatagtaaaattttctcaagagctattcttgctaagagtgctcgtatacagactgtgctttgcattgctgtccacgatggtgttgttgaacttggcactacggagaagctccaagaggatctagagttagtccaacatgtcaaaccttcttcacagatgatataattcgtaaccccaaaccggctctctcggacactccacttcgaacccgcc

SEQ ID NO: 15928 - DNA, 920 bp, Gossypium hirsutum
  Predicted polypeptide sequence is orthologous to G1666
attacaaaaaaaaaagtgggtctcatttcttcttaaaaagtcatctaatttgtctttcttcttcttttttctctgatatgtagcttcttttcttcggactttgcctgtcagacccctttttttgttggtggggattaaagggttttttctttttttaattttcaggtggagatcataaaaccttagtatctccaaagggaaagttgtgaattttgtttgtggttttttttttaacgtaaaaatccaagctttaaatctgaaagttaatggcggcgccgccgagtagtaggctacaaaaaatgttacaggctgcggtgcaatcggttcaatggacgtatagtcttttctggcaaatttgtcctcaacaaggtatcttaatatggtccgatggatactacaatggagcaatcaaaacaagaaaaacagtgcaaccaatggaagttagtacagaagaagcatctttacaaagaagccaacaactccgagaactttacgactcgttgtcttccggcgacaccaaccaaccggctcgacgaccgtctgccgcgttgtccccggaagatttaacggaatccgaatggttctatctaatgtgtgtctccttctcttttccccctggtgtagggttacctggaaaggcatatgcaaggaggcaacatgtatggcttacaggtgcaaacgaagttgatagcaaaacattttcaagagctattcttgctaagactgtgctttgcattcctattcttgatggtgttcttgaacttgggtatactgaaaaggtgcaagaagatttagggttagtccagcacgttaaaactttcttcaacgatggacaagcaccaaaccctccgccaccgaaaccggctctctccgaacattcaacgtcgaacccggccgcttcatcggactacactcgattt

SEQ ID NO: 15929 - DNA, 627 bp, Gossypium hirsutum
  misc_feature (461)..(461): n is a, c, g, or t
  misc_feature (484)..(484): n is a, c, g, or t
  misc_feature (494)..(494): n is a, c, g, or t
  misc_feature (499)..(499): n is a, c, g, or t
  misc_feature (607)..(607): n is a, c, g, or t
  misc_feature (609)..(610): n is a, c, g, or t
  misc_feature (612)..(612): n is a, c, g, or t
  Predicted polypeptide sequence is orthologous to G1743
gggtttcccagtagcctactcagagcttcttcttccaagattgcttctccacacgctttctctccttgcttaccttcgcaaatttatttccactctcttcctctatttgggtctccccgatttcctcgaacccgacattccttggcgcgaatacgcccctgaaacccaccacgcttccgccgcccccgtctctgctctcctcatccgggaactcctacccgtcgtcaagttctccgacctcgtcgacccgccggagagctgcgccgtgtgcttgtacgacttcgaagggcaggatgagatcaggcggctgactaactgccgccatattttccatcggagctgtttggaccgttggatggggtatgatcagaaaacatgtccgctttgtaaaacaagtattgttcctgatgatatgcaacaaacgtttaatgagaagctgtgggctgcctctgggatccctngaatctttggtgattattctcanattactgctntgtanttatacctgtgcttcccacaaaaaaaaaaatgcttttttgtttatcatcttataagagttggtttgtatatatacatgaaaatcccggaaattaccgccatgatcctncnncnagaaggagagatcat

SEQ ID NO: 15930 - DNA, 675 bp, Gossypium hirsutum
  misc_feature (473)..(473): n is a, c, g, or t
  Predicted polypeptide sequence is orthologous to G1743
tttttttttttttttttttaaaaaataaaatggtggattttattgaattcttaagaacccaaaagccatatttttaacctaaaatttatctaattcttttcgaatatataaaatttaagcctaaaaaagggatactgttttgatccgtgtacatttataatgtacaattttttcactaaactaaatggataacacaaaatttacaacccggcaacggaaccgtactcactgtaaatatcgacgattccagaagctgcccagagccgttgattaaattcagcttgcatctcatcaggtacaaacgatgtcctacaaagcggacacgtcacctgatcgtgatccatccagcggtccaaacacgttctatgaaaaacatgcttacaattcttcaaccacctgatctcttcctttccttcgaactcgcacaagcaaacggcgcaactctccggtggatcaccaccaccgaccaccgngagttcctcgaactttacgacggctaggatttcacggatcaagagagcgggtaccggcggtttcaaaggtgtggttcgggttgggttttccggccaatcggtgtcggtttcgaggaaatcggagagtccgaggtaattaaaaagtgagaggattaggtttctgatgaaacccaaaaacgatagcgtgtgaacgaagaatttg

SEQ ID NO: 15931 - DNA, 296 bp, Gossypium hirsutum
  Predicted polypeptide sequence is orthologous to G1743
aagaaaaaataaaatggtggattttattgattcttagaacccaaaaatcatatttttaacctaaaacttatcaaattcttttcgaataggtgaaatttagcctaaaaaggggataatcttttgatccgtgtacatttataatgtacaatttttttcactaaactaaatggataacacaacaaatttacaacccggcaacggaaccgtactcactgtaaaaatcgacgattccagaagctgccgggagccgttgattaaactcagcttgcatctcatcaggtacaaacctaaatgga

SEQ ID NO: 15932 - DNA, 426 bp, Gossypium hirsutum
  Predicted polypeptide sequence is orthologous to G1750
tcttcactaagatggtgctcttcgagcctggaggaattcagccccaaaatctttcctcaactttgatttcaacgaagaaaggagaagaaatccatggcctgttcgcacggttcggttgtacggagaagataaccctggtgacgtggaggccgcacgcggggatctcacgtgggaagccaaccctctggccattccagtgtattccagaagcttctggcgctctcaggctgctgagcttctttttgggtcctgttgggcctcgggtttgggctatttgtaaactgggttagggatgtgggtttagtatttggattttgaaaattgtaagtggactttgtggactattttagtcatggactttattttaatttatttgggtttatttatttgacttatttattataaataaaaaaaaaaaaaaaaaaa

SEQ ID NO: 15933 - DNA, 860 bp, Gossypium hirsutum
  Predicted polypeptide sequence is orthologous to G1765
tttttgccttctacttagccagcaaaaagaataaaaaagaatcaaagatgaacatggtccatggcaccaccactactgtggaagaagatgttccacttcccggtttccgattccacccgaccgacgaagagctcatcgggttttaccttcgacgaaaagtcgacaacaaatccttaagaatcgaactcatcaaacagatcgatatctataaatacgacccctctgatctcccaaaaaccagcatgatgggagagaacgaattgtatttcttttgtagacgaggaaggaaatatcgaaacagcgtaagaccgaatcgggtgacgggatcggggttttggaaagcgacaggtatcgataagcctgttttttcggttggaagcagtgaagccatcgggctaaagaaaacgttggtgtattaccgtggaagtgcaggcaaaggaactaaaaccgattggatgatgcatgaatttcgccttcccaatcccacattgactgcacaagatgctgaagtatggacaatatgtcgaattttcaagcggcataaaaagaacaaacaagaatggagacaaggtgctactaaacgagcttcaactagcaatggcaatggtgtacatggctatgaacgttgcagtgtagaatccagcagccatgaaaattacattacatttggctctcaaagcattgaaaactatgatgataatgatgatgatgatggtgatggtgaaatggttatggatcatatgaagaatgacgggagttgcagaagggaatggtatcatggagagatgcaatgtatggtatcatcatcatcaccatcttcaagcttttctactgaaaatgatttcttcacaaatgctaat

SEQ ID NO: 15934 - DNA, 812 bp, Gossypium hirsutum
  Predicted polypeptide sequence is orthologous to G1777
gcggccgcgtcgacctttggaacatctcaaatctcgggttgagaaaattactcaaatattcaaaagcccaaggcttctgtacattaaatggattttcagttcacacaacctctgaaagacaaaagaacctatggacatccatgattcatcttccagactatctaaaatagaaaggaagtacaaaatgggggggggggacaaaaaagatgctaagcaggggaagtaaaagcatttaagcggttctctgctcaatccataaattatcaactcccattttagataaaatgagggtctctctagttagatatgtacatatgtacttatctagaaaaaaaagcctacttagagatcaattcctgtcaagaacttctgctggcaagttgagatcaaagaaaccacctccataactttccttcttaggttgctttggtgatgggcaacctttgtcgtctgaagtcccaaagctgaaagatcggtcacgtttgccgctagtgccacaatctgagggatggcatttaccagtagtagtactggctttaccattccaacagacagcaagctctgatgctttctcaatgcccttggatttgtatggagcgatattatgggtatttcgttggagagaacccagcaaatcattctcaatgcactcatacattttcttacaaagggaatcaatgatcacagaaagattgattacttgcattcgtatctccataactttatcatcagtatattgatcaaagggctcttccaaaaacttagaaagtttctcaacatttgcctcaagttgctgctgctgatcctcaaat

SEQ ID NO: 15935 - DNA, 550 bp, Gossypium hirsutum
  Predicted polypeptide sequence is orthologous to G1789, G1911
aatgattaatgcacgatatatatattcattaaaaacaggaacttttttatgtaccagtgctatgagataattaattggtacatataaggaagcacaactagtgtaaaccaagtatatagaatgaagatacaactttcaatttaagatacactttgagaagaaataataggcgacatatttgctgcttgttgcaccagacaactggctgcatttgctttattaaaggctaaggcctttgtttctaccggtttctgctcatatttcactgaagcctcagattcctcattctttgttctccatccgtgaaattgtatcctttgttccctccagctttcttgtaaggaggtaagggcacttggccagactcaatctgttggatgtcttcgacaaggttctggtaatgtagcttcacttcctccacggttttccctccaactgccctggctagattgtgccagcggtctggggtatctttgtcgtagcatactaaagcattctcgaacaacttgttttgctttggtgtccagctcgaacctgaggccattgcaat

SEQ ID NO: 15936 - DNA, 606 bp, Gossypium hirsutum
  Predicted polypeptide sequence is orthologous to G1789, G1911
ccttaaaacgcgtccgctctttttcttttcttctcttttctttggcctcagacccttaatttcgattgttaattatcactgttctgcaatggcgtcaggttcgaactggacgccaaagcaaaacaagttgttcgagaacgctttagctatctacgacaaggatacaccagaccggtggcacaagctagccagggctgtcggggggaagaccgtggaggaagtgaagttgcattaccagaaccttgtggatgacatcaagcagatagagtctgggcacgtgcctttgcccccttataagaaagctggagggaaccaaggatacaacaatttcatggacgatgaagaaccaaggatgaggaatctcaggctttagtgaagtatgaaccagaaatagctgtagaatatcaacctttcaataaaaggaaatgcaaagcagcaaacatataaattatctcttaatttcgtttacatttcctgctcatatatatgttttttgtgtgcttgaatgtaacaagcagccacaacgctcctatacttgcatgtgtcaagtatgaaattatagcattggtaccttgtttttattaatgttaacctatctttgttctt

SEQ ID NO: 15937 - DNA, 550 bp, Gossypium hirsutum
  Predicted polypeptide sequence is orthologous to G1835
cgcagttttttttttgggaaaagacataattaggttagaagataagataggtggactgataggaaatgtaaagacatctaggtgggttacatcactaaccctaatttgaaatccaccctctacttcccggtgattttatatttttctgctactcctcctaccaaacatgtcatcatctaacatcctacttattccactaatgtacacactgacaaacaaggaaaataatgataataataatagtaatagtaaaacacagaacaaggaagctccctgctaaatgcctgtaaactaataatcaatgcggttgctatttctggtggaattaacaccgtagatggtgttaccgacttcagcagcttggcattgtttcctcatctctatcaccttctgtgagagttggagtgcaatgatgcaacaaatgtaggacttgcagcaggacggtattctggaaagaggcggcagacctgtagcgaaccccacatgcattacaaagggtctttggaccctgggtccttctctccatgtgtggagttttgtaacttcacag

SEQ ID NO: 15938 - DNA, 952 bp, Gossypium hirsutum
  Predicted polypeptide sequence is orthologous to G1835
cccttcccttccttcttaatcaagctttctcgagaaaattcacttcattttcctggaaattatctcttaattccggaaagttttgctcactgattagtaacaaagatttgtttcaattgttagtgctatatagtaaacatgattggatcaacggatttcattgatgagatagattgcggcagcttcttcgatgatctcatcgacttccctaacgaagatgtcgaagcgtacgagtccaccgccgtcatcaacgccgccgcgtttcctagtatttggacaactcagcccgagtcattacctctttcggactcggtttttctcaacaacagtgcttccgagctttccactgaactctttgttccgtatgaagatattgttcaattggaatggatgtcaaaatttgttgaagatactcagtgtggagcaagcttgacaactaagaaagaagattcctcttcaatcagtgagggatccaatcatcaattccagacttgcagtccggtttcggttcttgaaagtagcagctcgtgttcaggaatgaaaccattgcctcgcagtcctgaaacgtctgcccctgggaaacgcggacgtccacgaagcaaatgtcctcgtctggccactttcaatcatcttccaggagttcagatgacctccccagcttcatctgtcaatgagaacgacattccccagccatttgctgtcccgaaggtgctgtcagattctgagaactatgctgagtcacggcttctgatcaaattaccgaaacaaggcaatccagaacataagaagaagaagatcaagttatcggtttcagctgcagcagccattgctgatatagtcaaatccactggacagctgttaggaatgtatgcactgtgagatactagacacctcaatggaggcaggccatgggtccgaaacctttgcatgctgtggtgtccgatacagtctg

SEQ ID NO: 15939 - DNA, 969 bp, Gossypium hirsutum
  Predicted polypeptide sequence is orthologous to G1835
ctcgaacaattctcttcattttcctggaaaattatctcctgtttccccagaaaagttttgctcacttagtaacgaaaggtttataaatttcttagagagaaattattaacataaagaaaccatgattggaccaaccaacttcatcgacgagatagattgcggcagcttcttcgaccacatagacgacctcctcgacttccctaacgaggatgtcgaagctggtttctccgccgctgattccgccgtcaacgccgccgcttttcccagcatttggactgctcaccccgagtcattcccgggttctgactcagttttttccaacaacagcgcttccgacctctccgccgaactctctgttccgtatgaagacattgttcaattggaatggttgtcaaactttgttgaagattcaaattgtggagcaagtttgacaattaagaaacaagagcctaattcaaacaataaggactcaccatcccatcatgatcatgatcaccatcaattccagacatccagtccggtttcggtcctcgaaagcagcagctcttactccggggagaaaccggttgccgcccctgggaagtgcggacgtgcgcgtagcaaacgtccccgtcccgccactttcaaccctcgtccagcgattcaccttatctccccgtcttcgtccgtcaatgacaacgacgttcctcagtcgttgtttgttcccaaggtgccatccgactccgagaaccacgctgagtctcggcttctgatcaagttgccacgacaagttaacccggaacacaagaagaaaaagaagatcaagttgacactcccagcagcagcaccaccacctactgataacaacactactcaaaatccatctgttaggaatgcatgcattgtgagataacaaagacacctcaatggaggcaggccaatgggaccgaaaaccctttgcaatgcatgcggagtgcggtataaatctgg

SEQ ID NO: 15940 - DNA, 569 bp, Gossypium hirsutum
  misc_feature (454)..(454): n is a, c, g, or t
  misc_feature (515)..(515): n is a, c, g, or t
  misc_feature (532)..(532): n is a, c, g, or t
  misc_feature (536)..(536): n is a, c, g, or t
  misc_feature (559)..(560): n is a, c, g, or t
  Predicted polypeptide sequence is orthologous to G1838
ggaagagatgaagcatgcgaccaagcaagagtttattgcatccttgaggaggaaaagtagcggattttcaaggggtgcatcgatttacagaggtgtcacaaggcatcatcaacagggccgatggcaagcaaggataggtcgggttgcaggaaacaaggacttgtaccttgggacttttgctactgaagaggaggcagcagaggcatatgatattgcagccatcaagttccgaggtgtcaatgcggtgaccaacttcgatatgagccggtacgatgtcaaagccattgcccagagttctcttcccattggtggggcagctaagcgcttaaagctttcacttgaatcagagccaaaaccgatagtgaaccagaagcaacaaccaccaccaccccggtgcagctccaacagcaatattataagttttgctcccatgaaacagccggtttccactatnccttgtggaatccctttcgatgcagcagcagcaatggctgcatttatcacagaatatctancagcaccttcagactgncacncagtgttctgaccccagtcttcnnacacgtatg

SEQ ID NO: 15941 - DNA, 1021 bp, Gossypium hirsutum
  Predicted polypeptide sequence is orthologous to G1852
tgcaaacctcccactcctttgcttctgcaacaaagttaaaacctactccacttctcaaatttcattcatacaatttcaaccaaaccctttatccaatctggatccgcaaccaaatcctgtgataaaccagccattaaactaactactcataccgaagatccaaaagcatgggtcacttaaatctacctgcatccaaacgcaacccccgccaatggaagcttttggacatcataaccgccatattcttcggcctcgtactcttgttcttcctcttagtcttcacccctcttggggattccatggctgcctctggtaggcaagccctgttgctttccacctctgatccgaggcaacggcatcgcttggtgtccttggtcgaacttggccaccaccacaagcccatcgaagcttgccctgccaattccgttgatcatatgccctgtgaggaccccaggcgtaacagccagctcagcagggagatgaatctatatagagaaaggcattgtcctttgcctgatgaaatgcctctttgcttgatccctcctcctcctggttataagattcctgttcagtggcctgaaagcttgcacaagatatggcactccaatatgccacacaacaaaattgctcataggaaaggtcaccaaggatggatgaaaaagcaaggtcctcactttattttccctggtggtggaacaatgtttcctgatggagctgctccatatatcgagaaacttgggcagtatattcccttgactggtggaactcttaggactgcccttgatatgggttgcggggttgcaagttttgggggttcattgttatcagaaggcattttggcactctcatttgctcctagagattcccacaaagcacaaatacaatttgcattggaaagaggaataccggcctttgttctaatgcttggcactcgcagactcccgtttcctgcatttgcatttgatttcattcactgctctcgatgcctgatccctttcacagcttataatgcaacttattt

SEQ ID NO: 15942 - DNA, 931 bp, Gossypium hirsutum
  Predicted polypeptide sequence is orthologous to G1852
cttccacttcctttctatgcaaaaaagctaaaaagtcttcaatgaatcattgaaatttaaatctaatcaaagcttcaacaaaacatgggtcacttaaatctaccaccatccaaacgaaatccgcgccaatggaaacttttggacatcgtctccgccttcttcttcgccctcgtactcttgtttttcttgttggtcttcacccctctcggcgattccttggctgcctctggtaggcaagctttgttgctttccacctccgatccaaagcaacggcatcgtttggtggagctgttggagcttggccatcatcaccagcctatcgaagcttgccctgctgattccgtcgatcatatgccgtgcgaggatcctaggcgtagtagtcagctcagtagggagatgaatttctatagagaaaggcattgccctttgcctgatgaaacgcctctttgcttgatccctcctcctcttggctacaagattcccgttcagtggcctgaaagcttgcacaagatatggcattccaacatgccacacaacaaaattgctgataggaaaggtcaccaaggatggatgaaagaggaaggtccttactttattttccctggtggtggaacaatgttccctgatggagctgcatcgtatatagagaaacttggacagtacattcccataaccggtggaactcttaggacggcccttgatatgggctgtggggttgctagttttgggggttcaatgctaaaagaaggcattttgacactctcatttgctccaagggattcacacaaagcacaaatacaatttgttttggaaagagggataccagcctttgttctaatgcttggcacccgcagactcccatttcctgcatttgcatttgacttaattcactgctcctcgttgccttatcccttttacagcttataatgca

SEQ ID NO: 15943 - DNA, 457 bp, Gossypium hirsutum
  misc_feature (95)..(95): n is a, c, g, or t
  misc_feature (266)..(266): n is a, c, g, or t
  misc_feature (380)..(380): n is a, c, g, or t
  misc_feature (402)..(402): n is a, c, g, or t
  misc_feature (413)..(413): n is a, c, g, or t
  misc_feature (432)..(432): n is a, c, g, or t
  misc_feature (443)..(443): n is a, c, g, or t
  Predicted polypeptide sequence is orthologous to G1852
gcacgaggaaagcttcctggttcaagcaagagcaggtgtaaccttgtggacctaatggtggagatggatcgcatgttgcgtcctgaaggaacagntgtgattcgagattcacctgaagtaatcgacaaagtggcacgcatagctcacgcagtaaggtggacggctaccataaatgacaaggaacctgaatcacatgggagagagaaaatcctggtagcaacaaaaaccttttggaagctaacttcatcccattgagacagacttgntctttataatgtaggtattttccttttcgtttcaatttttttattatctcgagccaagttgtcttcctcatgcatcaaatagatgcaatcttgtttcttgctcactatttgggnaatatttatatgaagaaactgnagaagtacaanatatatattcatataaaancaaaagggctncagctttctggcag

SEQ ID NO: 15944 - DNA, 903 bp, Gossypium hirsutum
  Predicted polypeptide sequence is orthologous to G1863, G2334
ggggctgagagtgccggtgtggggatggtagcaatgaggtcgtcatcatcaccatttacagtgtcacagtggcaggagctggaacatcaagctttgatctttaagtatatgatggcaggtttgccagtgccacctgatcttgtgctccctattcagaagagctttgagtccatatctcaaagtggggtattgttccttttatgggaagaaggtggatccggagccaggacgatgtaggaggaccgatggcaagaaatggcggtgttccaaagatgcgtatccggactcaaagtattgcgagcgccatatgcaccgtggccgtaaccgttcaagaaagcctgtggaatcacaaactatggcacagtcattatctactgtgacatcattgactgtttctggtagtactaccagtggtggtgggactgggacggcaagcttccagagccttccattacatgcctttggtggtacgcaagtcactgctttggcaaccggtcagtctaattatcatgtggagtcaatcccctatggaatcccgaggaaagattataggtctcaaggaataaaacccgacgcgggtgggcatagtttcatctctgaggctttgggaagcaaccgggacacatggcctctaatgcaatctagagtctcttcatttcctcagtcaaaatccgatggcaacccggtcttactgaatgattaccctcagcattcgtttttcagcgatttcaactcgggagaaactgtgaagcccgagggtcaatctcttcggccgttctttgacgagtggcctaaaaccagggacacctggtcagctcttgaagatgacagatccaaccagacctcattttctacaacacagctatcgatatccattccgatggcatcatctgacttctccac

SEQ ID NO: 15945 - DNA, 836 bp, Gossypium hirsutum
  Predicted polypeptide sequence is orthologous to G1865
cataacgcgtccgatcacccctttatgtatccccatgcatctagacctccaggggttggcctgtcacctcaagaaaacaccacacattctctcctcggctctggctcttactcccagactaacacggattacaggagaaacagttatgtttatgggttgaaagaagaagtagatgaacatgcttttttctctgaaccttccggtacaatgaggagtttctcaggttcatctgtggatgattcatggcaacttgcaccactaacaatgagctcctcttcctcaaagcagaggaactgttctggattacagagtgaatactcttacttgcagcttcaaagcctcactgatcacaacccgaaacaaaacaaacaggatgctgatgaacattcctatatcaaatatgaaatgactgatgaattggagaaaggcgaaccccaaaagacagtccatcgtttctttgatgaatggccaccaaaacatagagattcatggcttgatttggatgataaatcatcaaacagctcatcagtttcaacaaccagactctctatatccatcccttccacttcacatgacttccccattttcaattcaagagctcataatgatggttgaatgtccagtggtaggtttctgcattagaggccaaagatgtacgtagtggggatcacttctttctgtgaattctgactgtttagtctttcatttatttcttccttctcctttggctttttgttttattgttttttgttttctgttctctttttgctaaatatggttaaattgggttgtgtttcttttttcccttattaatgaatgatccaatgacttcttac

SEQ ID NO: 15946 - DNA, 992 bp, Gossypium hirsutum
  Predicted polypeptide sequence is orthologous to G1868
cgaacggatggaaagaaatggcgttgctcccgggatgccgttgctgatcaaaagtattgtgaaaggcatataaacaggggccgccatcgttcaagaaagcctgtggaaggccagaccggccacactgccactaattcaaaggtggagtcgatgtcttcctctatgttggcatcggcaaaaaccagtggtggtgcagccaatagtctcgcaattgcactgcagcaccggtctggtgctgctgatccttcttcagacacccttgtgaacagaatacaagatcaacgggggttttcggtgttgtcttccaccaccaacctgaaatctgatgactccaccacattcaccattacaaaacaaggtgttccgtttgtagaatcatctctatcggattttggacatgttgcttccgattctcttgtcaatccgtcgcataaaagctattacatgaactctaaggagtatggtcatggtctgttcctagacttcactggtcaagaaacacaagatcaaacaccgcctcaccaattcattgataactggcccaaggatcagtctagtcgttctattgttacttggccaaatgagttaaaacctgactggactcaactctcgatgtctattcctatggtaacatcagagttctcatcaaccttgtcctcaccagtgaaagagaaactcgacctttcatctcttaggttagttcaggagttcgatcagatccaaatgggtttaggagtgaacaatgacatcactgaacaaaccaaaaggcaacctaactggataccaatatcttggggaggttcaatgggaggtccattaggagagatcttaaacaacacgacgaacaacgcaggtagctgccagaactcatcgacacttaccttcttatcggaagggttggatggcaaccgcatacaattgcagaacacgcctttcagttcactttcgaatagcagctcaaggagcagtccaatagctgagaacaacaagaa

SEQ ID NO: 15947 - DNA, 956 bp, Gossypium hirsutum
  Predicted polypeptide sequence is orthologous to G1868
atcttctttgatggacaacaacagcagcaaatgctgagcttttctgctcccaaatcagaagctctttcaatggggaggagttcccaaaatgtcacattcccttactttcatctcacatcaccagcatgtactagaaatacaggctacaatactggaggatttaatggtgcaaatatgaatggaggaccattcacttcatctcaatggatggagctagaacatcaggctttgatctacaaatacatggctgcaaatgtgccaataccatcaactcttctcattcctataagaaaagcccttgattctgctggtttctctagcttttctggtggactcctcagacccaatacatcagtgggatggggagctttccatcttgggttctcaaacaacactgatccggagccaggacggtgtcgtagaacagatggaaagaaatggcggtgctcaagagatgcagttgccgaccagaagtattgtgagcggcatatgaacaggggccgccaccgttcaagaaagcctgtggaaggtcaatccggacgttccaccgcatccaccaccacaactaccaccaagctgatgcattctggctcgtcctcttcagcatcagtggtagggccaaacggtggaaacggtgagtccaacagcctcaccattgcacagcagcaattcaagaatttgcagcctgctggtgaatctaatctttcgcactctggtccactaaacaggtggcttctgaataaagaaagcattggtgaaagaatgcatgatactgctcctgggaatgagtttggagttgtttcttctgagtcactccttaacccttcccacaaaagctcttccctcgttaagtgcattaattttggctgttctcaagatcttgatagtcaagaaaccgaatcacatcgatcagttcgccagttctttgatgcctggcctaaaacccagtccgactg

SEQ ID NO: 15948 - DNA, 945 bp, Gossypium hirsutum
  Predicted polypeptide sequence is orthologous to G1868
ccttttcaaacgcttgttattattcaaagcttcaactcatgcttttcagaggctgttttgattggttccttctccaaaatggattttggggttccggttttggatggtattctgggtcctgaaaacggagctccatctcaacctcagcctaagctagaaagatctgaagatcactgcaagtgttccaagttgcaaagaagtggtgatttactgactcccaagacaaggccattgcatcaaccttctcctttgttgagatctaattctttggtcttagctgacactggcccccatgagcatatgctctgcttctcttcactcaattctgaagttccttttatcaacatcaaagatggtgactttttggagataagtacacaaaacagtggtttttcttactgtcagcctacaccctcctcatatactagaaatgcaggttatggctctggaagcttaagtgcaagcatgcgtgggggttttaatggtgttagaggaccatttactccatctcaatggattgagttagaacaccaggcattgatctacaaatacatcacttctaatgtggcagtgccgtccaatttgctcaaccctctcaagaaggcactttatccttatggcttcaccagctctcctgctggatctttgcctcccaattcattgggatggggctctttccatctggggtactctggcagcactgaccctgagccggagaggtgtcgtcgaactgatggaaagaaatggcggtgctctcaggatgctgttgctaaccaaaagtattgtgaaaggcacataaacaggggccgccatcgttcaagaaagcctgtggaaggccagactggccatgctgcctctgggaccactaatccaaaggtggtgccgatgtcttcctcaatgttgacatcagtgataactgggcagcggtgcatccagcagcctcgc

SEQ ID NO: 15949 - DNA, 936 bp, Gossypium hirsutum
  Predicted polypeptide sequence is orthologous to G1927, G2184
tttttttttttttttttttacattcaaaattagttagatattaaaactatgcatatatgttgtccatgcaataatttcacttcacttcacttccaacttatacatatatatattcaggaggagatagatctccctaggaccctaactgttcctatcaagaaccataagacagcacacaatgcacctaaaatagaaatgaaaaagaatcccctattcctgcttctcctcctagcactagcagaaccattcactgcagtatccattgcatgtattctcaatttactaaagctagacatacgctccaatgcccgatttaccaatggactctcagctgcagaagcaggagccgtaggtattgaatccacaaacgaccacaaagaagatgaaaaccagcttccaccaccactgccatcatttttgttaccttggtcttgcttagggccattgtttacaaaacctgaagttggagaagcattcccaagatttgatcctgatggaatgaaaacatcaccactttgatcatgtgtccaaagtgcaccattaatctgatccatttgcagctgttgattctgcccatggtaatccacctggtccacacttgaatgaagcaccgattgctgatccattgagtttatatttggaccagattgataaaccatctggttcaacatattacccccagacgcattcagttgaggctgcaaatgttgttccatcatatttgcatttgcttggttttgccactgatttatcatattatcatacaagaatggaactgttccttgatcaatagaccccatgtcctgtagaaacatggctgcatcatggtacaggtcaaattcactcagcccatccaactcattgaactgcttgttctccacaggcttctcgatattggagatcaaaggttcaggaccaaggagatcatcctcgtgc

SEQ ID NO: 15950 - DNA, 842 bp, Gossypium hirsutum
  Predicted polypeptide sequence is orthologous to G1927, G2184
tttcacatgataactaaatataaatacggtatttacgacacacaaggacgcctactacaaagaaatttcaaggtacctattatgctttccttctgctaacacttcttcctgagacattaaaaactatttaatttaatgacaaatttggacttcactatgcaacaatttcaccaacttcccagtagaacataactaacaaaacttcccacttacattatatcttcacgaggagatcgaactccttacgaccctaaccatccctatcagaaaccataatatggcacacaatgcacctaaaatagaaaagaaaaagaaccccttactcctgcttctcctccgagcagttgtgccaccattgactatcaacgcattggtgtttctaacattcattctcaacctactgaagctagacattcgctcaaaggctcggtttaccgaaggactctcagatgcagaagcaggagtagtaggtattgaatccacaaatgaccacattgcagtagaaaatcggcttgcaccctcgccgtttttgtcaccctcatcttgattattaccattgtacaccaaacctgaacttgaagaggcattcccaagattcgatcctgatggagtaaagacatcaccactctgatcatttatccaaattgaaccattgatctgatccatttggagctgtcgctccatctcgtttccaaaagattggaatggcaaatggtaatccacctgatttaatataccatcctcgaaggcattcaattgaggctgattatcaccgattgtatttcattgagactgcacctgttgattattccaaaggcattcgattgaaagctgcactgctc

SEQ ID NO: 15951 - DNA, 923 bp, Gossypium hirsutum
  Predicted polypeptide sequence is orthologous to G1927, G2184
ctttgactgcgattttttctcttctattcctaaaaaaaaaaaaaaacttttcgtataatgtgagattaaatttcttgttttgaagtttgggttttgatcagtttttagctctcttgattgggtagttttctgttttttctttgtgtagaaaaaaaaaccaaaaaaagtctctttttttttactatcaagagagatgaaggtgactgcgacggctgtgacggttgattccggttttggggacgaccaagtgtggccaccggggtttcggtttcacccaactgatgaagagctggttctttattatctaaagaggaagatctgtaaaaaaaggcttaagcttgatatcattagggaaactgatgtttacaagtcggatcctgaggaattacctgggaaatcggtactgaagaatggggatcgacagtggttctttttctgtccaagagacaggaaataccctaatggagcaaggtcaaacagggctaccatacatgggtattggaaggcaacgggaaaggatcgttctattacttgcaattctcgagttgttggaatcaagaaaactttagttttctacagagggcgagcacctaatggcgagcgaactgactgggtgatgcatgaatacacccttgatgaagaggaactaaagaggtgccagaacgtaaaggattattatgctctctataagttgtataaaaaaagtggacctggccctaaaaatggtgagcagtatggagctccatttaaagaagaagcgtgggatgatgaggaatattctagtaaccctttagattcaatcactcctgtgaagccacctaatgaggtcattcctgatgataatgtaaaagctaatgttcaatctgagtctccattgagtgatattgaggagtttatgaaacagtttgctgatgagcctgcac

SEQ ID NO: 15952 - DNA, 802 bp, Gossypium hirsutum
  Predicted polypeptide sequence is orthologous to G1927, G2184
ataacctaatctcttctttttcttatggaaaacgccttggtccattaagtctccttccgaattttcttctttgactgccactctctcttttattttttctacccaacccccaaatttgctccagttctttttttaatataatatatatttttctctaattctaaatcatgtgaaataaagtttgttttgtgatcaatttttgctttcttgttgagaaagctttttttttttcaatcataaagaaaaaaaaaagagaatttttttatcatcaagagagatgacagtggcggcgaaagctgcgacgactgattcatgttttggcgaggatcaagtgtggccaccggggtttaggtttcacccaactgacgaggagctggttctttattatttaaagagaaagatctgtagaagaaagctcaaacttgatatcataagggaaactgatgtttacaagtgggatcctgaggagttgcctgcacaatcaatactgaagtctggagatagacaatggttcttcttcagtccaagagacaggaaatatcctaatgcagcaaggtcaaacagggcaactggacacgggtattggaaggcaacaggaaaggatcgtactgttacctgtaattctcggactgttggagtcaagaaaacgttggttttctacagagggcgtgcacctattggtgagcgaactgattgggtgatgcatgagtatacccttgatgaagaggagctcaagagatgccagaacgtaaaggactattatgctctttataagttgtacaaaaaaagtggacctggccct

SEQ ID NO: 15953 - DNA, 893 bp, Gossypium hirsutum
  Predicted polypeptide sequence is orthologous to G1928
gtctttggattttttttcttttttggtttgtaaaaaaccaagatccatggcccatgatttgcaaactctggaggtggtcaagttcattggtttatgtaagagaagatgatgaaaagctttatgttccaccaacagcaacagcaacagcaacagcaacagcaacaacaacaagttttggaagagaatatgtctaatttgacttcagcttctgcatctggtgaagccagtgtttcatctgggaatagaactgaagctggttctaattatcctcaacagtacttcaccactagtcaacaacctcaaactcagccagttaagagaaagagaaacctaccaggcaacccagacccagatgcagaagtgatcgctttgtcgccaaagacactcatggcgacaaatagattcgtgtgtgagatctgcaacaaagggttccaaagagaccagaaccttcagcttcatagaagagggcataatttgccatggaagttaaagcaaagaacaaacaaagaggtgaggaagaaggtgtatgtatgtccagaaacaaactgtgtgcaccatgatccgtcgagggcgctgggggacttgactggaatcaagaagcacttctcgaggaaacatggcgagaagaagtggaaatgtgaaaagtgttcgaagaagtatgcggttcaatcggattggaaagctcactccaagacttgtggcaccagagaatatagatgtgactgtggaaccctcttctcacggagggatagtttcatcacccatagagccttctgtgatgctttagcagtggagagtgcaagagcaataaacccacttctctcccctcatcaaccaggcacagcagcagcatctcacatgaatttacaagtgccccaattcaatccccatga

SEQ ID NO: 15954 - DNA, 739 bp, Gossypium hirsutum
  Predicted polypeptide sequence is orthologous to G1928
ccataacctaaccttgccatggtgtttgactgtgctggttttgttgcccaaacgttgaagaagggtttaaacgatgattaagtgcagctaagttggggaaatctctatggggaaatgctttaagacccaagaaatctcttgtcatcccgtcattccctcccatgttattgctttgggaatgggattcttttgtttttgagagatgatcagtggtgggttcttgaaaatcaatggggtttcctttggtgttccataccctgttgaaagactgttcaaatgatgaagacccgtcaaacccagaagataaagaacacatcatatcatggagtagagaatttggagtagcaacgggtgactgttccatgaaaccagaggtgatagctgttgcagctttattccccaaagatgccaacccatggggagaaccacttccaaggtcttcacgtgggaataaacccagaccagaaccagctgtagacgaggcaaaagacgtggaaccactggttcctcctgacatgtaagctctttgcatggaagccatagccgctactggtgatgattgtaagggttggctcatagtcacacccatttgagctgctttctgcaggagtgctgttgcagacatgtgtggagatgctgtttgggtctggaatggaggaagaagtgtattagaaccagtgttttggctagggttttcgttttgtgaccgtgggtgatctaaaggtttattggtggggga

SEQ ID NO: 15955 - DNA, 987 bp, Gossypium hirsutum
  Predicted polypeptide sequence is orthologous to G1932
ctctttcatggcgtcctcaagggaaggtcactacagaggtgtaaggaagagaccgtggggaagatacgcagctgaaatacgtgatccatggaagaaaacaagggtttggttaggtacattcgacacacccgaagaagctgcactcgcttacgacggagcagctaggtccctccgtggtgccaaagctaaaaccaacttccccacaccgtcttcctcttcttctccgccgccggctctttctcttgatcttaatctcgcttctcataatccccatcgttgggctttagcttcacctcatcaccatcaccgttttgccgccgtcggtgatttccttcaagctggtggtattaaagatatgaactttggtcccgacccatcgtcttcgacgagacccaatgtcctctccgtttcaacttcccctccggtgaccgcaaatggtaacacggcgtcgtttcttgggattgttcgacgtggtttgcctatagatttgaatgagccacctccactgtggctgtgaatgtggtttttcttctctaggcattttgcaggctccctttttaacctttaacccttccttaggcatctttgctacttctgtttagtaattattctgtattttgagaactaagaatcataaaaaaaaacatattaaaaactgaggaccctttgtgtaaatatatgttttttccttaacttatgtatgatttaaaacactttatcagatgtttttatcttcatttttttattttactgcatgaatatgatttaatcgtcgattttaatctgctacccgggaaccaaacagatacagatacagaatctctgtttctaaagccataaaggatgcatctttgttgaggaaaaaagaaaaagcacatgcacgcgcacgttagtgcgagtggggcttggacagttggcgatggcagctaacactgtgtaagttggggggtgtatttagacgtggtacaaaatgcgaaccaaagcgtg

SEQ ID NO: 15956 - DNA, 834 bp, Gossypium hirsutum
  Predicted polypeptide sequence is orthologous to G1946
gcgaatttcgacgtcagcttccccagaaaagccgaatcacgaaaagaaaagcgcctcccgcaggcttccctttcccttttaactccgctctctctttcggccgttaagccgcccgttgtctgtttctaagttccttcctctctattttcttctcatatcaatcctcttttatatttcaaattccacaaatatctaatgccgcaaattaaccctgcctctaaaccctagagtccccccctttttcacttctcggttttattttatactttaattattattattatttctttgattttgtgacgtggaatggatggagtgagtagcagtagcaacaaccaaaccgatgcatcgacgagcggcggaggaacccaaacagcagcacaacctctgctaatgccccagtcagtggcggggcatagtgcaaacgggccaccgcctttccttagcaagacttacgatatggtagatgatcctgccaccgatgccatcgtttcttggagcccaaccaacaatagctttgttgtttggaacccgccggagtttgctcgggatcttttgcccaagtattttaagcacaacaacttctcgagctttgtcaggcaactaaacacctatggtttccgaaaggttgatccagaccgctgggaatttgcaaatgaggggtttttaagaggtcagaaacaccttcttcggaacattagccgtcgaaagcctgcccatggccatggacatcaacagacacaacaaccacatggacagagttcatctatgggtgcctgtgttgaggttgggaaatttgggcttgaggaagaggttgagaggctcaagagagac

SEQ ID NO: 15957 - DNA, 455 bp, Gossypium hirsutum
  misc_feature (21)..(21): n is a, c, g, or t
  misc_feature (114)..(114): n is a, c, g, or t
  Predicted polypeptide sequence is orthologous to G1948
cctcagttttttttttttttnctataaagattgaaatttattacaaccaccaaatgatagagaacagcagggtttaagccttaaaaactagtgttataaagctctacagaggcnaacacaattacaaggaacacataggttgggtagatgacacagaagaggatgaagaacacacgatacaatacggtgagggaaatactaaccaaatatttcggaacatctaagtcatcatcagtctcttgctactaaaatcttctcattactaagatctgtgtgattagtcaagagaaaggtaaaggtggcgtgtggctcaggcattcactagcgagataagcaaatgttatctgcatctttagttagtctctctatttcctcaatctttggttttatgtccttttgacggttgcattgcattcttggtatctgaagcaagattacaactcaggcattcacta

SEQ ID NO: 15958 - DNA, 899 bp, Gossypium hirsutum
  Predicted polypeptide sequence is orthologous to G1950
gttattcctgtattttcatggtatgtcatgaggatgattcgataattggggaatttttggaaggtggatgctggtgattgaaataaataggttaaaaagtcttgaaatttgttgttgatcattgataaagctctcgttttttatcaaaatattgaatttgttgtgataattttgttatttcgggaaggggatagtttgaatccgttctctttttgggggtgttaaagtttgagtttctggacttcgggtaaaccttccgttagggactctgattgggagctgttacggtttatcggaaagtggctacagccacaaccatggggggagttccgactgacaatgtggactttgttgtgaccttggatgcagagagtaggtgttcttcggagtaagccgaaaaactaatagaggaaaacgctatctttgttagttctgcccttcgaatcttcttgttctttaaccttcttctttcccttacttcttcttttatctgtaattttcgcttcaaacatggaaattaatcctccaactaagtcagttgaaattaaagagaaagacctcttcaaagctgcggagaagggcgattcttccatattcaaatccctctcccaagaccaccttaccaagtctgttaaactccggaatgaagacgcccgatctcttctccacgtcgccgtctcctccgcccaccctgaggtggtcaaactactctctgccgccgctgatgaatcagttgtgaatggtatcgatgaagaagggttgggctcccattcactcagccgccagcattggtaatttggaaattatggaaatcctgttgaataaaggagcaaatgttaatgtgaaaaatgatggtggccgcaccgcccttcattatgctgctagcaagggatggttga

SEQ ID NO: 15959 - DNA, 1377 bp, Gossypium hirsutum
  Predicted polypeptide sequence is orthologous to G1983
acggccgggggtccccttatcactcagcactttattcttctctctccattaatcttcattgaaagaaaatcatctttgctttcacccatgaccactgtttatgacccttcacaccatctcacctccaaaaaattgtgtttcaaggaccttgaaatccctccaaggaaaaagcaactccattgttgccacaacgccgccgccatggaacttccccaccacgaagctaggctccacaaataccttccttccaatgaagacgatgacggcaccgatgatccatacggcaccgaccatttccgcatgtacgagttcaaggtaagaaggtgtacaaggagccgtagccatgactggactgactgtccttttgctcatccaggtgaaaaagcccgacgtcgtgaccctactcggtaccaatactcctccaccatctgttctgacttccgccgtggcggtggttgccctcgcggcgatgactgtgagttcgctcatggagtgtttgagtgttggctacaccctacacgttacagaaccgaagcttgtaaagatggtaagaattgcaagcgtaaggtttgcttctttgctcattcgtcacgtgagcttcgtctcttgccggaatcacaacctccatacaaaaactctgacaagaactataaccattgctgcttgttttgccggtccgttacatcgtcgtcgtcgttgtccccaacaagcactctcttgggtttatctcatttctcgagatccccatccctgtcaccgcctctatctcccttaaaacaccagcaaagaacaccaaggtacggcggtgatcgtattagtaaatttggaaccgaaatgacaagcagttacgatgatgttttgttgaaggaagtcatgagttatttaggaaccatgaatttgtccgaagtatcttcaccaatggctactactgcaaatacaaacattccatggttcgatgtttcattcaaaggagctccttcaacggtaagtccttctggttctggtgaatatttcaatggtggtggtgatgatgagaaaaacaatggaaacggtgtcgttttggatcatgatcttgacctcgggtgggttaatgagctcttgatgtagaggaagaagatatatatatatatgatctgcaaagtgtgtatattttatgtgtgattgggtttaaaaagattgctgatctgatgattgttttaaatatttcatattggcaaaccaagttaatttcaatttgtaggcttttttttcttgagagatctaatatgatcttctttttatttatgtacttttgactatgaatatgatgaagtcaaccttctgttcgagaaaaataaagaaaactggtcgggccgcctccgccctctaaatctctaa

SEQ ID NO: 15960 - DNA, 817 bp, Gossypium hirsutum
  Predicted polypeptide sequence is orthologous to G2010, G2347
ggcacgagcaaagtaaatatgaataaggatttcatagctgaagaacttgacaatgacatgcaagaagaagaagaagaaggtgttgggggtgatcatggtttcccagatgatgaaaagaagaagaaaggttatggaaggagaggagccgctggtggcggtggtggggtgtcgccgcctgcttgtcaagtggaaaaatgtgggcttgatttatctgatgccaagcgataccacaggcgccataaggtgtgtgagattcatgccaaggcgccatttgtggttgttgctggtctcaggcaacgcttctgtcaacaatgcagcagattccatgagctaccggagttcgatgaagcaaaacggagctgtcgaaggcggttggccgggcataacgaaaggcgtcggaagagctcagctgaatcatcatcagcagcagaaagttcaaatcgcagagggatgatgatcagtgctcaactgaaagagtctcattacctagctgatgatcaaagagccagagtcaatccaatggcaatccatggcagttcatcttttaagcgttcccaaatcagataaggaagcttaagcgaccaaaacaatacgctccctctcttctgtcatccgatggttcatgtcttgtactattctgtcatccgatggttcatgtcttgtactctgtaccacttactagattttgatggaggattttaataacaatgtcaggcatcaactcgattatcgagatttcacaaagtttgtgttcatgcgaacttgccttgctgtataatgatgataataaccctttatctaaaaaaaaaaaaaaaaa

SEQ ID NO: 15961 - DNA, 650 bp, Gossypium hirsutum
  Predicted polypeptide sequence is orthologous to G2011
attgaaacccaggatctctttccaaaaccttcttcattatcttaaaaaaacgaaatgaatccagacgaagaaaaacgctctccgaattcccttccaaacctaccccaaacgtcgaccttcccttcctcattaatggaactggaaacgttttcaagtggcgtgcctcagcctttggaaattcttcatgggaacccagtgccgccatttttgtcgaaaacgttcgatttggtggaggacacgtcgttggatccgatcatctcttggggtccgacgggacagagcttcgtggtttgggacccggtcgaattctctaagttcatacttcctcggaatttcaagcacaacaatttctccagctttgttcgtcagctcaatacttatgtgcgtattattgcaatagtacagcctacataaaaaaaaatatcgctgatggcatttggttttgtaacttttgtttctctttctttctttctttgattgtttgtttgtttgcctgtttttgttttccgtatttatttttttaaggcttaatctgtaaactggaacctgtaattgtagaagcccgatttgtacacattggttgtaatattctaattatcgaacttttgtacaaagattttgtaaaaaaaaaaaaaaaaaaaaaaaaaaaa

SEQ ID NO: 15962 - DNA, 912 bp, Gossypium hirsutum
  Predicted polypeptide sequence is orthologous to G2071
atttcatttagaaaactgggttttcttttgaataattaatcgactcatatgtagtatctgatttttttaatttttggggggcgtgattgtgtgttctgatctttcaattatttggcttgttaaatttcttgagcacattggaatgttaggtgttactagcacttgcagaacaaaaaaagaaagagttggtctttactttcccttttgtgtttatgtttttttattgtttttcttagttaaagaattcctgtatagatcttgatttttgggtttttcctctttttttttaacgtgtacttcccaaatatagaaatatgtaaatctttcaaactgcatgggatttattttatctgttttattttcattgaagtagtagttaaggacttttatatagcatagtttttaggatcatttctttgacactgttttatacagattttaatggggactaacatgaactttggaagtaacccaccgccgtcaggtgattgcggcgggaacaaaccgccgggcaataacctgttaactagacagccgtcaatctattctctaacctttgatgagtttcaaagcactatgggtggaataggcaaagattttgggtcaatgaacatggatgaattgttgaggaacatttggagtgctgaagaaattcaaacaatggcgtcttccggtggtgtcctagagggaaatggagggttacaaaggcaaggctctttgactctgccaagaacacttagccagaaaacagttgatgaagtctggaaagatatttcaaaggagtattcattggggaaagacggtattggaggtggaggaggcactaataatatgccacaaaggcagcaaactttaggagagatgactttagaggagtttttggtgagggctggtgtggtaagagaggatacc

SEQ ID NO: 15963 - DNA, 550 bp, Gossypium hirsutum
  misc_feature (85)..(85): n is a, c, g, or t
  misc_feature (467)..(467): n is a, c, g, or t
  Predicted polypeptide sequence is orthologous to G2085
tttttttttttttttttttttaaaggaagaaatcatttctaatcttcctacagacaccatgtaggctgtatttcgcaattctggngttacataatgatcggcaatgaaccatatatacagttgtcaaacgaactcaattattacaacaaagttcgacctgtgccccttaaacatcaagttacatagcactcaccacagcagaaggatcttgttaatcatctttcagcagtgcacagtggagttatccccattagatgaagatacaacatctggagttacagttacagcctctgactcgttagcttcagcatcactctgctcagcagtctttacagttggatccgggattgctactgtacaaacctttgaaaggtctctcaaaacacccttatttgcccacttggagtccaccatgcattgcccaagagtccttggaccagcaggtccacgaaggcactcataggagntttctcttagagctgattccacagctgtggtacattaaacttcttggaatattctccatcttgcccagaaaccctaccatgca

SEQ ID NO: 15964 - DNA, 936 bp, Gossypium hirsutum
  Predicted polypeptide sequence is orthologous to G2085
gcgctttcgatttcattgcctgtaaatgcttcctcaatgtacggacaatctcagccaatgaacattccacctcagatcgccggctccggcgctgacatcgacgacgatgtttcagcctccgtatccgtcgataaccaccacatcgttacttacgaggctccctccctcgacgacggtggtggagtagacgacgtagccaccaatcctttctacgccactgccgccgctacttccgcctctggcttggatgttgttccacgaggcgatggtgccagccaactcactctatcgtttcgtggtcaggtctatgtgtttgatgctattactcctgagaagtttcatgcagtgttgttactgttgggtggatgtgaactgacttcaggcccccatggtgttgaaatgtcatctcagaacctaagggttggaatggactttccgagatctaatcaaccgcacagagcagcgtcgctagacaggtttcgcaagaagagaaaagaacgatgctttgataagaaagttagatatggtgttcgccaggaagttgctcttaggatgcagcgtaataagggtcaatttacatcttccagaaaatctgatggtgattatggcagttgtagtcaggatgatgataacctagcagatactgtttgcacgcactgtggcattagctcaaaggccacccctatgatgcgacgtggcccatctggtccaaggtcactatgcaatgcttgtggacttttctgggcaaacaagggtactttgagagatattcccaagaaaactcatgaacattccccgactccagttgagcagggagaaagcgaaccaaatgactcggattctggaactgctattcctacagaaagcaacgtagtacctttctcaaacggggatgactcggctctaatcggcattgccgagcactaatcatccatg

SEQ ID NO: 15965 - DNA, 810 bp, Gossypium hirsutum
  Predicted polypeptide sequence is orthologous to G2110, G2574
gcggccgcgtcgacgtaggtgcaaagatgcgccgaggatatgtcaatcttaattacaacttatgaagggaatcacaatcacccacttccagtttcagcgactgcaatggcttccaccacctcagcagccgcttccatgatgttatctggctcttcaacatctcaaccagggctcaatggattaaacttcagccaccatgataattccacaacaagacagttctatttatccaactcaacctcatcatcattgtccccaacaattactctagacgttacctcttccccctcccattcccctttatcttcatctaattatttcaacagcttccctacaagctttcccagatttcctcgaagtctcaacttttcttcatcagaatccaacattttgcctgcagtttggggcaatggctatcctggttatggtgcagtgccatattatcaaactcagcctggtaactcaatccttggaaacgagtcccaaaaccagatttaccagtctttaccgggtaataatcagcaagggggagcctctcaacagtctttgacagaaaccttaacgaaggtaatcacatcagacccaagcttcagatcagtaatagctgctgcaatttcatctgtggtttgtaacagtgcaaaatctgaagaccaaactgatcaaaaagctcagcattttggtcagaaattgatgcaggccatagtttctcaaaatgagaaaggtcaatcatcatgttcatcaagctacttcaatggattggcatcttcaagttctcaaacaagaagttcattacttcagtcttctttgcct

SEQ ID NO: 15966 - DNA, 981 bp, Gossypium hirsutum
  Predicted polypeptide sequence is orthologous to G2130
ctcctgttcctttccagtatctcgccttttgattttactctccgccaaagttttagtttcttttttcttctctctctcgaaaacagaatccccgtttttctttatgttaaccacctggaaatgaatccagggagggtgaaatacacagagcgaagaactgttactaataagctactcaaggcatcgagcaagtggtttcccatggagtccaagcccaaagcccctaggatcgtcaggatttctgtcaccgatggcgatgccaccgattcttctagcgatgaaagcgagcaggagagacatcacacagtgaaaaggcatgttagcgaaatcaggatcggagattgttctacattcaattccaacaagccatcaaacaagcaaaacagaccgactaacaataagaccaatcttgtcaatatcagatcaaagaagcaacaaccgcagcagcagcagcagcaatgtttgtctaacggcgtcaagtaccgtggggttcgacaaaggccgtggggaagatgggctgctgagatcagagacccgacaagtcgaaccagggtctggcttggcacttatgatacggctcaagaagctgctttggtttatgacagagccgcgattcgaatcaaaggccctgacgctctcaccaactttataaagcctcctgccagaccctccccacctgagattgaacttgaaatgacttccgggtatgattctggccaagaatctcactcactctgttcaccaacttctgttctgagatttcagtcgaatgaagaaactgaacttcaaaccgagtccaaagatgactcaacaacacaaactgggtggagccctgttaaggaactctctcaatacccaagtaacttattagacgagtttttgttaacagatccagtggttttatatgattacttggattctgataaccctacacccatattttttgatgaactgagtttaccggaagcaagcagcaatttg

SEQ ID NO: 15967 - DNA, 901 bp, Gossypium hirsutum
  misc_feature (21)..(21): n is a, c, g, or t
  misc_feature (36)..(36): n is a, c, g, or t
  misc_feature (40)..(40): n is a, c, g, or t
  misc_feature (70)..(70): n is a, c, g, or t
  misc_feature (95)..(95): n is a, c, g, or t
  misc_feature (675)..(675): n is a, c, g, or t
  misc_feature (770)..(770): n is a, c, g, or t
  Predicted polypeptide sequence is orthologous to G2142
acggggcgcggcgggaggggnggtgtaaggggacgntgtncttattttgcaggccacccatgttcgatantcaatcaaactgctatatgttaaancggtacgcctgcaggtaccggtaatgaattcccgggtctacccacgcgtccgggaagcttgatgagaataacaccaatattaaccccacggtgatcacaagtctgccgaatgctgtagaaactgatccaataagatatgttacatccaaaactatggattgccaaactgagttggcgaacagcggaacccatctgcccatccaaggtgagaatgtgcttgtgcatccccttcagagaccagtctctgagactcaatcgactgagtgtcttgttggcaatgatataccgatcaatcaacaggaggatctgactattgaaggaggaacaattagcatctctagtgtctactctcaaggcttattgagcgctctggcacaagcacttcaatgcttgggtttggatttgtcacaggccaacatgttagtgcagattgatcttggaaaacatgcaaatagagggctatctgctaaggaaccacataattccccccatcaggcaatgacccatcttagagatgtgagcagtggagaggattctgatcatgctcaaaagcgactgaagaaataagatcggcacctgngttccataaaagatcatttcaactcggttttcccacctgatctttctttcttgtttcatcttgatttcatttggttattgtatatgctgcagttntggttcttttctagaagtccaagtatcgatcattgtttgttgtaagagtagtcccccttaaattatgtgtattttcatggggggtggtccattagaattctgttaaggtgatgtcaaggcgtttaccttta

SEQ ID NO: 15968 - DNA, 652 bp, Gossypium hirsutum
  Predicted polypeptide sequence is orthologous to G2142
catccacgcgtccgggggaatgcctcttcccatccgaggtgataatatgcttgtgcatccccttcagagaccagtctctgaggctcaaccgactgagtgctttattggcaatgatacagtgaaccaacaggaagatctgactattgaaggaggaacaattaacatctcgagtgtctactccgaagggttattgaactctctgacacaagcactgcagagtgcgggtttggatctgtcacaggccaacatcgctgttcagatcgatctcggaaagcatgctaatagaggactaacatcaggaacatcggctaaggatccacagagtgccccatttcaggcaatgacccatcatagagatgtgagcaacggagaggaatccgatcatgctcaaaagcggatgaagaaatgagatgagcaagttgagaatttttggcttctgttgggttattccttgtgtcattttttaagcttcatttggttaatgtatatgcatgcatttttaatatgagcagtccccatgatgttatctatctatatggagtggttcctcaggtttctgttgaggggatgtcaatgtttgacctctattatcatggatggatgtatcattcatattgttttaaatatataaatttatatttttatccaaaaa

SEQ ID NO: 15969 - DNA, 884 bp, Gossypium hirsutum
  Predicted polypeptide sequence is orthologous to G2142
gcacgagacgggacatccatgaaactcatccacatcacatttctttctccactgctgttctcgccgggaaccaaccaaccaagaaacaccattttttccccttcccattttctctccaattccttcactttttctatcaaaccatccaatcatccttctttttcgatctccccatttttgggttattattttttttcataatatttttggtcgtttgtttttgtcatccggagaaggaaaataaatgagaacaggaaagcaaagtcaagaggaggaagagtacgaggaagaagagtttggttccaaaaaacaaggcccatcttctaatcaaattatgtccggaaacgccattaacaactccaacaaaggtgggaagaacagtgataaggctaacgctataagatcgaaacactcggttaccgagcagaggaggaggagcaagattaatgaaaggtttcaagtattgagagatataattccgaacaccgatcaaaaaagagatacggcttcattcctgctagaggtgatagagtatgtccaatttctacaggagaaggttaaaaaatatgagggttcataccaggaatggaattctgagcccgcaaaattaatgccatggagaaatagtcactggcgtgttcagagttttgtcggtcaacaacaagctattaaaaatggttctgatccggggtcagcatttgccgggaagttcaatgagaataacatcaatatcaatcccacgataatcgcaagtgcacaaaatcctgtagaatctgatcctgtcagagacactatgtccaaagctatggatcagcaaccagagttgggaagcaggggaatgcctctgcccatccaaggtgataatatgcttgtgcatccccttc

SEQ ID NO: 15970 - DNA, 912 bp, Gossypium hirsutum
  Predicted polypeptide sequence is orthologous to G2144
ctaagcttgagctgaccgccctccacgaatctaacccaactttctcgcttcacttctttaacctgttaacactgcaatttgggttgaactaaccaagtggctgctttttattttcctgaattttgaacgtgggtatttttcacacttcccaaattgcctagtcccaccgctctctaatggagtcgaaggcagggacgacggaaaccagatccaacataacggcgtcagacggggaccaagttgcggcactcgaatccctacaatttacagacgaattccaccgtttaatcttggctccgccatctgacaatgcgacttctctcgcggctcttcttgaactcccggcttcacgagcccttgagcttcttcactctccggcttcggctaagcttatcgctgctccggctcccagctttgaagctttaaaaggaaactttctttttccttctaatacctctttgattgatcaagctgcgagatcctctgtgtttgctggaggggttaacaacaccaataacaagagcaacgcgcctgaaacgacgtcgaacaattcaaccttgaatcttgagaaagcagtgaagagtgagccggcggagaccgagtcatctcagccgttggtttctgacccagcggtggagaagcggaatttcaagagaaaggatcgcgaaaagaaggctaaaggttcaacgaagaaaagcaaaactgcggtgaatgatagctcagatggccctgaaaagctgccctatgttcacgttagagctcgccggggagaagcaacggatagccatagcttagcagagagagcaaggagagagaagattaatgcacgaatgaagctactacaggagttggtacctggttgcaataagatttctggtacagctttggtgttggatgaaatcatcaatcatg

SEQ ID NO: 15971 - DNA, 985 bp, Gossypium hirsutum
  Predicted polypeptide sequence is orthologous to G2144
ttaatatctctcaataacaattaacaagttttctattagcttgagctgaccgccattgaagaactaaatcaaagcttgtaaaaaaaatatttgaagttgttaagagttgaaattggggtgaattaaaggtgtgggtgttttttattttaaaagaattgaattgggtttttttcagaatttggattttgggtttgttcttcgtttttctgctatggagtcaaacgcggggacattggagaccagatctaataaaacggcgttggaaagggaggaagtagcggcacttgaatcgctacaatttacagacgaaatccactgtttgatgtcggctccggcgaccgacaatgccagttccttcacggctttgcttgaactccctgctccccaagctgttcagcttattcactctccggattcggctaacctcattgccgctccagctccgaacgttgaagatttcaaaggcgggtttcattttccttctaatggtgggctaattgaacgagcagccaggttctccgtgttcgccggcgaaggtaataacaagagcgactcgcctgaagcgacgtcgaacatttcaagtgcaaatctccagaaggcagtcaagagtgaaccggctgagaccgactcgtctcagccgttaatttccgatccaacggtggagaaccggggtatcaagagaaaagaccgagaaaaggtgaaagggcagacgaagaaaagcaaaacaacggtgaaagagagctccgacgacaccgagaagctgccttacgttcacgttagagctcgccggggacaagcaacggatagccatagcttagctgagagagcaaggagagagaagataatgcacgtatgaagctcctacaggagttggtaccaggatgcaataagatttcgggcacagcgttagttttggatgaatcatcaaccatgtgcagtccctacacgtcaagtggagttcttatcatgagactcgctgcagtga

SEQ ID NO: 15972 - DNA, 801 bp, Gossypium hirsutum
  Predicted polypeptide sequence is orthologous to G2147
ccacgcgtccgggaacaggagactagaggtgaaacaggtcgctcccaggccacaagacggagtcgagcatcagctattcataatctctctgaaaggagacgaagacatagaattaagcaaaagatgaatactcttcagaagctagtgccaaatgcaagtaagacagataaagcttcgatgcttgatgaagtgattgaatacttgaaacaactccaaacacaagtcgaaatgatgagtatgagaaacatggcggcccagatgatgatgcagaagacgcggcggcagcttcaaatgtcggctttagctcggatgggcgtcggaatggggatcggaatacttgacggtaacaactccttggctcccaatccttcaccagtcactgctcccacccacacatttcttcctcctcctcctccgtccttcgtgacaccgccgcctatgattccaacgcgcttcgcggcggctgctcaagcgaattcagatgctagctcacatggctccattccttcgcctgatccgtattgcactttactagctcaatccatgaatatggaactctacaataacaagatggcagcactgtatcgaccacaaattaatcaaactacacagacatcaagcaacccatcgaggtcaaacaatgtagcaaaggattaagatgaagcctaatggtccacccaatttgtgagaagcatatgtatttatgttactcgagcttgaggtatgagtgtaacaatgtgtgcaatacgtgtatgtattttcagacatgcctcactgttttctgatatgtcatagttgaaa

SEQ ID NO: 15973 - DNA, 563 bp, Gossypium hirsutum
  Predicted polypeptide sequence is orthologous to G2156
gtcgacacttaaaaaaaaatcaaaacaaaacaaaacttccttcctttctcattcggctgaaccaaaaaaaagggctcctcattcaatcgtcccttttgcttctctccttggccgatcatgggtttcatcggcgtcccatgcgcctccacctatcgtggctcatggctcgggaacaaaggagacgagaggcgtcccttggtccaaatccatgccgttgaaagggtctccgatggccgaaaccgcgggtaggttcccttccccgacctcaaaaaggtcttcaaggaggtgatgggaccaggtggaggagaggcggtgcaagtggaggcacctagggtttgctgcttgtttttttctgctggtggtttgggctggggtaagttgggtattaatgggcccgggtaaatttgggtacttacaaccaaatttgctccgatcttcttatttgccttcttccagtacatatcattcacttacttataacgcttcctctctccatcaaaacaactctttataattccaagacattgtcctattacttggatgcaaaaaaaaaaaaaaaaaaa

SEQ ID NO: 15974 - DNA, 550 bp, Gossypium hirsutum
  misc_feature (91)..(91): n is a, c, g, or t
  misc_feature (120)..(120): n is a, c, g, or t
  misc_feature (239)..(239): n is a, c, g, or t
  misc_feature (304)..(304): n is a, c, g, or t
  misc_feature (396)..(396): n is a, c, g, or t
  misc_feature (418)..(418): n is a, c, g, or t
  misc_feature (497)..(497): n is a, c, g, or t
  Predicted polypeptide sequence is orthologous to G2192
aatgccacccaacatgattagaattttaattccattaatgggaaaaacaccaactatagaaacccttacaacattcatccacagctatgangaattgatccaagcaacacgaatgtgtcncaatacaaatcaacaagtctctatatcacacactaacactaataaacccactgtgcagtgcccaatatagagtcacaaagctaaggacagcgatcttcaatgcaatctagcaaagttgngttgactctctaaccataccatacaaccggcgattccaatggctgcatagattgtgatcctagcntccactctacagtacaagtggtgagctgagataggtcaatcacacctacgcctctggtgaaaaccaaacgggaggacatcaagactcgggangatcccctagtgatgctctacnagctgtctcatgtcagcgcacgcatgaggaatagaaccttctcctagacgtaacgctacggaattggttgaaacgaaancgcattctggtgctagggccaattttccactctcaaccttgtggggttccccg

SEQ ID NO: 15975 - DNA, 769 bp, Gossypium hirsutum
  misc_feature (637)..(637): n is a, c, g, or t
  Predicted polypeptide sequence is orthologous to G2192
tccacgcgtccgcaggaagtaacacacaagttttggtggatgatcagttgctgggagggaggacattgatccaagaacaacttttccctcaccataatgggctttcaccaagcttggataaaggggcaaacagattcaaaacagggagtggttctagagacgagagtgctgggacacctacttctcatggatcatgccaaggtagccctgcaactgaaagtgccgctactaaggatccacttggtttcagccacgaccaatgctcccccaaattggccttccatttagaggaactgaatatatctacttcattctcaatgccggaagcccctgtgacagcagaacctcgagaaccatttggaggcatgttagtggaggatgctggaagttcgaaagacttaagaaacctatgtccaatagtagcagaaatcggtgccgatgaacgattaccagaatctagttggacaccgccgcaatgttccgaactgggtatcaagcacacaatgcatacattcactcagacaacaccccatgtaacagctcggcatggaatgaagagtgtgaccattaaggctacatacagggaagatataatcagatttcggatctccttaagtagtgggatagtggaactganagaggaagtggccaagaggctgaaactggaggtgggtacttttgatatcaagtatttggatgatgataatgaatgggttttgatagcttgtgatgctgaccttcaggaatgtctagatgtttcaagatcatc

SEQ ID NO: 15976 - DNA, 597 bp, Gossypium hirsutum
  misc_feature (435)..(435): n is a, c, g, or t
  misc_feature (480)..(480): n is a, c, g, or t
  misc_feature (507)..(507): n is a, c, g, or t
  Predicted polypeptide sequence is orthologous to G2226
cttgaaaaagcttacaattttttttatataatttctgttagaaaaaaacccagttcacttttcagttcttggtaccttggctgaccatttttgtttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtatgaccccnacaattcatttcggtgctgttgtatgtagctgcaaacggcctcancacgactgtcaggtgtgtctgactcantttgagccaaaatccgagattaaccacttgtcgtgtggccatctctttcacaaggtgtgtttggaaaaatggttggattattggaatatc

SEQ ID NO: 15977 - DNA, 694 bp, Gossypium hirsutum
  Predicted polypeptide sequence is orthologous to G2226
gaaaagcttacatgtattactttcatgttaaacccagttttcttttccttatgcatcactgatcccatgaaaatttgtcctctttttgtgtcatatatatctgcaagagagtgacatcatttatatccttaactagttcatataatcatttgttcgaataaacttagcttaatcttgatataaaagaatgggtctctcaagtctcccagccccatcagaatgagtgctatgtgtactcttggtaaacacagctttatccatatctatggttaaaggcataattcgatcaatccttcacattatcggtatccatctctcctcgtcctcgtcctcctcctcctcctcgtcatcatcatcatcatcatcatcatcgccatcctcggatcttattgaaatccctgcggtatcattcgacatcagcatcggtaatgctgatagttacattaaagagttccggagcaggattgccatcgacccggtacgatgcggtatgtagcggcagtcaaccggagcatgactgtacagtttgcctgactaggttcgagccagaatcagagattaaccgcttgtcctgcggtcatctgtatcacaaggtatgcttggaaaagtggttgaactattggaatgtcaattgccctctttgcatgaacgctctgctgccagaaaacgaacgggcctacttttgggaagcgtg

SEQ ID NO: 15978 - DNA, 956 bp, Gossypium hirsutum
  Predicted polypeptide sequence is orthologous to G2227
gtaaaaggaaattatgttcactcttttcggaatttagtttccttctttcctcttttttgtaaaagtccccctctttcttgttttgttaatttgtatggcaacgacgacgtcgtattggtgttaccaatgcaatcggttcttcttgatttccaacgaagatccgatcacttgccccgactgtgacggcggattcgtcgaagagatcgataacatgcctcatgcagcgcgtgctttccacgctgactcccgtctcgtcggcggcgatggattcaccgcgatgtacaatagcacaactaccctccgtcgaagccggatgaacggtggcgatcgttctccttttaatcccgtcattgttttagcgtcaccttccggggaaagtacaaatgttgaacagagtgggagggggtttgagctttattatgacgacggaggtggattgggtttgcggcctttaccggcgagtatgtcggagtttctgttaggtcctgggtttgaccggttaattgagcagttatcacaaatggaaatccaaaacattgggcgtcacaaccaaccgccggcgtcgaaagcggcggttgaagcaatgccaatggtggaaatagacgatacccatatcaacaacgaactgttctgtgcggtatgcaaagaacaattcgacttaggaaccaaagttttaaacatgccttgtaaccatttgtaccattcaaactgtttactcccttggcttcgattgcgaaattcatgccccgtttgccgccatgaattgccggcagctataggggaagaaggggacgggagttcaaattcattggatgagacccccatggggttgaccatttggagattaccgggtggtgggttcgcgggtggggaggttttcagctggagagaatagagagtttcccgttgtttatacggaaatgggatggtggttttagcgggagggttggtgccgc

SEQ ID NO: 15979 - DNA, 853 bp, Gossypium hirsutum
  Predicted polypeptide sequence is orthologous to G2227
tcttctgcccccaaaatgtttcctcttttcggaaattagtattcaatttccctttacttctgttactatggactcaacgacgtcgtattggtgttaccgttgcagtcgattcgttcggatttttaaccgagatcccatcgcttgccccgactgcgacggcggattcatcgaagagatcggttaccatcctcacgccgaatcccgtcgcctcggcaccaatagattccaagctctctccaggtataccagctctactcctgcttccactagtcggtctcctttcaatcccgtcattgtcttacgcggcggagcctccacttcctcaaccgtcggggagcattctaatgttgagcatagcaggggagggtttgacctttattacgacgacggtggtggggcaggtcttcgacccttacccccgactatgtcggagattctattaggttcggggtttgagggactacttgaccagttatccgaaatggaaattcagaacatcgggcgttacgaaaacccaccggcatcgaaagcggcggtggaagcaatggcaacggtggaaataaacgaaacccatattctcaacgaacttcactgcggggtttgcaaggagccattagacttgggaacccaagtccgaaacatgccctgcaatcatttgtaccattcggagtgtatactcccatggcttgagttacgaaactcatgccccgtttgccggaatgaattgccggcagaaaccggtggtaggtatgcggaggaggggttaagtatttggaggctaccgagtggagggttcgcggtgggaaggtttacaggcggaagaatgggaagggagaatagagggttgagcgtc

SEQ ID NO: 15980 - DNA, 883 bp, Gossypium hirsutum
  Predicted polypeptide sequence is orthologous to G2227
aaatgttttctcttttgggaaattagtattcaatttccctttacttctgttactatggaatcaacgacgtcgtattggtgttaccgttgcagtcgattcgttcggatttttaaccgagatcccatcgcttgccccgactgcgacggcggattcatcgaagagatcggttaccatcctcacgccgaatcccgtcgcctcggcaccaatagattccaagctgtctccaggtataccagctctactcctgcttccacaagccgtcgtaaccgcggcgatcggtctcctttcaatcccgtcatcgtcttacgcggcggagcctccacttcctcagccgctggggagaattctaatgttgagcataacgggagagggtttgacctttattacgacgacggtggtgggccaggtcttcgacccttacccccgactatgtcggagattctattaggttcggggtttgagggactacttgaccagttatccgaaatggaaattcagaacatcgggcgttacgaaaacccgccggcctcgaaagcggcggtggaagcaatggcaacggtggaaataaacgaaacccatattctcaacgaactttactgcggggtttgcaaggagccattcgagttgggaacccaagtccgaaacatgccctgcaatcatttgtaccattcggagtgtatactcccatggcttgagttacgaaactcatgccccgtttgccggaatgaattgccggcagaaaccggtggtaggtatgcggaggaggggttgagtatttggaggctaccgagtggagggttcgcggtggggaggtttacaggcggaagaatgggaggggagaatagagaggtgagcgtcggaggggaaagaggaggggttctgg

SEQ ID NO: 15981 - DNA, 838 bp, Gossypium hirsutum
  Predicted polypeptide sequence is orthologous to G2227
agcatgtcttcaacgtcttcgtattggtgttacagctgcacccgtctggttcgtgtggtggttttggatagcgggtcaaacgacgccgttgtctgcccgtactgcgacggaggcttcatcgaggagatcgaatcttcggacaatcacaaccgtcggtttccagctatgtacatgatcaccagcaacgataatagccgtcaaaattcgattcgggcgcgaaatctcgtctttcgtaggaatcgtcgcggttctgttgaccggtcaaacatcaatccgatcatcgtcctccgtggctccaccgacgacgagaacggctccaccaacgggatcagcaacagcgggtttgggttcttctatgatgacggatctgggtccggtttaagacccataccgacttcgatgtccgaatctctaatgggtttgggtttcgaccggttattggaacagctttcccagatcgaaataaccggactgggtcaacccgagaacccgccggcttcgaaatcggcaatcgaatcaatgccgacgattcaaatagaaaaagcccatgtttgttcggaaacccactgcgccgtttgtaaagaacctttcgagctcgggtcggaagcgagggagatgccgtgcaagcatatttaccatgaagattgtatcatcccatggctggcgcttcggaactcgtgcccactttgccgccacgaattgccgtcggatcggagcgagtcgaacgacgaggcatcagagacggtggggctgagcatatggaggttaccgggtggggttttcgcggtgggaaaggttcaggggagaaagggaagtgccggtagtatacacggagatg

SEQ ID NO: 15982 - DNA, 954 bp, Gossypium hirsutum
  Predicted polypeptide sequence is orthologous to G2239
ctcctttcctcaccatgtcgtacaccacccaccatggagtcttctcgcttttcttcttgctcttcctgctcctctccccgccgccgtccttcgcacagaacttcaaccaagacgaagaaaattacgctcgtttcagcccttccatggccgtaatcatcgtcgttttgatcgccgctttgttcttcgtgggtcttttcgccatttatattcggaattgttccgacgtgtacaccaacagacagagcatccgccccgtcgccgggcgttcattgcgcggcacgcgtgggctggacgcgtcggtgatcgaaactttccctatcatggtttactccgaagttaagggtcataagatcggcaagggagctttggagtgcgcggtttgcttgaacgaattcgaagacgacgaaacgctgcgtttgatacccaaatgcgaccatgttttccaccctgaatgtatcgacgcttggttagcttctcataccacttgccccgtttgtagagccaatctcgttcctcaaccaggtgaccccgtgagtcaactcactgcattaaataacactgccgtcgagttagaccttgaggctcagaacaatggcagtaactcagaaccggaagaagaaaggagcataaataacaacgctgttaattgtcaggtagaggctcaagtggcttcggaggttgaagtgaataatttgaatgtaactttaaataggaaccgtacacgtggatcaagatctggccgtccacgtaaactttctttcttgcgatctcactcgaccggacattctttggtccaaccgggggagaatacagatcgattcactttacgattaccagttgatgttcggaaacaattaatgaaccgaaagttgaatcgggcgacaagcttagtgttgcccagggaaaggagttcacgccgagggtaccgagcatcagaagatggagggagtaata

SEQ ID NO: 15983 - DNA, 891 bp, Gossypium hirsutum
  Predicted polypeptide sequence is orthologous to G2239
tggaattatctccttccatttcttcgtcctcttgctcctcatctctccgccaccttccactgcccaagtccaacccaccagcccaaacgacgaacaatactcttacgcgcgtttcagcccttccttggccataatcgtcgtcgttctaattgctgctttgttctttttgggtattttctcgatttacatccggaactgctccgaatccaacgccaatggaagcagcgtcaatcctgttaacggcgaagccggccgttcgcggcgtgggacgcgtggacttgaagcgtcggtgatcgagactttccccaccatgatttactctggagttaaggttcataagatcggtaaaggagctctggagtgcgcagtttgtttgaatgaattcgaagacgacgaaacgctgcgtttaataccgaaatgcgatcacgtttttcaccctgaatgtattgatgcttggttggcttctcatacgacctgccccgtttgtagagctaatctcgcttctcaaccaggtgattctggagtgagtcaacccactgagttgaatgagatcgccaccgagatagacctcgaggctccgaacgacagcagtgactcggaaatggaaggagaagaaaggagaataaacaataataatgtcagcagtgacgtagaaggtggtgttgctctggaggttgaagtagttgacttgaacaaaactttaaataggaatcgtacacgtggatcaatatctagccgtacacgtaaattcttttttccgcgctcccactcaactggccactctttggtccagcccggtgaaacaccgaccgatcaccttacgattgccggctgatgttcgaaaccagttaataaaccggaattgaaccgggcacgagcttggttttgcta

SEQ ID NO: 15984 - DNA, 942 bp, Gossypium hirsutum
  Predicted polypeptide sequence is orthologous to G2239
gttctccaccgccaaacatggaatcgttttcgttcttttcctactccttttcctctctccgcctccctccaccgctcaacctaccgacccgaacaacgaccgttacccttacgcccgtttcaccccttccatggctatcatcgtggttgtcttgatttccgctttgttctttatgggttttttctctatttatcttcggaactgctccgaagccaacgccaacggaagcgtcgtccgccctttcaatggcgaaactgggcgttctcgccgtgggatgcgtgggcttgagccgtctgtgatcgagactttccccaccatggtttactccgaagtgaaagttcataagatcgggaaaggagctttggagtgcgcagtttgcttgaacgagttcgaagatgaggaaacgctgcgtttaatccccaaatgcgaccacgttttccaccctgattgtatcgacgcttggttggcttctcatactacctgccccgtttgtagagctaatctcgctcctcaacccggtgaccctgtgagccaacccgccgagttggataacaccaccaccgagttggacctcgaggctcagaactacgacgatgactcagaactggaagaagaaaggaggataaatcctaataatattaactccgatgcggaggctcaagttgcgccggaagttgaagtaattgacttgaaccgaactttaaataggaaccggacacgtggatcaatatcaagcagaacacgtaagttctttttcctgcgatctcactcaaccgggcactctttggtccaaccaggtgaaaacacagaccggttcactttgcggttaccgggttgatgttcgaaaacagttaataaaccgaaagttaaatcgagcaacgagcttggtgttgcctagggaaagaagctcagacgaggataccgaacggagaagacggtggt

SEQ ID NO: 15985 - DNA, 644 bp, Gossypium hirsutum
  Predicted polypeptide sequence is orthologous to G2290
tgccattgttatcactacatatgaaggtcaacactgtcatcacggtatcgcattccccagaggtggactcatctgccatgaagctgcctttgctggtcaattgacaccgccagtctcacaaatttatcatccaggggtgcagtcacataggcaaatgcctccgagcataacacaatcacagccgcaccaagcacccgttgacgtaggagaaccacatccggagcctgaacccacctcacagctccccacagatgaagggttactcggtgatattgtgcctcctggaatgcgtggcagatgagaaagagaatatggcctgtaattgatgggtataaacataagggcagccaagtcatgcgacacaatacttttctcaagatggaagtgagtcatttacctgaaaaggttcacacagatgattatatcataaattattattatatttacttacacaagctcagctataatgcttgcatgaggtcattaatctcttatggtgcccagattttatctaatctcaacccttcaattctaatctatgcatctgaatattgaaattcctgttggttaggtttaagagattaattactgcagatcatataaaagtagtaacattacttgctattaaaaaaaaaaaaaaaaaa

SEQ ID NO: 15986 - DNA, 909 bp, Gossypium hirsutum
  Predicted polypeptide sequence is orthologous to G2311
aaaaactaataacaaaaaaaataattaaaaaaaaatcctttgctgccgagtggcgctcactggcagcagtagcggcggctgccggaagcaaaaaaatcgtgtagctcatcgtcgtatgtgatagtgagatggggaatccaaagcagaagtggacggcggaggaagaagaagcattaagggcgggagtggctaaatacggcaaagggaattggaaattaattcaaagagaccctgagttaagccctttcctctttgctcgctccaacattgatctcaaggacaagtggcggaacttgagtggtggtcccggcggccatggttcacgggaaaaatcaagggcgtcgaagcccaagccgagctccgacggttcgcagggcgctgttgttgttaagcaaactgcattgcctaaaccacttgttgatgattcttcgaaaagctttgctccaaaccggtacaatgaaatgattattgaagccatatcagcgttgaaagagccaaacggatcagataacagagcgattgtcggctacattgagcaaaggcaagaggtacctcaaagttttaagaagcagttatgttcaaggttgaaaaggctggttgctatagaaaaactagaaaaggtgcaaaatcggtacaagatacgaaaagatgagacattcgggatgaagacgacaagcccaaaacaaaaaggcacgaagcttaagcagtcgcaaaatgctggtcatacaacttgcgatgcagttgaagaagcttcaatgactgctgcctatcttattgctgaagcagaaaataagtcatttgttgcagctgagcagttaaagagcagaacgagtctcgaaatggctgagatgcagatcactactacagttggccaagagattttgaacatgttctcaagtgaaatgtgct

SEQ ID NO: 15987 - DNA, 901 bp, Gossypium hirsutum
  Predicted polypeptide sequence is orthologous to G2319
ctcatattgtctactgttaggtagcaaaaaggcaaagccaagccaagcagaggaaaacatgaactcatcacccaatcctccacaaccccctccgccgcagtcttccacttccaccaccgccactgatggctccggcaagaaagtcaggaaaccttacaccattactaagtcgcgtgagagctggactgaagaagagcacgacaaattccttgaagctcttcaactgtttgatcgggactggaaaaaaattgaagattttgtcggttcaaagacagttatccaggttttaagaatggagatttgatgttttgtctttgatcttagtttttccatcgtttatctcattctgcttctgcctttttcagattcgaagtcatgcccagaaatactttctgaaggttcaaaagaatgggacgattgcgcatgtgccgcctcctcgtcccaagcgcaaagctgcacacccttaccctcaaaaggcctccaaaaatgtgttagtgccattacaagcatccatgggttatccttcatcgataaataccattgcacctggatatgctccctgggatgaagcttccatgctggtaaacactgcctcaagtaaaatcatgtcaccacaagatgaatttacaggtcttcgaggaacggaagctaatattggatcgaagggcgtagctaagattagtaacagtggtgttagtggcattggaagctcaggtcaaacaatatctaattccgatatgtcaaagcaagggaaacaagcgtccatgcttcacggtatacctgattttgctgaagtgtatagcttcattgggagtgtctttgatccagacactgatgggcacgtacaaaaactcaaagagatggatcccataaattttgaaactgttttgttactgatgag

SEQ ID NO: 15988 - DNA, 581 bp, Gossypium hirsutum
  Predicted polypeptide sequence is orthologous to G2343
ccctaaattcggctttcgagcggccgcccgggcaggtactaccttggatgaagaaggtggtggagaaatgacacttgagagcttaaggagacaacaacaagagttgaatgaatgggttgaatcacaacaatgttcaagctttttgttgtgggataatattattgaaggacaaattggtggtagtgttgaaggaacaacaataccattaccaccttcatcttcatcatcatcaaatatgggaactacactatcttctttcccttcgtctctataaattatcattaatggtgatgatttgtttttctttctttcttttttgcttcttttgttaactttattaattggtcatgagcttgtggaaaatgtgagggaatgttgcatatttaagtatgcaccattttttttctttcttatcggtgtttggagaaatggaaaaggaaagaataaaaagcaatgtaacagctaattagataatttttactcatttctttcggatttttttttatatataaggtattctcggttgatcaaaaaaaaaaaaaaaaaaaaaaaaagtacctcggccgcgaccacgctaagcc

SEQ ID NO: 15989 - DNA, 552 bp, Gossypium hirsutum
  Predicted polypeptide sequence is orthologous to G2343
gcttagcgtggtcgcggccgaggtaccttgcgtgggcggaactaaagtctttcgtatcttcttcttgatccatgaattccaatagtttttaatctcattatctgttcttccaggcaagtgacttgctatatgagcccacctgtttcctacaaccccatggaggctaatgatcaacttctcttcctcaggtgtaaaccttcctcttcttatatcaggccttaaataattaatccatctcagcctacaacttttcccacatctctgaagaccagctttctcagggacttcactccaacatccatagccatgagtggtgatgaacctaatgagcttttcatcttcctcaggggaccaaaggcctctcttaaccttttgttgattgcagcaagaatggtgacccatcctgtataatttaatatggacgacgacgatgatgataaataatatcaactaatcttctgcttacttaattttaattcacaaattaaaagaaaggaaagaaatagctctttgggatttccccgcgtacctgcccggcggccgctcgaagcc

SEQ ID NO: 15990 - DNA, 905 bp, Gossypium hirsutum
  Predicted polypeptide sequence is orthologous to G2371
ggacctctcacttctaccccgccatgttcctatcctccatccacgctgcccgccacttcagccttaaccatgacgacgacgaagagctcgacgaccaaacatccaatctcgacaccctaaaccctaaaccaaatccccctgaaaaccaccagctaggccatgaaacggaacccatgtttgaaaagcccttaacccccagcgatgttggcaagctgaacaggcttgtaatccccaaacaacatgccgagaaatacttcccgctaggcagtgactccagtgataaaggcttgttgctaagtttcgaagacgagtcaggcaagtgttggcgcttccgctactcgtattggaacagcagccaaagctacgtgttaacaaaaggatggagcagatacgtcaaagagaagcaacttgatgctggtgacattattttattccaacgacaccgcacggatggtgatagattgtttatagggtggaggaggcgcggtgcagcagtggtggttgcaccggcggctactgatggcggaaacgccgtgatggagaataatggcggtggtggtgggggtggaaatggaggggtggagtaataggcgattgtatcaaaggtatcctcatcttggacacattcaaggtcttgaggctatttggagtgaacctagaatgccaccagctagacgagtccccaccatccacgcctgctagctcgatggtgtcgagccagggtccaacagcccaccagttttactagttttccctcctacacttgaaactacatggtcaggaatggatatcgtcccgagacatgaagcggatgaaaaagatgagggagggataagatctgaagatgtgacatccaggaattgactttgaatattgaaaccccacttggaacgtcacaattagag

SEQ ID NO: 15991 - DNA, 470 bp, Gossypium hirsutum
  Predicted polypeptide sequence is orthologous to G2382
catatatgaaaaaattgagaatagtaaaaggcagcagatgttggaattggagaagatgagaatggattttcacagggagttggaaatgcagaagaggcagatcatggagagagcacaggctgaaattgcggaactacagcatggtgagaatgaggcgaatgatgcctccggtgagaatgctagtgggtaatatatgcaaaacccagttatcttctttataacattcatcagattttggctgttaaatgttgttgtatggtatatgggagcctgttgccaaatgccgttgtgataaacaataataacacggtatacatgctgttatcatccaaaatcaagtagaaacttgtactgaatttagtgaagatcattactcccattccatgttatagtttaactgatgcgtcattttttcaaggtgaatgaatggccaagtgcctagatgtttaaaaaaaaaaaaaaaaaaaaaa

SEQ ID NO: 15992 - DNA, 653 bp, Gossypium hirsutum
  Predicted polypeptide sequence is orthologous to G2404
caaacgttgaggttcatcaattagttcatttaggacctttgtttgcccggcaaatcagatttttggtggtaatggtggttggtgcagacaatgatagtacgtaatatgcttatgggggaaagaatacattcaagagaccgatttagcaactggaggcttgatattgacaacatgtcatatgagcaattactggagcttgcagataagatagggtatgtccacactggattgaaagaagaagagataagtagatgcataagtaaaattaaggggtcgatgaagaatgatttagcaccaaacaaacccatgcatgtggataacaagtgcagcatttgtcaggaggaatatgaagatgaaggagatgaagagatggggaagctatgttgtggacacagttttcacattcaatgtataaagcagtggctgctgcagaaaaatgcttgccctgtttgtaagactgaggcatcacctcgatgatagcagcagcagccatggatggattcaatttaacccacttgttggtggtttacttactgtttcatttattttagtttagtccaaaattagcgtttatatggatgacaatggtagcaactttgcctccaaatcaaatatgatggtgattgttttgcttcacaaaaacaaaaaaaaaa

SEQ ID NO: 15993 - DNA, 514 bp, Gossypium hirsutum
  Predicted polypeptide sequence is orthologous to G2457, G2459
ggttccacaatccgagcatctttgctatgtccgctgcaacttctgcaacactgttcttgcggttgggatcccatgcaaaagattgcttgaaacagtgacagtgaaatgtggtcattgcagtaacctttcttttctcagcaccagacctccactgcaaggtcaatgcctcgatccccaaaccagcctcactctccagagtttctgcggtgatttcaggaaaggtactcagtttccatcgccatcttcatcaacatcgagcgagccatcatcccctaaagcgccatttgttgtaaaacctcccgagaagaaacacaggcttccatctgcttacaatcggtttatgaaggaggaaatacagcgcattaaagcagcaaatcctgagataccccatcgagaagctttcagcgcagctgctaaaaattgggctcggtacatcccaaattctccagcagcatcatccgtttgtggaagtagcagcaatggcttctatgaaaattttgcaggaacaaaatga

SEQ ID NO: 15994 - DNA, 851 bp, Gossypium hirsutum
  misc_feature (718)..(718): n is a, c, g, or t
  Predicted polypeptide sequence is orthologous to G2465
gcggccgcttcgacggagaaacgaggaagaagaaaaaagttttaagtaaaaaaaaggattttttttatagaaaaaagggtaatgatagagatggattacgctctgaaaaagcgcagatgtcacgaatatgtagaagctttagaggaagaacgacgtaaaattcaagtctttcaacgcgagcttcctttgtgtttggagcttgttaaccaagcgattgaagcacacaagaaagagatgtcgggaggttcaaccacgacggattacatgcaaggacaatcggattattcggagcagacaactagtgatgttcctgttttggaagaatttattccgatcaaaagaagctctaattgctctgaggaagacgatgaacaagaatcgcataaatccaaagaaaccaatgttcctgctgcttttgataaaaggaaatctgattggcttagatccgtgcagttgtggaacaacaatcaatccccagatctacccttgaatgaggatgatgataaaattggaagtgcgatcgaagtgaagaaaaacgggggagcatttcaaccattccagaaagaaaaaactgtagagatgagtggtcaatctgcagtaggaaaaaccaatggctcagctacaagtacttgtacaacagaaagtgggagtagaggaggagaagccaataatgcaaataaaagtaaaacagaagaaaaaggtggtcaggcttcgaganagcaaaggcggtgttggtcaccggagttgcataggcgcttcttgcatgctctccagcaactcggcggttcacacgtcgcaacaccaaagcaaattagggagctgatgaaggtcgatggacttacgaatgatga

SEQ ID NO: 15995 - DNA, 874 bp, Gossypium hirsutum
  Predicted polypeptide sequence is orthologous to G2465
aaaaaacatcacaactaattcccttgacttagcttctctcatcttgttcggatctctctatgctctttggtctgaaaccaaccctttcccctcacatatatttatatcatccactgtgtctgaaaatcctcggtgtggaagaaataaaattacttttttaagtaaagaaaatttccttgctatgatagatatggattacgctcaaaaaatgcgcaaatgccatgaatatgtggaagctttagaagaggaacgacgtaaaatccaagtctttcaacgtgaacttccgttgtcttttgagcttgtcacccaagctattgagtcatgcaagaaagagatgtacatgcaaggtcaatcggagtgttcggaacagacatcgagtgacagtcctgttttggaagaatttatccccatcaaaagaagctgtaattgctctgaggaagacgatgatgatgatgatgatgatgatgttgctgctgctgataaaaagaaatctgattggcttagatctgttcagttatggaatccaccctccaaagagggtgtgggcaaaactggaagtggggtacaaatgaagggaaatggtggagcatttcagccgttccataaagaaaaaggtaatgtagagaagaagagcgttgaagcagtaggaaaaggcaatgcttcggctacagcaactactactactacgagtgcttctacgacagaaagtgggagcagaggaatagcagccgacgatggaaatactgataaaaaagtagagaaagggcagcagcagcagcagccgcctcagagaaagcaaaggcggtgttggtcgtcggagttgcataaacgcttcttgcatgctcttcagcaactcggtggttcacatgtggct

SEQ ID NO: 15996 - DNA, 864 bp, Gossypium hirsutum
  Predicted polypeptide sequence is orthologous to G2520
ggatccgccagctatgatgagcgatggaaggtacaatctagcagagatctggcagtatcccatgagtgagtctgggataagtaggggtcagttcggacatgggttggctcagttcggggaccccagtcgagaggtttccggcaatgatccgggtagcttggagcagcagcagagaaggggtggtatgaggagaaggcgtgacggagaagttgaaacagctaaggttgtctctactagctccactagtagtggcaatgccgtgaataatggtgaggggaagagaattaaagcagcaggaggcagagaacaaaatcatgaatctagagttgaagcagaacccagttcaggcaagcttgtggaagaaaaagctcaaccttccgagccacctaaacaagattacatccacgtacgagcgcgaaggggtcaagctactgatagccacagcttagctgaaagggctaggagagaaaagattagtgaaagaatgaagattcttcaggatttggttcctggttgcaataaggttattggcaaagcacttgtccttgatgagataattaattacattcaatcactacagcgtcaggtcgagttcctatcaatgaagcttgaagcagttaattcaggaataaaccctgccattgaagtatttcctcgtaaagattatggccaacaagcgtttgatgctactggtatggcattcggttcgcaagtgataagggaatacagtggtggcacatcaccagagtggttgcacattggcagtgctttcgaaaggacaacataatcgggtaaagggaatccccttgcaattaaataagagcattaaattaatttgcagtgcttccagcttgggtcggccaa

SEQ ID NO: 15997 - DNA, 924 bp, Gossypium hirsutum
  Predicted polypeptide sequence is orthologous to G2522
aaaaaaaaaaaaagcttgcctcctctcaaccttcacacaaaaatggcttcttttcaccatttctagtttcccattgatttccccttatcttttctctcttttcaaaagaccccctttttcttcaaagcttcttactttcagaaggctgcacctttaaccacagttcaactaatgtacattcaagtattcgttttttgaagtagatgcatggatagaagggatacaatggcattaacagggtctgcatcttattatattcaacaaagaggcataactgggtcagggatacatggatcacaagacattcatatgttatctagtccaaatgtacaataccaatcaagtatgagtgctactactatgggacctgtggagagtattacccctcatagtgtcaatgtaggcacaccttcagctgttccatctagtgagaccacgaaacggaaaagaggaaggcctcgaaagtacggtcccgacggaaccgtttcattggcattgactcctccatcggttactaatccagggacattaacaccaccgagtcaaaaacgaggtagagggcgaccaccgggtactggaaagaagcaacaacttgcttcccttggtgtatggctgtccggttcagccgggatgggtttcactccgcacgtcatcaccgttgccataggagaagatattgcgaccaaattaatgtcattttcacagcaagggccaagagccgtatgcattttatcagccaatggggcggtctcgaccgtaacacttcgtcagccttcatcctcgggtggaaccgttacatatgagggggcggttcgagatactatgtctgtcaggctcgtaccttctaaccagcaataatggctcacacaatcgaactggtggtcttagtgtttcccttgctagtcctgatggtcgtgtcattgg

SEQ ID NO: 15998 - DNA, 923 bp, Gossypium hirsutum
  Predicted polypeptide sequence is orthologous to G2522
tttctctctctgcttttaattcccttaacctccgtcaatctttcctttttgaaaacaagttgattttgaaggcatcattcaagtgtataggttattggaggtgaatgcatggatcgaagggatgccatggcattatcagggtctgcatcttactatatgcaacaaagaggaataaccgggtcagggtccgaacctgagtctgggatacacggatctccaggcattcatccgttctctagtccaaatgtacaataccaatcaagtattccagtcactactgtgggatcaaccttagctatggagtctccatcaggaatcgcccctcatagtgtcaatgtaggcacaccttcagcacagccatctagtgagacagtgaaacggaaaagaggaaggccacgaaagtatggtcctgatgggactgtttcgttggcgctgactcctgcatcagctcctcatcccgtgaccacaacgccgggccaaaaacgaggaagagggcggccaccgggtaccggaaggaagcaacagttagcttcccttggtgactggctgtccggttcagctgggatgggttttactccacacgtcatcaccgttgcagtaggagaagacattgcaacgaagataatgtcattttcgcagcaagggcctagagcagtatgcattttgtcagccaacggggctgtctctactgtaactcttcttcagccatcatcttcgggtggcactgttacatatgaggggcgattcgagatattatgtctatcaggctcttacctgctgatcagcaacaatggctcttgcagccgaagtggtgctcttagtgtttcccttgccactcctgatggccgcgtcattggtggaggtgtcggagggatgcttattgcagcaagcccggttcacgtgattgtcggaagttttcaatg

SEQ ID NO: 15999 - DNA, 809 bp, Gossypium hirsutum
  Predicted polypeptide sequence is orthologous to G2536
gctaagtaccggtcagagatggcggtggccatcggttttcgcttctttccgacggaagaagagttggtttccttctacctacgtaaccagttacaaggcacgagacaagatatgcaccttgttatcccagtcctcaacattttttacgaccttgagccatgggaccttccaagtatatatatatatatacactttcttcactgatcacaccaacatgatgaatcccactgtaagtaggtaacctttttttgtttatggttgcagagcttgctggggagctttgtaaaggagacgtagagcaatggttttactttataccaagacaagagagggaggctcgtgggggaagagctagccgaactacagcttcgggatattggaaggcgacggggtcttccggctttgtctactcgtcggacgatcgactgatcgggatgaagaaaacaatggtcttttacaagggaaaagccccaaatgggaggaaaaccaaatggaagatgaatgaatatagagccatcgaagcactgtccgacccatatgtggctgctcctccaaagttgagacatgatttcagtttgtgtcgagtctatgttgcatcgagcagctctcgagcattcgatagacgcccactagaagcacacaacaatgctgcaacaacttccgggggagcctcaggaacttcacatgctggaggagaccactataatccagccgaggctagtgaagatgagttttgggaattgattaacaatcttgaagaacatgccataggatgggaacaacttaatgaaatataaataggcaatcag

SEQ ID NO: 16000 - DNA, 820 bp, Gossypium hirsutum
  Predicted polypeptide sequence is orthologous to G2559
gcttagcgtggtcgcggccgaggtactttttttttttttttttttttttttttttttacaaataggaattaatgtatttcacaatatatatttgtatatatacacacatagataatgattaaaaaccaatattagaatgtctttgacaattacaaaccaacaagaggaaaagtaataagaaaacataggcaaagaatcaaactaaattcgaggaagaaaaatgtgtcctatatatgaaacattagttgaggatgttaactaccgaaacagccaagaaatttctttggtgtatatccagttgaacgaaacttggctgctgtttcctctatcttaagaaaatcttcacctttcttggcttcgatcatcgctcttctttcttcagcttgtttatggagttgagccactttgtttttcattttctctgcatattcttccttcttcttttccagtttttcctcaatgctctttagctgcgcttctacagcagatttcttggtattctcccatgatccaatagcagatatcttcttatatgccttgttgtctatttttgccttctcattttcctcccatgctttaactaaagctagtcatttttctgtctcaacttgagcaagcacggaatctctgttgtttggacttttctctgtaactgatggtggtgtttctgctgctgcaactttttgaggaagagggatgatcacactcttcttctctgcacctgcttcatcttcattctccatctcttcttccttaacaggctgtggctgttgctgctgctgctgcatgtcctccttgggttcagaggctccattttatt

SEQ ID NO: 16001 - DNA, 550 bp, Gossypium hirsutum
  misc_feature (19)..(19): n is a, c, g, or t
  misc_feature (26)..(26): n is a, c, g, or t
  misc_feature (162)..(162): n is a, c, g, or t
  misc_feature (188)..(188): n is a, c, g, or t
  misc_feature (431)..(431): n is a, c, g, or t
  Predicted polypeptide sequence is orthologous to G2559
tttttttttttttttcccnttgttgncaaatcaacgaatacgatggtagattaaatattggtgatgttacacacggtttacacacaaaacaaacatagaaaccgacaagaaatatacagatgaaaaacgcgaagcttcaaacaacagtcaaaattcacattngcttcaacctcagaccccaaactttngaacttcagaaacacccgaggacctttttgggagttggtccggtgcacggtattttggcagccatttcctccgccttgagaacctcttctcctcgttgggcttcaaccatggccctcttttcttctggcttcctggtgaagcaaagctaccttggtttttcattttctctggcatattctggctttcttcttttccaatggttcctcaatttttttcagtttggcttccagagatgctttctntggctgttactcccatgctacaatagcagagagctttttctgggacttattctctggcttgggtcttttcactttcttcccatgccttgatgaatgacaaccttttggccttttcaacc

SEQ ID NO: 16002 - DNA, 691 bp, Gossypium hirsutum
  misc_feature (670)..(670): n is a, c, g, or t
  Predicted polypeptide sequence is orthologous to G2559
cattcaaataaacagacaataccacagaaatcaaaaagattttcgttttttaattgtatttggtgatgataacttgggtgtttagaaaaggttaggcaggttgaatatcaagttctcactcaaagcttttgcccgactgagtcactctcagccaacgcactataaaccacttgtacctaccgttgcagatcggctctgtcaatcaaaccagcaaatacaacatcctttcccttctcttttaatctttcttgtcttctctttcacctcgctttgttgtccatcagttgaggattcttgtcaacaaataacgcatggcagaggaagaacccaagaaggttgaaaccgtaaccccctcggagcaaccacctcccgaagcccccaaagacgttgcggaggaaaaatcggtaatcccacctcctacctctgaagaaaaacctgctgagtccgccgcactccaaaaggcggtggaaccgactgaggaaaagagcacggagagtactgtggaccgagatgctgtgcttgctagagttgcgacagagaagcgaatttcactgatcaaagcttgggaagagagtgaaagaagcaaagctgaaaacaaagctcataaaaaactttcctctatcgaggcatgggaaaacagcaagatagctgctctggaagctgagctganaaagattgaggaaaaactaga

SEQ ID NO: 16003 - DNA, 687 bp, Gossypium hirsutum
  Predicted polypeptide sequence is orthologous to G2565
tccacgcgtccgatgaaatcgatagacttgaagacgagtataggaattactgaagcactgcgattgcaggtggaagttcagaagcagctccatgaacaacttgagattcagagaaatttgcagctacgaatcgaagaacaagggaggtatctgcaaatgatgtttgagaaacaaaaaaaggtggaggacgaaaaaggtggggctccctcttctgcctcggatgaccttcttgcaccattaccaggctcaaagcatccaccttgcaacaacggtaaatcagattcagaagctttggagcaagatcactcaagaaccgggattggtccaggaaatgctggcactaacgaggacaaaagctcctcaggtgtaagcacgaagcagaagatgccagaaacagaatcgactgtccatgatgagtccggtttctcagtctcaaaacgtgcaagaacagagaaatagcaggatacttaagactttttaacatctgataaataatcttttgtagacaacatatctctgctcctggagatgatgttgttaatatagataaatctgctgatagaaagcaggagttgttgaaacattacatcatacattcttctttatgtgtatttctctaacatttgaccacatgcaatatattctttcattttgaaagaattataagctaaaaaaaaaaaaaaaaag

SEQ ID NO: 16004 - DNA, 940 bp, Gossypium hirsutum
  Predicted polypeptide sequence is orthologous to G2592, G2713
ttcgtgatgtgagggatagttttgggagcttatctaggcggagttttgatgttagattggtggggcatcatagaggaaaatctcatggtgctttacatgatctgcatgatgagccgcttgtaattcagaacggccgttgggctaatctccctcccgagctgcttactgatgtgatcaagaggttggaagagagtgagagcacatggcctgcacgaaagagtgttgtcgcatgtgcttcagtttgccaatcatggagagtcatctgcaaagacattgttaagagtcctgaattctgcgggaagcttactttcccggtgtctctaaagcagcccgggccacgtgatgggattatccagtgtttcataaaaagggataaatcgaaactgacataccacctctttctgtgtcttagccctgccttactagttgaaaatgggaaattccttctttcggcacaaaggacacgcaggactacttccactgagtatataatttctatgaatgctgacaacatttcaagatcaagcagcagttacatcgggaagctgaggtcaaacttccttggcacgaaattcataatatacgatacccagcctgcctatactgcctcttctcatgttcctccaccaggccgaacgagtcgaagattttactccaagaaagtttcccctaaagtccctacgggcagctataacatagctcagattagttacgaactaaatgttcttgggtacccgtggcccacggaagatgcattgtattatgcattctattccggcctcagctcttggtgtaggtggttcagtccctggccagccagagcttcttcgtcaccctttggaggactcattcagagcatttccttttctaagtctcttgatcattcggtcgagtttagcagctctcggttttcagatgttggtgtgtctcataaagatga

SEQ ID NO: 16005 - DNA, 944 bp, Gossypium hirsutum
  Predicted polypeptide sequence is orthologous to G2592, G2713
tgaaaagagaagaacgaagtaatgatgttcctgcatgcgtgtggatgatctatagcctccattttagcgaaacatagttataatttaagttttgggggttctttgttagtgccaaaaataaatgtcgttccgaagtatggttaacgatgtgagggatgctttggggagcttatctaggcgtagtttggaggtgagatttcctggtcatcataagggaaaatctaatggttcagtgcttgaattgaatgatgagcccatggttatccagaatagccgctgggcgagccttccgccagagctgttgcgtgatgtgatcaagagattggaagcgagtgagagcaactggcctgctcgcaagcatgttgttgcttgtgctgcagtatgcaggtcatggagggaaatgtgcaaagaaattgttagatgtcccgagttctccgggaaaatcacctttccagtttctctgaagcagcctgggtcaagggatggaaccattcaatgcttcattaagagagacaaatctaatttaacttatcaccttttcctttgccttagtcctgctttgcttgttgaaaatgggaagtttcttctttctgcaaaacggacccgtagaactacttgcacagagtatgtaatctctatggatgcagataacatatccagatctagcagcacatacattggaaaactcaggtccaactttcttggtaccaaattcataatttatgacacgcaacctccatacaacaatgctcagctttcaccacctggccgaagccgaaggttctattcgaaaaaagtctccccaaaggttcctaccggtagctacaacattgctcagtttcatatgagctaaatgtcctagtactaggggacctcgtagatgcattgcagtatgtactcaattcctgcctcagctgttgagccaggtggcattgtccctggtc

SEQ ID NO: 16006 - DNA, 968 bp, Gossypium hirsutum
  Predicted polypeptide sequence is orthologous to G2592, G2713
gtagttcagagcagccggtgggctaacctaccccctgagctgcttgtcgatgtgatcaagaggttggaggagagtgagagcacatggcctactcgaaagaatgtcgttgcatgcgcatcagtttgtcggtcgtggagattcatctgcaaagaaattgttaagagtcccgaattctgtgggaagcttacattccccgtgtctctgaaacagcctgggccacgcgatggaaccatccagtgtttcattaaaagggataaatctaaattaacgtatcgcctctttctttgtcttagccctgccctgctagttgagaacgggaaattccttctttctgcaaaaaggacacgtaggactacttctacggagtatatcatttctatgaatgctgataacatttcacgatcaagtagcagttacattggaaaactgaggtcaaacttccttggcacaaagttcataatatatgacacccaacctgcctatacctcgactcatgtccctccaccaggccggacgagtcgaagattttactccaagaaagtttcccctaaagtccctactggcagctacaacatagctcagattacttacgaactaaatgttctcggtactcggggtccacgaaggatgcattgtatgatgcactctatccctgcttcggctcttgacgccagtggtgttgtccctggccagcccgagcttctccgtcatccattagaggactcattcagaagcatttccttctctaaatctcttgaccactctgttgagttcagcagctctcggttttccgaaattggcacatcttatgatgatgaggacgggaaaatgaaacccttgatcctcaaaaacaagcccccaagatggcacgagcagttacagtgttggtgcttgatttccgaggtcgagtaacagttgcttcggttagacttccaattgattgctgccacacaagcagctgctggtgc

SEQ ID NO: 16007 - DNA, 864 bp, Gossypium hirsutum
  Predicted polypeptide sequence is orthologous to G2633
tgagattctccttttgttctttgaaaccccaaacttagcaccaaaacttttagtttagaagtggaatcaaaataagaattcatccggttcttctctttgatgtgttattggtgccaagcagcagttgttggaaatggttgggtgatttaacttattcataataacagtgctattggttaaatacggaggtactttatcagaaaggttttgcagtgctctgttgttgtctgttgactcgtaggattaaataaaagaaacttctgcaatgcaaacgtctcagaaacataaaattacaggcaagtgcattgactggcccgtgcaagagctggagtcctattgttgtcctccaaaccagagcttagagccatgccagtcaggttctgatgatggcagcaatagtgtgcaacattcaattcctaacctggagcgatactgcacccttgattcatcgtccagtgtgcagaactcttcttcgacagccagtttttcacccgatggcagtcctgtttcgcagcaaaactacacttacccattggaccttcatcattccccggaaaatacatgtgcttcaccaataagtggttcttgtgtaatagacaatgaaaatgacttggggctcatgataagacaactggaaactgctatgctaggtatcgattcaggtgatcttgaccttcatgcaatagcagcttctggcagagccactgaagtttccgtagaagcggagaggtggaaatacatgaaagagatgatcgccagaggggacctgaaagaactgctttttgcttgtgccaaagctatagaaagtaatgatatgtatatggctgactgtttgattgcgcattacgtcaaatggtgtcagtt

SEQ ID NO: 16008 - DNA, 963 bp, Gossypium hirsutum
  Predicted polypeptide sequence is orthologous to G2717
cacagcgtcccattgaatcgccgtgaaatctcctgtagcatagcatcgccatggtagaaaaaaataattgaatttaatttcttctttaattctctttttcttttcggtctttttaagaaaaatagcagttcttcgccttccgatctccgattcagtcacccacaaaattatatcataagcttcttgaatttgaaggcttttttcccctttgtgttcctttaaatgggtgctcctaagcagaaatggacacctgaagaagaggcagcgctaaaagctggagtcatcaaacatggtgctggaaaatggcgaacgatactgaaagaccctgaatttagtggcgtcttgtatctgcgttccaatgtagatcttaaggataaatggagaaatatgagtgtgatggccaatggatggggttctcgagacaaagctaggctagctgtgaaaaggacatctagctttcctaaacaggaggagagtgcggtggacctcgctgtagctccaagtgatgaggaaatcgtggatgttaagtctgtcccagtttccagtgctacattacagattccatcttctacaaagagatccatcgtcaggttagataacctcattatggaagcaattacaaccttgaaggagcctggtggttcaaacaagacaaatattgctgcatatatagaggagcaatactgggcacctcctgactttaagaggctcttgtcagcgaagttaaagtatttaacagcttgtggtagactgataaaggtgaaacgcaggtataggattgcacctgctctgtcattttcagacaggaggaggaatcatcccatgctattttcagagggaagggaaagggtttctcctcgatttgatagggatgatttgaaaatcatcacaaaatctcagattgatttagagttagctaggatgaggaagatgacaccacaagaggctgctgcagccgctgct

SEQ ID NO: 16009 - DNA, 899 bp, Gossypium hirsutum
  Predicted polypeptide sequence is orthologous to G2717
ctcgttaaaacaaaaatttccgatgctccgcgcgtgatctcttcctcccttcccacgtttctccgatcaggaatttgttgatgggtgcccctaagcagaaatggacagcagaagaagaagctgccctcaaggcaggagttctcaagcacggaaccggaaaatggcgcaatatactttcagatcccgagtttagttcggtcctgcggtcgcgctcgaatgtggatctcaaggataaatggagaaatataaatgccacggccatatggggatcaagacaaaaagctaagcttgctcttaaaagaaatcagttagccgctaaacacgatgataaccccatggcactaatcaccgtacctccgactgaagaagtcgttgatcctaagccccttgccatttctagtagaacaccaagggtaactggacccaaaaaaccagtttcaaggttggagaatattttattggaggctatcactagtttgagagagccaggtggttccgatagagcttcgattgctttatacatagaggagaaatatgctgcaccgctgaacctcaagaagcttttggctacgaaactaaagctgttggtagcaaatgggacattgacaaaggtaaagcataagtacaggattgcaccacattcaactatttccgaaacaagatctcctctgcttgctttggaaggaaggcagaaggattcttcgaaatcggagaagaaagccatcaacattcttactaaaacccaagttgatgttgagttgtccaaaatgaagaccatgactgccgaagagccgctgcagctgctgcacgagctgttgcagagcagaattcgcaattgcagagccgaaagcagcaagagagcagtgccgcggaagctgaagctgagcagcaaaatttcg

SEQ ID NO: 16010 - DNA, 628 bp, Gossypium hirsutum
  Predicted polypeptide sequence is orthologous to G2717
atgcagatttgttgaaaatgaggagcatgactgcagaagaggctgctgcagctgccgcacaagcagttgcagaggcagaagttgcaatcgcagaggctgaaaaggctgcaagagaggcagatgtggcagaagctgaagcagaagcggcaaaaatttttgctaaagcagcagagaaagcattgaagtctaggatgctatagacctgatggcataaatggaaacctacaattttgtctttagttcattgctggaaaaatgcaagagactccgacatcatgctggcctggcataccaaccgcgatcatgtctataactgtaaatatattaggcttgtaaagaagaaaatgtgagataaatcggtccatcaagcgctactttttgtacgaacatttggtaaaggaggttagaggtgttagtgattctataactttatcatgaagtaaaagggtacagatatagcaaaaagaaatagagaaaggcattcatgatggcacgctttgagatatatgatccgtctctactgaaagtcaacccgaaaacaattgaaccgcaattttgctagtgggtgttcaagctatttagtgttgctgttggctaatggccacctaaaaaaaaaaaaaaaaaaaaa

SEQ ID NO: 16011 - DNA, 908 bp, Gossypium hirsutum
  Predicted polypeptide sequence is orthologous to G2763
cttcttcttttccctcgattccaccctctgagttcatcaaatcgacgcttctgttatcattcaccgaatcatacggtgtagagagagagagagagagagagagagagagaatattagaggattttgatccggtgagatggcgtccatggtaacgaatccagtgacgaacgcaaattctgatcgcaccaaaaggaaaaagaagaaatcaatgatcatggaagacaatcaccagagtcacgccagatggaaatcggaggcgcagcagcaaatctattcctccaagcttcttcaggctttgagccaggtcagtctcaacactccttcctcttcggctcctcgcggtggccgagccgtccgtgaagctgctgatagagctttggccgttgctgctaaagggaggaccaggtggagccgggccattttgacaagccggcttaaactgaaattcagaaagcagaagaggcagaggggagccgccgtggctgccgtcacggggagtagccgctcgaagaaaccgagatttagcgtttccaaactgaaatcgaaaagcttaccggctgttcaaagaaaagtcaaggttcttggacggttggttcccggttgcaggaagcaaccgttgcctattattcttgaagaagcgactgattacatagctgcgcttgaaatgcaggttcgagccatgaccactctcgccgagctgctatctgggctccggtgccgccagctctggctcagctcttccgccccagtcgccgccgcctagtcagtaacacctttttttaatttgcttagttgccaagtcatcctcatcctcatcttccttttttattttttattttattgcctcctcactctctaagtaatgttaaatacatgttttctttgtttttccttttccttcctcacgt

SEQ ID NO: 16012 - DNA, 877 bp, Gossypium hirsutum
  Predicted polypeptide sequence is orthologous to G2766
ttctcctttaacttatataatttcccttcctagttcttccatttctccacgctaccaaagccatgtatccatcatcttcgtctcaaaagcccatgggtcaatccggcctcacccgttacggttctgctcccggctcctttctggccaacgccgttgattccgtcatcggagcggaccctaacctcgtcggccactacttctccgccgctgactcctcctctttaacatcagagtcaacttgtaaagtcagctcatccaacgatccgcgagagcctaaatcagctgctgctgctgctcctgctcctcctcatcctcctccgcatcatccccatggatcttaccctgcaccttcttcttcctctctgctcagacaacgcagctcccccgccggtttccttagtcacctcacatcggaaaacggtttttccgttacaatgggcaacagaaattatagctctcaaggcagtggtaatggtggccatggagtgtcaaggttgaagtcccagttgagtttcactaggcaagattctctttctcagatctctgaagtgagtgagaatcttgtggatggtgttagctctaacagtaaccaccaaaatcctgcacattcgtttgctgctgctggctttggaatggattcatgggataatacaaactccattgtgttttctgccccatcaagcaagagggctaaaaatcttgatggcgatatttataactgtttcaatgccttggaaactcagtttagcttgccccaaacgacactcgagatggccacagttgaaaagctgctacatattcctgaagattccgtgccctgcaaatccgagccaagcgtggttgtgccctcacctcgaagcattgctgaagagagaaa

SEQ ID NO: 16013 - DNA, 1090 bp, Gossypium hirsutum
  Predicted polypeptide sequence is orthologous to G2783
agtacaaaatttttgtaataaaaggaggtttatacagtgcatatgctatttaacaagtgaataacacagccttaagtttatatccccctatagcgaaacaaaggagaaatcaagtagcataagttcataatcctagtaaagagagaacagcagccacgaaagatcgttaatatcagcacttagctatatccgacttgttgctgttgctgtggctgttgataatttccatacccaggataccctccatagtacatgttggggtcttgtggggcagcgccatagccgtaaccatatccttggctgtatccataatatccagcgttccactggtttggatctgcttgggcctgcttgtttgatgtgctacgaccccatgaaagccgaatactttgtccacccaactgagtcccgttcagtattcggagagattcttcagcacaactcctatcagcaaattgaacaaatccacaacgcttgttttgtggaatcttcacatgcaccaactgaccatatgggctgaagacctctctcaaatggtcttcagtcacgttagaatccaaattaccaacaaatatagttgtattatttggatcattctcgttctgagtcccttgcgatgaagctgctggatattgctgtgcagcaccagtcttcttgttagtagccggccctatgcgcataggcctagttgaacaaaaagcaccattcatctcagtcatggcacgattatattcagtttcatcgccaaacctgacaaacccataaccttttgtgcgcccagtgatcctatcaatcacaacctttgcacccttaacagaaggaaagtgtgccctgaaggtctcttgaagcatgtaatctgtaacatcagcagccaagtctccaacaaagattgtgaactcaggggtctcatctcgcctatcgcctgaactaaaggatgcccagttcaacctatagttgctctcaccatttggcataggtgtaccattgtatgtttgtaaaactctctcagcagcagctcttgaaacaaactcaataaatccatagccctccacttgaccggtttgcttgttgcggataacttttacagaag

SEQ ID NO: 16014 - DNA, 840 bp, Gossypium hirsutum
  misc_feature (9)..(9): n is a, c, g, or t
  misc_feature (824)..(824): n is a, c, g, or t
  Predicted polypeptide sequence is orthologous to G2791
ccgcgtttnaccccacagttcgatcccacctcctcccacgatgacttcttagaccagatgctctccactctcccttcttgctcctggtccgacctcaagtcaccttgggacccgcctaaatctgatgaaacgccgccttctaatcatgacaataatgttgggtttcactacgacgagattctagcctccaagcttagacaacatcaaatcaacggcggcggcggagggactactgcagctatgaagatgatgatgcaacagcagatgatgttaccgggaagacccatcgccgccgcaggtggaggagggttgactatgccgttgcataacgatatcgttgatgggtcttcgtttaagtcccccaatcaacagggtggggagggttccgtgcaagctctgtacaacggtttcggtgctggatctttgcatgggactaataatcagtcaccgaaccagcctcagccttttcaccatcctcagggaggcaatatgcagacacaaagctttggagcaacagcagggatagttatgaaccaaagtcaggcaagcggatcgacaacgggaggtgcaccggctcaacccaaacaaagagttagggctagaaggggtcaagctactgatccccacagcatcgctgaaagattacgcagagagagaattgcagagagaatgaaagctcttcaagacctggttcccaatgccaataagacagataaagcttcaatgcttgatgagataatcgactatgtcaaattcctccagctccaagtcaaggttctgagtatgagtagattgggcggtgccgctgctgttgctccccttgntgctgatatgccatct

SEQ ID NO: 16015 - DNA, 904 bp, Gossypium hirsutum
  Predicted polypeptide sequence is orthologous to G2791
atctcctccatcatcaaagcaaaaaaataaccctaattatgcagccttgtagtcgtgaaatgcaagcaatgaactctctcttaaacccgacccaacaaatccctctccaagaccttcaaatcaacggtaacagccaccatcatcaacagatccacgtcccatcatcatcgcagttccagtatcccacaccgacttcaacaacccaccatgacgacagcttcttagaacagatactctcctccaccacgtccttcccgtggtccgacgaaacgggtcctcccaaacccgaggataacaataacgccggcttcaactacgatgagatggttctagcttccaagcttcgacagcatcaaatcaacggcggagctgctggtaaccctttttccgctatgaagatgatgttgatgatgcaacaacaacaacagcaacagcagatgatgttagcgggcagacccacggttgcctcctccgccgccggaggcggaatcaccaccaatcatcagggtggagagggttccatgcaagctttgtataatgtttttggagatggatctttgcatggaactatgcaggcgaaaagctttgtgggggctaattcagcaacagagatgacccaaagtcagggaagtcgtccgacggccggagaagcggtgacggcgccggaaaagcctaaacaaagagttagggcaaggaggggtcaagctactgacccccacagtatcgcggaaagactacgtagagttagaattgcagagagaatgaaagctcttcaagaactggttcccaacgccaacaagacagataaagcttcaatgcttgatgagatcatcgactatgtcaaattcctccagctccaagtgaaggttctgagtatgagcagattgggtggtgctgctgctgt

SEQ ID NO: 16016 - DNA, 550 bp, Gossypium hirsutum
  misc_feature (452)..(452): n is a, c, g, or t
  Predicted polypeptide sequence is orthologous to G2834
tttttttttattaaaaacaaacaattgtcaagattacgactttaacaagaaaaaaaaaagaactgctgttctaacaaggttagagcatttctttaagcaaccaagtacagagggctgccttaccacacaaatttaacacatccctgaatccctactgatgaaggaagaaattagccacaatcaagggctttactcctctccacttttctgactgtaattacaggacctagaaagtagaaatgcaaatgaactctctgagtcatcaaatggtggtcgagggaactcatgaaacccaccaaaattacatgtatcgaagctcaacggtgagaagtaaccaacagcatcatcaatcccccctttaatgtccatactactactttgaacctcactttcactagaaacataagagaggttgaaattcacacttccaaccttattagtggctccatcanatgttccggcgggtgctgctttaatttcatcaaaaggaatggctggagtgtgaccttggaaaagagtgatatgcccaaacagcttatctttccttgaa

SEQ ID NO: 16017 - DNA, 629 bp, Gossypium hirsutum
  Predicted polypeptide sequence is orthologous to G2834
acagggccgtctaacgcgtccgaacaaggatcacaaaaagttccagcctctgaaaaccatcttatgtgtcaaaaaccattacaagagatcccactgtgacaagagctacatcatgcagcaggatgccacaccaagaaattctcagtgattgctgatctcaaaactcatgagaagcattgtggtaaagataaatggctatgttcgtgcggcaccacgttttcgaggaaagataagctgtttggtcacatagctcttttccagggtcacactccagcaattcccctggatgaaactaaaggacccattgccccatctgaccctggagatggcagtgaagcaacaaatgtggtcggaagcatgaatttcttcaactttggtagtgaaaatggggtggatgtcaaatgcagccttgatgatcctgctgcttatttctcaccattgaactttgagacatgtaactttggtgggtttcatgagttccctcgaccggcatccgatgattcggagacttcattggcatttctcctttcaggaacgtgtagttacaataataataatgatgttgagaggtcttgaatattgatggtagactagactagattgtattcttccttggttctagatcgcga

SEQ ID NO: 16018 - DNA, 801 bp, Gossypium hirsutum
  Predicted polypeptide sequence is orthologous to G2846
gggccgcgtcgacagtggtaccaacaacaacagcagtattttgatcgattccactttgggttttggtctttcatcatcggataattggaaccaatccttgctccggagtaataatcaagagtttccaatggattcaacatatgaatgcccttcaacactgttattcgacactgacccacaacaacaatccgtttttaacaacaacaatcagtcaattaactatatgtcttgttcttctttatcatcatcaccttcttggccaaaactagctccaccattgacgacaaagcagcagcaacaaccacctgtaggtactggtaccttacaattctccaacaatacatccttttggaacgcatctgcaactggcaacatattaccttcgttgtatgaagagaaacctaattgtcccaccttgactacaaagactaatatcgaagaagttcggaaaaattcgaattcgaagaaagcaagtaatgaaactccactcaagaggccaagacttgaaaccccatctccattaccaacttttaaggttcgaaaggaaaagctaggggaccgaatcactgccctccagcaattggtttcaccttttggaaagactgatactgcctcagttctacatgaagccattgaatacatcaagttcctccatgatcaagtcaatgttttaagtactccatacatgaaacaagcagcagcttccatacaacagagtactgataagttgaaagatcaccaagaaggtccaaaacaagacctaagaagtcgtgggctatgtttagtgcctgtttcagcaca

SEQ ID NO: 16019 - DNA, 911 bp, Gossypium hirsutum
  Predicted polypeptide sequence is orthologous to G2851
atcatcatcaacaaacagcttcccctttcttccctttccctccaccacagccaccaccaccaccggcggcagcggcgactgctgctactttcttccctcaactcatccctacttccacttcttcttcttcttcatggcatgacaataataaccaagaggggaggactggtgggagaagaacaagcaacagcattacaacaccaagcttcaactggtaataataatattatgaaacaagaaaactatgtgtatggccatgcaaatgaagattaccatcatcatcatcatcattatcaaggatctaaagcaacaactaattggtccatggctactgcttcttcatcaccaaaatcctgtgtaacaacaagtttcaacaacaacatgttggatttttcaagcaacatcaaagctgatactgctacaaggcaacacctaccattaatggatccatcacctgagtgtaatagcagcactgcaagtggtggggcattgaagaaaactagggttcaaccttctgcaactcaatctactttcaaggtgaggaaagaaaaattaggagacagaattacagcacttcaccagcttgtttcaccatttgggaagacggacacagcctctgtgttgttagaagctattgggtacatcagattccttcagagtcaaattgaggctctcagcttaccgtacttgggcagtgatggatcatcaggaaacatgaggcagcagcaacagtctgttcaaggggagagaatttgtatatttcctgaagaccctggtcagctgttgaatgaaaaatgcatgaagaagaggaaaggtagtcctgctgatcttcaggattctaatgaagaaccaaagaaaaacctaaagagtagagggctatgcttggttccaatatcatgtacacttcaagt

SEQ ID NO: 16020 - DNA, 844 bp, Gossypium hirsutum
  Predicted polypeptide sequence is orthologous to G2851
gttttgggagagttgtagtttcataaaagggaaagtgaaaggaaaaccaggaggaaaagagaaagttttctagtgatcatcatcatcttcttcttcttcttcttctttagataagattcataaggccatgaaccgaggtgtgttgcagagctcaccggtgcagcaactgatggccggaaaccctaactggtggaacatcaacaccatgcgcccaccaactcatcatcaccaacaagcggcggcggtggcggcagcaccttctcctttcttgcatcctcctcccactactttcttctctcacacacccacttcttcttcttcgtcttcttcatcttcttcacttcccgttccttcttggcatgataataaccaggagcttcctgagtcatggaatcaacttctcttgggtggattggtaggagaagaagaaaaggggggtgatataggacagtttcaagcgttacaccaagtctcaaatgctaattctgttgtggatgtgaaacaagaaaactctgcaagcagctatgtgtatggacatgcaagtgaagattttcatcatcaccaggcgaataaaccagcttggtttcaccagatatcgtcagctgcttcatcacctaagtccagtgtcacaagtttcagcagtaacatgttggatttttcaggcaacaaagctgaacatgggaggcagccacagccagatcggtcttctgagtgtaacagcactgcaacaggggggccattgaagaagcctagggttcaaccttctgcaacccaatctaccttaaaggtgaggaaggaaaaattaggagacaggattacatcacttcaccagctagtttctcca

SEQ ID NO: 16021 - DNA, 533 bp, Gossypium hirsutum
  misc_feature (9)..(9): n is a, c, g, or t
  Predicted polypeptide sequence is orthologous to G2851
cggcacggnagtaaacataggcagcaacagcctgttcaggggagagaattgatatttcctgaagaccctggtcggctgttgaatgaaaactccatgaagaggaaaggtggtcccgatcggcaggagtgtgatgaagaaccaaagaaggaccttaggagtagagggttgtgtttggttcctgtgtcatgcacacttcaagtcggcagtgacaacggtgctgattactgggctcctgcgctatgagggattccgatagaagaaccctcggaaaggctagcagactttaaacaaaactaaagaaatgtagaagcagtgatgagagctttccatgggaaagaacgatataacatcatgagcagttactctgcaaagttgaaaggctgattgctcacgatgctatataaatgttctttcttttcaacaatttgtagatggtttgtgtgtcaaattaagctctaactggcctgatgattttgaataatttaagcttataattatctatatttttctttcgttaaaaaacaaaaaaaaaa

SEQ ID NO: 16022 - DNA, 634 bp, Gossypium hirsutum
  Predicted polypeptide sequence is orthologous to G2854
aattttttttttttttttttgataaacagttcaaaatagagaactaaaactaaatcgacaaataagaagcataataagttcacaataaacattaaaaagcatcagtccgaaaaactaccatggtgtaatataacactgaatagcaatagactggaaaatcaaatcaaaacaaaactcaatatcagaggataagaaaccaagaaagcgaagctaaaacgatatgggagagagggaaaagatgaaacataacccaaaaaaaagattgtacaggaaacaatgaaaatctacaaccttaaaacatgtttgattggatcacaccaacaactaatgtgctctggatcaatgtcaacgagcttcactccagccacactttttactgctgtggttgttggtacgctcctggctgttggtaattcccatatccaggatagcccccataatacatgctagggtcatggggaggaggtgcatatccatatgcttcatatccttgagcatagccataatatccaccattccactgggcctgatcgggttgagcctgtttgcttgaaggactacgtccccatgaaagtcgaacatttcttcctcctaaaatggtaccatttaaaacatataacgcttgctctgcacc

SEQ ID NO: 16023 - DNA, 790 bp, Gossypium hirsutum
  Predicted polypeptide sequence is orthologous to G2854
gcggccgcgtcgactttttttttagcatcagtccgaacaactaccatggtgtaatataacactgaatagcaatagactggaaaatcaagtcaaaacaaaactcaatataagaggataagaaaccaagaaaagcgaagctaaaaagatatggtagagggaaaagatgaaacataaccaaaaaaaaaattgtacagaaaacaatgaaaatctacaaccttaaaacatgtttgatgggatcagaccaacaacaaatgtgctctggatcaagtcaacgagcttcactccacccacactttttactgctgtggttgttggtaagcccccggctgttggtaattcccatatccaggatagcccccataatacatgctagggtcttggggaggaggtgcatatccatatgcttcatatccttgagcatatccataatatccaccattccactgggcctgatcgggttgagcctgtttgcttgaaggactacgtccccatgaaagtcgaacatttcttcctcctaaaatggtaccatttaaaactgataacgcttgctctgcactagttctattagcatattgaacaaaaccacaattcttgttagcaggaatttttacatgaactacctcaccaagctgactgaatatttgttttaactggtcttcagaaacactaggatccaaaccgccaacaaatattgtggtattatttggatcgttctcgccaggatttccttgagtgttctggtaagtatcttttcctcatcaggcatgaagcatttcttttttctttcacc

SEQ ID NO: 16024 - DNA, 850 bp, Gossypium hirsutum
  Predicted polypeptide sequence is orthologous to G2854
gcggccgcgtctacctggggatcttccaaatctccaccttatctatcaaatatgatgcaacaaccaccaccaggaggcgttgctacgcctccttcaatggcagccgatcagtctcaaacccatcactaccagcaacaacagcaatcgcagacttggatgatgatgtctcaacaacaacagcaggtaggtcagccggttcctccaccttccggctggaatacgcagcctatccctcccccctctcagatgcagcagtaccccgccggttcagcggccgccggctccggcgagattcgatctctctggattggtgatcttcaaccatggatggatgagaattacctcatgaatatcttcgctcaaactggagaggttgtttcagctaaggtgattaggaataagcagacggctctaccggagggatatgggtttatagagtttgtctcgcaagaggcagctgagcgggttttgcagtcatacaatggggtgccaatgccaaattctgagcagaactttagattgaattgggccgctctcggatatggggataagaggcaagaagagggcactgactacaccatctttgttggggatttagctggggatgtttcggattacttgttacaggagacctttaaagctgtttacccatctgttaagggtgccaaagtggttactgataggacaactggacggtctaaaggttatggctttgtgaggtttggtaatgaaactgagcagattcgagccatgacggaaatgaatggaatttattgttcgacaagggcaatgcgaattggaccagctgctaataagaagccattcactggtcagcagtatcagaaaggac

SEQ ID NO: 16025 - DNA, 974 bp, Gossypium hirsutum
  Predicted polypeptide sequence is orthologous to G2854
tcgtaatctcccaaatatctttcctttgtctcatcgaatatgatgcaacaaccagcagctggtggcgtggctccgccaccttccatggcggctgatcagtctcaggctcatcagtaccagcaacaaccgcagtcgcagccttggatgatgatgtctcaacaacagcagggtggtcagccggttcctccacctaccggttggacgccgcaacctgttcctccgcccactcagatgcagcagtactccgccggttctgctgctgctggctccggtgagattcgatctctttggatcggagatcttcagccgtggatggatgagaattacctcatcaatatctttgctcaaactggagaggtggtttcggctaaggtgattaggaataagcaatctgctttaccggaaggatatgggtttatcgaatttgtgtcccgtgtggcagctgagagggttttgcagtcttataacgggctgccaatgccaaacgctgagcagaattttaggttgaattgggcatcacttggatctggggaaaagaggcaagaagagggtcctgagtacacaatctttgttggggatttagcagctgatgtttcggattacatgttacaagagacttttaaggctgtttacccgtctattaagggtgcaaaagtggttactgataggaccacaggacggtcaaaaggttatggatttgtgaggtttggtgatgaatctgaacagattcgtgccatgactgaaatgaatgggatgtattgttcaacaagggcaatgcggattggaccagcttctaataagaagcctgtcgctggtcagccgtatcagaaagctacttaccagaatgctcaaggaaatcctggcgagaatgatccgagtaacactacaatatttgttggtggtttgggaccccagtgtttctgagaccaattaaaacaaatatttagccaacttggcgaggtagttcatgtaaa

SEQ ID NO: 16026 - DNA, 895 bp, Gossypium hirsutum
  Predicted polypeptide sequence is orthologous to G2854
ctcgtctatcgaatatgatgcaacaaccaccagcaggaggtgtagctccgccgccgtccatggcagccgatccgtctcaaacccagcagtaccagaaacaacagcagtcgcagccgtggatgatgatgtctcaacagcagcaggcgggtcagccagttcctccacctgcaggttggaatccgcaacccgtccctccgccctctcagatgcagcagtactccgctggttccgcgaccgtcggatctggcgaaattcggtctctttggatcggtgatcttcaaccgtggattgatgagaattacctcatgagtatcttcgctcaaactggagaggtggtttcagctaaggtgattagaaataagcaaacggcactgccagagggatatgggtttatcgagtttgtatcacgtgccgcagccgagagggttttgcagttgtataatggggtaccaatgccaaattctgagcagaattttaggttgaattgggcggctcttggatatggagaaaagaggcaagaagagggtcccgattacacaatctttgttggggatttagctgcagatgtttctgattacatgttacaagagacttttaaagctgtttacccgtctgttaagagtgccaaagtggttactgataggactacaggccggtctaaaggttacggctttgtgaagtttggtgatgaaactgaacaaattcgtgcaatgactgaaatgaatgggatttattgttcaactagggcaatgcggattggacccgctgctaataagaagcctgtcactgatcagcagtatcagaaagctgcttacccgaatactcaaggaaattctggagagaacgatccgaataataccaccatttttgttggtggtttggatcctagtgtttc

SEQ ID NO: 16027 - DNA, 418 bp, Gossypium hirsutum
  Predicted polypeptide sequence is orthologous to G2893
ttttttttttttttttttatttagagataaaaatgaattagtttatcttcacaacttaacaaacattgaattcctcagttgcagtaataacatttggacaaaaactcgaatgacaacaaaaaatctgaacacaaataaacccagaaaatcaactatgaagaaataacatcagaggttccccttcaatggaagttcccatagttctcccatgctccatatcccatctgcaaaaccatcattaacccaattgttgtccgccatgtggcagtcggcagtcataaaatctccaactgctgatgtggatggcaggttgatggtttccatgccgtagcaactactgttatcaacataatagcaatgctttgcaaccgtgttgtactcattgttatcagtgatgccgaatgaacttgtttggtac

SEQ ID NO: 16028 - DNA, 861 bp, Gossypium hirsutum
  misc_feature (837)..(837): n is a, c, g, or t
  Predicted polypeptide sequence is orthologous to G2907
gcggccgcgtctacctttttcctgttgtgagcattgccttctgagcaactagacatagtaaaacattgctccttaatctcttctaaaacattaaaggtctttggcatcacaaaatgtaattgtagattttcatatacatttcttaactctgaacataattgaatttaatatttgtctcattctcaagtgttttctgtaagtttcttaatagttcccatgaacagccattttctagtttttcttttttactttctgaaattttgtcagggaaataggacaaattttaaccgtctcaaagagactgaaggagctattccatattcccaagaagctgtaggaattgtacccaattctgaggtggaaagttctatgtcttccaattttcttcccaataatagtcagattccttcacaaactatggatacagcaagcatgaacagtgtgcatgtgcaggcatcagaatatgaagatgctgaatcagtgtctaatcatcaagcaagttcacagttccattcttttcttgattcacatcagcctgttgcagggagggctgataccagattctatgatccatatgttcatgtatcacattcaaataattgttatgggaagccatctataactgcttttcaacttactcaaactgacaaggatagagagtataatgttgctggaataacgtatgagccccagaagaaccttgatttcacatcatgggaggatgtgttgggaaactgtgatcgtggggttgaatctgcacagtatcagccaccatttaccttgaaacaaaatgatactgtggggctgctatttgacaacagctttcttaaaaagcangcgtttgaggatcaatcacatgct

SEQ ID NO: 16029 - DNA, 857 bp, Gossypium hirsutum
  Predicted polypeptide sequence is orthologous to G2964
tttggttctcttcctcttcctcttcctcttcctcttcctcttcctcttcttcacccaaaaacccccgcccgaagctaggtgaaagaagttctctaatggatactcgtaaaaggggaagacgtgaagctgggttcaatgctaatggcggcatcaagaaatctaaaccagaattggaatctttatcaactggtgtaggaagcaaatcgaagccttgcaccaagtttttcagtactgctggttgtcaatttggtgagagctgccatttcctgcactatgttcctggaggttacaatgcagtgtcccagatgatgaaccttgcaccagctgttcaaccagcttctagaaacgtggcagcgacagctgcaatacctcatggatctgcctctgcggtcaaaactcggttatgcaacaaatttagtagtcccgaaggttgtaagtttggtgataaatgtcattttgcacatggagagtgggaacttggcacacctattgctccatctcttgatgatccccgttccatggcacctcttcctggccgcatgggcagtcggatggaaccaccacccccatcaggtcctgctgctacatttggtgcttcagcaactgcgaaaattagtgtggatgcttcccttgcaggagccattattgggaaaggtggtgtgcactccaagcagatatgtcgtcaaacaggtgcaaatctatctattcgggaacatgagtcagatccatcacttatgaacatcgagctcgaaggatcatttgagcaaattaaagaagccagtgcaatggttagagaactaatcagcagcctgggtccagtaccgggtccggccaaaacagctggtgcacatggtggt

SEQ ID NO: 16030 - DNA, 944 bp, Gossypium hirsutum
  Predicted polypeptide sequence is orthologous to G2964
gggttactcttcttcttccttctctctctgggcttttacattcctctttctttggtttttagggttcctgaaactcttgcagtcatttgatttttttgttggtatctttttcctttggatatggatctgtgatttttcattaaaagcaaagttctcaaatggatgctcgtaaaagaggaagacgtgaagctgggtttaatgctaatggcggcatcaagaaatctaagccagaaatggaatctttatcaactggtgtaggaagcaaatcgaagccttgcaccaaatttttcagtactgctggttgtcaatttggtgagagctgccatttcctgcactatgttcctggaggttacaatgcggtggcccagatgatgaaccttgcaccagctgttccaccggcttctagaaatgtgacagcaacagctgcagtcccgcatggatctggctcccaagtcaaaactcgcttatgcaacaaatttagtggccctgaaggttgtaagtatggtgacaaatgtcattttgcacatggagagtgggaacttggcaagcctattgctccatctcaagatgatccccgttccatggcacctcttcctggtcgtatgggcagtcggatggaaccaccacccccatcaggtcctgctgctacatttggtgcttcagcaactgcaaaaattagtgtggatgcttcccttgcaggagccatcatagggaaaggtggtgtgcactcgaaacagatatgtcgtcaaacaggagcaaagctatctattcgggagcatgagtcagatccatcacttaggaacatcgagcttgaaggatcatttgagcaaattaaagaagcgagtgcaatggttagagaactaatcagcagcctagtccggttccaggtcctgccaaaacacctggtgcgcatggtggtcaagggcatccaggaagcaactaca

SEQ ID NO: 16031 - DNA, 878 bp, Gossypium hirsutum
  Predicted polypeptide sequence is orthologous to G2964
tatttccacccttttcctttctcctccctccgcgctttcccttcttctccgaaccctagctttccattttctctcacttttgtttctttctcttggatttcgttgctcgcccaatggagtttggtggtggacgcaagagagtgaggcccgaggctgccttgaacggcaatggcggcttcaagaaatccaagcaagaaatggagtcctttccaactggtataggaagcaaatcaaagccatgcacaaagtttttcagcacttctgggtgccaatttggtgagagctgccacttcttgcattatgttccgggtggcatcaaagcagtgtctcagatgctcggtaacaacccagctcttcctgccgctgccagaaattcagtagtcccaccatcctttcctgatggctcatctcctccagctgtaaagacccgcctgtgcagcaaattcagcacccctgaaggttgcaagtttggtgataaatgccattttgctcatggcgaatgggagcttggaaagcggactggtcctacttacgaagaccctcgttccatgggaccaatgcctgggaggatggctggcagattggagcctccctcaccaggttttggtgctgcagccagcttcggagcatctgccactgccaagatcagcattgatgcatctcttgcaggagctattattgggaaaaatggtgtgaactcgaagcatatttgtagggttacaggagccaaactttctataagggagaatgaatcggatcctagttcaaggaacattgagctggagggaacatttgatcagatcaagcaagccagtgcaatggttcacgagctgattataaatgttggttcggcctctggaagtagcatgaagaacacc

SEQ ID NO: 16032 - DNA, 846 bp, Gossypium hirsutum
  Predicted polypeptide sequence is orthologous to G2969
ggcctgaatacttgaaccacaaagctatctcacctttgttatcaagctctctgagtgcgcgtctatcaatggcgaaaaccaatattgggtcattcttcaataagttcctttctcttttcatccttcttctccaccttggttgcttcgttttcaccgccgctaaagacaaccataaagcaaccaagaaacgcaaatcctcacctctttctcctaactctcacaaacaccgcaaagctctttcctccacatggacttttctcaaacgcatttttttcttctaaagccaactgcataaacaccatccaggccgcacaccctccaacatcagcaaccacacccgcgttaacctttgcaagaaactcccaacattcccttgtctccatgtccatgatcaatccacctgaaactcacctatcagacagccctcccccactttctcaaatacaatccgggtcttgtccagaatccgatatctcatccgactacccgtttttccctctacgtaacgatatcttcccatgcacagcttgcggcgagatttttcagtaaaccccatttgctcgaacaacaccaagcaaccaaacacgccgtatccgaactcgttgatggcgattcaggtaacaacatagttcggatcatactcaaaaccggttggaccgacaaagttaagagccctgaaatccaccgtattttgaagatccataacagcccaaaaattctaaccaagttcgaagaatacagagaggttgtcaaagcgaaagccgctagaaacggtgcgatggggaggcgagacgagaggtgcatagctgatgggaacgagctgttgagatttaattgctcaacttt

SEQ ID NO: 16033 - DNA, 859 bp, Gossypium hirsutum
  Predicted polypeptide sequence is orthologous to G2981, G2982
ggtaagtggtagtaaccatattcaaaaccataaccaccatgaaaatggggagaaaaacccaactttgggaggagcttctaggtcgtggggcacgaccgtttccggtcaatccgtttcgactagtggtagtgttggctctccctcgagccggagcgagcaagctatggctacaccagctagtgagaatactttcttaagattgaaccatctcgatattcacggagatgatgctggatctcaaggtgccgttggtaaaaagaagaagagaggtcaacgtgcagttgcaggtgataagagtggcagagggctccgccaatttagcatgaaagtttgtgaaaaggtggaaagcaagggaagaaccacatacaatgaggtggcagatgaacttgtagctgaatttgctgatcctggcaatagtgtagcatcaccagatcagcaacagtatgacgagaaaaacatccgccgaagggtttatgatgctctgaatgttctaatggcaatggatattatatctaaggataaaaaagaaatacagtggaagggacttcctcgtactagtctgagtgatattgaagatttaaagactgaacggcttgggctgagaaataggattgataaaaaggctgcctatttgcatgaattggaggaacagtttgtaggtcttcagaatttgatacaacgaaatgagcaactatacagctcaggcaatgcttccggtgggggagtggctttacctttcatcctggtgcagacacgccctcatgcaactgttgaggtagaaatatcggaagatatgcagctggtgcattttgactttaatagcactccctttgagctccacgatgacaattatgttttg

SEQ ID NO: 16034 - DNA, 958 bp, Gossypium hirsutum
  Predicted polypeptide sequence is orthologous to G2989, G2990
ccttcatctcccccccatttaacaacccaagagagaagagcccatttttccccccgtttctctatcccttttcctttttcattaccaagcttcgtaatttcttgcatattatcaaatatttctcataaaacccatctttaaaacccttttaaaattcatttttagcctttttctttaatttttacctttttttttgcttggtgttaactctagatgttaaagccatggatatagctcttgcaagcaccgcaccaaaatcgccagaggctgagcccgagcctgagccagtgagtgaaacaccaactcggatccaacccaccaagcctgtatctttcaccaacggtgttctcaagcgtcacaagcctcaccaccaccaccaccactaccaagcgccacccatcgtcataacctacaaagaatgtctgaagaaccatgcagccagcttaggcggccatgctttagacggttgcggtgaattcatgccgtcgccaacagccaccccaactgacccaacttccctcaaatgtgctgcttgtgggtgccaccgcaacttccaccgccgcgaaccggatgacccaccacccacaacagctaccccaacaatagaataccagcctcaccaccgccaccatccgccaccaccagcaacggcaggtcaaccaaatcgtagtcctaactcagcttccccacctccgatctcatcatcttactacccttcagctccccacatgcttttagctctttcaggaggtcttacaagctcccatttaccagctggtgggctgacaccaaacactgctaatcttggttccaactcaaagaaaagattcagaactaagttcactcagtaccagaaggataagatgctggagtttgccgagaaaattgggtggaaaatccagaaaagagatgagagatattcaagaattctgccgtgaagttggggttgatagagggg

SEQ ID NO: 16035 - DNA, 948 bp, Gossypium hirsutum
  Predicted polypeptide sequence is orthologous to G2989, G2990
cctagatgttagagccatggaaatagcccctacaagcacccctccactaagcaccacaacacccaaatcacccgacccagagaccgaaacaccagttcggatccatcctgccaagcccaaatcttttactaacggtgttctcaagcgccaccaacctcaccaccactacctccaccatgcgccgcccatagtagtgagctacaaggaatgcctcaagaaccatgcagccactttgggtggacatgctttagacggctgtggtgaattcatgccttccccatcagccaccccatccgacccaacttccctcaagtgtgcagcttgtggttgccaccgcaacttccaccgccgagaatcagatgacccaccacccacaacaacagccaccgctactatagaatatcagcctcaccaccgtcaccatccaccgcctccagcaagtcaagcaccacatcgtagtccaaactcagcttccccaccaccgatctcatcatcttactacccttcagctcctcacatgcttgtagccctttcaggtggtttagctggtgcattagacaacaaccaccatcaaaataactctcatttacaaggcttaggaacccttaccccaaacaccacaaatctgggttcccactcaaagaaaagattcagaacaaagttcactcagtttcagaaagataagatgttggaattcgctgagaaagttgggtggaagattcagaaaagagatgaacaagctatccaagagttttgcagtgaagttggggttgatagaggggttttaaaagtttggatgcataacaataagaacacttttgggaagaaagatcaagccattaatgaaggagaaactgggaataacaacaatactgagaatggactcagccatgaagaccaccatcaccacacaacaacaatggtcagaatctcaaccatcactttgaa

SEQ ID NO: 16036 - DNA, 794 bp, Gossypium hirsutum
  Predicted polypeptide sequence is orthologous to G2997
gtgtttgttcgcttactttgcttcaacaaaatggaaagcacatgaaaggctttcgagtaagacacccttttgcagcctcgcctttgtgggtttccttctgcatcaacaaaaacaagggcagggggggaaagggaaaaagaaagtggccactgggcagtgaaatatatatttttttatagaaaaagaaatggattttgaggaacatgatgaccaagacgaagaaatgggtatggctgttccagcaggatacgactcactcggcaactcgtcagctccacggtctaaaataggacccgcagcaagtggcggtgaaggtgcggcggcttctgcaccaccgagaaaagtggggtcaggtataaggtaccgcgagtgtcaaaaaaaccatgccgtgagtatcggaggccacgcgttggatggctgtggggagttcatggcggcaggtgatgaagggacacttgacgccttgaaatgcgctgcttgtaactgccacaggaactttcaccgtaaagaaactgacggtgaaggtagtagtatctacaaccctcaccatcatcatcaccactaccagcaacacccccaattctcgccctactatagggcgccgccaccggccgggtacctccacctgactccacagcagaggcctttggccttgccagcagcgtcgggaggtggtattgccggcggttacagcagagaagacgaagatgtttcgaatcctagtagcagtgccggtggaggtggcggcagtgggggattaaagaagaggtttagaaccaaatttacaccggaac

SEQ ID NO: 16037 - DNA, 868 bp, Gossypium hirsutum
  Predicted polypeptide sequence is orthologous to G2997
gtgaagagttggaatgcattttcaagtccgctctgcagactgtagccaataatggccaaaccccaaacccaatccctgctatcatcactgtagccacactcttgttcgcttcacgggaggggaaaatggagtttgaggatcaagaagaacaggaagaagaaatgggtttgacaccgagttatgactcgctgggaaactcgtctagactcaaaatgtcaggtgttgaacctggttcagtaactccaacgggtcagcagcagcagcagcagcagaggaagcctaggtatagggagtgtttgaagaaccatgcggtggggatcggcggtcacgctctcgacggttgcggtgagttcatgccggctggaactgaaggcaccctcgacgctctcaaatgcgcggcttgtaactgccaccgtaacttccaccgcaaggaatctgagcttggctccccaaactccgtccacaccacggacctctacttccatcaccaccaccaccaccagccaccgcaatttgcgccttactttagagcaccaacagggtacctccacgttgccggacaacaaaggccattagctttaccatcaacctcaggaggaggaggacacagcagagaagatcaagaggatgcttcgaatcaaggaagctcaaggaagagatttagaacaaagtttacgcaggaacaaaaggagaagatgctgagtttagctgagagactagggtggcggattcagaaacatgatgaagagattgttcaacagttctgcaacgaaactggggtcaaaaggatgttttgaaagtttggatgcataaaacaagcacactcttggtaagaaccctagaacagattatgaggaactttagatgt

SEQ ID NO: 16038 - DNA, 986 bp, Gossypium hirsutum
  Predicted polypeptide sequence is orthologous to G2998, G2999
tggattttggctggataatgctaaatatcgggaggaatataggggaaagggaaaacaataagatatctaacctagataagcttcttgcatcatcatcatcatcaccgtcatctcttttgataacgtttcaaagttttccgagttaggtgaatagttgaatagtgagcttcattttaggctctttattttgtgtttagtcgataattagttgttaaactatggaagttagaggtgaagaacatgatattaaaacgccagtgcgagatggggatcataatggtgctgcggttctcacttgcactcaaaccctagaccaagttcatcgtccccaaaggcaacagtcacttggccatgttggaagatctccgaacccggatcgaatcgccggcgccagtgttgcacccatttcagtcagttctaacacgaagccattggcgggtgtcgttaggtatcgagagtgtctgaagaaccacgctgccagcatcggcggaaacgtttacgatgggtgcggtgagttcatgcctagtggagaagaaggaacactggaagcgttgaaatgtgcagcctgtgactgccaccgcaacttccaccgcaaagaggttgatggagagacccaacaattcgggggtaggagaagcttgatgcttaaccctcttcagttgcctccaccattgccctctccaaccatgctgcaccaccaccaccatcaccatcaaaagtatacaagtccacccagtgcaatggttacaccaatgaatgtagcgtttgttggcggtggcaccgagtcttcaagcgaggatcttaacatgtatcagtctaatccggagggaatggcggcagcagcacccccatatgttttgtcaaagaagagatttagaacgaaatttacgcaggaacagaaggataagatgttggaattagcggagaaattgggggtggagaatcaataaacaagatgaagatgaagtcgaaaagttttgcgctga

SEQ ID NO: 16039 - DNA, 931 bp, Gossypium hirsutum
  Predicted polypeptide sequence is orthologous to G2998, G2999
accaacctgtctcttgttgggatatatatctgtagttggcttattgggagcacaaacccaaacactgtatccttaaccctaaactccaacccccaaccccaaattcctttccctcgtttctctttgcttctcccttgctaattacagatgtttacaccctgcttagatggtgtggtaaaggcgtaaaagcggtggcctgactctgccgtttcctcatctctttcttaaaactctcgttgaaatttggggtatgggtcgagggattttggcaccataatgctgaatacatgaatatctgaggaggaggaggaggaagagataagggaaaccaaccatatatcctagataagctacgtacttgcatcttctcttttatgaaatgcttcaagttgcacacaaaagcacgggaaaacaaatctattatgagttgaactttgagcttgtttagcttggataaaatatcataaaaaagtttgcttctcttttttgtttttcaaccaactactccttaaattatggaagtgagaggccaagaacatgatattaaaacgccagggtcttcagcctttggtcttcactcgcctggagtagagagaagaaaagatgggaaccataatggtacggccgttctcacgtgcactcaaaccctagatcatgttcatcatctccagaggcagcaatcactcggtcaagggagatccccacatccggatcgagtcgctgccgccactggtgctgcagctgttgcacccatttcagtagttcaaacgcaaagccgtccagcttcgtcagataccgagagtgtctcaagaaccatgccgccagcatcggcagaatgtgtacgatggctgcggcgagttcatgcctagtggtgagatgacactcgagcttgaatgtgctgctgtgactgtcatcgcacttcatcgcagag

SEQ ID NO: 16040 - DNA, 514 bp, Gossypium hirsutum
  Predicted polypeptide sequence is orthologous to G2999
ccatctcttaatttgcctggtttcggtgtgaagtcccagggaagctcagccatgccttccattgatgaactggggttgagccatggtcatggtaatgcaagcgtcggtggcttacaaagtcatggggttggcttgaacgatgggaaccaagagcatttgaagacctttagatgggagttatggtaatactgatcataattcacacagagttaacagctgcaaaatgaactactcagcgtcctcatcagctttccaccatgacaagggattggacaccgtttcttcaagaaccgaaggtacccttgattcatggatttgtcctgcagaatagaaatcattgatcactactaaacttaattaatgtgcagaatattgtcagcactagaagggttatttttctcttctttttctcttttgttcatttcagaaataattaattcacattatatatatgcttaattccgtcagtatacttatattatcctcctctgtcgggattaacacacttgtaaaa

SEQ ID NO: 16041 - DNA, 934 bp, Gossypium hirsutum
  Predicted polypeptide sequence is orthologous to G3055
agattatcgtgtttggaacaaccaagaaacctccaccgacacccttctgtccaattccgaccaggcaccgaacaagaaaccaagaaattcccaggatttaaacactaggtccagagccataggcaagatgttcttcaagaccaagctttgttgcaagttcaaagccgggacttgtccttacatttcgaattgcaacttcgctcacagcacagaagagctccgccatccacctcctaactggcaagaaatcgtggccgcacacgaagaagagaaagggatcctgtcggagccgagggaagaatttcaaatcccatctttagggtctaccagtttctcaggagaaacacagaggtcatataaaggaaggcattgcaagaagttctattcggaggaagggtgtccttacggtgataattgcacctttttgcacgacgagcagtccaagaatagagagagtgtagctataagtttgggtcccggagggtacggtggtggtggcgccggcggaggaggaaatggtagtggtggtgggaatggatcaaatgcaaagccgtctaattggaagacaaggatttgtaataagtgggaacttactggttattgcccttttggaaataaatgccattttgctcatggagctgcagaactacaccgatacagagggggccttggtgatgcagaaactaaggatactaatgctaccctgcccgactcgaagcaaggcggaggaatgcctttgagaactccttcagaccccgcggcggcgtcagttccccaacttccggtttcagacgtttaccactcacaaaggacatcgattgtactccaaaggccggggcaaagaactcttcagaaatggaaaggtccagataaaatcagtctaatatatggtgactggatcgatgatattcaataaactcatttctttcgagta

SEQ ID NO: 16042 - DNA, 548 bp, Gossypium hirsutum
  misc_feature (47)..(47): n is a, c, g, or t
  Predicted polypeptide sequence is orthologous to G3067
ccacgcgtccgatggattctctgccaagaaagagctcaaggaaggancttggtgtttttacaacttccacaagtggacgagctttcgagtccattcaaattctcgaagacgatccatctataaggaaagctttaatagtttgcagggtaatagctggacgagttcatagacctttggagaatatacaagaaatggcaggccaaaccgggtttgattcgttggccgggaaagtcggtctatattcgaacatcgaagaactttatctgctcaatcctagagctctacttccttgttttgtggtaatctgcaaaccttagaagacacaagttgtgactttatgaaagttatgtgaatccctttttccttggtagagtttttcttttttggaaagaattctcattcttcttgcaatattcttgttaattgctgatatgttctggtttttcatgcaattatattgcttcttttgtgtttaggaactgtattgtagatgaaagatgtgtggaaaaatttatatttcatcaaccatgattggatatttcaagctt

SEQ ID NO: 16043 - DNA, 956 bp, Gossypium hirsutum
  Predicted polypeptide sequence is orthologous to G3074
aaaaggaaaaagctatattcggatctgcgataggtggaaggtggtgttttttgttagatttttttttcatgtttgaaaggattaggtcaacaatgatttccttctgaaggttttttttttctttgaaagggaaaagatcttgttttggtttactttttttttagtattttaataatttaatgatccaaatctgccaaccaaaccatgaggaagaagcttgatacccgtttcccagctgctcgcattaaaaagattatgcaagccgatgaagatgttgggaagattgcgttagcagtgcctgttttagtttctaaagcattggaattgtttctacaagacctttgtgatcgtacatataagattacccttcagagaggagcaaagaccatgaattcattacatttaaagcattgtgtacagagctataatgtatttgattttctgagggaaattgttagccgggttcctgattatggtcatggtcatggtcatggtcattccgatgctgttgctgctgctgctgatgacgatcgaagtatttcaaggagaaggaaagccgctggagatgaagtccatgacagtgatgaagaatcaaagaggagcagaatatgacaaagaggtatctggtgaacttcaatttattatgccaaagccaaactatgttacttggactcgggtatgagtgtcggatacggacatatatctgacacggcatgatgtgggtcatgtagggaccattggtagagggagaggccggggacgaggtaggggacgtggaaagaggaggtcgaaatgtggaaagagatgctcatcgtgaaatagaaccagaaccctgtgcaactcttcagcaaaacagcaaaagtcatccaacccctggaatgctggtagatgatgggttctgagtccaaggaaccgataaaagagaacacaattgctgaagatgccaccaagctgtt

SEQ ID NO: 16044 - DNA, 861 bp, Gossypium hirsutum
  Predicted polypeptide sequence is orthologous to G3074
cccaaatcatgaggaagaagctcgatacccgtttcccagctgctcgcattaaaaagattatgcaagcagatgaagatgtcgggaagattgcattagcggtgcccgttttagtttcaaaagcattggaattgtttctacaagacctttgtgatcatacgtatgagattactcttcagaggggagcaaagaccatgaattcattgcatttaaagcattgtgtacagagctacaacgtattcgattttctgagggacattgttagtcgggttcctgactatggtcatggccattctgatgctactgctgctgctgctggtactgatgatcgaactatttcgcggagaaggaaagctactggagatgaggtcaatgacagtgatgaagaatcaaagagaagcagaatgcatgatatgggtcatgcaggcaccagtggcagagggagaggccggggacgaggcaggggtcgtggaagaggagctcgaaatgtggaaagagatgctcatcgtgaaatagaaccagaaccctgctcaactcttcagcaaaacaacaaaagtcattcaacctcaggaatggtgatagatgatggttccgagttgaaggaaccggtgaaagagaacacagctgctgaagatgccaatcaagctgttcggaattttgatctgaatgccgaggtagatgagaatgtggatacaaaagcctcagcaactgctgctaaagttgctgcacctgcacccccagtcggtgttgctagtggcgctgctgcaccagcagcgccagctgcagcagctcagccttctacagcagagcctacacagaggccaacatgaagaataccaggctggtctctttcggatatggaca

SEQ ID NO: 16045 - DNA, 810 bp, Gossypium hirsutum
  Predicted polypeptide sequence is orthologous to G3091
gcggccgcctcgacattttctctctctaaaatctcacttcaaaaaaagtctgttttttttaactaagttcaaactggctatcgaaaatcaagaatccactgttcgtgaaatcaagcccaagaacagaagaatcatgggaggtggtggacctgatgaagaagacaacaataacgacaagtggccgccatggttgaaacctttattgaaagaacagttctttgttcaatgcaagcttcatattgattctcataagagtgaatgcaatatgtattgcttggattgtatgaatggttctctttgttctttttgccttgcttatcacagggatcataattacattcagataaggagatcttcgtaccatgatgtaataagggtatctgagatacaaaaatatttggacatatctggtgttcaaacttatgtaataaacagtgctaaggttgtcttcctcaatgaaaggcctcaaccaaggcctggtaaaggtgttatcaatacttgtgaagtctgtgatcgtagccttgttgataactttcggttttgctcccttggttgcaagattgttgggacgtcaaaggattttcaaaagaagaaaaggcaactagcgatggtatcgtcggactctgaggattcatacagtagtagtagccatgggaagccaaggaagaatgacgacaacagcaacaaagttcgtagttttagtccatcgacgccacctccgacttcggttaattaccgaaatgctaaacgtaggaaagggattccccagcgagctccaatggcaggactaatcatacaatattaaagctc

SEQ ID NO: 16046 - DNA, 824 bp, Gossypium hirsutum
  Predicted polypeptide sequence is orthologous to G3091
gcggccgcgtcgactttagattagaactcaaaattcatatataggcaaaagatataaacactcccttggaaaaggagtacaatacatgatattttccctgtctttcacattgctcttagtcttcttgccctaaaaccagaaagaccctatttacaatttagcatttgccaaaaacttatgtctatagtcactcacttagaaaagctggctcattatcattattactatttccacttctatattttgcttctcctatatatatatcatataatatacataatagtagagagaggtatgtatggcgtaacactaatactaacactaacagggtaaatataaaaggatataagccactatcttttatggcatttctttggcttaatattctatgattaatcctcccattggtgctctgtggggaatcccttttcttcgtttggcagttcgagttggaggtggtgttgatggtctaaagctctgcactttgttgttaatcttctcatggcaactgctactgtatgaatcctcagagtctaatgctgccatgttcatacctggctgccttttcttcttgtggaaattctttgatgttccaacaatcttgcagccaagagagcagaaacggaaggaatcgacaaggctgcgatcacagacctcacaagtgttggtaacaccttttcctggcctgggttgtggcctttcattaagaaaaacgatcttagcactgttgattatataagtttggactccagatatgtctaggtatttttgtatctcagatactcttatcacatcatggtatgaagacctccttatctggatat

SEQ ID NO: 16047 - DNA, 744 bp, Gossypium hirsutum
  Predicted polypeptide sequence is orthologous to G3091
gcggccgcgtcgacgtgaaatcaagcccaagaacagaagaatcatgggagctggtgggcctgattaagaagacaacaggtggcctccatggctgaaacctttgttaagagagcatttctttgttcaatgcaagcttcatgctgattctcacaagagcgaatgcaatatgtactgcttagattgcatgaacggcgctctctgttctttctgcttagcttatcacaaggatcatcgttacattcagattaggaggtcttcataccatgatgtgataagggtatctgagatacagaaatacctggacatatctggaatccagacttatgttatcaacagtgctaaggttgttttcatcaatgagaggcctcagccaaggcctggaaaaggtgtcaccaatacctgtgaggtctgtgaccgtatccttgtcgactcatttcgcttctgctctcttggttgcaagattgttggcacatccaagaatttccagaagaagaagagacacttggccatggcctcagattctgaggattcatacagcagcagcagtagccatggaaagcttatgaacaactgcaacaaaatgcgaagctttagtccttcgacaccgcctccaacttcagtgaattcccgaactgcgaaacgaagaaaagggattccccatcgatccccaatgggaggtctaatcatagaatattaaccatagcccatatacaaaagatatatatttaccctactatgttaccc

SEQ ID NO: 16048 - DNA, 889 bp, Gossypium hirsutum
  Predicted polypeptide sequence is orthologous to G3091
atgacagattaggaggtcctcataccatgatgtgataagggtatctgagatacagaaatacctggatatatctggtgttcaaacctatgttattaacagcgctaaggttgtgttcatcaatgagaggcctcagccaaggcctggaaaaggtgtcaccaacacctgtgaggtctgtgaccgtagcctggtcgactccttccgcttctgctctcttggttgcaagattgtgggtacatcaaaggatttccagaagaagaagagacatgtggccgccatggcatcagactctgaagattcatacagcagcagtggccatggaaagctcagtaacaaattgcagagctttcgtccttcaacgccccctccaacttcggttaattatcgaactgcaaaacgaagaaaggggattccccatagagccccaatgggaggactaatcatacaatattaagacataaccatacccatagagctcatcctttttgtcctggagttgaaatatatttatcctaatagtatttgccccacagatacacacaatcatggtgccacaatgccccctaatgtttagagccgccacctctctctagtatcgtgtatataaacatcagcagtagcagcagagaaggatggcaaaaataagggccccaaatgagctttgcttttagtgttttacaagttgaaaattaggttgagagcgttaattttaatgtttagagttttgggatcttatacaataggttggttgatggggaaatcagatgtgtaaatacggggaaagggtagtgcaaaaagaaaggcacttactgtggtgctgaggtatgtttatgttacatatattaatattcggggtggtgttatggaattgaaatcatagtaaggttttagt

SEQ ID NO: 16049 - DNA, 833 bp, Gossypium hirsutum
  Predicted polypeptide sequence is orthologous to G3967
gcggccgcgtcgaccaaattttgttcatcttataaattctagtctaaaattataaaaacagatggcctgcttttctttgtggctgctgatttgaacaccgcatgttttataaaaggtgatgtcagttcataattaagataataaaatccaggactaccatttgctataaaacacttccgtataatcagatgaaatctcatgcagatggtgaccaaaccagcagccataaatagcctcattgtctacattttttgttttttaacttcatttgttccatctgtttggtcactttcatggccttgtgttcttgtcaggcggatagggaattgcagccttggattgccaaagatgacgaccaaggtcagaagatgtggagaatcaaccagcgaattgtaaaattgatagtcgagctgatgagaaatcatgatagcgcagaatcattggtaattgtggcaagtgcttctgatctacttctacgtgccacagatgggatgcttgttgatggggaagcttgtactttaccacaactggagctgctggaagcaacagctagagcagttcagccagtactcgagtggggagaatcaggactggcagtagcagatggactttcaaacctgttaaagtgtcgtctaccagctacgactcgatgcctttctcatccaagtgcacatgttcgagctctcagcacatcagtccttcgcaatattttgcatataggttcaatcaattcaaaatctaaggtggaaataaatggtatctgtggtccctcttaccagttcttcaatataggtgccatcaactggcaaactgatatcgaaaagtgcttaaca

SEQ ID NO: 16050 - DNA, 894 bp, Gossypium hirsutum
  Predicted polypeptide sequence is orthologous to G3967
acgggaaaaagtgtagaaagtttcccattagatgcctcggatttggccaattttcttacaaaggataggcacttaggattccattgcagtgcacaaattcttctaagatccgtgcttgtggagaagcaagagttatgtttctctgttgtttcactattgtggcacaaactgatagcagcccctgaaacacaacccagtgccgaaagcacttctgcccaacagggatggagacaggtggttgatgcattgtgcaatgtcgtatcagcatctccggcaaaagcagcaactgcagttgttcttcaggtccaaattttgttcttcttgagaacatcagctttctttatcgctgctgacttgaactccctatgttttttgtaaaagtctacaatgattcataatctggatggtgtccaaatcagcagccataaattgccttattgtctagctgttttactttagtttctctatttgtttggtcacttttatggccttgttttcttgtcaggcggatagggaattgcagccatggattgccaaaaatgatgatcaaggtcagaagatgtggagaatcaaccagcggattgtaaagttgatagtggaactaatgagaaatcatgatatcccggaatcattggtaattgtagcaagtgcctctgatttgcttctacgtgccactgatggaatgctcgtagatggggaagcttgcactttaccgcaactcgagctgctggaagcacagctagagcagttcagcagtactagagtgggggaatcgggactggctgtcgtggatggactttcaacctgttaaagtgtcgtctgcactacaactcgatgtcttctcatcaagtgcacacgttcgtgctctcagcatatcggtacttcgcatatctg

SEQ ID NO: 16051 - DNA, 843 bp, Gossypium raimondii
  Predicted polypeptide sequence is orthologous to G28, G22, G1006
gataaaaaaacatccccaaacacaaaatttgaacattttgagattagatttttagaggaaaaaaaataggttgactgttttgttttggctatggagatgtattcaagtgcaaacgactccgatttggctatgctggactcaattcggcaatacttactcagcgattcatcggaccttcgactcactgcttccactgattttacctcggctccccccatgttttgcaggagctcaagctttagccgtttgaacccttgtttcactgaaacctggggtgatctcccgctcaaagaagacgattccgaggacatgcttgtttacggactcttacgagatgctctaactgtcggttgggcaccgtccgataactctacgacgaatttaacgccgatcaagccggaaccgcaagaatttttaccgcagacatcgttggaaaaagtggatatggtgacggagaggacggttcctgcggtggtgccggccaaagggaagcattacagaggcgttaggcaaaggccgtgggggaagttcgcagctgagattagggacccggctaaaaatggcgctcgggtttggttaggtacttttgagacggctgaggatgcggctttagcttatgatagagcagcttataggatgcgtggctcaagagctttgttgaattttcctctgagggtgaactctggggagcctgatccagtcagagtaacgtcaaagagatcgtcgccggagccgtcttcgtcttcgtcttctggctccgaaaatgcgtcaccaaaaaggaggagaaaggtggctggctcagctccggcagtggttcacgctgggttagacatgggtgctgga

SEQ ID NO: 16052 - DNA, 897 bp, Gossypium raimondii
  Predicted polypeptide sequence is orthologous to G481, G482, G485, G1364, G2345
cttctagggcttttccctactctttaaatctctccaaaatccccactacgagctaacaataccctcttactcctactatacatatatattcaacttcaactgctctttttcactgtaaaagctctatatcacaataccttattgaactttgagaattgaaggcgatggtggactcagacactgagtcgggaggaggtccaaacaacgcatccaacgcagatctttcttccccgaaagagcaagacaggttcttgccaatcgctaacgttagcaggatcatgaaaaaggctttgcccgccaacgccaagatttccaaggaagctaaagagaccgtccaggaatgcgtgtcggagttcatcagtttcatcaccggggaagcctccgataagtgtcaaaaggagaagcggaagaccatcaacggtgacgatctgctgtgggccatgactaccttaggtttcgaagattacgtcgagcctttgaaggtttacttgcagaggtttagggagatggaaggggagaagaccgccgtagcacgtgataaagacgcgcctcttgctggaggcgtcggtgctgctgctgctgctggttctagtgggatgtatgggatgatggtacaccagcagcatcaaggccatgtgtatggttctggtgggtttcatcagatgggccggggcccaaggtagagtttcttcatcactcacacgtgtatggttgttattaatttgataaaagaaaatctggtttggtttcggttcggcatacttggttgggccggggataaggccttgctaatttattattgggacacgtgcacggttgtgatagcttgtatgtttgaggagaaaggtagtgtctgctttcactttttcacacccttgatttgagggtttagtacta

SEQ ID NO: 16053 - DNA, 863 bp, Gossypium raimondii
  misc_feature (12)..(12): n is a, c, g, or t
  Predicted polypeptide sequence is orthologous to G867, G9, G993, G1930
ctcttttcttcncaccttttgaaagacaaacatttaaaaaccaaccttgttcaactactgcatcctctgcctatatctttttcctgtttgtacaacccaaaagaaagaaaaaaacaaatggatggaggctgcatagccatagatgaaagcacaaccagtgattccatgtccatatccatatcctctcttttacctcccgttaccaaatatcccgactctctctgccgagttggaagtggaaccagcgtgattgtggaatctaaagctgaatctaaaaagcttccttcttccaagtacaaaggcgttgttcctcaacccaatggccgatggggtgctcagatatacgagaaacaccagcgtgtctggcttggaactttcaatgaagaagatgaggccgccaaagcctatgacatagcggctcaaaggtttcggggtcctgatgccgtcactaactttaaacacctccaagaaactgaggaagatggcatcgaaatggccttcctcaatacacattccaaggctgaaatcgttgacatgttgcgtaagcatacttacaatgatgagcttgagcagagtagaacaaggagatgctatggcttcgacgggaatgggaaacgtgtggtaggaaacgaggctgtgtttggctcttttggtgccgaagtgaaagcgcgtgaccagcttttcgaaaaagctgtgaccccaagcgatgtggggaagttgaaccgactagttatacctaagcagcatgcggagaagtacttcccattgcaaagtggaggtgcttcttccaaaggagttcttttgaacttggaagacgtgactggtaaagtttggaggtttaaatattcctactggaatagtag

SEQ ID NO: 16054 - DNA, 760 bp, Gossypium raimondii
  Predicted polypeptide sequence is orthologous to G2
caagatcttcagcttcgttctttaatcctcttctactctatacttacttttttagcttagctgattaactctctcataggcttttccttttttttttttttttttggtctttcagcttttccttggaaaatcactggctttgatggtcattttttaatatttaatttcagcttttatgatagttttttttcttcgtttaaagtagattatgatcatttttttttgagaattttctgctttgaaaatatatagtatcttcgcgatttttagtagctgaaaaagtttgtgaagtgaaaaaaaaatgtgggatcttaacgattctcctgatcgttcaagaggcgaggaatcggaagggtgttcatcgccggtagacggcgaaaaagggaaggggaaacgggttggatccgtttccaattcgagttcttccgccgtggtgatcgaggatggatcagaggaagaagatgcagcagctttaaagaaacgaaacagtaacatgatttttgggttctcggtgcctgtcgagagcggtggaccagctccggtgactcgtcagttttttccacttgaccaagacccagaaatgagggcagttcccaccggaactgcacaagggttccctatggctcactgggtcggagtcaaattccggcaatcggaaccactcgccgttgctaaatccgttgaagctacaaatcccatgaaaaaaagcagaagaggaccaaggtcaagaagctctcaatatagaggtgttactttctat

SEQ ID NO: 16055 - DNA, 630 bp, Gossypium raimondii
  Predicted polypeptide sequence is orthologous to G2
tttaggcttgtttgacaccgagattgcgcttctagggcttatgacagagctgcaattaagtgcaatggcaaagatgctgtcactaactttgatcccagcatatacgacaatgagcttattaattctggtaaaacttcagaaaatgctggagatcacaaccttgacttgagcttggggaattcaaacccaaaccaaaacagtgctaaacctaatgctgataggcaaagtggtacgagttatcagcagcatagtctcccacttgaagcaactgattggcaatgtcggggatttaggtctatgcaggaatctcgtagaattgatgaagctggccatggatatagtgaggaagaaacaatgcagttgttgagccaaactcacattcactctccagctgtctcagttaagtgtaatgaaatgcaaagatatggacagttgaggagacctggaggcaacagtaacatatttcacattgttcctcaacacattaatccatcaccttatcagattcatattccaagaagcagcaatggagggcgaattgggagtgatctttcattatcaactagtgatcaacagtggcaatcaggtcctcaccaccagttgttttggaattctgcagcatcatcagga

SEQ ID NO: 16056 - DNA, 873 bp, Gossypium raimondii
  Predicted polypeptide sequence is orthologous to G4
caatcaccaaaagaaaaatttgcaattaagccataattaattttgccctctaaatttctctaaaaaatctcctaaatcccatactttaaatccaattcgccatgtgtggaggtgcgattatctccgatttcattccgcctgcgcggtcgcgactggtgacggcgaattatttgtggccggatctgaaaaaatccggctctaaaaagcggtcgggtagaaagcactcgaagaagccggcggtcggctttgaagatgacttcgaggctgattttcaggtgtttaaggatgaggattctgatgtcgatgacttcgatgatgatgttgatgatgttttggctgatgttaagtcctttgctttctctgctacagagaaaccctctcctgctgtttctcatggttcaaactccataaaatctgtggaattcaatggtcaagctgagaaatctgcaaaaagaaagaggaagaaccagtatcgcggaattcgccagcgtccatggggtaaatgggctgctgagatccgtgatccaaggaaaggggttagggtgtggcttggaacttttaataccgctgaggaagctgcacgagcttatgatgctgaggcacttagaattcggggtaagaaagcaaaggtgaacttccctgatgagactccacgtacctctccaaagaatgctgctaaaatgaattcccagaaacctctttctgggtcaaatttgagttctgttcaatcaagtctcaacccagatttcagttactcaaacaaacatgagcagggctattatgataccatgggtttcatagaagagaagtcactaatggatcagtttgcatatgcagaccctgttagagctgctgtagatgatgggttaaaac

SEQ ID NO: 16057 - DNA, 825 bp, Gossypium raimondii
  misc_feature (796)..(796): n is a, c, g, or t
  Predicted polypeptide sequence is orthologous to G4
ttctaactctgtaaaatctgtggaattcacacctcaagctgagaagtctgcaaaaagaaagaggaagagccaatatcgaggaattcgacagcgtccatggggtaaatgggctgctgagatccgagacccgaggaaaggggttagggtctggctaggaactttcaatactgctgaagaagctgcaagagcttatgattctgaggcacgaagaattcggggtaagaaagcaaaggtgaacttccctgatgagatgccacgcacctctccaaaacgtgtgattaagacaaatgatgagaaaccacttcccatgtcaaatttgagccctgttgaaccaaatatcaaccagaatttcaattgcttgaacaaaccagagcaggtcttttatgataccatgggtttcgttgaagagaaggcaccaatggatccatttgcttatgtggacactgttcctgctgctgttgatgttggattgaaaccctttggccaatctgacaatacccccttgtatttcagctcagaccagggaagtacttccttcgactgttctgacttcggctggggagaacatggtgcaaagactccggaaatatcatctgctcttgaagctactatggagggtgatgattttctggtggatgcaaaccctaagaagaagctgaaaccaagctctgagaatgttatgcctattgaggacaattcagcagagagtttgtctgatgagctactggctttgggcgatcagatgaagtacccatttcttgagggcaactgggatgccacccttgatgcgttactncatggagatgcaagtcagtatggtggagc

SEQ ID NO: 16058 - DNA, 795 bp, Gossypium raimondii
  Predicted polypeptide sequence is orthologous to G4
gaaacaaatagcagagtttaaaacattcatatgtttttcagtattcaaacataaacaaattcagacacaattacttatacagtcactcaaatttaaaatttagtccaaagtctacaaaaaaacacataaaaaaggggtacatactaaaaacctctgaaagcagtgcaggcaaggcttaagcatgcatatagcttggtttttacttcaacttcacaacagattttgaccaaattctaacatgttgctttatttacaaacactagttattatggaaagttcgctcagaaaacaccctcctccatggtagggaaatcatcaaagttccaaagatccatcgggtttccaccatcctgtgttgcatctccattgaggaaagcatcaatagtggcgtcccagtttccttcaataaatggcggcatttggaagtatttcatctggttgtccaaagccaacagctcgtccgacaaggtcttcgcggagttgtcttcggcaggcataacattgtcggaacttggtttcagcttcttgctagggttagcatcctcaagaaactcatcaccctctacagaagcttcaagaatggatgatatttcaggagttttggcaccctgttctccccagccatagtcggaacaattgatggagttacttccctggtctgaattgaagtacaagggggcattatctgattgattaaatccagcatctatagacataggaacagggtccacgtatgcaaactgattgaccgatggcttctcttctacgaaacccatggtatcaaagtattcctgc

SEQ ID NO: 16059 - DNA, 884 bp, Gossypium raimondii
  Predicted polypeptide sequence is orthologous to G8
ctttgttcttatgttgatgtgcagacgaattgtatctgagtaaggaagaattcgtgcacgttcttcgtcggcagagtgctgtgttttcgagggaagctcgaaatatctaggagtaacgttgcacaaatgcggcaggtgggaagcacggatggggcggttcctaggcaaaaggtgagatacttgttcctaggcaaaaggtgagatacttgtttaaggaaatttaaatttttgcagtcaacatgctgtcatttaggagtatggatgtaaaatgatttgagtgcctcttggtgttgaactgagaatcggtttttcttgaacggattctcagtgggattgttgtttggttttttctccttggatgggaaaaagaaaaaaaaaaatttctaagatgcctatttcaaagaggaaaaataattggggatggtgtttcatggtggggattacgatgcttgcgtgcaggtatatttatcttgggctattcgacagtaaagtagaagcagcaaggtcctagtgatcatgaattactctacctgatactgaatttattaccctgaattctcaacctcaatagggttccatccaacacttgtctaccttttgattttttctggaaatcagggcttatgacagggcagctatcaaaagtaatggacgggaggcagtcaccaactttgagctgagtacatatgaaggggagatggtctttgataccaggaacaaaggcaatagtcacaaccttgatctgaacctggggatatctccgcctgttagcgatggtcccaaggaaaaggaaaatgcggggcatctccaaatgaataacggagagagttttaagggtaacttttgaatcgattattttgaatttacttgtatgtttcatcaca

SEQ ID NO: 16060 - DNA, 833 bp, Gossypium raimondii
  Predicted polypeptide sequence is orthologous to G15
ctccacagtttatttagggtggttatgacatggaggagaaagctgcaagagcatatgatctagctgcactcaagtattggggaccctccactcacatcaatttcccattggagaattaccaaaaagaacttgaagaaatgaagaacatgacaagacaagagtatgttgctcacttgagaaggaaaagcagtggattttcaaggggagcttcaatgtacagaggagtgacaagacatcatcaacatggaagatggcaggctcggatacgaagagttgcagggaacaaagacctttatcttggaacatttagcactcaagaggaagcagctgaggcttatgacatagcagctatcaagttccgaggggcgaatgcagtgactaactttgacataacaaggtacgatgtggaaagaatcatggctagcaatacccttcttgctggagaattcgctaggcgaaacaaagatgtcggacctggtggtaatgacaaccttttaactggtaacaccaatgctgaaaccaacattaacatatcaccaaagaacaatggaggtcaaccagactggaaaatgatcctttatcagtcatctgaacagcaacagcccaacatcattgagaattttaaggctcaggctttctcattggcaccagaaaccatggttggccacagagaggtggatgattccagcaagatagggactactcacttctccaatgcttcttcattggtgactagtttgagcagctcaagagaaggtagcccagagagaagcagtttacctatggcgtttgcaatgcctcctccaccatcatcctagttgatcactacttca

SEQ ID NO: 16061 - DNA, 879 bp, Gossypium raimondii
  Predicted polypeptide sequence is orthologous to G19
gtagagctttggttctctgtccgctgcttctttcttcccttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttctctcagttcgacaacaccaaggccggttccaaagccaagaaccttgaaaaagtgacaaacgagtcgactcagaagacaagccgggggagagagaaagaagggaagactcagcgaactcgaaagaacatttacagaggaatcaggcaaaggccatgggggaaatgggcggctgagataagagatcctcacaaaggtgtccgagtctggctcggtacatacaacacggctgaagaagcggctcgagcctacgatgaagccgccaagcgcatccgcggggacaaagccaagctcaacttccctcaaactccacgcctaactcagcctcctgctaagaaaaggtgtatgatggctcctgagttgactccaccgagttctgaaaccaagagctcaccaaccccacaaccttttatgggttttggttacgagaatggagtttacaggccgagtgaagcaatggaaagcgagatggagctgaaggagcaaatctcgagtctggagtccttcctgggtttggagcctgatgagatgacaactgagttgagtggaagcgctgagcctgagtcagtgaacctttggatgcttgatgaccttgtgacacatcatcaacaacagcctcagctctttta

SEQ ID NO: 16062 - DNA, 904 bp, Gossypium raimondii
  Predicted polypeptide sequence is orthologous to G43, G46, G1419
gccatcttctgaagaaacattagccttggaactcattccagaacatcttcttactgactttgcttccatggattcttttcttgccagtcttcatcatatagtggaagccccacaattctctcaaatccatagccccaatcagatgaaacagtctactctaagccaacgccgtccttctataaacgtcgccattcccgcaccgaaagtgaacgtaagcgacgagcagaggcattacaggggtgttaggagacgaccttggggtaaatttgcagctgaaattagagacccccacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcagcccactctgaattaactaaagcttgtataaaaaggaaaagagaggaggaagaagaagaagggagagtggagagtaaagtagtgaaaagagagaaggaggaaaacgcggtgaaggagacgggaagtgtgacgccgggagtatgtttaacgccgtcaaattggacggggttttgggatagtgaagatatgaagggaatattcagtatccctcccttatctccgttatctccgtttgggtattcagggcttgcggttatgtgaaacgcttttggtgggttttggacgccgttaactaaaatcaggaatggttggctgacgtggctagttcaattatccgaagatagaaatttgttcaatcattagtgtacatactctacattgcggcccaagccttttgttttactataacattctatttcttcttttattttttttttagtgaatgataatttttaagtgattaatgttatttac

SEQ ID NO: 16063 - DNA, 844 bp, Gossypium raimondii
  Predicted polypeptide sequence is orthologous to G43, G46, G1419
ttccccttttttagtctccaacttccatttttcttgtcggtgttgatatcataaataccaaaatggcacgttctgaagaaacatcagcccagttagaacttatcaggcaacatctctttactgattttgcttccatggaaactccaccacccttctatcaactctcaaattccgagtcatctcatgtttatagcccgacccggttaaaacaatcgagtctcagccaacgtcgtccttctattaacgttatgatcccacccacaagttttaacataggcccaaacccggttccagattcggctgcggtggcggttgaatcatacgagaaaagtcattatagaggtgtcagaagacgaccatgggggaagtttgcggctgaaattagagaccctaacaagaaaggggcaagggtttggcttggaacatttgacaccgccatagaagcggcaaaagcatatgatagagctgcctttaagctacgcggtagcaaagctatactgaattttcctcatgaagctggaaaatcaaatttctcagagtcagggaaaaggaggagaaatgaagaggaaggagaaggagaaaagagagtgagcctgttggagtccaaagcagggagaagagaggaggaggtaacggtggcagaatgtggaacgccgtcgaatcagacggggatcggggataatgaagatataaatgaaatattcggcggcccactcttatcacccttatcatcgtttccatggttcgggtattccaggcttgaggttatgtaaaagcttagcaaggaatgtggctgtgtttactttttaagtgtttagtaatgagtaaggatgggatgcctaaa

SEQ ID NO: 16064 - DNA, 829 bp, Gossypium raimondii
  Predicted polypeptide sequence is orthologous to G129, G136, G140, G146
gagaagtaaataaaaaaacccttctctttctttttccgcctttaattatcatacttgcctttttcttttcttttcctttcaagttaggaagcatggtgtaccccaatgaatcccttgaagactttccccagaagaaaatggggagaggaaagatcgagatcaagcggatcgaaaacacgacgaaccgccaagttaccttttgtaagaggcgcaatggtttgctcaaaaaggcttatgagctatcagttctttgtgatgctgaggttgctttgattgtcttctccaaccgtggtcgactctatgagtatgccaacaatagtgttaaagcaacaattgaaaggtacaaaaaggcttctgattcctccaacactgggtcagttgctgaagttaatgctcagttctatcagcaagaagctgacaaactccgaaatcaaatccggaatttgcagaatataaacaggcacatgctgggggagtccgtagggggattgcctatgaaagagcttaagagcttggagagtcgtttagaaaaaggaattaacagaatccgttccaaaaagaatgagctgttgtttgctgaaatagagtatatgcagaaaaaggaaattgacttgcataacaataaccaacttcttcgagccaagatagctgaaaacgagaggaagcagcagagcatgaatttgatgcccggaggttcaagtaataacttcgaggacatacattctcagccatatgactctcggaactacttccaagttgatgccttacaacccgccgccaattattacaaccctcagcagcagcaagaccagatagttcttcaactagt

SEQ ID NO: 16065 - DNA, 689 bp, Gossypium raimondii
  Predicted polypeptide sequence is orthologous to G133
ggaagatccagatcaagctgatagagacacttaacgaacaggcaagtcacgtattcgaagagaagaaacggtcttttcaagaaagctaatgaacttacagttctttgcgatgctagagtttcgatcatcatgttttccactactggtaaactccatgagtttatcagcccttccaccacaacgaagcaagtaattgatcagtaccagaaaaccttggggatcgatatctggaacacccactatgagaaaatgcaagagcagttgaagcagctgaaagaggttaacaggaacctgcgcaaagagattaggagaaggatgggcgactgtttgaatgatttgagcatcgaagatcttggtgctttggaacaagaaatggagagctctgtcactcttattcgtgatagaaagtatcgtgttctctccaaccagatcgatacttccaggaaaaaggtgaggaatgtggaagagatacacaaaaatctcttacatgaactggaatccctgaaagaagatccatatggattagttgataatggaggcgattatgataccctgatcgggtatcaaaatggaggtcctcgtatatttgctttacgcctgcagccaaaccatcctagccttcacagtggcggaggctccgatctcaccacctatcccttgcttgattaaatatctatctcgccatgatt

SEQ ID NO: 16066 - DNA, 901 bp, Gossypium raimondii
  Predicted polypeptide sequence is orthologous to G137, G145
caaaaaaaaaaaaaaaaacaggtgaaatccctttttcttttggtctcaaaacaattcaaaagggaaagattgttggttttagggtttgggttctcattgatttttagtgaaaaaattataaaaaaaaaattatgggaagaggtagggttgaacttaagaggattgaaaacaagatcaacaggcaagtcacttttgcaaagagaagaaatggtcttttgaagaaagcttatgagctttctgttctttgtgatgctgaagttgctctcatcatcttctccaatagaggaaagttgtacgaattttgcagcagctcaagcatgatcaaaacattggagaggtaccaaaaatgcaactatggagctcctgagccaaacgtgtcatctagggaggctgctttggaattaagcagtcgacaggaatatttgaagcttaaagcacgttacgatgccttacaaaggtcccaaaggaatttactaggagaagatttgggacctttgagcagcaaagagctcgagtcacttgagaaacaacttgattcatcattgaagctaatcagatcaacacggacccaatacatgcttgatcagctcaatgatctccaaagaaaggaacatcttcttaatgaagccaataagaccctaaaacaaaggttggtggaagggtaccaagtaaactcgttacaattgaatccaaatgcaacggaagacgtcggctatggccgtcaacaggttcatcatcagcctcatggcgatgccttcttccatccactggactgtgagccaactttacaaatcggatatcagcatgatccaatgtcagtggtgactgcagggcccagtgtgaataattatatgacaggttggttaccatagcatatatatctctatatatctatataaag

SEQ ID NO: 16067 - DNA, 829 bp, Gossypium raimondii
  Predicted polypeptide sequence is orthologous to G184, G186, G916
cgcctttacagattttggatctaagccgttcctcggctgccggagcagaagcggcggagacgatatctcattcgtcgtcggaagaaaggacacgttctgggacacctccaagtaacgtggagaagagggtgaatagagaagaaagcccggaatctgagagttggggaccaaattgtaaagttcaaaaactgagttctgggaaacctgttgatcaatccactgaagcaaccatgaggaaagctcgtgtttcagttcgagctcgatcggaagctccaatgattactgatggatgtcaatggagaaaatatggtcaaaaaatggcgaaaggaaacccatgtcctcgagcttattaccggtgcaccatggccgtcggttgtccggtccggaaacaagttcaacgttgtgcggatgatagaacaatattgataacaacttacgagggcaaccacaaccacccacttccaccggctgccatggcaatggcatcgacaacggcagcagctgctagcatgttgctgtccggttccatgccgagtgccgatggaatcatgaaccctaacttactagccagggcaatccttccttgctcctcaagtatggctactatttcagcttctgccccattcccaaccgtgacattggaccttacacactcgccgaaccctctgcaattccaacggccaccacccccgccgacacagttccaagtcccatttcccggccaaccggcgccggtgtccgcccctcaattacctcaggtttttggccagccattgtacaataataatcagtccaaattctcaggcttgcagttatctcaagaaatggg

SEQ ID NO: 16068 - DNA, 854 bp, Gossypium raimondii
  Predicted polypeptide sequence is orthologous to G207, G227, G230, G242
ctattgcatgcctttaaatttgatttcactgtatgtaacaagcacaccggatagaaaagaaatggatcggatcaaaggtccatggagccccgaagaagatgagttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcgtcttctcacgtgtacaagccgatcccaaggaccggcggtgttaacgttgatgtaaatgttacgccagctggagtggaagcggcatcatcttccaacgatccaccgacctcactgagtctgtctttaccgggggtggagtcatgcgaggtggtgtcaacccagccaataaccgagtcaactcagaatcggagtgaagaaaggggaggtggggtgatggggttcagtgtggagtttatggcggtgatgcaagagatgataagggttgaggtgaggaattacatgacccagatgcagcaacagcagcagc

SEQ ID NO: 16069 - DNA, 814 bp, Gossypium raimondii
  misc_feature (774)..(774): n is a, c, g, or t
  Predicted polypeptide sequence is orthologous to G274
cgggatatgcgattggttactatttttaaaaaatggcattgaaaccgaattcaccggatggtagaacaaggagttggcttcagatatttatcgtttttggattatgttgttttttctacatattaggagcatggcaacgaagtggtttcggcaaaggggatagcatagctttagagataaccaaacacggcgccgattgtaacatcatcccgtcgttgaacttcgaaacccatcacgccggcgaagtggggaacgtcggtgaatctgaaaagatcaagtcttttcagccctgccctcctcgttacgttgattacacgccttgccaagatcaaaagcgtgccatgactttccccagggacaacatgatctatcgggagaggcattgtcccagggaggaagagaagttgcattgtcttgtcccggcacctacaggatacgtgaccccgtttccttggcctaagagtagggactatgtgccttatgctaatgctccctataaggccttgacggtagagaaggctattcagaactggatccaatatgagggtaatgtattcaggttccctggtggaggaacgcagttcccacaaggcgcggataagtatattgatcagcttgctgctgtgatcccgattacgaacgggactgtaaggactgcacttgataccggttgtggggttgcgagttggggggcatacttgtggagtagaaacgtccttaccatgtcgtttgcaccaagagattcacatgaagcacaggttcagtttgcccttngaagaggtgttcctgctgttattggtgttcttgggaccat

SEQ ID NO: 16070 - DNA, 896 bp, Gossypium raimondii
  Predicted polypeptide sequence is orthologous to G274
gttctttctttcttcctttcttctggcgtactttgggttcccactctaatcatggtatccaagcacaatccatcgggcaacaaaaaacggagcccactatctatatttgctgttattggtttgtgttgtttcttctacattctgggagcatggcagcgaagtggttttggcaaaggagatagcatagcattggaagtaacaaagcaggcagactgcagtatcttcacaaatttgaactttgaaacacatcacaacgatgtagagattgttgagccttccaaaccaaaagctcaggtgtttaagccgtgtgatgtaaaatacactgattacaccccttgccaagagcaagaccgagccatgaagtttcccagggataacatgatttaccgggaaagacactgtccccccgaagaagaaaaactacactgtctcattccagcacccaaagggtatatgacaccatttgaatggccaaagagtcgtgactatgtccattatgctaatgttcctcacaaaagcctaacagttgagaaggctgtccagaactgggtacagttcaaaggaaatgtgttcaaatttccaggaggaggaacaatgttccctcaaggtgcagatgcgtatattgatgagcttgcctctgtcatcccgatagcagacggttctgtcagaacagcattggatactggttgtggagttgcaagttggggtgcctacatgctgaagagaaatgttctggctatgtcttttgcacctcgggacaatcatgaagcacaggttcagtttgcactggagcgaggtgtgcctgctgtaattggtgttcttggatcccattaatctccatatccatcaagagcatttgatatggctcagtgttctcgatgcctaataccatggac

SEQ ID NO: 16071 - DNA, 654 bp, Gossypium raimondii
  Predicted polypeptide sequence is orthologous to G274
gaagaaaaataaacttgtttattggcattcatcactatgctttcttggatcttgacataattatttgggcagctacccaaataatggaaaaaaacactatttcctcccaaaatcacactcaggattacaagctaacataattgggtatattctctacatagtgaataacacaatggagcaacttaagtatctttttgagggttgttgatcggaactcttcagtccctctgtctgaaccaacttcaccatcagttcgagattttaacctttgctttttagttttaccttgaaatacttgacctgttgatgttggtttattcagcactggatggactgtttcctttgataacaccaacccagtactgtttaactgcaactaaaattttctctggcacaaggggaccatcctcgtgatcattcatcttggggtcccatctcatgcctccagcaattttcctaaccttgtttaggacatcgacatcatcccggaatatcacagccccttcaggccgtaaaatgcgatccatttccagaaggatgtcttcaaagctacacttatcttgatacaagctaaagacaccattagcatgaataagggcatatgttcttggatacgtaaagaaaccttcgcaccagtcatgatatattccaatt

SEQ ID NO: 16072 - DNA, 896 bp, Gossypium raimondii
  Predicted polypeptide sequence is orthologous to G275, G837
gggatcaaagatgaacatgaagctcaagtacaatctgtacttgaaaggggaattcctgctgtgtctgctgtgatgggtactaagagacttccctaccctggcagagtatttgatattgttcattgtgcacgatgtagagttccatggcacatagaaggtggtaaactcctcttggagctgaaccgtgtcctgcgacctggtggtttctttctgtggtctgctactccaatttatcaggacaagactgaagatgttgaaatctgggaagctatggttgaactaacaaaatcaatgtgctgggagcttgtaaacaaaactagtaaggatgcagtaaatggggtggctgtagcagcatttaggaagcctacttctaacgactgctacgagcaacggtcaaaacaagagcctccagtctgtcctgagtctgatgatccaaatgcggcatggaatgtgcccctgcaaacttgcatgcacaaagtgccagtagatgcttcagaacgtgggtctcagtggcctgatcgatggccagaaaggttggaaaaagcaccttattggttgagttcccaagttggagtttatggcaaagcagcaccagaggattttgctgcagacaatgagcactggaaacgggtggtaactaagtcatacctaaatgggatgggaataagctggtcatctgtcagaaatgtcatggacatgaatgctgtttatggaggatttgctgctgcactaaaagatttgagtttatgggtcatgaatgtggtcccaattgactctccagatacacttcccataatatatgaaagaggtctatttggcatgtatcatgattggtgtgaatcctttagcacctatccaaggtcttacgatcttctccatgccgaccatctattctc

SEQ ID NO: 16073 - DNA, 831 bp, Gossypium raimondii
  Predicted polypeptide sequence is orthologous to G291
gaaacatgggaactagaaaacaatatacttaccgtcaagacacctgacccttcatcggattctatattctactacgacgaggcggctcaagccaagttccagcaagagaagccttgggccaatgatcctcactacttcaagcgcgttaagatctctgcgctcgctctccttaagatggttgtccacgcccgatctggtggtaccatagaggtgatggggctgatgcaaggcaagaccgacggcgatgctatcattgtcatggacgcctttgctttgcctgttgaaggcactgagactagggttaacgctcaggcggatgcctatgagtatatggtcgattattcccagaccaacaagcaggctgggcgattggaaaatgttgttggatggtaccattcacatcccgggtatggatgctggctgtccggtattgatgtttcaacccaaatgcttaaccagcagttccaggagcccttcctggcggttgtaattgacccaacaaggactgtttccgctggaaaagtcgagattggagctttcaggacataccctgaaggatataagcctcctgatgatcctatctctgaatatcagaccattcctctgaataagattgaagactttggtgtgcactgtaaacagtattatgcattggacatcacttatttcaagtcctcacttgattgtcacctcctggatctgttatggaataagtactgggtaaacaccctttcttcttcacctctcttgggtaatggagattatgttgcaggacaaatttcagatttagctgaaaagctggagcaagcagagaaccaactggctcactct

SEQ ID NO: 16074 - DNA, 863 bp, Gossypium raimondii
  Predicted polypeptide sequence is orthologous to G307, G308, G309
ggtatgcaatgggcgcagctttaatgccagtacttgcattaagacacggtggaccaccggcgtttcgaccgaccggaattggaccgcctcaaccggataatactgatgcgttgcaacaagtggggtggaagctagctcaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccaagattgtcacggttgttgaacaagaagcgaatcacaacggtccggttttcttagaccgttttactgaagctctccattattattctacccttttcgactcgttggaaggttcaggggtggcgccaccgagtcaagacctggctatgtccgagttatacttaggaagacagatttgtaacgtggttgcttgtgaagggatggaccgagttgaacgacacgagccattgactcagtggagaactcggatggaaacggccgggtttagccctgttcatttgggttccaatgcttataaacaagctagtatgttgttggccctcttcgccagcggcgatgggtatagagtggaggagaataatgggtgtttaatgcttgggtggcatacaaggccacttatcgccacctcggcttggcgactcgctggtactgagtcaggtagtgagttaactcaggagctgagttgagaaaaagtaaaaaacctgttgaaaagaataagtggggtctatcttttaactgagttg

SEQ ID NO: 16075 - DNA, 848 bp, Gossypium raimondii
  Predicted polypeptide sequence is orthologous to G386, G707
gatcgtactaagcgccgccacttcggtttcgttgccggtgtcaccgcaacggcttttcgatttcctacgcgacgaacggttgaggagcgagtgggacatattgtcaaatggcggacctatgcaagagatggcacacattgccaaaggccaagatcatggcaattgcgtttccctcctgcgtgccagtgccatgaacgcaaatcagagcagcatgttgatattgcaggaaacatgcatagacgcagcagggtcgcttgtagtgtacgcgccagttgatattccagccatgcacgttgtcatgaacggtggtgattccgcttacgtcgcacttttaccttcgggattcgccattgtcccggacggtcctgggtctcatggacctatctctaacggacatgttaacggaaacaccggcggagggtcgtcgagagtcggtggatcgcttctcacggtagcttttcaaatattggtaaacagtttaccaacggctaaactgaccgtcgaatcggttgaaacggttaataatctgatttcgtgtactgtccaaaagatcaaagctgcccttcaatgcgaaagttgatgactcagtgagttgggtaattttagttattaatataggttttggttgtggttaaagagtgcgactcagtaagttgggacgagtgggggtattgagtcaagaacgaaccgcgcgtggagaattattgtatggtgatgatcaaagggacaagggtggtggttcgggtattgactcaagtcgaccctttgagttggctcgccgggaccagaaaagaaagtcaaaactcaaactgcgtcgtatttggtgtactaatccaatttctctttcc

SEQ ID NO: 16076 - DNA, 899 bp, Gossypium raimondii
  Predicted polypeptide sequence is orthologous to G388
aactgagaacagtaataggaaaataccctccgggtgcatcaacgactggttcatgttcatctgaaaatgaccaagaaaacaggagttcattggatttttacactgggattttcggacttgaaaagtcgagaatcatggagattgtaaaccaagccatggaagagttgcaaaagatggctacggctggtgaaccgctgtgggttcgaagcgttgagacgggtcgggagatacttaactacgatgagtacgtcaaagagttctctgttgaaagttcaagcaatgggaggccaaaaagatccattgaagcctctagagagactggggttgtttttcttgatctcccgaggctggtacaaagcttcatggatgcgaatcaatggaaggaaatgttcccatgcataatctcaaaggctgctactgttgatgtgatttgccatggggaagctccgaataaaaatggtgctgtacagttgatgtttgctgagctgcaaatgctcacacccttggtgcctaccagagaagtgtactttgtccggtactgcaagcaattgagtgctgaacaatgggcaattgtcgacgtttctattgacaaagttgaagaaaatatcgatgcatccttagtgaaatgcagaaaacgtccttcaggttgcatcatccaggataaaaccaatggccattgtaaggtgatttgggtggaacaccttgagtgccagaaaaacactgttcacacgttgttccgtaccattgttcgcagtggactagcatttggtgcaaggcattggatggcaacattgcaacatcagtgtgaaaggctcgttttcttcatggcaaccaatgttcctaccaaggattttcactggtgtgcaacattggctgggaggaagagtattttgaaattg

SEQ ID NO: 16077 - DNA, 690 bp, Gossypium raimondii
  Predicted polypeptide sequence is orthologous to G409
gattggtattttttttttattacttaattcataattattagtacaagaagtaataatacacaaacaacatcctatatttatttatgtatgtatgtaacatatagatgtgtaacttaataagccgaaaaccagaaagcatgatcttcaacatgaaatccataactacaagaacttgcagggggggcggagtaatcattgtcttccaattttgggaaaatgtaaaaagatggttgaaacaaagccttactcaagttatcttcctcatcttgggatgtatcaaactgatctggttcgaatggataaaatgaatgagggctgtctgaatcaacaggcttttgggggggttcttgacacactgggttcacatccgataactctgagttgttcttttctttcataaccaacttatcagtaagctgaagaacctcctgtttaagtttatctttctctttgaggagattaccataatcatctttgagggtattaaagctagcttggaaagtgtcatagtctttttcaagctgcttagtcttccatcgagcacggcggttttgaaaccaaatggcaacttgacggggttgtaacccaagttctttagctagttgagttttcctttcaggttcaagtttgttttcaacctccaaacttttctctagaaactggacttggtcaacagtgagtcgtcttttc

SEQ ID NO: 16078 - DNA, 697 bp, Gossypium raimondii
  Predicted polypeptide sequence is orthologous to G409
ctttttttaaaacccaaacaacatcatatatttatttatggatggatggaacatataaatgggtaacttaataagccgaaaaccaaaaagcatgatcttcaacatgaaatccataactacaaaaacttgcagggggggcggagtaatcattgtcttccaattttgggaaaatgtaaaaaaatggttgaaacaaagccttactcaagttatcttcctcatcttgggatgtatcaaactgatctggttcgaatggataaaatgaatgagggctgtctgaatcaacaggcttttgggggggttcttgacacactgggttcacatccaaaaactctgagttgttcttttctttcataaccaacttatcagtaagctgaaaaaccccctgtttaagtttatctttccctttgaggaaattaccataatcatctttgagggtattaaagctagcttggaaaggggcatagtctttttcaagctgcttagtcttccatcgagcacgggggttttgaaaccaaatggcaacttgacggggttgtaacccaagttctttagctagttgagttttcctttcagggtcaagtttgttttcaacctccaaacttttctctaaaaactggacttggtcaacagggagtcgtcttttcttcccggggtgatgaaaatactcatcaagatcttcctctccattctcttcttc

SEQ ID NO: 16079 - DNA, 865 bp, Gossypium raimondii
  Predicted polypeptide sequence is orthologous to G427
ctccaccgccgcggctcaccaagccccccattagtggctatcgcgctcgtcgtcttcgcttcttcaacgcttccacagcgatgtcatccaagacgtggcggccaccgcagctgcagcagcaggaggtggtggtggggactccatggtcgccgtggaatctggggaattgaagaacagcaacagcgagaccatgaacaagagcgaaggcgtcgtggtgcaaagcggaggagatgcggcggtgaattggcaaaatgcgaggtgcaaggcagagatattagcccaccctttgtacgagcagctactgtcggcgcacgtgtcgtgtcttaggatcgccacgccggtggaccagctcccgaggatcgacgctcagctggatcagtcgcagcacgtggtggccaagtactccgctctcggcggcgcagcccagggcttggttgcggacgacaaagaactcgatcagttcatggagtttcaccgggggaaggtacgggggcaacaatgtcagatgatgatgaagaccaagtggagagtgatgcaaatatgtttgatgcaagtttcgacggtcctgattcaatgggatttggccctctcatcccgacagagactgaaaggtctttgatggagcgtgtgagacgggaactcaaacacgaactcaaacagggttacaaagagaagattgttgacataagggaggaaattttacgtaagagaagggcaggaaagcttccaggggatacgacgtcggttttaaaagcttggtggcaggcacattccaagtggccataccctactgaggaagacaaggcaaggttggttcaagaaacagggttacaattaaaacagataaacaattggtcatcaatca

SEQ ID NO: 16080 - DNA, 885 bp, Gossypium raimondii
  Predicted polypeptide sequence is orthologous to G427
tacaaattcaataccgtgtctttaagctatgattgtaagaaaaaaagggggaaaaaaacaatcttttcaatcgtgtccttggatttcgctgtcctttgttgtaatctccttctctatatcagaccatggaacagtaatcatcatcatatatagctttcgaagacgtttttacaggaagaaaaaagggataaaggtgaagggggtagtcatggcgtttcaccataataatcacctttctgatcatcatcaggaccttcctctccatcaccttaccgagcaccaccaccagcaggcgagtcaactgtcggaaaccaacggtccaaattggttgaacaccgccctcctccgttcacagcagcctcaaccggcgcaaccacactcttcccagttctccgagcctaactttcttaaccttcatactacgagagctgcttctgattccaccacgggttcccaagctccgaaccagtggctctcccgtacgtcgtcttcccttcttcatcgcaaccacagcgacgtcatagacgacgtaggtgccgccgcggaagctgcgagaggaggcggaggggaatccatggtcgccatggaatcgggcggcagcggcaacaacaacggtattatgaacaacaacaagagcgaaggtgttgtggtggaaagcggagggggcggtggggatggggtcgtgaattggcagaatgcaagatacaaggcggacatactagctcaccctttgtgcgagcaactcttgtctgcacacgtggcgtgccttagggtcgctacgcctgtggatcagctcccgaggatcgacgctcagctggctcagtcacagcatgtggtggctaagtactcctccctcagtggtgggtcccagggcgtggttgccga

SEQ ID NO: 16081 - DNA, 921 bp, Gossypium raimondii
  Predicted polypeptide sequence is orthologous to G447
cagcagcagcagcagcagcaatcatctcaacaattactctccccagctggatcactgttgcagcctcaaatgttgcagcagcagccgacccatcaacagagccaaccattgcagcaattgcctctttcacaaagccaatcacaacctcttggcagcaatggcttctcaacatcaatgcctgttcaacctcaacaggtttcagtgaaccaaccccaaattcacaagccatttactgctatgagaactcattctggtcttactgacggagatgctccatcatgttcaacctcaccttctaccaataactgtcaggtttcctcgttgaactttttaaacaaaaatcagcaagttccatccttattggtgtcagatcctcttgttgagcctgcaagtaccctggttcaagagcttcagagcaagcctgatattagaatcaaacatgaactacccacctctaaaggaccagaactatcaaagtacaaaagtactgtgacagatcaattagaagcatcctcttctggaacatcatactgcctggatgcgggcaccaaccagcataatttctccctccccacctttttggaaggtgatcttcaatcacactcccggaacaatcttccttttacagcaaatattgatggattggcacctgacactttgttatcaaggggatatgactctcaaaaggatcttcaaaacatgttgtcgaactatggtggcaacccaagagatattgatgcggagttgtctactcctgcgataagctctcagtcgtttggtgtgccaaacatacctttcaagactgggtgctcaaatgatgttgctatcggtgacacaggagtcctaaatggtggactgtgggccaaccaaactcaacgcatgcgaacatattcaaaggtgcaaaagcgtgggtctgtagga

SEQ ID NO: 16082 - DNA, 858 bp, Gossypium raimondii
  Predicted polypeptide sequence is orthologous to G450, G456
caacgttatcatatattcccccctcctacttcctatttctctagcaaatacactatcaagagagagagaaaagagagacattttgtgacgaaaaaaaaaaaaaaaggaaaaggactaaagttggatggttgtagggttttgcacgtaaaagctcgtgtttaatcatcataatgactagcattatgggcacagaggatgataagtatagcacgattaacttcgaagagacggagttgcgtttagggttgcccggcgccaacggaaacgacggtgaaactaccaaaaacaacggaaaacgagggttctcggagaccgttaatttgaagcttaacctttcatcaaaggagactgtagccgaggattccgagaagatgaaggagaagagctcaactgaccctgcaaagccacctgccaaggcacaagtggtgggatggccaccagtcaggtcattccggaagaacatcatggccgtccaaaaagccagttccgaggaggaaggtggcagcaagaaggccggaaacagtgcagccgccactactaccaccacggctgcggcgtttgttaaggtcagcatggacggtgcaccttatctacgcaaagtggacttgaaactatacaagagttaccaacaactctctgatgccttgagcaaaatgttcagctccttcactattggtaactgtgggtctcatggaatgaaagatttcatgaatgagagcaaattgatagaccttttgaatggttctgagtatgttcctacttatgaagacaaagatggagattggatgcttgttggagatgttccatgggagatgtttgttgattcgtgcaaacgcttacgaattatgaagggatctg

SEQ ID NO: 16083 - DNA, 856 bp, Gossypium raimondii
  Predicted polypeptide sequence is orthologous to G450, G456
ctaaaccttcctatattcctattcctcttcttatcatcactctctcaatcctttgcttattacaacaaaacctttttcttctttatttttcacctttcagttcaaatcatcaaacccagaaagcgtggctacaacaaactgcaaaaaaaaggaaacaattagagaaagaagctatggaagttggcttaaagatgacgatgaaaggaggcggaggagatcatgttggaggttgcgacaaagagaagatggggtttgaagagactgagctgaggctagggttgcctggtggtggtggtggtggtggtgacggtgaagttgtgaggaaaagaggcttctctgaaactgttgatttgaagcttaacctttcctccaagcaagacacctctgggatcgatcccaatgatgagaaagtgaaaggcttgcaccaggagaagaatcttctcctttctgccattgatcctgctaagcctcctgccaaagcgcaagttgtgggatggccaccggtccgatcattccgaaagaacatgttagccgccaccacacagaagagcagcagcgaggagagcggcgagaaggcggcgctggtgaaggtgagcatggacggtgcgccttacctccgtaaggtggacttgaggatgtacacaagttaccaccaactctccgatgctttagccaaaatgttcagttcttttactatcggaaattgtggatctcaaggaattaaggatttcatgaatgagagtaagctgatggatctccttaatggctctgattatgttcctacctatgaggacaaggatggtgactggatgcttgttggtgacgtcccttgggagatgttcgtcgaatcatgcaa

SEQ ID NO: 16084 - DNA, 864 bp, Gossypium raimondii
  misc_feature (744)..(744): n is a, c, g, or t
  Predicted polypeptide sequence is orthologous to G470
ccaacatcatctaattacgagaatcctatccaatcaagagatttaatgccaaaagcttcattgggacaagatcatgagaacggaaaatctagagaaggaagttgcaagctctttggtattcctctcattagtaattctgttgcatcagagcccaccgtctctcctattaatgccacgaacaaggcagcaagtcatgtggaagctgcaccaaaccaagctcgtacatttacgtttgatcaaaagtccgagcagccaaaattctcaccgttggcagagaatctgtctatttttaatgagcaggagaaatcgtttcagccgggtcagcctcatacaagagaggttcaaagcaaatctcctagtgcttcaactaggagttgtacaaaggtcctaatgcaagggagtgctcttggtaggtccgtggaccttactaagttcaacaactacgatgaactgattgctgaattggatcaattatttgaatttggtggtgaattaatggcccctaaaaagaattggcttgtcgtttatactgatgatgagggtgatatgatgcttgttggagatgatccctggcaggaattttgcaccatggttcgcaagatcggtatctacactagggaagaggttcagaagatgaagccggggtcattgaattcaaagggcgaggacaatctggtttctgcggaagggctagatgcaaaagacgtgaaatgtacatcagcatctagtacagagaattgttanagctcggctctaataattccgggtaatataatgggcgtgtataattgcatataagtatcgaaccttgttttaatagggagaagaaactgatcagatgaacatataccatgttattacatg

SEQ ID NO: 16085 - DNA, 894 bp, Gossypium raimondii
  misc_feature (871)..(871): n is a, c, g, or t
  Predicted polypeptide sequence is orthologous to G470
gtgatgtggccaccttcaatagatgatgcgatgattgatgtagctcatggtgaaagaaaatttgggccagagaattggatgccctctaggaggcatgaaccaacttacacagatttgctctcaggttttgggtcgaatgctgatacatcgcgcggatattatccttcctttgttgatcaaacttcagtagctggtaattcggggaaaaaacaattactaggtcaagaagggaagcttggctcttggtccctcttgccatctggtctctcactcaagttgtctgacagtagtacagaccctcctttgcaaggttctgatgtgccttatcaggcgcggggaaatggtagatttagtggttttggtgactaccctatacttgaaggtcataggattgaatgctcacgtggtaattggttgatgcctcccccaaccacttcttgttatgataattcaatccattcaagagatttaatgccgaaaacatcattggctcaagagcataagaatggaaaatctagagaagggaactgcaagctctttggtattcctctcataagtacctctagcgcatcagagcctgcagtctctcatattagtgctttcgccaagcctgtaggacatatgcaagctgcattgcaccagtttcatgcacttgaatctgataaaaggtctgaaaattcaaacgcctcccagatggcagaggatgtttctgcttttaatgagcaggagaaaatagtgaagctgggtcagccccatgcacgggagtttcaaagcaaactgtctactgcttcaactaggagttgtactaaggttctcatgcaggggactgctcttggaaggtctgtggaccttactaagttcaacaactatngatgagtgatcgctgaattggat

SEQ ID NO: 16086 - DNA, 736 bp, Gossypium raimondii
  Predicted polypeptide sequence is orthologous to G477
ggtcatcaaaacatttttaattccagaaatgttgataattttgttcatcaaaacatttttaattcgagaaacataatcaaacaattttttttttcgattacaaaataacttgtaaaagtctaggtgaaacttaaccgaggggggggggggggaatcctgttagcagctgctgaactttctcatcatgcttccatctatgttactccgactatttggacatctcgagaactgtgcagctttcagcaacattgaacttgtcttaatctgtacttaaatgattcggaggcagggctcattttcattggcttcttgcatagattgtctttgatgttccactcgctgaagctgcgatgaaagctgaagcaagttgatcgttggtccatctttgcatgatagtccatcagtgatattgaagttggcagcttcactactatcagatatcagtatagcacccatgttactgccttcggttgaattgatccctgatgaagagatcgtattcaacactctgtcgagcttttccgagacttgagtcatgtgatggttatggtagcctggaataaccagggaacgggccatgggaattcctgatgagtggcttgaagagctgtgtgattgagatgacagaagagagagagcacaaacagaatccgaaatcccagataatccctgaatgctcaatgctgcatcgaaaacattgatgtcttcacttgctgacgaggaggtgccttggaac

SEQ ID NO: 16087 - DNA, 861 bp, Gossypium raimondii
  Predicted polypeptide sequence is orthologous to G478
atattccagagggtccttaaatgaagctcgctcccgtaagtgtagggaattttacgagttgaaccaactccctccctgggaatcccaaatcccccactgcttcttctatgtgtttaagcttgtaagatcatcaatggtaagcaatcatacagacaagaaaaacgacaccgtagcctcgccggaaacaagggggaaaagggtttttctttgaaattttgctgcttccacaccatgttggaatacgaatggggaaacccctcttcaatcatgttatcgggtgaagagaccgcccaagaacccgaccccaatcgtcagcttttccatcactatgccaccaccaccaccaccaccaccacccaccaccaaccttacaacgaaaccctcctttctcatcacaaccccactgttttttctcaccaaaacctcttccataaccctaaccaagctcaacccccccaacaccctgctactcttcattccttgtacgacccgcactcctactctgccacctccgcttactccactgtccacgcttccttgctctcactggacccagtttctgccgtcggagggagcggaggcggttactttctcgttcccaagacggaggaagtttctagacctgttgactttactgccaggattggtctcaacttaggtgggcgtacgtatttttcctccgccgaggatgactttgtaaaccggctttatcgcaggtctagacccggagatctcagctcaaccaattcccccaggtgccaagccgagggttgcaatgccgatcttacccaggctaagcactaccatcgccgccataaagtctgcgagttccattccaaagcttccaccgtcatcgccgct

SEQ ID NO: 16088 - DNA, 865 bp, Gossypium raimondii
  Predicted polypeptide sequence is orthologous to G502, G519
cgcgtagaataccaaagaagtttgtagcaattaacaccgagagcgagtgtgaaaaagctcaaaaactacgtttattaccttcaaggtgaaaagttcaaaaaatgacagcatcggagttacagctgccacctggattccgattccatccaaccgacgaagagcttgtgatgcactatctttgccggaaatgtgcatcgcagtccatcgccgtgccgattatcgctgaaatcgatctttacaaatacgatccttgggaccttccagatttggcgttgtacggagagaaagaatggtattttttctccccgagggataggaaatatccgaacggttcacggcctaaccgggcagctggttctgggtactggaaggcaaccggagctgacaaaccgattgggcagccgaagccggtcgggattaagaaggctttggtgttttacgctgggaaggcacctaaaggagagaaaaccaattggattatgcacgagtatcggttagctgacgtggaccgatcggctcgcaagaagaacagtttaaggttggacgattgggtgctttgccggatttataacaagaaaggcgccatcgagaaacagccaccgcaaggaagcattggcaaaagctctgccgtgacggagatcgaagacaagaagccggatatagcgacacttggcgtggacacgcgccagctgcccccgcctcctacggggctagttaacgattacgtgtactttgacacgtcggagtcggtgccgagactccacacggactcaagctgttcggagcacgtggtgtcaccggagttcacgtgcgaggttcaaagcgagccgcaatggaaggactgggggaagtgccaccaacacca

SEQ ID NO: 16089 - DNA, 636 bp, Gossypium raimondii
  Predicted polypeptide sequence is orthologous to G504, G1425
ttaggctcaatactcttcaactcctccctttaatgagaactgggaatataacattgaaccaaagctgaccagcaaaataatggagagcacagattcgtcgtcggcgtccgcgcacccgcaactcccaccggggttccgattccgcccgaccgacgaagagctggttgttcactacctcaaaaagaaggccgcctctgctcctctgcctgttacaatcatagctgaagttgatctttacaagtttgatccatgggagctgccaagtaaggcaactttcggggagcaagagtggtatttttttagtcctagagacaggaaatatccgaatggagcgaggcctaatagagctgcaacttctggttattggaaagccactgggaccgataagccgattgtaacttcaaatggaaatcaaaaggttggggttaaaaaggctctagtgttctatagaggtaagcctcccaaagggattaaaacgaattggatcatgcatgaatatcgcctcatcgacaacaattccacttccaaacctcaaattgttgatcttcccaacaggaaagcttctttacggcttgatgattgggtcttatgccggatttacaagaagaacaatacccagagacctatggagacaga

SEQ ID NO: 16090 - DNA, 862 bp, Gossypium raimondii
  Predicted polypeptide sequence is orthologous to G504, G1425
gatcaaaccataaaagtcctatgatgctctccttctctggtaaactttcagaattcaaagtaaaatattctccatttcattactgagttatatatacatacatatatatatttgaaggtgtcgcaatggagagcaccgactcgtcgaccggatcacagcagccgaacctcccaccgggattccggttccaccccactgatgaggaactagtggtacactacctcaagaaaaaagctagctccgctcctttgccggttgcaattattgctgaggttgatttgtacaagtttgatccatgggaattgccagcgaaggcaacgtttggtgaacaagaatggtacttttttagtccgagagacaggaagtatccgaatggagcgagaccgaacagggcggctacctcgggttactggaaggcaaccgggacggataagccggtgttgacttcgggagggactcaaaaggttggtgtgaagaaggcactggttttttatggagggaagccccctaaagggatcaaaaccaattggatcatgcatgaatataggcttgctgataataagactaacaacaaaccccctggatgtgacttgggcaacaagaaaaactcactaaggcttgatgattgggtgttatgtcgaatctacaagaaaaacaacgcgaatagacctctggaacatgataaagatgactccatggatgacatgcttggtactgtaccgccttcaatatcaatcggtagccaacataatccaaaattccacttctcaacaaagggaacaagttttggcacattactagaacatcaagaacataatagtttgtttgatggaatgatggggagtgatgggattaacagtgc

SEQ ID NO: 16091 - DNA, 849 bp, Gossypium raimondii
  Predicted polypeptide sequence is orthologous to G536
actccctcccgaaatctcagatctaatattcttttaacctaccatctctttcgctatctgccttttcccttcctctctatctgattcctatcgacaatggccgccgccgccacttcttcaccccgcgaggaaaatgtctacatggcgcaactcgccgagcaagccgaacgctacgaggaaatggttgagttcatggagaaagtctctgcctccgccgacaacgaggagctcaccgtcgaggaaaggaacctcctctccgtcgcttacaagaatgttatcggtgctcgccgtgcttcctggcgcatcatctcctccattgagcagaaagaggagagccgtggtaacgatgaccacgtcgctacgatccgtgattaccgggccaagatcgagtccgagcttacttcgatctgtaacgggatcttgaagctccttgacactaggcttgtcccctcggcttcctctggatattccaaggtcttctatcttaagatgaagggagattaccacaggtacttggccgagttcaagactggagctgaacggaaggaagctgctgagagtactctcactgcctacaaatctgctcaggacattgccaacgccgagttggctcctactcacccgattcgacttggactggcactcaatttctctgttttctactatgagattctcaattctcccgatcgcgcttgcaatctcgccaaacaggcatttgatgaagcgatagctgagttggatactctaggcgaggaatcgtacaaagacagcaccctcatcatgcaactcctccgtgacaatctcactctctggacctccgatatgcaggatgacggggctgatgatatt

SEQ ID NO: 16092 - DNA, 931 bp, Gossypium raimondii
  Predicted polypeptide sequence is orthologous to G536
gatggccactccttccccacgcgaagaaaatgtctacatggccaaactcgccgagcaagccgagcgctacgaggagatggtcaagttcatggagaacgtcgtctccgccgtccccgctcccgacgaactctccgtcgaggaacgtaacctcctctctgtcgcctacaagaacgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaagcttgttccggctgctggaaatggggattccaaggtgttttatctgaaaatgaagggagattaccataggtacttggctgagttcaagactggcgatgacaggaaatctgctgccgagaataccctcactgcctataaatctgctcaggacattgcagtagctgagctagccccaactcatcctatccgtttaggattggctctgaacttttctgtcttctactatgagatcttgaactctcctgatcgtgcttgcagtcttgcgaaacaggcctttgatgaagccattgcagagctggatactcttggagaggattcatacaaggatagcactttgataatgcaacttctccgtgataacctcactttgtggacctcagacatgcaggatgatgggactgatgagatcaaagaagcttccaagcctgaggaagagaaacaaccgtgaagttcccagtctttgtggtagcattttacttctcttcttgtttttgtatggagaagttggttgatcccactctctctttagttacttgcttttagttgatcaggcctggatttatgaaccttggaagtaactgctataaattcc

SEQ ID NO: 16093 - DNA, 878 bp, Gossypium raimondii
  Predicted polypeptide sequence is orthologous to G536
ctcaaatccctctgaaaaatcctctcacattttctttccatcccaacatcccccaaaatcaccatggcctctacttcaccacgtgaggaaaatgtctacaaggcgaaactcgccgagcaagccgagcgctacgaggagatggttaagttcatggaaaccgtcgtttcctccgtcgttgctcccgacgaactcaccgtcgaggaacggaatctcctctccgttgcctacaagaacgtgatcggcgcccgccgtgcttcctggaggattgtttcttccatcgagcagaaagaggaaggacgtggcaacgccgatcacgtctccatcattcgtgagtacagggccaagatcgaggctgagttgtctgagatttgtgccggaattttgaagcttctcgaagagaagctcgttccggctgccgggaacggggattccaaggtcttttatctgaagatgaagggagattaccataggtacttggctgagttcaagactggtgatgaccggaaagccgctgctgagaatacgctctctgcgtataaatctgctcaggacattgcagtttccgagctcgctccaactcatcctattcgtttgggattagctctgaacttttctgtcttctactatgagatcttgaattctccggaccgcgcttgcagtcttgcaaaacaggcttttgacgaagccatctcggagcttgatactctcggagaggattcatacaaagacagcactctgataatgcaacttcttcgtgataaccttactttgtggacctcggatatgcaggaggatggaaccgatgaaatcaaagaagcctccaaacctgaggatgagaaacaacagtaaaatccctaatcttcgagttagtattttac

SEQ ID NO: 16094 - DNA, 783 bp, Gossypium raimondii
  misc_feature (11)..(11): n is a, c, g, or t
  Predicted polypeptide sequence is orthologous to G536
ggaagctcacncaatttctgcaaaaatcgttacgatggtgcctgacaatctaagccgtgaccagtacgtttacttagccaagttagcggaacaagccgaacgctacgaggagatggttcaattcatgcaaaagctcgtcctcggctctactcctgcctccgagctcaccgtcgaggaacggaaccttctctcggtcgcttacaaaaacgtgatcggatctctacgcgccgcgtggaggatcgtttcttccatcgagcagaaagaagaaggtcggaagaacgaggaacatgtggtgctcgtcaaggagtatagatcgaaggttgaatctgagttgtcggatgtttgcgctagtatcttgactttgttggactcgaatctgatcccatctgctgctgcgagtgaatcgaaggttttctatttgaagatgaaaggggattatcatcggtatttagcagagtttaaggttggtgatgagaggaaagctgctgctgaggatactatgctgtcttacaaggctgctcaggatatcgcactgacggatctagcaccaacgcacccgatcaggctgggacttgcgctgaattactcggtgttttactatgagattctgaatcagtccgataaggcttgtagcatggctaaacaggcatttgaggaagccattgctgagcttgacacgctgggagaagagtcttacaaggacagcactctcattatgcaactcctaagggataaccttactctctggacttcggatgttcaggaccagttagacgagccata

SEQ ID NO: 16095 - DNA, 745 bp, Gossypium raimondii
  Predicted polypeptide sequence is orthologous to G536
aagacaacaaaaaattgaacataaggaagtaagtcataaagactataaagtaaccgattcaataatgtttaaacagaagagaacacagaacaacagtctgaaaacatctgataaacaaatcgaaccatgtcataggtaacaaatcctggtactactaccatgagttgaaagcaggtcactctagcagcaagcccctttcctacctcgacaagcccagtcttaaaagaatactctttcatccaattaactctcagcctgaggttcatctgcttttgattgctcacctccttcctctggcagatccgaggtccacaaggggaggttgtccctaaaaagctgcatgataagggtgctatccttgtaagattcttcattaaggctatcaagctcggcaatagcctcatcaaatgcttgtttagccagatgacaagccctctcgggagaatttaatatctcatagtaaaaaactgagaagttcaaagccaggccaagtctaattgggtgagttggaggcaaatctgagcttgcagtggaagtggcagcctcataagccttaagtgactgatcagcagcttctttacgatcatctcctgccttaaattctgccaaataacgaaaataatctcctttcatcttatagtagaaaacagttgattccccggtggaggaagatggaatgaggtgcttgtcaatgactgagagtatgtcattgcatatttttgagagctcatcttcaaccctttgc

SEQ ID NO: 16096 - DNA, 770 bp, Gossypium raimondii
  Predicted polypeptide sequence is orthologous to G558, G578, G629, G1198, G1806
ggagaatccaatccggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagactagctcaaaatcgtgaagctgcaagaaaaagcagattgagaaagaaagcatatgtgcaacaactagagagtagtcgtttaaagttgacacaattggagcaggagcttcagcgggcacggcagcagggtatcttcatatcaagctctggagatcaaagccattcgatgggtggaaacggtgccatggcatttgatgtagaatatgcacgatggttggaagagcaaaaccgacaaattaatgagctgagaacggcagttgaagagcaatgcagctaaggctgatgttttccatttgttgtcaggcatgtggaaaacacctgccgagaggtgtttcttatggcttggtggtttccgttcatctgagcttctaaagcttcttgtaaatcaattggagcctttgaccgagcaacagttggtggggataggtaacttgcagcaatcctcccaacaggctgaagacgcattatcccaagggatggaggcattgcagcaatctctggctgaaacattgtcgactggatctttaagctcttctggatcatctgggaatgtggcgaactacatgggtcaaatggccatggccatgggggagctcgggactcttg

SEQ ID NO: 16097 - DNA, 846 bp, Gossypium raimondii
  Predicted polypeptide sequence is orthologous to G558, G578, G629, G1198, G1806
cgggagaattggggagattccaatatggcagatggcagccctaggactgatacgtcaacagacgacactgaagagaagaatcaaaggtttggaagaggtcaaacaaatgctatcgtggcttccgattctagtgacagatcaaaagataaaacagaccagaagacattgcgtaggctagctcaaaatcgggaggctgcaagaaaaagccggttaaggaagaaggcgtatgtgcaacagctagagagtagccgactgaaactgactcaactcgagcaggaactgcagcgagctcgtcagcagggtatattcatttcaagcacgggagatcaatctcattcgatgagtggaaatggtgccttggcatttgacgttgaatattcacggtggctagaggagcacaataagcatataaatgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatctttggccgagacattggccaatggctcacctgctccctcgggaccatctgggaatgtggcaaattatatgggccaaatggctatggccatggggaagcta

SEQ ID NO: 16098 - DNA, 466 bp, Gossypium raimondii
  Predicted polypeptide sequence is orthologous to G565
cccactctcattagaagaatttaattcaaatgattagtacctttccatgtcaataaggtcagtctatgaacaatccaacacagaagaacttgtaatcatactgttccactgctttcagcggcacaaattgaggggctttcagatttcacaaagggcgagcccctgctactggtatcaagcccttgcaataggccaagaggatcttgttgcatcatgtcggccaaggcatgcgagttggtattcaaggaagatgtcaataagtcagaacccgaaaggagaggaagtgagtggtgggtcggggataggggagaagtataaaggaggagggaaaggaaggcataggtattttttttttcgggcgatggatgctccatagcggagaccattgaagctaataaagccatggctcctgataaacttgctgaattgtggacaattgacccggaatagagctaaaaggatcatt

SEQ ID NO: 16099 - DNA, 881 bp, Gossypium raimondii
  Predicted polypeptide sequence is orthologous to G565
cttggatctcgtgtccgatcccttcgaaccgttatgatccgaagacgacatgctttgtagttacatggaccttgagatgccaggggaatcagcgaagggagtcgaggcggctgctgggtcttggagtcagaacccgaaaggagaggaagtgagtggtgggtcggggataggggagaagtataatggaggagggaaaggaaggcataggtatagcaattcggttgatggatgctccataatggagtccattgaagctaagaaagccatggctcctgataaacttgctgaattgtggacaattgacccaaagagagctaaaaggatcattgcaaatcggcggtcggctacacgctcaaaagagaagaaagccctatatatgtctgaattggagaggaaagtccaaacacttcaaacggaagcaacgactctttctgcacacctaaccctattccagagagatacgacaggcttgactactgagaacgctgagcttaagctccggctacaagcaatggaacaacaggcgcagctatctgatgctctaaatgaagcattaaagaaagaagtagagaggctcaagactgctactggagaaataacgacgccgactgataccttcaatttaggaatgcaccatatatcatacgcccaatcttccttctttcctcctcagaatacacaactgccaccatttcatcctttccattctaacttattgacatcttccttgaataccaactcgcatgccttggccgacatgatgcaacaagatcctcttggcctattgcaagggcttgataccagtagcaggggctcgccctttgtgaaatctgaaagcccctcaatttgtgccgctgaaagcagtggaacagtatgattac

SEQ ID NO: 16100 - DNA, 892 bp, Gossypium raimondii
  misc_feature (879)..(879): n is a, c, g, or t
  Predicted polypeptide sequence is orthologous to G584, G1136
cgtttacttcaggtgtaattttaccttcatctggtgtggtgaaatcaagtgggggtgccggggattcagatcactctgatcttgaagcttccgttgttaaggaggccgatagtagtcgagtcgtagagcctgaaaagaggcctcgaaaacgggggagaaaaccggctaacggaagagaagagcctctaaatcatgttgaagcagagcgtcaaagaagggagaagcttaaccagaagttctacgccctgcgtgcggtggttcctaacgtgtcgaagatggataaagcatcgctcttgggtgatgctatttcatatattaacgagctcaagtcgaagctacaaagtgcagattcggagaaagaggagatgcagagccaattagaggcattgaagaaaaatttgtcaagtaaagctccaccaccacatgatcaagacctcaagatttcaaatcacactggcgataaattgatagatttggagattgaggtgaagattattggatgggatgcaatgattcaaatccaatgcagtaaaaagaaccatccagcagcaaagctaatggctgccttgaaggaattagacctggatgtgcaccacgctagtgtatcagtagtgaaagacttgatgatccaacaagccaatgtgaagatggggagccggtttttcacgcaggagcaattaaaatcagccctaacaaccaaacttggagatgcaagatagagagtattgagcagagcttgattgaaagatcattgttgaaaatggctgcagggttctgggatattttaaggctcctggtagcacgagctctgtaaaataatgttctattttggtcttattagtgtttagtgtagttaataatagtttgagaggtgatgtntatgaatctggag

SEQ ID NO: 16101 - DNA, 811 bp, Gossypium raimondii
  Predicted polypeptide sequence is orthologous to G597
tttttttccctttatagtttaatttcaacatgagcatcatcatcttcatcactatcacccttccactaacgtaactgtaattggcaacaaactcaaactcggcatcttcagtctgaaacacaacacctaaaagactagaacacaagtgctttctctctcgcgtctgacttacacctttaccttacaaatgcatcacactaacaacactcctaagccaagacctatcgggcgtttctagcttagcaaccaagtcccaagttcaacaaaaaaagtaaatcctgtacccttaattctacttcagttacacgatgcttaaattacaaaatggttcccactacaacactggctgacccactacagactacccagttaaaagcatgattttacttccatggaaagtttgacatgccttgtgggttattattgttgttattattgcaggttcccatgctctggttaaccgggctaccaggcccacctgaggattcacttagagtaccatgtgaaggtgagctggtaacccctggagcaacctttggtggggcagataggccttccatctggtatgttgactttgcttcctttcgattgtctgtaataaaactacccacaaccacctgaacaggagatgcagctgttagaaggccagctacaccaccacctaaaacacgaccatctgggccagacaatgacacacttaaccctccagttctgctccgctgaccaccattttctgacagaagaaatgaaccagatagtgacagaatttcaaatcgcccctcataagttacagttccaccagatgttgctg

SEQ ID NO: 16102 - DNA, 710 bp, Gossypium raimondii
  Predicted polypeptide sequence is orthologous to G602
ccattaccaaattattatcatttttctttcccttttcacaaattgtacacctataagctttaattatggcggaggaaacgaagaaggaggttgcggctgaaacgcctgtggctccgacgccggcagtggaagctccaacgccggtagcggaggatcttaaagctgattccaagaaaacaaccgtagctccaccgccagctgaggaaaaatccgatgaatcgaaggctcttgccgtcgttgagaaagcccctgagccagcaccaaagaaaagttcaactggatcacatgatagagatgttgctcttgcggatcttgaaaaagaaaaaaagttgtcattcattaaggcatgggaagatagtgaaaaaaccaaagctgagaacaaggcccagaaaaagctctctgctattgtagcatgggagaacagcaagaaagcagctcttgaagcaaaactcaaaaaaattgaggaacaattggaaaagaagaaagccgagtacgccgagacaatgaagaacaaggtagcttcaattcacaaggaagcagaagaaaagagagcaatggtcgaagccaaacgtggagaagaggttctcaaggccgaagaaatggctgctaaataccgtgcgaccggacaaagtccgaaaaagctccttgggtgtttctgaaaatttctggtccggttttgaaatgaatttcattaaaacttgtttgcttgc

SEQ ID NO: 16103 - DNA, 895 bp, Gossypium raimondii
  misc_feature (890)..(890): n is a, c, g, or t
  Predicted polypeptide sequence is orthologous to G616
tttctcaaactcctcctttactgagttgcttactagtggtattggaaatgttagcaacaataatactagtccttcagcatcagcttcagcttcagcacatcaagaccctagtgcggagtctgatttttaccaaaaggctaatagtactgctaggctctggccagtgactccaatggattactttgcctcggggctacttggaccatcttcttcaagaggtcatcattcttcagggtttcctggaggacaaatccatctagtgaactctttgcaacaaccaatgacaacaccaccattcaccgtgtcaggtgagaaccatcaagagatgcagcatttctcgtttgttccaaaccctgaccatctcatcccggtggcaacaacacaaccggggcaaggggttgactacaacctcaatttcacaatctcttccggccttgctggtttcaatagggggacccttcagtccaattctccttttttgcctcctcacctccagaggttttcttctatagatggatcatcacccttatacattggtacaccaccagtggagaatcatcaccaccatcaattcacggctggattagatggccgcttgcagctctgctatggggatggaaacaggagctcagaccagaaaggaaaaggcaagaactaatcagtttcctttaaaaatggtttccacctggctccatcttttccctggaaagcagagatggagagagctgcagtgggaaagcattgagtgaatgtgcatgcatttgggtgattatttgatatacctttatttctgtgcttctgaaaattgttggtattttctgttttatccttttctgaagtcaaatcattatgtgttttcaacatgtataacaaaacaattcaattcaagntattc

SEQ ID NO: 16104 - DNA, 866 bp, Gossypium raimondii
  Predicted polypeptide sequence is orthologous to G616
gattcagacacacaaggttctaagttctcatgagttggtaatgggagaagtgagtcgagcaggatgggtcagaaaggtagtgacaactactaccctgatgatgaagaaggtagagaggtcatgaaaagggctagtgcaaatggaggtggaggtgatgctctagctgacaccgctgctgctaatcggcttcgaggctggcaccattcttcgagaattattagggtttctcgagcctcgggtgggaaagatcggcacagcaaggtttggacttcaaaagggttgagggataggagggtaaggttatctgtcaccacagctatacagttttatgatctacaagaccggttgggctatgatcagcctagtaaagcaatagagtggctgattaaagcagctgctgatgcaattgcggagcttccttcacttaacacttcatttcctgataccccaaggcaattgagtgatgatggaactgaacaagggtttgactcggctgaagtagagttagatggcgatccgaataattaccaagaaaaccaaagtcagcagcacctttccttgtccaaatcagcttgcagtagcacgtccgagattagcaagaactcgggtttatccctttccaggtctgagaaccgtgtaaaagcccgggaacgggcaaggggaagagtagcaaaagaaaaggggaaagagcaaaagactgacattgcacatcaacaaaatgtgaaccccatttctcacaactcttccttcactgagttactaacctgtggcattggcagtgttagcaacaatcacactagtcctagtcctaccgcttcagctcgtcaaaccccaggcagtggcctgtcactcaaatggattacttt

SEQ ID NO: 16105 - DNA, 755 bp, Gossypium raimondii
  Predicted polypeptide sequence is orthologous to G618, G2057
agggaacagtagcatcaacataaacattgcaaacaaatgtccagtaacataaaaaacacatgacaagttctgcaagaagagaagccatagctgagttttaagagctcagtcaaaaaaatagtcaaagtacaacacaatgaactgatagaaactaatggaaccggggattgaataacctgaaatcaacccagatttcttcttcccacggcataggccattgatttgaagtgaccaaaatcttccctcaaactggtgttgaatcgagcagcatctcctcatttacttcactgtcaacgatcaaactggtcctgttagaggggaaagactatggcttttctccattttattggatcaatggtgagagtcagaggaagcagaggacagcttatttgcgatgctgtcttgatcctcttgtgcgccctggaaccgtgctggaacgcgaaatccagagaatacacctgatgtggtgaattcaatgccagataaagcaggttggtgatggatattttgtgggatttgatgatgatgatgatggtattcgtcggttgttggaattggctggtctatccaagcacgaaccaagggcgtgttactggactgaaggggtcccctctgaaagaaaaactggccgttttggccaaaagctggtgatagtggcggtgctgatagattgccaaagagaaatcctcccattccaccgccaccgccactaccagtatcagcagcagcagcaccattattccaggccaccaatc

SEQ ID NO: 16106 - DNA, 903 bp, Gossypium raimondii
  Predicted polypeptide sequence is orthologous to G618, G2057
gttcgtctctcggctccaccgccatccagttctacgacgtacaggaccgtctcggatacgaccgtcctagcaaagctgtggattggctaataaaaaaagccaaatccgccattgacgagctcgccgagcttcctccatggaacccattggatgcaacgatttcaaccaagaaacccaataaccaagaagacctaaacacatcaacagcaacaaacaatgaatttcacatcgaaaaccttgctgctgggtctggttctcaatgcgttcagcagcacgaaatgggagataacttgaataataattcgggttttcttccagcttctttagtttctgatgagattgctgatactatgaagtctttttttccattgggagcttctagtgagacgccgccgtcttcttcattacaatttcaggattacccgccggacttgttgtcaaggacgagcagccatagtcaagatctgcggctttcgcttcagtcatttccggagccaattcttttgcatcaccatgaacaccatgctgctgctacagctcaggcgcaccatagtgaatctgttctattctctggaaccaccccattagccggtttcgatgggtctaatgctggatgggagcaccaccagcagcagcaaccggtggagattgggaggtttcagagattgtttgcttggaatagcagtggtggtgatgctggtggtggcaatggcggtggatttatctttggcactccatcgcaacagtcattgccactgacttttggccaaaacagccagtttttttctcagaggggaccccttcagtccagtaacacacccttggttcgtgcttggatagaccagccaattgatgaacaccatcatcatcatcaaatcccacaaaacatccatcaacaagctg

SEQ ID NO: 16107 - DNA, 839 bp, Gossypium raimondii
  Predicted polypeptide sequence is orthologous to G618, G2057
cagcattagaacaaactaggttcccatctcagtagtaactctaggaaacagtagcaaacattgattggtaacatgaaaaacatgacaagtccaacaagaaaaagaaaccattgttaagctctaagagctcactcaaatataaatttaagctacaacacaatcaactgatagaaactaaacaaaccggggattgaaaaacctgaaatccacccagatttcttcttcccacggtataggccattgattcaaagttgaccaaaatcttccctcgaactagtctttgattcttggatccatcatagtatagttatcttctcatccagttcacagtcaacaatcaactagtgctgatagaggggaaagactttggccttttctccgatttactcgatcaatggtgagaatcagatgaagcagaggacagcttattggcaatgctgtcgtgctcatcttcttcgccctgaattcgtgctggaacgcgaaacccagagaatacaccaggcgtggtgaatccaatgccagataaagcagtgtgatgatggatgttttctgggatttgatggtggtgatgttgttgatgatgatggtgttggtgttggtcggttgtggaaattggctggtctatccaagcacgaaccaagggcgtgttactggactgaaggggtcccctctgagaaaacaattggctgttttggccaaaagccggcggcagtgactgcggtggaggagtgccaaagataaatcctcctcctacaccgctactggccgcagcaccaccgccaccgctactatcagcagcagcaccgctattattcaggcaaacaatctctggaaccttc

SEQ ID NO: 16108 - DNA, 853 bp, Gossypium raimondii
  Predicted polypeptide sequence is orthologous to G653
ctcctctctctctctctctctctattttgtttgataaatacccagaaaaccctttcagtcttctagctctcaatttctttttcttttttaccttcttatttcatagatccagggtgctcttcttcttagttcacattggcatagataaaggactgtacggtcagatctaagccgtattctagcaatgtcgtttaccggtactcagcagaaatgcaaggcttgtgagaagactgtttatccggtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactgttcaaggagtcggggaatttcaacaagaatttccagtcacgtatgtatttttttttcctctcggtggatggaatcctttatttggtttcttgatagttttcgtgtttcgttggtttttaatttgccttcggttttgttttcggcagctgcaaggtcagctgagaagttaactcctgagctggtaaaatctcccttgcaaacaccggatgtgtttgatgtttcgattaattgggaaaaattcgttatagtgtgtcataatgtttttgctaactcctaatagctcgtgttaatttcagacaagatcacctagcaaagccgccagcatgttttccgggacacaagaaaaatgtgctacttgtggcaaaactgcttatccactcgagaaggtagcttttgagatccattaaatcattagatgagaaatctatatattttctgcaattgccggactccaattttctggttatctatatg

SEQ ID NO: 16109 - DNA, 883 bp, Gossypium raimondii
  Predicted polypeptide sequence is orthologous to G715, G1646
tttttatttttattttggaaaataataatcatataacaaagccagcgcaaaatgcaatggccgctgtaccttatcccatccatatctgacccttaaaaatatccaccgccgccaccaccaccacgatcaccaccgccacatccccatctcccgccatttggtcaccagccaatggacagtaaccagcaaactcaatccaccccatacccacctcagcctcccacatccgccattacccctccttcatccgccacagcaaccgcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactggtttggctccgatggttggggctaccgccagtggggtaccttacttttatccccctatgggtcaacctgctgctggtggtcctggtgggatgatgattggccggcctgccgtcgatcccaccggaggtatttacggtcagccaccttctcaggcttggcagagtgtttggcagacggcgggaactgatgatggctcgtatggaagtggagttaccggtggtcaagggaatcttgacggtcaaggctaacctaaaatca

SEQ ID NO: 16110 - DNA, 843 bp, Gossypium raimondii
  Predicted polypeptide sequence is orthologous to G715, G1646
catctgccgttgattcttcatccaatcgcttgaggacaagcaagcccagtcctcctcttaccctcctcctcctcccactacttctattacgcctcctcctccttcctcctccgccgccatcgccgccactccgcctgctcctttccaccacctcctccagcagcagcagcaacagctccaaatgttctggtcttaccagcgccaagaaatcgagcaagtcaacgacttcaagaaccatcagcttcctcttgctcgcatcaaaaagatcatgaaagccgacgaagatgtccgtatgatctccgctgaagcccctattctcttcgccaaagcctgcgagcttttcattctggagcttaccatccgttcctggcttcacgccgaggagaacaagcgacggacgcttcagaaaaacgacatcgcggcggctattactaggaccgacattttcgatttcttggtggatattgtgcccagggacgagatcaaggatgaggccgttctgggtgggatggtgggtaccaccgccagtggggtgccatatttttatcctcccatgggtcagcctgctggcgctcctgctggacctggcgggatgatgattggaaggcccgccgtcgatacaaccggtggtatttatgctcagcctccttctcaggcttggcagagtgtttggcagacggcgggggctgacgatgggtcgtatgccagtggaggtagcggcggtcaggggaatcttgacggacaaggctaagcaattcattgggtcaatttgggtgctcgatggcatggcaaatggcgtgatgcactggggtattgcactaagaaatttgggttgcttatgat

SEQ ID NO: 16111 - DNA, 680 bp, Gossypium raimondii
  Predicted polypeptide sequence is orthologous to G718
gattggactctgatgctgttggatgtctatgatctggtgacaggttgcttctgttttatatgaagactgtgcttagtgttctatgagttctatctctccgatggattggaatgccaaaacgcctttgcaatgggactgggaaaacttgatgatgttaaatgcaacacccgctgaaattccaaggaagctcagacctgaagagtgggatattgatggagagggaggaatgaactcagggtctttctattcttctggtgctgctggaggtagtggtggttctggctcagatttgggccttgcttctttgtctaaaagttcaaaatcggcatctattaattcttcttctatgggggaggtaaaaatgaccaaatttacttcggaagcctttgaagctatcccagatgatattagcaaccagaacgaagctttcagggctgagctggctggtacttccccaacacttgaggcttcagttggctctggtgagccattgctcagtttaaagcttggtaaacagacatactttgaggatgtttctggaggaagcaatactaagaatttgtcttattcttccacttctggacaatctcctgcccaagcaaagagatctaaacccaattgtcagggcatacatgttccgcgttgccaagttgaagactgtaactttgacctctcctcag

SEQ ID NO: 16112 - DNA, 568 bp, Gossypium raimondii
  Predicted polypeptide sequence is orthologous to G718
aattgcaagaacatcaatgcctcatctttattgccttaatcaaagtctagctcctcaaataatacgcttttgcaaacattgtgccaaataccatgcttcttgttgtttgactaaccatgcaaggaagaaaagccaacaggtgaaggtcaaagaaatattgaagagatgctctagcaatgatgggttaaagaaagttgaacccaagtacaagtccttaaagcccaacaatggaaaaagggggcttgggttcaactcagttaaagaaaaccctagcatagtgcataaggggtggagatcccccaagttcatagagggaaccaccctatatgatgccttggggaggattcactcctcaaatgacaagtcaactcaagtaaaggtaaacttgagttccgcaaagagtaagatgaaggaagctggatcaacaagtggagaaaaatttaatgctcccatttctcactcttatctttgtgattatatgttgacgtgggatttagggaaattggctgttaaatatgtgggtgccctaccctaaaagaaaagtcatgaaaagaactgtgtgggtacc

SEQ ID NO: 16113 - DNA, 833 bp, Gossypium raimondii
  misc_feature (807)..(807): n is a, c, g, or t
  Predicted polypeptide sequence is orthologous to G735
cacataatggatagagttttctccgtcgaagaaatctccgaccacttctggccgtcctcctcctcctccgccaccaccaactccgcttccgctgatgacgataacaagtccggttctaaaatgaaccgtagtgcttccgaatgggcttttcagcagtttattagagaggaagttgataaggaaggtgaagatgaaggagtgactgagggggatctaaagaagaagaatggaacggcgtcgtttaacaatgggtgtttagagagtaatggtaataacaatgttctggtagattcagatgaataccaagcttttcttaagaacaagcttaacttggcttgtgctgctgttgccatgtcaagggcatcttttgtaaaaccgcaagattcggctgttagagctgacagcggatcacaggcatccgatactccccagtcagtatccatagctacttctaaaggggctggtgataagaacggtaatgcactgtcgggatttccttcagtggttaatggacaaaagaagattggagctcaggtgaggccaagcacaagtggatcatcgagagagatgtcggaagatgatgaagtagaaggagagaacgaaacaatggagaacatggatccagctgatgcaaaacgtgtaaggaggatgctttccaatagagagtccgctaggcgctctagaagaagaaagcaggctcatttgaccgaactcgagacacaggtttctcaactaagagtcgaaaatgcaaccttattgaagcgtcttactgacattagccaaaagtacaatgaatcagccgtcgancatagagttctgaaagctgatgttga

SEQ ID NO: 16114 - DNA, 760 bp, Gossypium raimondii
  Predicted polypeptide sequence is orthologous to G773, G1412
aaagcttattaaatttcaatggattttcatttattacatttcaaaaataacagcaataggttagcccaaagaaatccaaacaattatacaaagttttgaaatcctcttcaattccatacctctttccccctctctctcttttttttttcaactttttattgcttaaacacaaacccacccgactgagtcaggtaccggaatccatacgggtcaattgagttagaaaagttctgggtcatcaacccactagagttctgttgaaaaaaccctgagttattaattcgctgagttctgagtccactctgtacttcctcttccaccgaattaccagctttactcattgacatatccatctgggttagcgtaggcggcatcgtgggtatacacaggtcattatttacataactttgaatcccctgagtctgagtttgtccactgggaaccaactcaggcaccgagttaagccctgcaagactcgcccaatctaaattcccactgcccagattgtgaaaccccgttttgtcatcgttttgaagcgtcttcaacgagttcatccgaggcaaagcaaaataacgattgtctaactcggggaatggctcaagcatatcgtcgagttgggaagaagaagaagaagtagagccattgttactatgctctttgcttgaaacacatggtaatgatttttgagcacttgaattcttcttgtaaattctacataatacccaatcatccaacttggagctaccacttttacgggaag

SEQ ID NO: 16115 - DNA, 873 bp, Gossypium raimondii
  Predicted polypeptide sequence is orthologous to G773, G1412
aactttttggtcggcaagaaaactttacaatcatgggagtgccggaaactgatccattggctcaattgagcttgccgccggggtttcggttttatccaactgatgaagagcttttagtgcaatatttatgcaggaaagttgcagggcatcatttttctctgcaaatcattggcgaaatcgatttatacaaatttaatccatgggatttaccgagtaaagctttgtttggtgaaaaagaatggtattttttcagtcctagagacagaaaatatccgaacgggtcacgacctaatagagttgcagggtccgggtactggaaagctaccggaactgataaaattattacaacggaaggccgtaaagtgggtataaaaaaagctctggttttttacgtcggaaaagctcccaaaggaactaaaactaattggattatgcatgaatatcgactcattgaaacttctcgtaaaagtggtagctccaagttggatgattgggttttatgtcgaatatacaagaagaattcaagtggtcaaaaacctttgtcaagtgtttcaagcagagagcaaagcacgaatgggtcatcatcatcgtcttcttcacaactggatgacatgcttgagtcattgcccgagttggacgatcgtttctttgctttgccacgcgttaactcgttcaaaacgcttcaaaacgatgtgaaactggggtttcaaagtctggggatcgggaatttggattgggggagtcttggtgggcttagctcggtgcctgagctggtaccgagtggacaacctcaaactcaaactcagagtccggggattactagttatggaaatagtaacgtatatgtcagcacaatgccgcctacactttgtc

SEQ ID NO: 16116 - DNA, 813 bp, Gossypium raimondii
  Predicted polypeptide sequence is orthologous to G778
gagaaacccccttggtagctcatggcagaaccatttaataatattacaaattcaaagacaataatttgcaaacaaaacaaagctttgtaataaaataaaataaaaaacatataaccaaccacttgaaactaaagaattataatccgagttcatgttgttgtttttttctttttctttttgtgtataaataaaggcacattgaaagcttaactctttgaactagaagctggcggttgttgcatttgttgatacatagcggccattctactataagcatccatagtcatcggttgtgattgacaagcaaggaatgtagataaagggtctgtcattgaagcagcttgttgtaaccgatcattgttgttagaaccatcccaaggtgtattcattgtcatgaaaggattagacaaaacaggtgagataccaatgatgtttggtcggcccatgaagttcatgtccataacactcatccccattcccatcggtgccatcatcgacatttgaagttgttgttgcaacatcatcgatggtaagttcatcctattcatcatttggacttgtgcttgtaattgttttaagtattcaatcacttcatctaacattgaagctttgtctgtctgtaaaatggtaataaacattaagattatatcaatgcattgcatgcatgaccaagtcttgtgtcattagttagctgtttttcaaaggcaaatgacagattttcagacatgtcgaggaccaaataaggggcctaccatgaaagggtatttatgtggtagcaggtgattgtcgccacacctatcaacgtaaccctct

SEQ ID NO: 16117 - DNA, 894 bp, Gossypium raimondii
  Predicted polypeptide sequence is orthologous to G791
ctcaccatcacattcttccctcacagattccctcaaatcaaccaaattcactcgttccatatctccaatctatctctctgttctcttttgttttgttttcttcactttctgcatcaaacatcttccgctgtctggcataactgaatccttgccgggaaaaatgatatcccggcggcaaccgggtgcggaggacctggtctcctctgacaatcccaatgcttggatttttgatgattatggtttgttagaagacattcctgtccctggtggtgatcttccctcacttgacccttcagccccaatctggtcatctccttcccttacttgctctactcctctcagtgttgaattcactgaatcgtttgggaattcagacaatcttaatgaaacaggctcccgaaaacggatgaggtctggatcatccagtgcatctgggtccaaagcttgcagagaaaagatgcgaagggataagctaaatgacaggcatgtattgttgtccctatttctctcccttcaacccaatttgtttcctctgatatttatatgttaatgtctcaaggttcctagaattgggttctatcctagagcctggaaggtcttccaaagtggacaaggctgtaatattagttgacgctgctcggatggttactcaattacgggatgaggcccagaaactgagggagtcaaatgagagtctgcaggagaagattaatgagcttaaggctgaaaagaacgaacttcgtgatgagaagcagaggctaaagaccgagaaagataatctcgagcggcaagtaaaggcattaggttctcagccaggattcatacctcaggctcctgctattcctactccattttctacctcaagccaagtttgttggtgggaaactggtgcct

SEQ ID NO: 16118 - DNA, 665 bp, Gossypium raimondii
  Predicted polypeptide sequence is orthologous to G849
caagacgtaggaatgatattaagttccgtagtagagatgatgaagaaaacttttctaggtttaagacacttagcaagaggtttaaggcttctagacctccaacatgtaccggagaccgaagaataaggaagttgctgacatccaaatactggaaagttgctacaaagttgaaggattttgaacattctagatttggaggaaaaaggcctctgtatcgcaagtggaagacatactacaactaccacagatatcaatatgacacgctttataaacagaggaagatctttgaccgtaaaagcattactagttctcctgagaaggatatgaatggtgataagtgtagcacagctgcaatgtcagatagagtgaaatttagcatcaagtcctttaggattccagaactttacatcgaggtgcccgaaactgcaactgttggttcactgaagaggaccgtaatggaggcagtgacagccttaattgggggtggaatacgtgtcgggctactccttcaagggaaaaaggtgagagatgacagcagaactctatcacaggctggtatttcctgtgatgataatctggatgctctcggtttcactttggagcctggtcctgcaaaagctcctccaacatgtgctctgaagaaccacctctttttatatcatatg

SEQ ID NO: 16119 - DNA, 842 bp, Gossypium raimondii
  Predicted polypeptide sequence is orthologous to G849
cccagtccaaggattcccatgtgaaattcaccattaagtcctttagaattccggaactttatattgaggtgccagaaactgcaactgtcggttcactgaagaggacagtaatggaggcagtgactgccttacttggaggtggaattcgtgttggggtactacttcaagggaagaaggttcgagatgacagccgaactttatcgcagactggtatttcctgcgaagaaaatctggattctcttggtttcactttggagcctggtcctgcaaaagctcctccgccagtgtgctcggaagaaccaccccttctgatatcatgtgataaagcccctcaacaactaacaagccttccagccactccggttgtagatatggcaattcccgatgccacacctgatccactgttactaaccaatacagcacatcctgtggatagtaatcatgaaccggtttcctcccaaactgacgtgctaactgatcaaagtctatcggagtctagagctatagttcctgttccagcaatgaatgttgaggcactagctgtcatccctgccagcccgaaagtccgaaaaaccgaacttgcacagcgtcgaactaggaggccgttttctgttttagaagtagaagcattggtacaggcagttgaggagcttggtactgggaggtggcgtgatatcaaactgcgagcttttgagaatgccgatcaccgaacttacgtggatttgaaggataaatggaaaacattggttcacacggcgaaaatttccccacagcaaagacgaggggagccagtaccacaggaactgttggacagggtattagctgctcatgcatactggtct

SEQ ID NO: 16120 - DNA, 818 bp, Gossypium raimondii
  misc_feature (795)..(795): n is a, c, g, or t
  Predicted polypeptide sequence is orthologous to G852, G2633
ctccaacgattgggtgcttatgttcttgaacggcttagagcaagggtggaatcatcggggagtaatatctaccaagccttaaaatggcaagaaccgacaagctcggaactaatggcttacatgcatattctctttcgaatctgcccgtactggaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcctccatttatccgtgttactggtattgatgattctcagtcaaatcatgctcgaggtggcggacttagtattgtggggcagaagctatcggaatttgctaagtcgtacaaagtgccattcgagtttcatgatactagcgtgtctacttccgagattcaagtacagaatctcaacattcgtcctggggaagccctagccgtgaatttcccttatgtattgcatcacatgccggacgagagcgtaaccatctcgaaccacagagaccgattgttgagattggtgaagagtttgtcccccaaagtcgtcacccttgttgagcaagagtctaacaccaacacatccccctttttttctcggtacatcgagacactcaattattacacagctatgttcgaatccatagacgtagcttgtccaagagacgacaagcaaaggatcagtgcagaacagcattgcgtggctcgggatattgtgaatatgattgcttgtgaagggcaaganagggtggaaagacacgaacttct

SEQ ID NO: 16121 - DNA, 768 bp, Gossypium raimondii
  Predicted polypeptide sequence is orthologous to G852, G2633
ttttttcttttttttgactaatggtatgaaaatttattagaaaaggcccactttggattataacatggttcaatatacaatatcatcatcatcaatcactataccgtacaacaaacctacctatcatctctaacctattgaaaaaaaaaagaatgtgattatttgtatattacctttgtatcattgtatgtatctcagttgttgcagcgccaagcagaagccgatataaggttccgatccttccatctcaacaacatagcaccatccttctccaccagtgtatagtgtttagagtaatacctcagtaggcttcttatcactgaattcacatatgagcttaatgggtattgtcggaatccggccattgttagcctggacttccattttcccaacagctcgtggcgttccactctctcctttccctcgcaagcaatgatattcacaatatccctggctaggcattgctgctctacgttgattctttcttttctgtcccttggaagtgtctcgtcgatggactcaaatattgctaagtagtactctagagtctcgataaacctggggaggaaaggggccgtgtttgtgtttgactcttgttctaataatgtggtaaccttgggagaaagtgacttcaccagtcgtagaatcccgtccctagggttgttcacgtcaacgctctcgtcaagggtgtgatggagctgcagcgggaagttgacagccagagcctccccaggcctgagactaaacatgtcccttgtgacatctggg

SEQ ID NO: 16122 - DNA, 816 bp, Gossypium raimondii
  Predicted polypeptide sequence is orthologous to G866, G883
gaaagaacttttgctttaagcataatctcaacgactttgtcagtctactttttaatttggcattacaattagtacaatacctatttacatccaattgccccaacctactccaaaatattacaaaacaccactaaactctttttttatgtataaattaacttagattaatatttgcttattatcacgttgactcgaagtccagtccattcccacggcaggagccatattctcctgcattgcgggttgagtgtgtcggtgctccccttcgtacgttacaatcaacattgacggatcatcgggggctcgctccacgtgtttcctagcggggcaccctctaacgctactgcacttataatatcctcgcgggaatggggagcctttgattggcttttgcccgtatttcctccatgaatactcgtctggtggaatatcggcgatcttcgaacttatggcaggaacccttattactttcttcaccctatttttccttcgctttgagcaatggcacttgctgttgccggagccagatctcttgccggaaacgttatcggagtggtcatgttcatggcatctcttcttgaacggtgtcgacgatagcggcggctttcccgtcgaaacggccagcgccggcgccaagaatagagatgatccctgcttcccgttcgagacgctgccgtctccggtgatggcagaagacataaacgaagagttagaggaaacgctaaagctttcttttgtgaactccaactcggtacttttaccgttggagccaaacaaattaggttttgtgaagtccagagtcaaactctgcggctg

SEQ ID NO: 16123 - DNA, 836 bp, Gossypium raimondii
  Predicted polypeptide sequence is orthologous to G866, G883
ctcttctacttttcgcaggcttcatgttctgttgacctctcaacttgcttagtttcctttggttgtcgtcgttgtttttcgtgaaaatggcggtggatctgatgagttttcctaagatggatgatcagatggccattcaggaggctgcaacgcaaggtatgaagagcatggagcacctgattagcctcctttctcaccagtctaaccgactcgactgcgctgaggttgccgatctcaccgtctctaagttcaaaaaggtcatctcactaattaacagaaccggtcacgctcggttcagacgtgcaccgattcagtcctcttccttttcctcaccgtcatcatccgctgcttctctaactgttactgattcccacaaggctctaactcgaactcctgccccggttgaaacaccgccgctgaccgtaaatccggcgccggttgaagctccaagtacggatcctgctagtttcgttcctttgcaaccccagagtttaacactcgattttacgaaaccttgtttgtttagttctaacactaaaagcactgagttggagttcacaaaagaaagcttcagcgtgtcgtcgaactcttcgtttatgtcttctgcgatcaccggagacggcagcgtttcgaacgggaagcaaggatcatctctatttttgacaccggcggcggccgtttcctcgggaaaaccaccactatcctctgctccattcaagaagaggtgccgcgaacatgagcactctgagaacgtgtccggcaacggcaagtgtcactgctcaaagcgaaggaaaaacagggtgaaaaaagtaatcagagttccagccatcagttct

SEQ ID NO: 16124 - DNA, 909 bp, Gossypium raimondii
  Predicted polypeptide sequence is orthologous to G872
gcacaatctgagcgaccttttctttctgttacaaattgactttcaattgatggtgaagccaatctgcacaacacattcttcagcatcacaaacagagtatgcctccgacataaacaccaacagctgcagcagtaatagcagtagcagtagcagtagttccaagtataagggtgtacggaagaggaaatgggggaaatgggtgtccgaaattcgacttcccaacagccgtgagcgtatttggttaggttcttacgactcgccggaaaaagcagccagggcgttcgatgcggctctttattgtttacgtggccgtgatgccaagttcaatttccctgaaaatccaccggagatcgccggtgggacgtcgcttagcccgccggaaattcaagtggtggcagctaggttcgccaaaggggtggaactggaaaccccggggaataacaacaatattgtagggacagaagagtatacatcgtcttcgtcgggcgggggagcgacaacgcaagtggagagtcgtcatcatgaagaagacatgatggactggtcgtttttgagcatgttggataataacaacaccaatgatggagggatgtccgattatggcttttattcaaatttgggccatttgcctggtggtgatgatgatgaactctatcctccgccgattgatgttgatgaaaacggtggcaacgctttttcaccgtcatcgtttctttggaacttttaagccaaatttagatttctttttaaaagcaaataaagttaacttttgtgtttatttgtttgatgggataaatcaaggcgtttggcgaatattagcagccaggatcggtgattttccacagatacagtgagatgatgagattccaatgataggaagggtggaggtgccatcttcctgtgtatact

SEQ ID NO: 16125 - DNA, 873 bp, Gossypium raimondii
  misc_feature (868)..(868): n is a, c, g, or t
  Predicted polypeptide sequence is orthologous to G878, G884
acaatggcagcagagcaaggaaaaagatcacagctatcagctccaacatatcccactataactttgccacctagaccacccattgatggcttatttcaatcaggttctgggttaagtccaggacctatgacactggtttcagcttttttctctgaccctgactcaacaaataggtctttttctcagcttttagctggtgccatggcttcacctggagctaaactgccttacaatcccatggatgattcatttatggaagtgggttttgaaaatggaggtgaaaagaattctgggtttaaacaaaatagacctttgaatttgggtgttggtaattctccttggttcactgtgcctcctgggttaagcccttctggtttgcttaactctcctggtctcttttgcttatctcctcagagtccttttggaatatcgcaccagcaagcattggcacaggttacggctcaagctgctctagtgcaatctcatgtacatgcgcaaccggaatatcaaactttgtctgctgcaacttcttcggaaccatcgatccctccttcatctgccaatcctgaagaaactttgcagcggatgctttcttcagaccctcaaagttctgcaatggaatgcttggaagcttctcaattcgataaaaaaagtcagccttgtgttgctgtcgataaaccggccgaggatggttacaactggcgtaagtatggacagaagcaaattaaaggttgtgagtatccgcggagctactataaatgtacacatccgagttgccctgtcaaaaagatagtcgagcgttctgccgagggcctaataactgaaattatatacaaaagcacacataatcatgaaaagcctccaccanataaa

SEQ ID NO: 16126 - DNA, 888 bp, Gossypium raimondii
  Predicted polypeptide sequence is orthologous to G896
gttcgaatcgatggcacgaagagaacgatccattggttgtgggagtaacatgttggtttcacccgaggcacgagtcgttcgttgttcccagtgccacacccttaccaaccttgtcccaatcaatgctcgaccaggccgaaccaggtataatgggctgccgagaatgcatgaaaacccatacgggaacggcccaagtccgcaacatccacaatatccacaaccgcgaccatccttatctccagttccgatttacgggagaaaacgagcacttctttgtggtgtgaattaccatggaaagagttataaactcaaaggaagtatcaatgatgtcaagagtatgaagtaccttcttgtggagacattaggatttcccaatgattccattttaatgctcacagaaaatgaaagggagccttcaaagatcccgacaaaacagaatatccgaaaggctttgaaatggctggtctatggatgccaaccgggggactcgttggtgttccatttctctggtcacggcactcgacaaaaagattacaaccatgacgaagtcgacggatttgatgaagcattgtgccctcttgatcacgaaaccgaagggaacataatcgacgacgaaatcaacgacaccatcgtaaaaccgttgactcgaggaaccacactgcacgcgatcatcgatgcctgctacagtggaacagtcctcgatctccctttcgtttgcaggatgaacaaggaagggcgttatgcgtgggaagatcaaagaaatcccttatttaacaagcgtacaagtggaggattagccttttgttttagtgcttgtgatgatcatcaaacctctgctgataccactgctttcacaggaaccaatgtgagaaccggcgcgatgacata

SEQ ID NO: 16127 - DNA, 857 bp, Gossypium raimondii
  misc_feature (58)..(58): n is a, c, g, or t
  Predicted polypeptide sequence is orthologous to G896
caggcccaacgctaattccacctccttcttttcttcttcttcatcattagaaattccncttttttccccaaataattttttttaggaattaacctttgagattttgaataatgtatccgccgccagggccaggaggcatgtactacaattacccgccgcctatgctggtcaactgctccggctgccacacccctttgcagcttccgcaaggtgcccgatccatccgttgtgccatctgtaaagccgttaccaacatcgctgaccctcgatccctccctcccgcgtcccaaccacctgctccttccacccacgcgcctccttctccctccccttacaatcatgctcctcccggggcacctccccacgcccacggtcgaaaaagggcggtggtctgtgggatttcgtatagatactcgaggcatgagctcaaaggttgcatcaatgacgccaagtgcatgcgttaccttctcgtcaacaagtttaagtttcccgaggattccattcttatgctcacagaagaagaaactgatccctacaggcttccaacgaagcataatataaggatggcattattttggttagtacaaggttgtcaacctggtgattctctgttatttcactattccggtcatggttcacggcaacgaaattacactggtgatgaagttgacggctacgatgagactctttgccctttggattttgaaactcaagggatgattgttgatgacgagatcaatgcaactattgttcgacctctacctcatggtgttaggcttcatgcgattattgatgcttgccatagtggaactgtattggatttaccattcctttgtagaatgaataggactggacag

SEQ ID NO: 16128 - DNA, 898 bp, Gossypium raimondii
  misc_feature (869)..(869): n is a, c, g, or t
  Predicted polypeptide sequence is orthologous to G926, G2632
gttatggttgcagagagagccaaactgcaatcaatctctaggcatttgcttctccaattccaatcttctttttctttttctttttttactaataagtcgtgagaaatgccagcaaaaccagggaatgatgatcagcagatagaccatggggctcaaagtgtgttgcagtcaactgcctactctgaaccctggtggaaaggagttgggactaacccctttggtgaagctgcctcgaagtcgccttctgtagaacaactaaatggttcagtggcaaatggagctgtgcattcacaggctcatggggacttgggcaatgaagatgggataaacagacaagatcgccaacatctcaaacacgttccttccacaacaccccttactttgggtgaacaccatgaaccaaattcccaaatggaactagttggtcactcgattgtcttgacatcatatccttattcagatcctcagtatggtggaatgctgacttcatatgggccacaaatgatggtttcaccacatctatatggaatgcatcatgctagaatgcctttgcctcttcaaatggaagaggagcctgtttatgtaaatgcaaagcaatatcatggcattttgaggcgaagacagatacgtgctaaggctgagcttgaaaagaaagccattaaaattagaaagccataccttcatgagtcccggcatctacatgctatgagaagggctaggggttgtggaggtcgttttcttaatacaaagaagcagggtgatgatgttaccagccccacttcacaaaagggcatgaattcagatgaaaacatttcaaccaaatcatctatcttgtctgggtctgagtgcgtatccgcaaatggtgctgngaatatgaattccttctatagtcagcaag

SEQ ID NO: 16129 - DNA, 853 bp, Gossypium raimondii
  Predicted polypeptide sequence is orthologous to G938
gagattgatgtggatgaacttgagagaacgatgtggagggacaaaatgcgtctcaaacgacttaaagaacagaacaagagcaaggatggggtcgatattgtgaaacagagacagtctcaagaacaggcgaggaaaaagaagatgtcgagggcacaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggtttgatcgtaatggtcctgccgctattgccaagtaccaggctaataattcgattcccggcaacaatgatgggtgtaacccgattggtccaacaccacacaccttgcaagaacttcaagatacaacgctcggttcccttttgtctgcactgatgcagcattgtgatcctcctcagaggcggtttcctttagagaaaggtgttcacccaccgtggtggcctactggtaacgaggaatggtggccgcatctcggattgcctaaagatcaaggccctcccccttataagaaacctcatgacttgaaaaaggcttggaaagtcggggttctcacagcagtaatcaagcacatgtctcccgatatagccaagattcgcaagcttgtaaggcagtctaagtgcttgcaggacaagatgactgcaaaggaaagtgcaacatggcttgctatcatcaaccaggaggagaccttggctcgagagctttaccccgagtcctgcccagctttgtcctccgggggaggaagtggatctttggttataaatgactgcagtgagtatgatg

SEQ ID NO: 16130 - DNA, 858 bp, Gossypium raimondii
  Predicted polypeptide sequence is orthologous to G938
caaagtcaggtttgatcgtaatggtccttctgctattgcaaagtaccaggcagataattcgattcctggcaagaatgatggctgtaactcgattggcccaactccacacaccttgcaagaacttcaagatacaactcttggttctcttttgtctgcactgatgcaacactgtgatcctcctcaaaggcgattccctttagagaaaggcgttcccccaccatggtggcctactggaaatgaagaatggtggccacaactaggattgcccgaagatcaaggccctcctccctataagaaacctcatgacttgaagaaggcttggaaagtgggggttctcacagctgtgatcaagcatatatctcctgatattgccaagattcgcaagcttgtaaggcagtccaagtgcttacaggacaaaatgacagcaaaggagagttcaacttggcttgccatcattaaccaggaggaagccttggcccgagaactttaccctgattcctgcccacctttgtcctcaggtggtggaaatgtatctttggttataaatgactgcagtgagtatgatgttgaaggtgttgaggatgagccgaacttcgatgtgcaagagcgcaaacccaggactatcagttctaatttggtcatggagagaatgagggctatccaacaaccaccttattcgactaagggggaagttgtcagtaatttggatttcacgcgaaagaggaaaccatccaatgatttaaacatggttgaacaaaaaatctacacttgtgaattcctccagtgcccttacagtgaatttcgtttgggttttcatgataggactgccagggacaatcatcaattgacttgtccata

SEQ ID NO: 16131 - DNA, 836 bp, Gossypium raimondii
  Predicted polypeptide sequence is orthologous to G989
cttgatgatagaaattttctttcagtttctcacctcccaaacaggcccagcaactttcaatctctgacacaactctgcaaaaaaactctgtacaggaagaacttttgttagtcctcttcaaaagatatttgtcccttttctcccaaaagttcctcacctttcgaatctattctcctttctctctttctctctctcttaatcgatcatgcttcaaagcttagttcctcaatctccaatcagttccaacactactagctctaatcctagctcctccatgaagtcaaagcgcgtcgaaagagacgtctccgcagctaccggcgaagattccactgctgatgatccttctaacaagcgtcctaactactcctccggcgacaaagcagctgccgccgatgaacatgatgaaacggtgatagaaggtgagtctacagggttaaggcttttaggtctcctgctccaatgcgccgaatgcgtcgccatggataacctcgaggacgccaccgatcttttacctgaaatatcccaactctcttctccgttcggctcatctcccgaacgtgtcggcgcgtacttcgcacacgctttgcaggcacgcgtggtgagttctagcttaagaacctattctcccctggataacaaatcacttaccttgactcagtcccaaaagatcttcaatgctctgcaatcttacaattcgataagtcctttggtcaaattctctcacttcaccgccaatcaagccatcttccaagcattgagtggtgaggattgtgtccacgtcatcgatctcgacatcatgcaaggtctccaatggccaggattattccacatcctcg

SEQ ID NO: 16132 - DNA, 862 bp, Gossypium raimondii
  Predicted polypeptide sequence is orthologous to G1017, G2567
gacgagccaggcatgctcattacggcctatctttatcagatctccacctcaataaactgcagtcagcgtctctttccggctagtttcccaccacttgattacgctcctgtacctaataggacctccaatggtggcccaaacattcgaaagcctagcatgagtgagaacgtttcttgtgtgctaaccatgtcccatccctcacagaataccaagaaagctgatggtgcaaagacacctcagcttgtacttttcggtcggccgattcttactgaacagcaaatctctctcagctgctctggtgatacaatctcaccagttcttactggaaatagttcttcagaatatctggataaggcagcaaacttttccgatggttctggatctgctcttcatcaacaaggccttcctgagcgagcatcctgcgaaggtctcccgtggtacaaaaacagtcgccaagaaactgaacccaatttagagaccggtcactgtaaagttttcatggaatcagaggatgtcggtcgtacactcgacctttctttgctggggtcttatgatgaactgcagagaaagttggcagacatgtttggtatagaaaactccgaaactctgagccatttactctatcgggatgctacgggtgctgtcaaacaaattggagaagaaccattcaggtagaactcattcaccttgtatgtttatgggttaatgcccttacaaagggcatggtaatcaatttctcattgccattgcagtgactttatgaaaaccgcgaggagattaacgattctaacggattcaagcagcgacaacgtaggagaatatagaggaagaagcaaaccttggattcaacatgtacagctga

SEQ ID NO: 16133 - DNA, 1459 bp, Gossypium raimondii
  Predicted polypeptide sequence is orthologous to G1017, G2567
ctgtttattcctcacgcgagaaagtgaaaccattaaaggtacagcagagagtctgaaaaggctgaatcggacaatcgatgaaggaatcagataagagcttagatccacagttatggcatgcatgtgctgggcccatggttcaaatcccaccattaaactccaaggtcttttacttccctcaaggccacgccgagcactcactcgccgccgtcgatttcccctcgtctccgccggtcccggctctagttctttgccgagtggcttcgctcaaattcatggcggataccgaaaccgacgaggtatacgccaagatcctcctcatgccgttacccaacacagagctcgacctagaacacgtcgccgttttcggctccgataacgcggagaagcctgcttctttcgctaagacattgacccaatccgacgccaacaacggcggtgggttttcggtcccgaggtactgcgccgaaaccattttcccgccgttggattacacggaggaccctccggttcaaaccgtcgtcgccgtggatgtccacggtgaaacgtggaagttcaggcatatttatagagggaccccgaggaggcatttattgactacgggatggagcactttcgtgaaccataagaagctcgttgccggcgattccatcgtgttcttaaggtccgaaaacggcggcctgtgcgtcgggatccgacgagccaagcgcgggactggaaacggacccgaagctgggtctccatttttgtctttcttaagggaggacgagagtaagatgatgatgatgaaccgaaatggggattggagaggaaaggggaaactgaaggcggaagctgttttacaggcggctacgttggcggccagcggtcagccgttcgaggttgtttattacccaagagcgagcacaccggagttttgcgttaaggcgtcgtcggtgaaggcggcaatgagggttccttggtgttgtgggatgaggtttaagatggctttcgagacagaagattcttcaaggattagttggttcatggggactgtgtcttctgttcaagttgtcgatcccattcggtggcctaattccccatggcgactttttcagttggaggagttgagcacccaagttcctcaagggctagcatgggacaacattggagggccaagcattcccccttacaatcgcctcacagcagctcaatttgaggcattttttcaccctcctggggccaattgctcttcacaaatcggatatagcaatgatgtggtttcggatgagatgaatggggcagtgcatagccaaaatgtgaacgggtatttcccaggatggatgctttaattatatctagctacctacttttcattatttatttaaacaaaaattaacgcaacttgtaattatatttgtatgaatgccaataaacataaccatgaacatataataaattgtaaggacttaatttccct

SEQ ID NO: 16134 - DNA, 914 bp, Gossypium raimondii
  Predicted polypeptide sequence is orthologous to G1020
tcaattcccccaccattttttcctctctcaccattatctcatcactcttaaaacggagcttcctaaatggccctgagggagaaaacggcggacgtcaagggaaacgggaatgggtgtactaaagaggttcattttagaggagtaaggaagcgtccatggggtcgttacgccgctgagatcagagatccagggaagaaaagccgtgtttggcttggaacttttgatacagctgaggaagcggccaaggcctacgatgccgccgccagagaattccgcggcgccaaggcgaagactaatttccccctccctggtgaaatcctcaacaatggtagtaactgtaacaacaatggcgataccaactgcagcaacaacaataacaatcacagccctagccggagtagcaccgtggagtcatcaagccacgagccgccgacagtcgtcaagtgttcaccgttggatctcaatctcggacacggtgcagtcatcgggtacggatctccagccgtcaggcttcctttccctcaaatttcgtcggtcaccggttttttcgccaacggcgtcccggcagttgcagccccccaagttttttacttcgacgcgttggtccgacccggtgttatgaaaggacagcagtatcaacaacggttgagattcgatcaccgtgattatcacgaaactttcaacgctggtgtacaaagcgactcagattcgtcctccgtcgttgatttaaaccaccacgagatcaaacggcgaccgcttctcaatatcgatctcaaccaacctgctccggaagtcgcgtgattattattttttaaaattgccgatatcaagaaccggaaaaaaaaaacccacaaattttcaattttccctctttaaaatcgttaatcttctttttagtcccaaatttgaaaatt

SEQ ID NO: 16135 - DNA, 918 bp, Gossypium raimondii
  Predicted polypeptide sequence is orthologous to G1043
ctttatccatggcctgaacctgaaacactatcaagcaacaagaaaagggtaatacaacaacttgcggaaggtcaacagtgtgctactgagcttcaagttattgtactccagaacaacaagccctctcaacaagctgaggagcttgtgcaaaagatcctgtggtcatttaatcaaacaatttctatgctatctgaagctggtcatcatgatgaagtgatttcccagaatcaggctacttgcaatgatgattgtaagtctcaagattctagtgagagcagcaagagatcactttcagcattcactaaggacaagaggggctgttacaagagaaagaggtttgctcaaacaagcacagtggtgtctgataaaattgaagatgggcatgcatggaggaaatatggacaaaaaatatcctaaattctaaacatccaaggagttactttaggtgcagtcacaagcatgatcaaggctgtagtgctatcaaacaagttcaaagaatggaagatgatacccaaacgtaccacatcacatacattggtacccacacttgcagaggccagtacccatccatggctacaccacgaatcgaccgtctgagtccgatattaaaactcgaatccgaggaacaaacgacgacaccaagcgatgttacggatttggattcgatgaccatgtggacggatgtaatgatgggtggtgttggttttgaagctgatgcggtgtccaacatgtattcatgcactgaaatcacttgtttggatttagaacctgttgagcttgaaaatggtttgcagtttgattaccctgattttgcttcgtaaaactttggcttctttgtacagttaatattataagccatgttccctatttgtattatgtaatcgacgggcaaattatgttgttagtccctgtacttga

SEQ ID NO: 16136 - DNA, 870 bp, Gossypium raimondii
  Predicted polypeptide sequence is orthologous to G1051, G1052
cagtttatatcattggcttcaaggacttactattatatgatgttggtgtttgggtttgggggtttgagttgatagatgtgtgtgtcgtgtaatatttttgtgtgtttggttgtatagttagttgttggttagtttaagattagctttgtttttcgtgctcttttatttatttatatatattttttgagtttttggggtttgtgacattggtgtagaatggcacaattacctccaaaagtacccaacatgacccagaattggccttcttttccacatcaaagattgcctacaatggcaaacatcatttccaccactgccaacaccgccactatgaatgcctcccaccaccaccagccttcttgggtcgacgagttcctcgacttctcctccgcacgccgcggggcccaccgccgttccattagcgactccatcgctttcctcgagcaaccattggtggaggaatgcagggactccaacaccaaccacaacaacaatgccatgataacggaaaccaatgtgttcgatcgtctcgacgacgaacagctcatgtccatgttctccgacgacgtagccgtcaccatggctgctgcaccgacgttatcctcgtccaacccttccactccgacgtccgaccaaaacagcaacaatgacgagaaaccactgccgtccctggatctgcagcagcccaagaacgaaccaggagaagtggagagctcatgcaaacctgaaccacaagctgctcaacctccatcaacctccaatggcgaccccatcgttgatcccaaaagggttaagaggtaaaacaaatcaaaacccattattatacaacattttttaccccattataaatattttaaattttattttggg

SEQ ID NO: 16137 - DNA, 869 bp, Gossypium raimondii
  Predicted polypeptide sequence is orthologous to G1146
cttggtattgtttccagtgctgcttgaccaatatgtatttagaatgagcaaacaatatttggccaatgtggcattgaaaattaatgtcaaggttgggggaagaaatactgttcttgttgatgcaatatcacgaaggatacctcttgtcagtgaccgtccgactataatttttggtgctgatgttacccatcctcaccctggggaggattcaagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctgttatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacagtttacagctgatgcattacagtcccttacaaataacctttgctatacatatgcaaggtgcacacgatcagtgtcaattgttccccctgcgtactacgcacatcttgctgcatt

SEQ ID NO: 16138 - DNA, 832 bp, Gossypium raimondii
  Predicted polypeptide sequence is orthologous to G1146
ggaatacagttcttgttgatccgatatcaccatgaatacctctagtcagtgaccgcccgactataatttttggtgctgatgttacccatccgcaccctggggaggattcaagcccttctattgcagctgttgttgcctcccaagattggcccgagattacgaagtatgctggtttggtttgtgctcaagctcatcgccaggagctcatccaagatttattcaagacatggcaggatccagtaagggggactgtttctggtggcatgattaaggagctcctaatatctttccgaagagcaactggacataagccacagcgcatcatattctacagggatggtgtcagtgaaggccagttttatcaagtgttgttgtatgaactagatgctattcgtaaggcatgtgcttctttggagccaaattatcagcctcctgttacctttgttgtagtacaaaagcgacaccacacaaggttgtttgctaacaaccataatgatcgcaatgctgttgacaagagtgggaatattttgcctggcacagtggtggactccaaaatctgtcatcccacggagtttgacttctacttatgtagccatgctgggattcagggtacaagccgtccagctcattatcatgtgctatgggatgagaacaagtttacagctgatgctttgcagtctcttacaaataacctttgctatacatatgcaaggtgcacgtgatctgtgtctatcgttccccctgcatactatgctcatcttgctgcattccgagctcgtttttacatggaaccagagacttcagacagtgggatcatgataagtggccctgc

SEQ ID NO: 16139 - DNA, 846 bp, Gossypium raimondii
  Predicted polypeptide sequence is orthologous to G1181, G1850
tctgaactttctagaatttaacaatcagacttctcatctctggtgaacgaaacaaacaccttctttaaggaattattaattatcgtctttgatggctccgccgccggtggagcaaaacggagatgcaacgacgggaacggcggaatcacaaaggtctattccgacaccgttcttgactaaaacgtatcaattggttgatgatcacacgattgacgacgtgatttcgtggaacgacgacggatctacttttatcgtttggaatcccatggtgttcgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcgacggaagatctcgtcgccaacagcagcagctgttacggtggctccggtgacggttgcggctattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagcttgtgcaataatatattcagtttgatgtcgaattacgcaagttctcagtcggagaacatttctcccgtgcacaaaccgctagatttcttgccggcgaagcggttatcatggggagaatcagtcgaagaagaaacgagtccgaggttattcggcgttccaat

SEQ ID NO: 16140 - DNA, 914 bp, Gossypium raimondii
  Predicted polypeptide sequence is orthologous to G1190
cactatcgaagagcagagagcagctttagagaagttgcaggacttattgacatcaatgtgctttacagtgtatgctacacaggatgatattgctgtgtggcagaaatcatcagatattggctgctatgagaagctcaccggtccagatgtctacccaggcacgtgtgatgacagtatcgaacaggatgcagcatggtacactccgttacgcccatgtgttacatctccaagacaaaagcttaagaggtcatccgtgggttccctgccaaagtggccacagaggttaaacatcgcacctgagcgcatttcagatgttcctggtgggagtggcaatgctttaaagcgcgatgacagcaactggaaagtgcgagcccagcactacaaaaagatcctcccagcaattgggactgataagattagaaatgttatggacatgaatacagtctatggaggtttagctgcagctctcattgatgatcccttgtgggtcatgaatgtagtctcttcctactctgccaacacattacctgttgtctttgaccggggccttgtcggcacttatcatgactggtgtgaagctttttcgacatatcctcgaacatacgatctccttcacctcgatggcctttttgccgccgagagccataggtgtcatatgaagtatgtgctgttggaaatggaccgcatcctgcgaccggaggggcacgcattaatatgggaatccagctacttcatggatgctatcgagaccattgcgaagggaatgaggtggaactgccacaaagaagatactgaaaatagtggagagaatgagaaaatactagtatgccagaaaactctgtggtatgcctcctctactaacagtacaagatgatcccaaaagtcttctttgcctggttaaaaccataattatt

SEQ ID NO: 16141 - DNA, 705 bp, Gossypium raimondii
  Predicted polypeptide sequence is orthologous to G1202
aactatcagcagcggcggatcagtcccatagtcgtcgaccatgatactccacaacgcggtggtcgtcacaatggattctgattgccgagtctttcaaaacggagctgttttcatcgacaaagacaaaatcaaagccatcggtcaatctcccgatattcttcaacaattctcccatgtcgctcaccacatcctcgacctccacggtcaaatattgcttccaggattcatcaacacacacgttcacacttcgcagcagctcggtagaggaatcgccgacgacgttgatctaatgacgtggcttcaccatcggatctggccgtacgagtccaacatgaccgaagaagactcttacatctctactttactttgcggagtcgaacttattcactctggtgtcacgtgcttcgctgaagctggagggcagcacgtgactggaatggccagagccgttgagttgctgggattgcgagcttgcttaacggattcagtcatggactccggtgatggtttaccgccatcgtgggggattcgaacaacggatgaatgtcttcagtctcaaaagaagctttacgagaagcacaataatacagcagatggccgtataaggatatggcttggaattaggacagttatgaactctactgatcgtttactgcttgaaaccagagatgccgctagagaattaaaaactggcatccatatgca

SEQ ID NO: 16142 - DNA, 960 bp, Gossypium raimondii
  Predicted polypeptide sequence is orthologous to G1206
gggattagatctctcaatggaagggaagatgatgagtttttagggaagctgttataaggtctacgaagaatttataagatggaatagtaaaaatgattggcatctattgtaagcaagttcagctgtgtgttccaaaagttgcatacaaataggtcaagttaaactccggggaaaagaaaagaaattctcagctcggatagtctttaacaattgtccgagcaaatacaaaaaggtcggttccatggttgcagttgtcgaagctggcttcagtttggagttgatatcagttcagataattctttaacagctcgttctactgcataaataatcatcttcctaatctgtttacacgaaaccgtttgcaagtaaggttttgcaggaaataaataagtcgaaacatcaacgaaaggatgtgcctacctcaagtttgtcttctctggctctatggttcttgggtagtttccggaactcctctgttaaacggaggcattcctggatattctctggagaaacaaagtccaaggcgacttttgtgcatgactggaaaacataactatgagagaccataaacatgtgttccacaacatggaacgataatgcatgtattaattaaataccttcaggtttctaacttggtgcggacatccagccggaataaaaacagcctctccgagattttgctcaaacgtccatggttcaactcctaggaatcacgcgcataattgcatgaggaaaaagacgaaaaaacacggtataggcaaagtttttacattagacaacaatatgtcattctttgtactaaccatatttctcctttagtctccttttgtgctccgcagttaggtaaaatgattggtcatgaatcggatggattacctgatcataaacacagccatcaagaaacgtgagtgactaccactttaaggagtttttctttcaatgcagatggccaaagggttt

SEQ ID NO: 16143 - DNA, 733 bp, Gossypium raimondii
  Predicted polypeptide sequence is orthologous to G1206
ttttttctttttttttaagtaatcattttgtaattttctctaatttgcctaccaaagaagaaaagaaaaccataactgagtgacctctactgtaatttacccattggttttctatatcatgctgctactttattacaacatctactaaccttttgcctttaactatcaattggtgaaggtaaatattttgacacatacttcagaggtagccttaagcgatgagcagcttgccgcaatggagaagttgaaaatgaaacacaaggcacaggatgaaaaggaaagtttagaaagagagcgacttaaaaaaggctttgatgaatcggaagccaccaattggggtgataatatactatatgtttccagtggtgagtttagaggagcttcacttccggaacccttgaccagcagaaaggacataggtggtgcactgtgggacatttttaggagggaggatgttcctaaactagaagcttatttgagagagcactacacagaattcaggcatacctattgctccccagttgaaaaggtaagccatgggggagcacttttagaattaaatcgagaagcttactgggtaaaagcactttttttaaatcgtaacaatgctaaaccctttggccatctgcattgaaagaaaaactcctttaagtggtagtcactcaacgttcttgatggctgtgtttatgatcaggtaatccatccgattcatgaccaatcattttacctaact

SEQ ID NO: 16144 - DNA, 821 bp, Gossypium raimondii
  Predicted polypeptide sequence is orthologous to G1255
cttctacttattatttctgtctattccatttaatgattactgacaagaaagcagcgaatgtcatggcatgcaagacggctagagcctgtgatggttgtttgcagaagcgtgcacgttggtattgtgcggatgatgatgcctttctttgccaaggttgtgacacatcagtccactctgctaatcagttagccagcagacatgaaagggttagtcttcaaactgcatcctctaatttcaatgcttcgatgcacagtactattgatcaagatgctccaccggcatggcaccaaggtttcactcgaaaggcaagaacagcaaggcaaaacaagcccatgttggggcaacaaaaaggtgaggggaccgtattggctttgaatcctattgatccttttgttcctgaggttggtagtgaagaagggtcagttgatgaaaacgaagagcagctgctttgcagagtcccagtattcgacccttttttctgaagaattatgtaatatggtaacaagtgattgtgatgaagttgccacgccaaatgaagatgggaatttagttgttgatggttatgaacatgaaagaacatatgagttggatgatagtttgcatggctttttaccgtcagatttggatcttgccaattttgcagccgacgttgagagcttgctaggagttagacttgatgaagattcttgtgatatcaaaaaaattgaatcgttagactgcacagatgaaaatggaagcgagctatttcatgaacgcaaaataatgaaaagttgaagaggaagaagaagtggaaggtataacagcttgtttctgtgaatctg

SEQ ID NO: 16145 - DNA, 606 bp, Gossypium raimondii
  Predicted polypeptide sequence is orthologous to G1255
ctttttttttaaaaaaatgggaaaaagggaaaaaaatccttcccccttatttatttattaaaattatggggagtttgaaaacattgggggctaagcaccaggaactagggagtacatcaggggggacgagaaaaaaaggatttgaaagggctacttgttgagcaatggaaaagcagggcctggaaaaaaggatgcccttttgacaaacctccctttcattcgagggctcttctccgcattaagtttgcgaaccccgtaccttattttcttggaaaacaaccttggtccccgcttttctctggaccttgaaactcttggttctctacccccgccccccattggcgggtggtggccccccattcccatcaaaccactatagctctggtgaacttctggtccaccatttcccatggaatctggccagcattcgtctggggccaaatctggtttgcccccaaaagtccaaggaaacccttgggttgcccagggggggattacggcttcataatctaagctcaaaaggggcttccttttcttcttttttgcagaattcccctgaaattccccaccctttttactcttcacttctacctcttcctttaccaa

SEQ ID NO: 16146 - DNA, 897 bp, Gossypium raimondii
  Predicted polypeptide sequence is orthologous to G1272
tcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcatatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttct

SEQ ID NO: 16147 - DNA, 781 bp, Gossypium raimondii
  Predicted polypeptide sequence is orthologous to G1451
gtgactcagtcctttttatttggaatgagaagaatcagttgttgctgggtatccggagagcaaatcgtcctcagactgttatgccatcttctgttttatcaagtgacagcatgcacattggtcttcttgctgcagccgctcatgcggctgcaaccaatagccgttttactatcttttataacccaagggccagtccttcagagtttgtcattcctctcgccaagtatgttaaagcagtctattacacccgggtttctgtaggcatgcggtttagaatgctgtttgagacagaagagtcaagtgtccgccgatatatgggtacgataactggcattagtgacttagatcctggtcgctggccaaattcgcattggcgctctgttaaggttggctgggatgaatccactgcaggagagaagcagccaagggtgtccttgtgggagattgaaccattaacaaccttccctatgtattcatcacccttccccctgcgattgaaacgaccatggccatctgcgctaccctctttccatgctttcaaagatggtgatatgaacatcaattcccaaatgatgtggcttcaaggtgggattggagatcaaggacttcagtctttaaacttccaaggttttggagttgcaccctggatgcagccaaggcttgatacttcttcaatacaaggtgtccaacctgatctttaccaagcaatggctgctgctgcatttcaggaaatgaggactgttgattcatccaaattaggctctcagtctctcttgcaatt

SEQ ID NO: 16148 - DNA, 815 bp, Gossypium raimondii
  misc_feature (17)..(17): n is a, c, g, or t
  Predicted polypeptide sequence is orthologous to G1480
acttcaaaccctccacnggttgactcctaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctctgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtaggaacagttccagatgggaattaccacgcgacacaagtgggtggttcaatcgatcgagaagctagggttttaaggtaccaagagaagagaaag

SEQ ID NO: 16149 - DNA, 866 bp, Gossypium raimondii
  Predicted polypeptide sequence is orthologous to G1480
gaaaaggagaaagacagtagatttgtttaaccccagcaactcgttgaaatggcgtccaagttgtgtgactcatgcaaatcagcgacggccactctgttctgccgtcctgactcggcttttctttgccccaactgcgactccaaaatccatgccgccaacaagctagcctcccgtcacgctcgggtcttggtctgtgaagtttgcgaacaagcaccggctcacgtcacctgcaaggctgacgcagccgctctttgcgtcacttgtgaccgtgacatccactcctctaaccctctcgctcgccggcacgagcgggttcctttggctcccttttacgattccgtcaagcccaacacagcgtttaacttcctggacgaccgttacttatccgacgtcgatggagacgctgacagcagcagggaagaagcggaggcagcttcgtggttgcttcctaaccctaaccacaaagcacatgaaagcccggacgtgaacacggggcagtacgtgtttcccgagatggatccgtatctagatctggattacggtcatgtggatccgaaaattgaaacccaggaccaggagcagaacagttctggaactgatggagtggtccctgtccaaagcaacaccgtccaagctccgatggtcaacgatcactgtttcgacatggagttcactacaccaaaagccttgccttatggctacaactacaactgtaactacaaccctcactgtcttagccacagtgtatcatcttcttctctggatgttggggtagttccagatggcggtagtacgattacggacatatcagtcccgtgcgcgaaagtgacggagacgactcatcaggcggtgcaactctcatcggc

SEQ ID NO: 16150 - DNA, 883 bp, Gossypium raimondii
  Predicted polypeptide sequence is orthologous to G1512
gatcaaaaagagaaaccgcaaaaacaaagctccgatatcctggtttttttttttcaaagttaaaacccagttttcattttggtctgtttcagcttcctctttacctaatggctatggaaccaaacttctttgaacaagaatcacatttcgagtctgatggagatatttcactcaagaacaaatggaatccaataccagaaccaacaaaagacctagaaaaagattccagctgtttcgattgcagcatttgcttcgagtcagcacaagagccagtagtcaccctctgtggtcacttgtattgctggccttgcatttacaagtggcttaatgtccaaacttcttccctcgatacagacccgcgacagaagaactgccccgtgtgcaaggcaagcatctcttccggttcattggttcccctctacggtcacggcacatcttcacattctcaacccaagaatccacagtcagatctgaacattccccaaagaccacctccttctacatcgaacatgaccgccccttcttcgcatctaaatcaacagcttcacgaaaactttttccattctcagtctcaagcatttcataaccagcaatacttcccaccttatggaggatatgcaaccttggcatcatccgaccttagtggaataccgatgacgaatttcttccatccgatgatcggaactttgggagaaatggtgtatgctagaatatttgggagctcaaacacaagtatgtttgcttaccctaaccaagcgtcttacccattaatcaggaataacaatcttaggatgagaaggcaggaaattcaggttgacaaatctcttagtagagtatccatgtttcttttctgttgcatcattctttgtcttctcttgttttg

SEQ ID NO: 16151 - DNA, 868 bp, Gossypium raimondii
  Predicted polypeptide sequence is orthologous to G1535
ttttgagggatgaacgccgccgagctcagccgtttgtgctatcaaatgggaatgccttacatgaagtggctccttttgctaatggttcccatcctggaaattgcatttcactccttagaatcaacgtttccagcaactcatcacaacacgtagacctaatgctacaagagagctgcaccaacaaatccggcagcctcgtcgtgtactcaaccgtagacgtcgattccgttcagctggcgatgagcggcgaggacccgtcgtgtatcccattgcttccgttaggcttttttataaccccaatggaactggtgaatgatggtgggtgtaaggacgaagcaaatgggcataatattacagcagggagtttactcaccgttggacttcaagttctagccagcacaataccatcggcaaagatcaatctgtcgagcattgcagccattaacaatcatttatgcaccaccgttcaacaaatcagtagtgctttgagtagcaattgcatcgggtcttgcaatgaaggtgacaatggtaaagaaaaatagggtgttggtgattcgtgaattacccataacatccttaattttgttaactaattgaggaagttattggtaattgtactgaaaatcgtgcactgggatttgtagtaattttaatgtggtaaataaagagtgtaatgatgatggagggttaaatttgaaaacttgggggggtataggtgaagtcaagagcgcaccaattgtgaccctttgcttttaatggtaaaggccaccaattagcaagggtgggtggttcgggtattgacttcagctttcttgccctttttttggtaatttttatatatagttataataaacctaagtatttgact

SEQ ID NO: 16152 - DNA, 888 bp, Gossypium raimondii
  Predicted polypeptide sequence is orthologous to G1835
ttttgttattgcagtatgaagatattgttccattggaatggatgtcaaaatttgttgaagatactcagtgtggagcaagcttgacaactaagaaagaagattcctcttcaatcagtgagggatccaatcatcaattccagacttgcagtccggtttcggttcttgaaagtagcagctcgtgttcaggaatgaaaccattgcctcgcagtcctgaaacgtctgcccctgggaaacgcggacgtccacgaagcaaacgtcctcgtctggccactttcaatcatcatccaggagttcagatgacctccccagcttcatctgtcaatgagaacgacattccccagccatttgctgtcccgaaggtgctgtcggattctgagaactatgctgagtcacggcttctgatcaaattaccgaaacaagtcaatccagaacataagaagaagaagttatcggtttcagctgcagcaggcattgctgattatagtcaaaatccaactggacaagccgttaggaaatgtatgcactgtgagataactaagacacctcaatggagggcagggccaatgggtccgaaaaccctttgcaatgcctgtggtgtccgatacaagtctggcaggctcttccccgagtaccggcctgctgcaagtccgacatttgttccgtcagtacactcaaattctcacaagaaagtgctggagatgagaaccaaaagttgtgcactagcgcccaccacaacaatggctgccaacaatttaccagagttgattccaaataaaagcaacccagcattggattatatatgagtgtcttactccgtacacatccaatcatgagtatggaaagtgttggaaaaaacgaaggtagtatatcggatacatacttttatcc

SEQ ID NO: 16153 - DNA, 884 bp, Gossypium raimondii
  Predicted polypeptide sequence is orthologous to G1852
cgggaacacagtcatttggaaaaagcctgtatggagattcgtgtctgccaaaccaaaatgaatttgggcttgaatcttgtgatgaatcaaatgaccccagtaatgcatggtactttaagttaagaagatgcgtgacgtcaacgtcttctgtgaatggtgaacatcctgttgggattattccgaagtggccagacaggctaacaagagctccttcaagggccttggtcgtgaaaaacgggattgatttgtttcgggcagacacaaggaggtggacaaggagagttgcctattataagaatactctgaatctgaagcttgggagtccagcagtacgcaatgtcatggacatgaatgcattttttggaggttttgcagcagcacttgtatcagatccagtatgggtgatgaatgttgttcctgctcggaagccattaactcttggtgtaatatatgacagaggccttattggagtataccatgattggtgtgaacctttctcaacatacccacgtacttacgattttattcatgtagctggcattgaatcactaataaagcttcctggttcaagcaagagcaggtgtaaccttgtggacctaatggtggagatggatcgcatgttgcgtcctgaaggaacagttgtgattcgagattcacctgaagtaatcgacaaagtggcacgcatagctcacgcagtaaggtggacggctaccataaatgacaaggaacctgaatcacatgggagagagaaaatcctggtagcaacaaaaaccttttggaagctaacttcatcccattgagacagacttgttctttataatgtaggtatttttcttttcgtttcaatttttttattatctggagccaagttgtcttcctcatgc

SEQ ID NO: 16154 - DNA, 837 bp, Gossypium raimondii
  Predicted polypeptide sequence is orthologous to G2124
gggatcaagtcgttgactggttgcttaatgctcgcttacatgaaatcgatgaactcccacctctgccgatgcccccaccgccggcgaactttccgatttccgatgcattttggaggactaaatcgaaagaagttacgagggatgtaatcgatgataaagatgataaacatagaagaaatgaaggtgatgatgatgatgatcatgggacacaacatgtatcatctggttcatattatcatttcgagccttctaattttcctttatcatcacatttagtaagccatggatttgcagtgcatgcgccccaggttgataatttcaacgttgtggcagcaccattgccatcagcattatcactatgtccattaccaccgccgcagccaggaggcggagcaccaccattgtttccgcctcatgtggtggatcctagacaacaagttaaccattttcagatgctgagttcaggtgcacaacagaacctcttgcttaattctctcaactttccaccgataacccaatcttttagacccttccaattgatgcctcctaggtttccccataatcaaccagataaatgaccaaaaagaaaatcaaatatcatatggggaaaaatatagtgttaatttgaatctatttacataattgcaaggcattatgggggagatgatgaaattcaagtgtgttttagattatcatgatgggcttaataatattaccaaaattccctagtataggatataatttcaatacacattcagccagaaatgtaagttttgtaccacttttcttagggctttgtgtttggtttttgcttcattttgggtggtttggaaaaat

SEQ ID NO: 16155 - DNA, 794 bp, Gossypium raimondii
  Predicted polypeptide sequence is orthologous to G2144
cgttttactcattcttctaagcttgaccttaccgccctccacgaatctaacccaactttctcgcttcacttctttaacctgttaacactgcaatttgggttgaactaaccaagtggctgctttttattttcctgaattttgaacgtgggtattttcacacttcccaaattgcctagtccccccgccctctaatggagtcgaaggcagggacgacggaaaccagatccaacataacggcgtcggacggggaccaagttgcggcactcgaatccctacaatttacagacgaattccaccgtttaatcttggctccgccatctgacaatgcgacttctctcacggctcttcttgaactcccggcttcacgagcccttgagcttcttcactctccggcttcggctaagcttatcgctgcttcggcttctagctttgaagctttaaaaggaaactttctttttccctctaataccactttgattgatcaagctgcgaggtcctctgtgtttgctggaggggttaacaacaccaataacaagagcaacgcgcctgaaacgacgtcgaacaatgcaaccttgaatcttgagaaagcagtgaagagtgagccggcggagaccgagtcatgtcagccgttggtttctgacccagcggtggagaagcggaatttcaagagaaaggatcgcgaaaagaaggctaaaggttcaacgaagaaaagcaaaactgcggcgaatgatagctcagatggccctgaaaagcttccctatgttcacgttagagctcgccggggagaagcaacg

SEQ ID NO: 16156 - DNA, 887 bp, Gossypium raimondii
  Predicted polypeptide sequence is orthologous to G2144
aagattgcagtatatgaatactcatgccatttaagtcagctcaagtcatgcggataagaggaaaagatcgtaatcggatgataatctacttcattccatggatttcagtgtcagattggaacatatggaaactgaagcttcgtttatacatgagcagctgcatcatgaatctagtagatcttacaggttttctaacagcgaagagaagattgaaaatgaggcatatggaaagaggcagcactatgaacatgattctgacctagctgatcgcctaactacagctgagaatgaggtcatttcaccatcatcatcaaaggttgttgatgatatggtcttcaacaagtatcttacagaagctagtggtcttcttaaagaagccaaagagtgtatgaagggaagacatgatgaagagcgtgtagaagtcatcttgaataggtctgcctcattactctcacaagccatctcaatgaagcccatgagcctattggctgtaggccagttaggcaatacatatcttcttcacggagaattgaaactacatgtcagtcgtgagttgaggactctttttactaaaaatgatcccataactcgtgagaggccgcaaggaagagtagttaacagactagatcaattttcatgcagagataaaattatttccctcttagttagtgcttgtgaggagtgtgaagatctccttgtgagagctgggcaaaaatatcagctggcattatcaattgatggagatgatgtgagatccctatataattggggtcttgctctgtcttttcgtgcgcagttgattgcagatataggaccagaggctgcgtatgatgctgataaactattcttggctgcaatcgataaatttgatgtcatgatgactaggg

SEQ ID NO: 16157 - DNA, 898 bp, Gossypium raimondii
  Predicted polypeptide sequence is orthologous to G2144
gggatcttgaatcgctacaatttaccgacgaaatccactgtttgatgtcggctccggcgaccgacaatgccagttccttcacggctttgcttgaactccctgctccccaagctgttcagcttattcactctccggattcggctaagctcattgccgctccagctccgaacgttgaagatttcaaaggcgggtttcatttcccttctaatggtgggctaattgaacgagcagccaggttctccgtgttcgccggcgaaggtaataacaagagcgactcgcctgaagcgacgtcgaacatttcaagtgcaaatctccagaaggcagtcaagagtgaaccggctgagaccgactcgtctcagccgttaatttccgatccaacggtggagaaccggggtatcaagagaaaagaccgagaaaaggtgaaagggcagacgaagaaaagcaaaacaacggtgaaagagagctccgacgacaccgagaagctgccttacgttcacgttagagctcgccggggacaagcaacggatagccatagcttagctgagagagcaaggagagagaagattaatgcacgtatgaagctcctacaggagttggtaccaggatgcaataagatttcgggcacagcgttagttttggatgaaatcatcaaccatgtgcagtccctacaacgtcaagtggagttcttatcaatgagactcgctgcagtgaacccaagagttgatttcaactttgatagtgtattcacggcagaaagtggattttttatggacagtaacttttctggcatggttatgcctatgatgtggcccgagattcaactttcagcaacctgtttgggggagagaagaagtctgcaataattacttaactccggagaacttgcttttaagctatg

SEQ ID NO: 16158 - DNA, 852 bp, Gossypium raimondii
  Predicted polypeptide sequence is orthologous to G2226
gtaaatgtttcatctttctagtccttttgagctttttttactttatggaatataagtggtgtataactctttttctttttttaagaagcctatcttatttcttggccataaactattaacaagatgccatttaaaaaagaaaaaaaaccatctttatcaatgttccactgatatcacatccaccagttgaattgcaggttaccagggtttagccattgtttttcatttgaagctctcctccccattgtttttaaggtcatatatttattatatattatcagcacaaaaagaaaaaaatgggtctctcaagtcttccatctccatcagaaggagtgttatgtatactcttggtaaacacagctttatctatatctatagttaaaggcataatccgatcgatccttcacgttgtcggtgtccatctcccaccaccatcatcggattacactgaaaatctctcggaatcattcgatttccaccttaatactcctgaaagttacatcgaggaattccggagtaggaccccaacaattcatttcggtgctgttttatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgcttttggtaagaagattattaccaagtatattattatgcagagttgaggaattcccgtgtacagcgcggtatataaaaatatactgttatctttatcgagtgttgtcgttacc

SEQ ID NO: 16159 - DNA, 868 bp, Gossypium raimondii
  Predicted polypeptide sequence is orthologous to G2227
ctttgaataaaaagagctctttccttcctcccttaaagactcaaaccaaacatcgtaaaaggaaatatgttcactcttttcggaatttagtttccttttttcctcttttttgtaaaagtccccctctttttttgctttggtttattaaatctgtatggcagcaacgacgtcgtattggtgttaccaatgcaatcagttcttcttgatttccaacgaagatccgattacttgccccgactgtgacggcggattcatcgaagagatcgataacatgcctcatgcagcgcgtgctctccacgctgactcccgtctcgtcggcggcgatggattcaccgcgatgtacaatagctcaactacccttcgtcgaagccggatgaacggtggcgatcgttctccttttaatcccgtcatcgtcttggcgtcaccttccggggaaagtacaaatgttgaacagagtgggagggggtttgagctttattatgacgacggaggtggattgggtttgcggcctttaccggcgagcatgtcggagtttctgttaggtcctgggtttgaccggttaattgagcagttatcacaaatggaaatccaaaacattgggcgtcacaaccaaccgccggcgtcgaaatcggcggttgaggcaatgccaatggtggaaatagacgatacccatatccataacgaactgttctgtgcggtatgtaaagaacaattcgagttaggaaccaaagttttaaacatgccttgtaaccatttgtaccattcaaactgtttactcccttggcttcggttgcgaaattcatgccccgtttgcccgcatgaattgccggcagctaaaggggaagaaggggacgggagttcaaattca

SEQ ID NO: 16160 - DNA, 826 bp, Gossypium raimondii
  Predicted polypeptide sequence is orthologous to G2227
tttgcctttatttctggatctggaatcctcccctagggtcaagcatgtcttcaacgtcttcgtattggtgttacagctgcacccgtctggttcgggtggtggttttggatagcgggtcaaacgacgccgttgtctgcccgtactgcgacggaggcttcatcgaggagatcgaatcttcggataatcacaaccgtcggtttccagctatgtacatgatcaccagcaacgataatagccgtcaaaattcgaatcgggcgcgaaatctcgtctttcgtaggaatcgtcgtggttctgttgaccggtcaaacatcaatccgatcatcgtcctccgtggctccaccgacgacgagaacggctccaccaacgggaacagcaacatcaacagcgggtttgggttcttctatgatgacggatctgggtccggtttaagacccataccgacttcgatgtccgaatctctaatgggtttgggtttcgatcggttattggaacaactttcccagatcgaactaaccggactgggtcaacccgagaacccgccggcttcgaaatcggcaatcgaatcaatgccgacgattcaaatagaaaaggcccatgtttgttcggaaacccactgcgccgtttgtaaagaacctttcgagctcgggtcggaagcgaaggagatgccgtgcaagcatatttaccatgaagattgtatcatcccatggctggcgcttcgaaactcgtgcccactttgccgtcacgaattgccgtcggatcggagcgagtcgaacgacgaggcatcagagacggtggggctgagcatatggaggttaccgggtggggt

SEQ ID NO: 16161 - DNA, 880 bp, Gossypium raimondii
  Predicted polypeptide sequence is orthologous to G2239
gaaaacgaccgttacccttacgcccgcttttcccttccatggccatcatcgtggttgtcttgatttccgctttgttctttatgggttttttctctatttatcttcggaactgctccgaagccaacgccaacggaagcgtcgtccgccctttcaatggcgaaactgggcgttctcgccgtgggatgcgtgggcttgagccgtctgtgatcgagacttttcccaccatggtttactccgaagtgaaagttcataagatcgggaaaggagctttggagtgcgcagtttgcttgaacgagttcgaagatgaggaaacgctgcgtttaatccccaaatgcgaccacgttttccaccctgattgtatcgacgcttggttggcttctcatactacctgccccgtttgtagagctaatctcgctcctcaacccggtgaccctctgagccaacccgccgagttggataacaccaccaccgagttggacctcgaggctcagaaccacgacgatgactcagaactggaagaagaaaggaggataaatcctaataatattaactccgatgcggaggctcaagttgcaccggaagttgaagtaattgacttgaaccgaactttaaataggaaccggacacgcggatcaatatcaagccgaacacgtaagttctttttcctgcgatctcacacaaccggacactctttggtccaaccaggtgaaaacacagaccggttcactttgcgattaccggttgatgttcgaaaacagttaataaaccgaaagttaaatcgagcaacgagcttggtgttgcctagggaaagaagctcacggcgaggataccgaacccggagaagacggtggggggagtagtagaggaaagctttttcgat

SEQ ID NO: 16162 - DNA, 747 bp, Gossypium raimondii
  Predicted polypeptide sequence is orthologous to G2382
aaaacaaaacatctaggcacttggccattcattcaccttgaaaaaatgacgcatcagttaaactataacatggaatgggagtaatgatcttcactaaattcagtacaagtttctacttgattttgaatgataacagcatgtattccgtgttattattgtttatcacaacggcatttggcaacaggctcccatataccatacaacaacatttaacagccaaaatctgatgaatgttataaagaagataactgggttttgcatatattacccactagcattctcaccggaggcatcattcgcctcattctcaccatgctgtagttccgcaatttcagcctgggctctctccatgatctgcctcttctgcatttccaactccctgtgaaaatccattctcatcttctccaattccaacatctgctgccttttactattctcaattttttcatatatgtcgctgaatttctggatagaatctgcaagcaatttgactgaagaatcctcgccagattgcctcccaaatcttctctttttaggtggtagtccatctgagacatcctcctcactgtcagcgaattcagaattggctggactatccctcatttcatccaaaccatttgctcggttcaaataaactcgagggttcataaatacgtattcacccgagtcaaatccgcaagagagacgaccctgctgtggaggagttgacatcagcatatccatcttcttgaaataaacccatttgct

SEQ ID NO: 16163 - DNA, 819 bp, Gossypium raimondii
  Predicted polypeptide sequence is orthologous to G2520
aagcataaaaaagaatccccttaggaaacctcactgggaagttacttaagttcgcaactccttaggtctctttctaagccatcatagatacacagttcggtaatgagatcaaacacattagagacaacaagcaataaaccccatcatctttcttcgctaataatttaaccaaactttacctttttgctgggtgatggatccaccagctatgatgagcgatggggggtacaatctagcggagatctggcagtatcccgtgaatgaatctgggttaaggaggggtcagtttgggaatgtgccgccgcctcattacgaccaccccaatccagaggtatcgggtggtgtgaggagaaggcgtgatggagaagatgaggcagctaaggttgtctccaccagtagtggcaatggcgtgagttttggtgatggaaagagacttaaagcatcaggatgtagagaggagaatgacgattctaaagttgaagcagcagaacccagttcaggcaagccagtggaacaaaaagctaaaccaccagagccacctaaacaagactacatccatgtgcgagctagaaggggtcaagctactgatagtcacagtttagcagaaagggcgaggagagaaaagattagtgaaagaatgaaaattcttcaggatctggtccctggttgcaataaggtcattggcaaggctcttgttcttgatgagataatcaattacattcagtcactacagcgtcaggttgagttcttgtcaatgaagcttgaagcagttaattcaagaatgaatcctaccattgaagtatttcctcttaaagatta

SEQ ID NO: 16164 - DNA, 919 bp, Gossypium raimondii
  Predicted polypeptide sequence is orthologous to G2522
gttttcgctacttactttctctaactacttttcttcatttttttcatgtctagattcaaagtgctttgcttgtaaacgctaaatgcatctccttggtttgttttctggctcaattccctgatcttttgcatgcatctttgaattttaactatggaaaaccataaaatatgttctaagatctatatgcttttcagctggtttattttcacccaatttggagctcttttttggttaaaattttttgtttgaaagttgattttgaaggcatcattcaagtgtataggttattggaggtgaatgcatggatcgaacgggatgccatggcattatcagggtctgcatcttactatatgcaacaaagaggaataaccgggtcagggtccgaaccggagtctgggatacacggatctccaggcattcatccgttctctagtccaaatgtacaataccaatcaagtattccagtcactactgtgggatcaaccttagctatggagtctccatcaggaattgcccctcatagtgtcaatgtaggcacaccttcagcacagccatctagtgagacagtgaaacggaaaagaggaaggccccgaaagtacggtcctgatgggactgtttcgttggcgctgactcctgcatcagctcctcatccggtgaccacaacaccgggccaaaaacgaggaagagggcggccaccgggtaccggaaggaagcaacagttagcttcccttggtgactggctgtccggttcagctgggatgggttttactccacatgtcatcaccgttgcagtaggagaagacattgcaacaaagataatgtcgttttcacagcaagggcctagagcagtatgcattttgtcagccaacggggctgtctctactgtaactcttcttcagccatcatcttcaggtggcac

SEQ ID NO: 16165 - DNA, 785 bp, Gossypium raimondii
  Predicted polypeptide sequence is orthologous to G2565
tttcccagtcatcaagggatttagcatccctttcaccactagctccaaatcaactggtggaaagcagcaccggtgtcttggcatctgaggatcacaacaagaaaactaattggcaggaatgggcggatgatttgatcaatgttgtggatccagactggagtaagattcttgataataccaatgtcttaaaccccagagtggaggtgccaaaaccttctggagatatctcaaagcaacagcctcagtttcatcagaatcaacttgtgccacatggagaattttctagccatgcttacccatcatccactgctcctcctacaaagcctcgtatgcgttggacacctgagcttcatgaggcctttttggaagctgttaatcagctgggtggcagcgaacgagctactccgaaaggcatcttaaaacttatgaatgttgaaggcctaacaatctatcatgttaaaagtcatctgcagaaatatagaacggccagatacatgccagaaacatcagaaggaacatcagagaaaagaatcacttcaatcgaggaaatgaaatcgatagacttgaagacgagtataggaattactgaagcactgcgattgcaggtggaagttcagaagcagctccatgaacaacttgagattcagagaaatttgcagctacgaatcgaagaacaagggaggtatctgcaaatgatgtttgagaaacaaaaaaaggtggaggatgaaaaaggtggggttccctcttctgcctcggatgaccttcttgcaccattaccaggctca

SEQ ID NO: 16166 - DNA, 823 bp, Gossypium raimondii
  Predicted polypeptide sequence is orthologous to G2592, G2713
catggttatccagaatagccgctgggcgagccttccgccagagctgttgcgtgatgtgatcaagagattggaagcgagtgagagcaactggcctgctcgcaagcatgttgttgcttgtgctgcagtatgcaggtcatggagggaaatgtgcaaagaaattgttagatgtcccgagttctccgggaaaatcacctttccagtttctctgaagcagcctgggtcaagggatggaaccattcaatgcttcattaagagagacaaatctaatttaacttatcaccttttcctttgccttagtcctgctttgcttgttgaaaatgggaaatttcttctttctgcaaaacggacccgtagaactacttgcacagagtatgtaatctctatggatgcagataacatatccagatctagcagcacatacattggaaaactcaggtccaactttcttggtaccaaattcataatttatgacacacaacctccatacaacaatgctcagctttcaccacctggccgaagccgaaggttctattcgaaaaaagtctccccaaaggttcccaccggtagctacaacattgctcaggtttcatatgagctaaatgtcctaggtactaggggacctcgtaggatgcattgcagtatgtactcaattcctgcctcagctgttgagccaggtggcattgtccctggtcaaccggagcttatccctcgatcccttgaagactcatttaggagcatctctttctcaaagtcaattgacaactcatctgagtttagtagtgccagattctcagacattgttggaacccgtgatgaagaggat

SEQ ID NO: 16167 - DNA, 850 bp, Gossypium raimondii
  Predicted polypeptide sequence is orthologous to G2604
ctcagactctttctacccccatcgttcccctttgtgtctcacagttgaactgtatgggagaaagcttgctgctctctggttctagacagtgaactattgaaaggagagtttagctctgtctgattttacaatgccagttccccttgcgccatatcccacacctccagcaccctacactcctcctgctgccaatgggtatggctttggcattaagatacacaggttgttatggatgtaaagtaccaatattacaagtctagtttggcttctaaaaagcttggcctcatcaacaaattggtcaaagacaggagaatttatgaattaagtcattaacctttctgcatctacaaaagttactgtatttctactctcttttttttttttttttaccttccattgacaactgatctagtggccaaacctatgctaaccaggtgctcaaagccaacttgtgtgttccggttgtcgaaatttattgctctatccagttggagcaacctctgtgtgttgtgctgtttgcaatgcagtaacagcagtgccgcctcccggcacagaaatggcacagttgtttgcggaggctgtcataccttattaatgtacatccgcggagcaacaagcgttcaatgttcgtgttgtcacactgtcaatctggccttggaagcaaatcaggtggcacatgtaaattgtgggaactgcaggatgttactaatgtaccagtatggagcgagatccgtaaaatgtgcagtttgcaattttgtgacatcagttgggggctcagctagtgctgctgaacagaagttcaacagctgagactatattagaccccaagtcaaatattaaaagcaacaag

SEQ ID NO: 16168 - DNA, 945 bp, Gossypium raimondii
  misc_feature (875)..(875): n is a, c, g, or t
  Predicted polypeptide sequence is orthologous to G2783
caaactggagaggttgcttctgtaaaacctttcagcaacaagcaaaccggtcaagtggagggctatggctttaatgagtttgtttcaagagctgctgctgagagagttttacaaacatacaatggtacacctatgccaaacggtgagagcaactataggttgaactgggcatcctttagttcaggcgataggcgagatgagacccctgagttcacaatctttgttggagacttggctgctgatgttacagattacatgcttcaagagaccttcagggcacactttccttcggtgaagggtgcaaaggttgtgattgataggatcactgggcgcacaaaaggttatgggtttgtcaggtttggcgatgaaactgaatataatcgtgccatgactgagatgaatggtgctttttgttcaactaggcctatgcgcatagggccggctactaacaagaagactggtgctgcacagcaatatccagcagcttcatctcaagggactcagaacgagaatgatccaaataatacaactatatttgttggtaatttggattctaacgtgactgaagaccatttgagagaggtattcagcccatatggtcagttggtgcatgtgaagattccacaaaacaagcgttgtggatttgttcaatttgctgataggagttgtgccgaagaagctctccgaatattgaacgggactcagttgggtggacaaagtattcggctttcatggggtcgtagcacatcaaacaagcaggcccaagcagatccaaaccagtggaacgctggatattatggatacagccaaggatatggttacggctatggcgctgccccacaagaccccaacatgtactatggagggtatcctgngtacggaaattatcaacagccgcagcaacagcaacaagtcggatatagctaagtgctgatattaactgtc

SEQ ID NO: 16169 - DNA, 814 bp, Gossypium raimondii
  Predicted polypeptide sequence is orthologous to G2854
caatctcttctcctcgtctatcgaatccgttgaaacaaccaccagcaggaggtgtagctccgccgccgcccatggcagccgatccgtctcaaacccagcagtaccagaaacaacagcagtcgcagccgtggatgatgatgtctcaacaacagcaggcgggtcagccagttcctccacctgcaggttggaatccgcaacccgtccctccgccctctcagatgcagcagtactccgctggttccgcgaccgtcggatccggcgaaattcggtctctctggatcggtgatcttcaaccgtggatggatgagaattacctcatgagtatcttcgctcaaactggagaggtggtttcagctaaggtgattagaaataagcaaacggcactgccagagggatatgggtttatcgagtttgtatcacgtgctgcagccgagagggttttgcagttgtataatggggtgccaatgccaaattctgagcagaattttaggttgaattgggcggctcttggatatggagaaaagaggcaagaagagggtcccgattacacaatttttgttggggatttagctgcagatgtttctgattacatgttacaagagacttttaaagctgtttacccatctgttaagagtgccaaagtggttactgataggactacaggccggtctaaaggttatggctttgtaaagtttggtgatgaaactgaacaaattcgtgcaatgactgaaatgaatgggatttattgttcaactagggcaatgcggattggaccagctgctaataagaagcctgtcactgatcagcagtatca

SEQ ID NO: 16170 - DNA, 769 bp, Gossypium raimondii
  Predicted polypeptide sequence is orthologous to G2981, G2982
aactaacattcgttaaaaaaaaaacattaaaaaacctaacatgtaatccctaaactcaaaatatgggtatgtggacctgtcgattgaaaattccaccttcattcccccatacccaatattacacttctcaaaagcctaacaacaaaaactaaacccttacacaaataaaatttccctcttttccacaaccttccttcaaacctctccaagccttgaaaccccctctggctccaattttccacaataaaaacctcctctttcctcacttccaaagtgattttcttttttattttttttatttgaagtcatagaaacaaacagatagaaataatatattattttgggttggaagctactattactgattatcctcattaacatttcttgatgtcaagcacccatttttcattaaggtatggtaagtggtagtaaccatattcaaaaccataaccaccatgaaaatggggagaaaaacccaactttgggaggagcttctaggtcgtggggcacgaccgtttccggtcaatccgtttcgactagtggtagtgttggctctccctcgagccggagcgagcaagctatggctacaccagctagtgagaatactttcttaagattgaaccatctcgatattcacggagatgatgctggatctcaaggtgccgttggtaaaaagaagaagagaggtcaacgtgcagttgcaggtgataagagtggcagagggctccgccaatttagcatgaaagtttgtgaaaaggtggaaagcaag

SEQ ID NO: 16171 - DNA, 870 bp, Gossypium raimondii
  Predicted polypeptide sequence is orthologous to G2998, G2999
gtatccttaaccctaaactccaaccccccacctccaaattcctttccctcgtttctctttgcttctccctcgctaattacagatgtttacaccctgcttagatggtgtggtaatggcgtaaaagcggtggcctgactctgccgtttcctcatctctttcttaaaactctcgttgaaatttggggtatgggtcgagggattttggcaccataatgctgaatacatgaatatctgaggaggaggaggaggaagagataagggaaaccaaccatatatcctagataagctacgtacttgcatcttctcttttatgaaatgcttcaagttgcacacaaaagcacgggaaaacaaatctattattagttgaactttgagcttgtttagcttggataaaatatcataaaaaagtttgcttcttttttttgtttttcaaccaactactccttaaattatggaagtgagaggccaagaacatgatattaaaacgccagggtcttcagcctttggtcttcactcgcctggagtagagagaagaaaagatgggaaccataatggtacggccgttctcacttgcactcaaaccctagatcatgttcatcatctccagaggcagcaatcactcggtcaagggagatccccacatccggatcgagtcgctgccgccactggtgctgcagctgttgctcccatttcagttggttcaaacgcaaagccgtccaacttcgtcagataccgagagtgtctcaagaaccatgccgccagcatcggcgggaatgtgtacgatggctgcggcgagttcatgcctagtggtgaagaaggaacactcgaggccttgaaatgtgctgcctgtgactgtcatcgcaactttcat

SEQ ID NO: 16172 - DNA, 839 bp, Gossypium raimondii
  Predicted polypeptide sequence is orthologous to G3091
ctgaaacgttaaaacagactcgttaccctttgagttttcccctgttgttttctttcaattacttcaagctggcgatcgataatcaagaacccactgtccgtgaaatcaagcccaagaacagaagaatcatggtatctccattctcaaaaaatccatctcttttttctcttctttctttttatgttggattcttgatctgggtattcatttgaaatgtgtgttaatgaaatgttggttttgacagggagctggtgggcctgatgaagaagacaacaggtggcctccatggctgaaacctttgttaagagagcatttctttgttcaatgcaagcttcatgctgattctcacaagagcgaatgcaatatgtactgcttagattgcatgaacggcgctctctgttctttctgcttagcttatcacaaggatcatcgttacattcagattaggaggtcttcataccatgatgtgataagggtatctgagatacagaaatacctggacatatctggaatccagacttatgttatcaacagtgctaaggttgttttcatcaatgagaggcctcagccaaggcctggaaaaggtgtcaccaatacctgtgaggtctgtgaccgtagccttgtcgactcatttcgcttctgctctcttggttgcaagattgttggcacatccaagaatttccagaagaagaagagacacttggccatggcctcagattctgaggattcatacagcagcagcagtagccatggaaagcttatgaacaacaacaacaaaatgcgaagctttagtccttcgacaccgcctccaacttcagtgaattcccgaactgcgaaac

SEQ ID NO: 16173 - DNA, 881 bp, Gossypium raimondii
  Predicted polypeptide sequence is orthologous to G3967
cttggttacaagcggaaatactcatttcattgctaaaaatgttcaagctaaacccaatcatacaaaactaaatggatcttctatcgagtatggacatggtatcgactcagctattcatcatactcgcagaatcttagcgattttagaggcactcttttcactgaagccgtcttctgttggcacctcatggacttatagttcgaatgaaatagttgctgcagctatggttgccgctcatgtttctgaactatttagacagtcaaaggcttgtatgcatgcgctctctgtcctaatgcgatgcaagtgggacaatgaaatttacactagggcatcatcgttatacaatctcattgacattcacagcaaggcagttgcatccattgttgacaaggctgaaccattagaagcacaattgatatatgcacctgtttgtttagatagcagaacacgaagcaaacgtacaaataccgcttgctgtgatcctcctcgagtatcttcttcagaatatgaagattcaattcatccagccaataatctcagatgtcagatggtgttaacatcagatgaaggcttaggaaattccacgggcaaaagtgtagaaagtttcccgttagatgcctcggatttggccaattttcttacaaaggataggcacttaggattcaattgcagtgcacaaattcttctaagatccttgcttgtggagaagcaagagttatgtttctctgttgtttcactattgtggcacaaactgatagcagcccctgaaacacaacccagtgccgaaagcacttctgccccacagggatggagacaggtggttgatgcattgtgcaatgtcgtatcagcatctccggcaaaagcagcaactgcagttgttc

SEQ ID NO: 16174 - DNA, 868 bp, Gossypium raimondii
  Predicted polypeptide sequence is orthologous to G3967
atggaattgcagccatggattgccaaaaacgatgatcaaggtcagaagatgtggagaatcaaccagcggattgtaaagttgatagtggaactaatgagaaatcatgatatcccggaatcattggtaattgtagcaagtgcctctgatttgcttctacgtgccactgatggaatgctcgtagatggggaagcttgcactttaccacaactcgagctgttggaagcaacagctagagcagttcagccagtactagagtggggggaatcaggactggctgtcgtggatggactttcaaacctgttaaagtgtcgtctgccagctacaactcgatgtctttctcatccaagtgcacacgttcgtgctctcagcatatcggtacttcgcaatattctgcaatcaaatcctaagctggaaataaatggtatccatggtccttatttcagtatcagtgtcatcgattggcatactgatatcgagaagtgcttaacatgggaagctcatagtcaacttgcaagaggaatgcctatacattttctcgacaccgccgccaaagaactaggctgtaatatttcgatgtaacatgaattaaccttcgaatccttttcaggtccgactacatagaggaatataatagaactttctcccaagtgggttgaactgaaggatatggggatgaagcctttgaaggttgtgaaaagcatgcaatacaaggactctgccacaccaaggttttatgtcactaatcttactttgactataaattagctttgttatattataggccaagattcccatttgtttgagggattacagtatgtaatttcagttaacttctatggtttcaatcagttgtatttggatagtttag

SEQ ID NO: 16175 - DNA, 575 bp, Malus x domestica
  Predicted polypeptide sequence is orthologous to G28, G22, G1006
cttctcaattccacacacacacacacactctctctctcttcttttttgttagcctagtcatccaaattaaggacaaagctaacaagcaaagatggaagaacaacctcagcactacacaagctgctgctcattgacggtgaacaatattagcagtccatgtatgatgccgtgcttaacgcaacaatggggagatttacccttccaagtcgacaattccgaggacatgatcgtctacaactccgttcatgatgctcttagcctgggatggtctcccgaccacactttacccttccaagtcgacgattgggatgacatgatcgactacaactcccttcacgacgctcttagccccggatggtctaccgaccactcctgggaatgtgtgaaacccgaacagacgtatgatcttgatcatgtttttggacaaagtcatgatcagctgccacctgatgtttgcactcaatgtgaaccccacgattgtaatgttcccattaatggaaacgaaccctgaccaaccctagtactgccacctgatactgatattgctacgatggatcatgacgatcgtgatcaaa

SEQ ID NO: 16176 - DNA, 452 bp, Malus x domestica
  Predicted polypeptide sequence is orthologous to G481, G482, G485, G1364, G2345
ttttttttttgaccgcagaagcatactttgtcattcaactcagattcaaatacatcatactatcagtattaaaacttaacaactttaccaccttcgagttcttaaaaatgatatgtgacaaaattaaaaacttctactcattgcttcgcgtggaatgaacaacgagatgctgtgccgggattgcaaggtatcatggaacccatcatcaagatcaattgcacattgaccacaagccatgttcactcgcaaaagcgtcaatttccatttcccatattattcaagggcacataataatcctcttgagggttgccatagttcaatgctccctgatggacaaactgtgaacttgggccaggcattgctggaacagcattccctttaaaagaaccatctccacccctagctgagccctttgcatcaccctcagtctccctgtacctactcaagtaaat

SEQ ID NO: 16177 - DNA, 660 bp, Malus x domestica
  Predicted polypeptide sequence is orthologous to G481, G482, G485, G1364, G2345
gtatacagtgaatcgttgtgagtaatggcggaggcaccgacgagtccggcgggcgggagccatgagagcggcggcgagcagagcccccagggaggaggaggaggaggaggcggtagcggcgtcagggagcaggatagatatttgccaatcgccaacatcagtcgcatcatgaagaaggctctgccgaccaacggcaagatcgccaaggacgccaaggacaccgtccaggaatgcgtctccgaattcattagcttcgtcaccagcgaggccagcgataagtgccagaaggagaagcggaagaccatcaacggcgacgatttgttgtgggcgatggccacgttagggtttgaggactatatcgagcccctcaggatttacttggctaggtacagggagacagagggtgatgcaaaggggtctgctaggggtggagatggttcttcgaaagggaatgctgttccagcaatgcctggcccaagtgcacagtttgttcatcagggagcattgaattatggcaaccctcaagaggattattatgtgccattgaacaatatgggtaatggaagttgatgcttttgcgagtgatatgaggaagaagagaggacatggattgtggtcaatgtgcaattgatcttgatgatgtgttcctcgatatcttgc

SEQ ID NO: 16178 - DNA, 726 bp, Malus x domestica
  Predicted polypeptide sequence is orthologous to G867, G9, G993, G1930
cgttgctgtcgagccctcatccgccgaacccatttcctccgacgacgaagaaaacgacgacgccgaggccgcgtttctgagctcccactctaagtccgaaatcgtcgacatgctgcgaaagcacacttacaatgacgagctggaacagagcaagcgcaacaactccgcttatgggaagcggtctcggtccaacggatcactgggcctgttcggtacggacaacagtggagtcccgaaagcgcgtgagcagcttttcgaaaaagccgtgaccccgagcgatgtcgggaaactgaaccgcctcgtgatcccgaagcagcacgcggaaaagcactttcctttgcaaagcggaagcgctgcaaccttaacggtaagcgcttctaccgcttgcaaaggagtgcttttgaattttgaggatgtcgggggcaaagtgtggaggtttcggtactcttactggaacagcagtcaaagctacgtgttgaccaaagggtggagccggttcgtgaaggagaagaatctgatggccggggacattgtgagctttcagaggtcgaccggaccggacaagcagctgtacattgattggaaggccaggatgagtgtgaataataccaacaataatgggtcaagcccggttccgatggttcggctatttggggtcaacatattcaaaaatacctgggagcagcgggcccgggtcagcggatgcagctgcagctgctgctatcg

SEQ ID NO: 16179 - DNA, 763 bp, Malus x domestica
  Predicted polypeptide sequence is orthologous to G867, G9, G993, G1930
ttttttttttttttttttcaaattaatttgttgcacctaatttcaaaagctttgctttcttcagctcagcttttttctttttgtcatctaatatacatttcacctttcttgcagcttcacagaatgctaaaaaaaacaaagaaaaattttaaaaatgctacaaagctccgatgatcctaggcttcttgctaaactctaatttcaaaaactccatctctctcattcttttgccgatattattattgcaaccgccgccaatagcagcggcagctgcagcatccactgggccagccccgctactcccaggtattttgaatatgttgaccccaaatagccgaaccatctgaaccggtgcaagctgaccttgaaccgggttcgacccattactgttattatacacactcatcctggtcttccaatcaatatacagatgtttgtccggtccggttgacctctgaaagctcacaatgtccccggccttcaaattcttctccttcacgaaccggctccatcctttggtcaacacgtagctttgactgctgttccagtaagagtatcgaaacctccacacttttcccccgacatcctcaaaattcaaaagcactcctttgcaagcggaagatgcacttaccgttatggttgcagtgcttccgctttgcaacggaaagtgcttttcggcgtggcgcttcgggataacaaggcggttcaccttcccaacatccctgggggtcacgggttttttcaaaaactgctcacgcgcttt

SEQ ID NO: 16180 - DNA, 467 bp, Malus x domestica
  Predicted polypeptide sequence is orthologous to G867, G9, G993, G1930
tttaaagcaccttcttatctgtcattctatctctctgtctctctctctcctctccaccttcgaacacacaacatacataatcaacgaaacaagaacaatggatggagtaagtagcacagaagagagcacaaccagtgactccatatccatttcgccaccccatcatattgttacacgtgtggagccacttgccaagtcagcgccccaagtggacagcctctgccgcgtcggcagcggggccagcagcgtgattctcgactccgacctcagcagcggcggcggcggcactggtggcgtggaggccgagtcccggaagctcccttcctccaagtacaaaggcgtggtcccacagcccaacggccgttggggggcccagatttacgagaagcaccagcgcgtctggctgggcaccttcaacgaagaggacgaggccgctacggcctacgacgttgctgcacagcgcttcc

SEQ ID NO: 16181 - DNA, 661 bp, Malus x domestica
  Predicted polypeptide sequence is orthologous to G1988
ccaaatcgtctcgagacttcgattcctcctctacgctccgcaggaaatcgagaaatgaagaaagtttacagggcttgcgagctctgcgaccaggaagcctctttctactgcccctccgactccgccttcctctgctcccgctgcgacgcccgcgtccaccaggccaacttcctcgtcgcccgccacctccgccagcctctctgctccaactgcaaatctgttgcaggaacccgcgatctccactctctctgctcctcctgctcgcctgaatttttttccggtgactgcgacggcgacgccaagtcgtcttcgtcgtcggattgttccgcctgcatatccagcacagaaatggggaccacaaagaccgggtatgagaatcggaaatccgagagctccgtgacggatgtttccggttcgaatgttccgtacaaattctcaggcatgaagaggaatatcctgcccaaattctccggcgccaggaggaataatagcgtaaggagggcgcgagcgcgaacttcgaggagcgtggatgcgaaagcggagggcagtttcgtaaattggtgtaagaggcttggggtgaatggtaatttggcggaatcggtggtttcgaccgcgtcaaatgcgtttggattttgcctggagcggttggcgagtgtgcctc

SEQ ID NO: 16182 - DNA, 644 bp, Malus x domestica
  Predicted polypeptide sequence is orthologous to G2
cttcaatctcaagtcccagctgaaatgcataaatatgggcagttcagtagtaggaggcctactgccgaagacattcaaatgcctcacaatttcccaccacatttcaactcaccaaattatcatcatattcagtttccgagcagcagtgaaggagggggccgcattggcagtgatctttcactgtcaatgagcgaccaccaccaacaatggcaatccgctactccgacctccgatttatttgcaactgctgcagcatcatcaggattcccaccacaaattagaccgtcgtacacacaaaacggctggctgcagaaaaatgggttccactctctcaccagacgctaattaaagctagcttagctctctttggtcatgaccccttttaatcaagatttttctgcctaattaccaccatcatcccccacctccccgattctaatttattacgatcaagtcctcttgattctgtttattttgtaagcaccaaaaatccagttctttcagtgctccaaaacatagacaaattttagtaacaaggacaggaaattctcctattttttggagaaatgaaatcaaatgtatgctctcattggtgtttaccaaaacaaaaaaagaacaatacttgactatttaaagatgagtag

SEQ ID NO: 16183 - DNA, 2234 bp, Malus x domestica
  Predicted polypeptide sequence is orthologous to G2
ggcagtttagtcgccactccaacacaagatcctgcatcacctccactctctctctctctagctccatagctcgtccttatagctctcctctctttctctctctaacttttttcctcttcggggagtttccttgttcaagttgatgcctttttgccacgctgaattctgagtttgatgtaaaaaacgaaaccgacacttaaccagacagctggtaggcaagcgagagacagggaagataaaaaaaaaatgtgggatctcaatgactcgcctgatcagcggccacgtggcgaggaatctgaaggctgctcctcccagaagacctccgccgacggagacgaggaaaagaggaaacgggtcggatccgtgtccaattcaagctcgtcggcggtggtcatcgaggaggacggatcagaccaagaggaagatcaggacgacgggcccaccaagctggccaagaagcaaggaggaggtgggggaaagatattcgggttctccgtggcccacgaggagtccatggatagtgatccgcccgcgaccgtcaccagacagttctttccggtagagctagactattcctcctcctctaatcttgacgtaatggggcccgcagagggcggcggtagcatcccaccacctccttctacatcgtcgtcgtttccccgagcccactgggttggggtcaatttcgggcagtcggattcgggcagccccggaaatccgccgcccgccggggaggcctcccaccagcccatgaagaagagccggcgtgggccccgctccaggaactcccagtaccggggtgttacgttttaccggaggactggccgttgggagtctcatatttgggattgtgggaagcaagtttatcttggtggatttgacacagcgcatgcagctgctcgggcgtacgacagggcggcgatcgagttccggggagtggaggcggacataaattttagcatagaggattatgaagaagacttgaagcagatgaggaatttaacgaaggaggaatttgtgcatgtacttcgccgacaaagcaccgggttcccgagagggagctctaaatatagaggggtcaccttgcacaagtgtggcagatgggaggccaggatgggccaatttttaggcaaaacatacgtttatctgggattgtttgacactgaggttgacgctgcaagggcttatgacaaagcagcaatcaagtgtaatggcaaagaagctgtcacaaactttgatcccagcatctacgataacgaactcaactcctctgaatcatcgggtgttattgctgcggatcacaatctcgatttgagtttgggtagcacaaactcaaagaaaaacaatcaagcattagggaatgatcatcatagccaaaatgttgcaatggaacaccagcattctgtctcgatgcaacttgatgccaattggaggagtcaaggacttcggcctaagcttaacatacaacgagatcgatcaagagacgacattgatgctcagagaagagacgggtactcggagagtgaagccatgcagcttctactccgaacaaaccttcaatctcaagccccagctgaagtacataaatatgggcagttcaacaggaggcttactgctggagacattcaaatgtctcacaatttcccaccaaatttcaactcaccaaattatcatcatattcagtttccgagcagcagcgaaggaggcggccgcattggcagtgatctttcactgtcaacgagcgaccaccaacaacaatggcaatccgcaactccgacctccaatttatttgcaaccgctgcagcatcatcaggattcccaccacaacttagaccgttgcccacgcaaaacagctggctgcagaaaaatgggttccacactctcgccagacgctaattacgctagcttagctctttgatcatgacctcttaatcaagatttttctgcatctccacgtccccgattcttgttaattacgatcagtcctcttgattatgtttattttgtaagcaccaaatcggcaagtctagttctttcagagccccaagtcaaagattttagaacaaggacgggaaattctcctagtttgtgggaaatgaaatcaaatgcatgctctctttggtgttttaccaaaaacaaaatgtatggtcattttgtccaactaacaaatgaatggagtagatcttcaactagattttctgattctgacgacaaaaaaaaaaaaaaaaaaaaaa

SEQ ID NO: 16184 - DNA, 582 bp, Malus x domestica
  Predicted polypeptide sequence is orthologous to G4
gacgaggacgatgaaatggttgatttcaagccctctgctttctctgccggaaacccctcttttgctcgtggttctaccgctgtgaaatctgtggagtttgatgggcaagctgagaaatctgcaaagataaaaaggaagaaccagtacaggggaattcaccagcgcccatggggtaagtgggctgcagagatccgagacccaaggaaaggggttcgggtttggcttggaacattcaacactgcacaagaagctgcaagggcgtatgatgccgaggcacgtagaattcgcggcaagaaagcgaaggttaatttccctgaacaaactccttgtgcttctgcaaagcgttccatcaaggaaaatcctcacaaattgatagccaagacaaacttgaatggcactcactctaatctgaaccacaatttcaattttgtgaacgactcaagtgaggactactacagtgctctgggttttctggatgaccacccccccctgaataactttccatacctgtcccccttccctgccaatgaagatgttgcacctgactcctctgtctcatcaccacatgcccctctttttttc

SEQ ID NO: 16185 - DNA, 682 bp, Malus x domestica
  Predicted polypeptide sequence is orthologous to G4
acccaacaaagaagatgaagcctaactcacaggatctggagcctcctgaggataattcgggaaagacactgtctgatgagctctcagcttttgagatgaagtactttcagaccccatatctcgatgagagctgggatgcttcagtggacgcgttcctcaacggtgacgcaactcaggatggtggtaatccaatggacctttggagctttgatgatctgcccgcaattgttgggggagttttttaagcgatgaacctttccccacctttctagtttatgtaaataaagctacatgttagtgagtttttcagtcctctgtgagcttctacattgtttcattattggtctcgtgttcgctcccattttctccagaaagagttgtcggtttcctttacttgtgcttgcaggatgtgtttcgggttggagtgcaactgtgtaggctgttgaacatgcataaggcctgtgcggggagtattttaagccgtagctaatgtcatatggagagcgtataggtattaggtttactttcacctccaaagagcttgaacttgtggtttctcaactttgatgtttgtattgatgaaattgtgtgagctatgatggaatactgaaacctcataaatctgtacttgtttaaatttattcaggtcttttcttttacaaaaaaaaaaaaaaaaatgcgt

SEQ ID NO: 16186 - DNA, 748 bp, Malus x domestica
  Predicted polypeptide sequence is orthologous to G4
gaattccgttgctgtcgaccagtacaggggaattcgccagcgcccatggggaaagtgggctgcagagatccgcgacccaaggaaaggggttcgggtttggcttggaactttcaacactgcagaagaagctgcaagggcatatgatgccgaggcacgcagaattcgtggtaagaaagccaaggttaacttccctgaagaaacccctcgtgcttctgcaaagcgttctgtgaaggcaaattctcagaaactgatacccaagacaaacgtgaatggcactgagtctaatctgaaccagaatttcaattttgtgaacgactcaagtcaggactattacagtgctctgggttttctggatgaaaagccaacattgaataactttgggtatatgtctaccttccttgccaatggagatgttgcactgaaatcctctactccatccgatcctgcccccttttatttgagttccgatcagggaagcaactcatttgattgttctgacttcggctggggagaacaaggctcaaagactccagaaatctcatcagttctttcttctgtgatggaagaaactgatgactcactgtttctcgaggatgctaacccaacgaagaagctgaagcccaactcacaggatctggtgcttcctcaggataatgcaggaaagacactgtctgatgagctctcagcttttgagatgaagtactttcagaccccatatcttgatggggagctggggatgctttcagtg

SEQ ID NO: 16187 - DNA, 619 bp, Malus x domestica
  Predicted polypeptide sequence is orthologous to G5, G974
cgatttatctgatctcttgagggaagatcagctcatgaaagcacttatgccttttatgaaaagtgcttcttcaacatctccttccacttcttacacttaccctcctcagaacaaccaaaacttcaacttgtaccctgacttctgctcagcacctatgatttcacaagcaggtgttatagggcttaaccaacttaccccatctcaaattcttgaaatccaatcccaaatggtcctccaacaacaccaacaaaagcaacagatttctgcttttgcttcttcagctgcttaccttaagctgcttagtacaaatgcactcccaatgaagaaagctggcactccctccaaaccgacaaagctctacaggggagtgaggcagaggcactggggcaaatgggttgctgagattagactccccaggaaccgaacacgtctttggcttggtacatttgacaccgctgaagaagctgctttggcttatgataaagccgcttttaagctccggggagactttgcttgccttcatttcccccatcttaagcaccaaagggctcatgactccggcgcctttggccattacaagccccttcattcctccgtcgatgcgaagcttcaagaaatt

SEQ ID NO: 16188 - DNA, 513 bp, Malus x domestica
  Predicted polypeptide sequence is orthologous to G5, G974
tcgacaccaagcttcaagccatctgcgaaggcttggccgaaactcataaacagggcaaggcagcgaagcccgccaagaggtcatccgctgcaacgagccgacagccggccccgaagactttggccgtcaaggttgaaacctcgtcgccggtgattactgatagcgaggggtctgccgggtcttcgccgctttccgatctgactttcggcgactctacggagccgtgggagaacagcggcgcttccgagagcactgccgtgttagagaagtacccgtccgagattgattgggcttcgatcttcagttaattagtgttgttaatcatgtttaattgtaattgggtatgttttagttacaagtaattaagttgattgggggttctagtggctactgcaatcaagtttttgggatatgcagagctacatttgaattagggttttagttggtccaattggggttttagtatgttaatatgatgtacaacatctccgccatggtgggctggtttttttc

SEQ ID NO: 16189 - DNA, 516 bp, Malus x domestica
  Predicted polypeptide sequence is orthologous to G5, G974
cccaagcccatcccgatgaagcaggtgggctcggctggttcgccgccgaaacccaccaagctttacaggggtgtaaggcaacgccactggggaaaatgggtcgctgagatcaggctccctaagaaccgaaccaggctctggctcggaactttcgacacggcggaggaagccgctttggcttacgacaaggcggcgtacaagctcagaggcgacttcgccaggctcaatttcccgcacctccgccacaacgggtccgtcgtcggaggcgagttcggcgagtacaagcctctgcattcctcagtcgacgccaagcttcaagccatctgcgaaggcttggccgaaactcacacacagggcaagtcggggaagccagccaagaggtcctccgccgccagccgacagccggagccggtgactttagcggtcaaggttgaaacctcgtcgccagtgacgactgataacgaaggatctgccgggtcttctccactatccggattaacttactgtaaacccaac

SEQ ID NO: 16190 - DNA, 607 bp, Malus x domestica
  Predicted polypeptide sequence is orthologous to G12, G24, G1277
atacaaccttggtggccaagtagcatgcaaaaaaccccctcccacctttctctctctgtctctctctctgtctctctctctctgtcttccaaaaagcagagcacccctttcgcactctcagaccgacatcaacaattgaaggagaacaattgaagatggagggcggcggcggagaggctgcgaataggaagagagctggggtggacaacgacaagccgtacaaggggatacggatgagaaagtggggcaagtgggtggccgagattcgtgaacccaacaagcgctctagaatctggcttggttcctactccactcctgtcgccgccgctcgggcgtacgacacggcggttttttacttgcggggtccctccgcgcggctcaattttccagaggctttgccggtcgaaggtggctgcgggtgcggtgacatgtcggcagctttgatacgcaagcgggccaccgaggtcggcgcccgggtagacgcggtcgaaacggctctgcgacaccaccgcggttcggcggcagggaacggagacggcgatgagattaaaccctgcttcgccggatgcgtggatcgggtcgacctgaacaagatgcccgaaccgga

SEQ ID NO: 16191 - DNA, 681 bp, Malus x domestica
  Predicted polypeptide sequence is orthologous to G12, G24, G1277
atttcaacttcttttctgattttttttttttttcatttgggttttcttgttttgtatttttaggatatatagcttctgaaaaaactacaacgacatcagaaaatctaagggtttggaatctttggatccatattagtcatattttagataggttaaattctttgccatggaaggagattactgctgctcttcgtcgtcttcttcctcaacgtccatgagcatggagaagcgcaagcatcccgatcaccaccaagaaaagcagtacagaggaataaggatgaggaagtgggggaagtgggtggcggagattcgagaacccaacaagcgctctcgaatttggctcggctcctacacgacccccgttgccgccgcccgagcgtacgacaccgccgttttctatctgcgaggcccttctgcccgcctcaacttcccggaacttgttttccaagacgacggccagcagccccacgacatgtcggcggcttcgataaggaagaaggcgacggaggttggggctaaggtcgacgctgcccaaaccgctctccactcatcgccgacgtctccatccaaaacggcgtcgagccggggtggctctcagaagcccgacttaaatgagtacccagacccaaaaaactccgatgaaagttaataaaaccgaacagagctttagggatgaggccg

SEQ ID NO: 16192 - DNA, 609 bp, Malus x domestica
  Predicted polypeptide sequence is orthologous to G12, G24, G1277
ttttttttttttttttttaaaattcaaagactataatttcaagaaaagaaacattactgatcgcccttcagttggtttgttgttacaatttagaaactacatcaaattaccaatcgaaacggaattcttgtgattccatttcctgatcggacccaataacaccttctctgtattttcactttattgcacacctaaatacctactcataacaataaacagctggtgatcggtcggccttctcaattaactttcatcggagttttctgggtcggggtactcatttaagtcgggcttcaaagagccaccccggctcaacgttgttttggactgcgacgtcggcgatgagcggagagcggtttgaacagcgtcaaccttagccccgacctccgtagccttcttccgtatcgaagccgccgacatgtcgtggagctgctggccgtcgtcttggaatacaagttccgggaagttgaggcgggcaaaaaggcctcgaaaaataaaaaaggcggtgtcgtaagctcgggcggcagccctgggggtcgtgttagaacccaacccaattccaaagcccttggtggggtctcaaatctcccccccccccttcccccactt

SEQ ID NO: 16193 - DNA, 547 bp, Malus x domestica
  Predicted polypeptide sequence is orthologous to G15
gttgacacatgtcgcgctatgattgacttgtgatgtcgacacgtgtcgcactgtgattggcttcctggttggagggaaactcttatgggttcttgacggtataacgttgaccggtgctcaatagtttcgggattagtcaagtatggtacaaacaaaactaattagggttcagtttggtgaagcttgaagagggagagagatgattatattctgaagaagatcgaagatgctgaaaagggattggaattagtttgtgcaaacgagattgttgtgctccctaaatacaagtaaattatgtatgtggcctgaatttgagttttacgatttcaattgacttatattatatgatcgaactatttactcagcttctgtattttcaacgtttgtaagtccattatgtttgatgatggtgatatatgcgctatcgtatgtcatttaactgataggccagagatacattgctcaaggtaatatgactacgactttgcaggttgtcattatttgtatgccttcatatgttgtgctgtaggtcatgtataagtttgag

SEQ ID NO: 16194 - DNA, 617 bp, Malus x domestica
  Predicted polypeptide sequence is orthologous to G15
gaaaaagcagtggattctcaagaggggcttcaatgtatagaggagttacaagacatcaccaacatggaagatggcaagctaggattggaagggttgctggaaataaggatctttatcttgggacattcagcactcaagaggaagctgctgaggcttatgacatagctgcaatcaaattccgaggactgaatgctgtgaccaactttgacataacacggtatgatgtggaccgaattatgtcaagcaataccctccttgccggtgaacttgctaagcgaaataaggaggttgtacccattaatgaggctactaatgaaaccaatgtttcgcaaatcggcaatggggaagccgttgtcccactgaagaatattagtgaaggggaagattggaaaatggcactctatcagtcctcccagcaacttgatcagaagcaaccaagcaccgaaactcagaatgtgattcaagcccaggcagaggactctaccaaaatggggaatgctcatttttccaatgcctcttcattggtgacaagcttaggcagctcaagagaagcaagccctgataagtcaagccagcctagtttcttcggaatgcctccatctgcttccaagtttttc

SEQ ID NO: 16195 - DNA, 741 bp, Malus x domestica
  Predicted polypeptide sequence is orthologous to G15
ccctcccaggaccatatcattaaccataattcactccactaagataaaaactacatgagctattgtttgcatgtaatttagtgaaaaaaactttccacggatgagcaaaaaacacatagcctatggctatggctatgcatctgtccaggctgtgaaaatccgcatgtgaggattggtgagtgctggcctggattggactgttgggatccaagaactcactgcatcacttgaacttgtgaaaaacttggaagcagatggaggcattccaaagaaactcggttggcttgacttatcagggctcccttctcttgagctacctaaacttgtcaccaatgaagatgcattggaaaaatgagcagcccccattttgccagagtcctctgcctcggcttgagtcacattgcgagtttcagcactcagttgcttctgatcaagttgctgggaggactggtagagtgccatttcccaatcttcaccttcactaatgttcttcagtgagacaacggcttccccattgccgatttgggcgacattgttttgattagtagcctcattaacgggcacaacctccttgtttcgcttagcaagttcactggcaagaagggtattgctagacataatctgatccacatcataccgtgttatgtcaaagttggtgacagcattcagtcctccaaatttgataccagctatgtcataaccctcaccagcttcctcctggggtgctgaatgtcccaaaaa

SEQ ID NO: 16196 - DNA, 583 bp, Malus x domestica
  Predicted polypeptide sequence is orthologous to G19
tgagagggctcttttttctctctaagtttctacaagtggcaatataaacatgtgtggtggtgctatcatttccgacttcatcgccgtcaagcgcgccctgaagctgacggcggaggacctctggtcagatcttgacaccatctctgacctccttggcatagactactccaacagcatcaacaaacagccggagaatcacaaggtggtccaaaagccgaaaccatctatcaccaaagtgacaagtgatgagaagcccaagcaggcaagcgggtctgctgctgccgcaaaaggcaagagagtgaggaaaaacgtgtacagaggaataaggcagaggccgtggggcaaatgggcggctgagattcgcgacccctacaaaggcgtccgggtctggctcggcacctatgacaccgctgaggaagccgcccgcgcttacgatgaagccgccgtgcgcatccgcggggacaaggccaagctcaactttgcccaaccaccatcctcttcaccgcttccatctctggcgccggatacgccgccgccgacaaagaggcggtgcattgttgctgagtcaactcgggtggagccg

SEQ ID NO: 16197 - DNA, 815 bp, Malus x domestica
  Predicted polypeptide sequence is orthologous to G19
atgagaaagctcttttttctctcaaagtttctacaagaggcaacataaacatgtgtggtggtgctatcatttccgacttcatcgccgccaagcgtggccggaagctgacggagaaggacctctggtcggagcttgacaccatctctgacctcctcggcatagaccactccaacagcatcaacaaacagcctgaggattacaaggtggtccagaagcccaaaccatcagtcaccaaagcgacaagtgatgcgaagcccaagaaggccaccggggcagctgccgctgctgctgcagaaggcaagagagtgaggaaaaatgtgtacagaggaataaggcagaggccgtggggcaaatgggcggctgagattcgcgacccccgcaaaggcgtccgagtctggctcggcacctacaacaccgccgaggaagccgcccgcgcctacgacgaagctgccgtgcgcatccgcggcgacaaggccaagctcaacttttcacaaccaccaccctcttcactgcttccacctctggctccggctacgccgccgccgacaaagaagcggtgcattgttgctgaatcaactcgggtggagtcgactcaaccgagtttccacaccggttcttactattatgatacattttatcagggtgacggtgaatatgtatgctaaaaaatgagggggccgaaggtgacggaaggggtatgtaccataaggaccaaataatcgaagcttggaagtattttattttgaggtctgggaaaaaaggtggtggacaaggaatcacaacccaaccccaagcccggcttattacttcaaata

SEQ ID NO: 16198 - DNA, 495 bp, Malus x domestica
  Predicted polypeptide sequence is orthologous to G21
ggttttgcttatctcaatttccctgaattggctcaagcacttccccagccagactccaagtctccaaaggacatccaagctgctgctgccaaggcagctgctgcttctgcttctgaggataagcagcttatatgtgaagcagaaactaaagaagcggagcccaagatccctatatcaacaaattcaaccttgtccaatgctcaagaatcaagtagcacttgtgcttctggttcaacagattacgatgatgagaaattgtttgacctaccagatcttttcatggatgggaaagatggaagtgatattttttgcaattattcttcttcaacttggcatttgtgtgcagctgacactggattcaggctaggggacccattcttatgggagtattagttagccagtacagattaaggactgtatttttctcttttttatttaatttatttttatcaaacataaataattaagtttcaaaaaaaaaaaaaaaaaatcggt

SEQ ID NO: 16199 - DNA, 617 bp, Malus x domestica
  Predicted polypeptide sequence is orthologous to G25
taattaacaatctaatcaaagattaaacgcctccaatacagattaatcaggaagaaactaatgatcaaaatcatcaattttgcccgactgactcaatttacgatcgcttaaattaaaacaaactaataaaagcagacaacattaatcacacggaagcaggaacgctctcgtcgtcaacgaagctccaaaggtcatcactgacggtgctttcttgaggcggaggattctggggagtcgccgtgaactgcccgtccagataaggaatctgatagaatttcatcatgttctcgtacgccattagctcctcagaaagcttctgcacttcgtcatcttccattcttgcaatcgcctccaagctcaattccccttcttgtgtttcctccacttctgtcagctcagatccgccttgacaaccgcccatcccgttctgattgcaacccagcaaccccttcgaggagaaagcgccatctgaaccagaccaagagttttcttccccggaaataacaattgggtcggtgttcgcaatggccatggagttaaacccatctgaattggaattggagggaaatgccgcaaactggttcagatcatacccaaatcccaattcaaagcttttg

SEQ ID NO: 16200 - DNA, 701 bp, Malus x domestica
  Predicted polypeptide sequence is orthologous to G43, G46, G1419
agctgatgcaaggcactaccggggtgtgaggagaaggccgtggggaaagtacgcagcggagattcgtgacccaaacagaaggggatcccgggtttggctcggaaccttcgacaccgccattgaagccgccaaagcttacgacgttgctgctttcaagctgcgtggaagcaaagcaattctcaactttccacttgaagctggaagatcagcagaactctcagccgatcatcctctgctggtcagcagaaaaaggaggagagaacggatcaccgaaagtcatgagagttccggtgagatgatcagaaacaaagagataaagaaggaggaggatgttcaggatgtaaaaatccccgcccaagagagagtttcgaccgccgtttgcccattaacaccgtcaagttggacggcggtttgggatctgagcaaagaaaacgaactggggattttcagtgtgcctcctctgtctccgttatctcctcaccccaatttcatgggatattctcagctcatggttacttgaacttttaatttatggttatcattccttcattgccagagtttaatttgtatcatccatctgcaaaaaagcagcataaacagagtactgtaaatagtccagagcaatatggattgaagaactcatattgttttttaagtttgatttgtttatatattcctttaatctttgtataatgaaatac

SEQ ID NO: 16201 - DNA, 618 bp, Malus x domestica
  Predicted polypeptide sequence is orthologous to G43, G46, G1419
cacgaggttaataaatttgtacatacaaatttgatacggtagaatattacagaccatgcatatagtaaatcagtaaatccgtcctccaatcatattctaacatatcggcagaggaggatcctgagattaacacagctccttcaagtgccttctccttcccaaagcacccaactttgaagctccagttcttcagtctcagctacctcctcctgctttaccgatctcctcctcttccgcgccgtgttcaccggcggttccgacactccggcctccaacggaaaattcagtattgctttcctacccctcagcttaaatgcagcacaatcataggccttggcagcatcaacatcagtgtcaaatgtccctagccaaacccgagtacctttccgggccggatcacgtatctccgccgcgtattttccccacggcctccgccggactcccctgtaatgccttaacgcatcaccagggcctgaaacctgttgtaattcatcttttggaccgggattttgagaagtactattttttctctttggtgagctcaaattcaggggctctacttccatggatggtaagttaacgaatttttgggtttcgtttcggaatttgagaattggg

SEQ ID NO: 16202 - DNA, 413 bp, Malus x domestica
  Predicted polypeptide sequence is orthologous to G44
gaaggcggtggtggctgtaaagaaggagaagttgacggaaactccattgacgccgtcatgttggatggcgttctgggactcagagaaggaggacgtgaaaggagtttttaacgtgcctccattgtcgccgttatctcctcatccagccgtgggttgtccacagcttatggtcgtatgagggattgaacgttggtgtgtgattagaaattagaagctggttttttatttttattgttttgaattatttagaaagaataaaaaaaaagctatataaattgtcccgtacatgatatatgtgcgtgagattttccgacaactaagggttcaattggactaaaaattataccttatttaaaaaattaaaattattaaaaattagatttaaaaaaaaaaaaaaaaaaaaaaaaaaaaaa

SEQ ID NO: 16203 - DNA, 610 bp, Malus x domestica
  Predicted polypeptide sequence is orthologous to G44
acacttctagtcttcacttctttcttagtttttgaagtttctaagaactcgtttgaaagtgtttctatttagggtttttgaaatggcatcagaagactcttcagctttagagcagattaggcaacaccttttgaatgaatttacaacagtggatagcttcatcaccagtctcaacctttgcacctcccatatcccccaaaaacatgaaatcacccaatcacccttcaacacagcttcctcctcctcctccaccacctcctccgcaatcaccaccagcaccaccaacattggtagtgaatctactgaccaatatttcaaaatctccgattacttagtccctgaaattgatcaagacacccaattcgaaaccaaaccccaaatctcccacccaaaacctccaaaacactcaactctcagccaccgcaagcccgccataaacgtggccattccatccccaccaactctgtcgtcttcttctggtgatgaaaatcaaaacacatcaaacacttccaccgtggttgaagctgaagcaaggcactaccggggtgtgaggaaaaagccgtggggaaagtaccccgcggaaaatcctgacccagaactaagggggacc

SEQ ID NO: 16204 - DNA, 616 bp, Malus x domestica
  misc_feature (449)..(449): n is a, c, g, or t
  Predicted polypeptide sequence is orthologous to G129, G136, G140, G146
cgcattttttttttttttttttatttatatatcagacatatataataaatgttcaaaccaacattatgaaagattcgatcacatgtaagttggaggaacttgttagggtaatttctcacagaaatcttagtagtacacattgctgcaggcataaatataaaaatacagatgagaaatccgctttcatatactaaaatacgtacgtatgcctacgtacttggtaccaacggtcttcattcccaaagcaatcttgatcattcatctggtgttattatacacgcccaccacagtaaactaaatcagcagaagcaatacagaccaagcatatatattaaactaattgaagggaaatctgatcgcggcggggattgtagtgatgattgggttgtaacacgttcacttggaaatagtcccgagagtcgtatggctgaaactgcaagatctcatancttcctcctccagccatcacatttatgttctgctggcccctctcattctcaactatctttgctcgtaggagctggtaattgttgtgcaagtccagttcccttttccgcttgtactcaatttcggcaaaaaagaactcaatctttttggatcggattctactaatgga

SEQ ID NO: 16205 - DNA, 876 bp, Malus x domestica
  Predicted polypeptide sequence is orthologous to G129, G136, G140, G146
gcaattcttccttcccgttgccaagtgcaaccccaatagaaaaactcaaagtcaagaactagctaacagagaaaaccacaattcatcaatttggaggggtttttgccatttttcatccttgcaacaatggagttcccaaatcaagcacccgagagctcctcccagaaaaaattgggaaggggcaaaattgagattaagcggatcgaaaacactacaaatcgacaagttaccttctgcaaacgccgcaacggattgcttaagaaagcctatgaattgtctgttctttgtgatgctgaagttgctcttatcgtgttctccaaccgtggccgcctctatgagtatgctaacaacagtgttagagcaacaatcgacaggtacaaaaaagcatacgctgatcctacgaacagtggatctgtttcagaagccaacactcagttttatcagcaggaagcatccaaactgcgaagacagatccgagaaattcagaattcaaacaggcatatactgggtgaagctcttagctccttgaacgccaaggaactgaagaacctagaaggaagattggagaaaggaatcagcagaataagatccaaaaagaatgaaatgctgttttctgaaatcgaattcatgcaaaaaagggagaccgagctgcaacaccacaacaattttctgagagcaaagatagctgaaaacgagagggaagagcagcagcatacacacatgatgccgggaacttcctacgatcagtcaatgccttcgcattcttatgacaggaacttcctcccagcggtgatcttggagtccaacaataaccattaccctcaccaagtccagacagctctccaacttgtttgaaatgctggactgccgtctgat

SEQ ID NO: 16206 - DNA, 1037 bp, Malus x domestica
  Predicted polypeptide sequence is orthologous to G129, G136, G140, G146
ttctttattttctgcatatctccttgtttagatttgtggagctgtgaaaaaatcccaaaagcttccaactatggcctatgaaagcaaatccttgtccttggactctccccagagaaaattgggtaggggaaagatcgagattaagcggatcgaaaacacaacgaatcgtcaagtgaccttctgcaagaggcgcaatgggttgctcaagaaggcctatgaactctctgtgctctgtgatgcagaggttgctctcatagtcttctctaaccgtggccgcctctatgagtatgccaacaatagtgttaaaggaacaattgagaggtacaagaaggcaagtgcagattcttcaaatactggatcagtttctgaagctagtactcagtactaccagcaagaagctgcgaaattgcgtgcgcggatagtgaaattgcagaatgacaaccggaatatgatgggtgatgcattgaatagtatgtctgtcaaggacctgaagagcctggagaataaactggagaaagcaattagcagaatccgatccaaaaagaatgagctcttgtttgccgaaattgagtacatgcagaaaagggaactggacttgcacaacaataaccagctcctacgagcaaagatagctgagaatgagagggccagcagaacattaaatgtgatggccggaggaggaacttcaagctatgacatcctgcagtctcagccatacgactctcggaactatttccaagtgaacgcgttacaacccaatcatcagtacaatccccgccacgatcagatttctcttcaattagtatgaatgatccagattgcttggggaatgaagaccgttaccaagtacgtaggtatacgtacgtatattagttgatggaaggggatttcttgtctgtatttttatatttatgcctcctgcaacgtgtactactaagacttctgtgagacattaccctaacaagttcttccaactttgatgtgattgaatcttcataatgttggtttgaatatctattatatatgtgtctgataaa

SEQ ID NO: 16207 - DNA, 1065 bp, Malus x domestica
  Predicted polypeptide sequence is orthologous to G129, G136, G140, G146
acccacttcccacttctgcaattcttccttccggttgccaagtgcaaccccaaaagaaaaactcaaagtcaagaactaacagaaagagccacaattcatctattttgaggggtttttgccatttttcatccttgtaacaatggagttcgcaaatcaagcacctgagagctctacccaaaaaaaattgggaagaggcaaaattgagattaagcggatcgaaaacactaccaatcgacaagtcaccttctgcaaacgccgcaacggattgcttaagaaagcctatgaattgtctgttctttgtgatgctgaagttgctcttatcgtcttctccacccgtggccgcctctatgagtatgctaacaacagcgttagagcaacaatcgacaggtacaaaaaagcatgcgctgattctacggacggtggatctgtatcagaagctaacactcagttttatcagcaggaagcatcaaaactgcgaagacagatccgagaaattcagaattcaaacaggcatatactgggggaatcccttagcaccttgaaagtcaaggaactgaaaaacctagaaggaagattggagaaaggaatcagcagaataagatccaaaaagaatgaaatcctgttttctgaaatcgaattcatgcaaaagagggagactgagctgcaacaccacaacaattttctgagagcaaagatagctgaaagcgagagggaacagcagcagcagcaaacacatatgattccgggaacttcctacgatccgtcgatgccttcgaattcgtatgacaggaacttcttccctgtgatcttggagtccaataataaccattaccctcgccaaggccagacagctctccaacttgtttgaaatgctggactgccgtctgatgttcttctatccatatcctctgatctgtcttcataaatctatgagataattgacgttgtagtttttatgtatatgggagaaccagtttgctcatgttctccataatatatatatgtgtgatgatggaccccaattctgtgataacatatatagtaaattttattttctcaccccga

SEQ ID NO: 16208 - DNA, 877 bp, Malus x domestica
  Predicted polypeptide sequence is orthologous to G129, G136, G140, G146
cagatattaagatggggaggggaaagattgaaatcaagaggatcgagaacacgacgaatcggcaagtgaccttctgcaaacgaagaaatgggctgctgaagaaagcatatgaactatccattctctgtgatgctgaagttgccctcattgtcttctctactcgtggccgtctctacgagtactctaacaacaacagcataagaaacaccatagagaggtacaagaaggcatgttcagatagcacaggatcatcctctgttactgaaattaacgctcagaactctaacaggcacttaatgggagatgccttgagcactctgactgtgaaagaactaaagcaggtggagaataggcttgaacgaggcattactagaatcaggtccaagaagcatgaactgctgcttgcagagattgagtacttccagaaaaaggagattgagctggaaaacgaaaatgtttattttcgaactaaggtatcagaagtcgagaggcttcaacaagcaaacatggtttctgggtcagagatgaatgcaatccaggcattagcttctcgccatttctttagccagaatatgatcgagggtggagaagctaccttcccacagcaagacaagaagaacctccatcttgggtaactaattagctttttgaaggcagaatcttcaaatgcaggaaatgctacctcaatcatcttaattatatccagataataatgatgatatatcttctcttatgctgaacaacttttctaattactagctttattatgtatttgtaaggattgtaatatgactttggggtttagtacccagtactacccagaataattactactacactatgatctggtattcaataagtttaaattaattagctt

SEQ ID NO: 16209 - DNA, 642 bp, Malus x domestica
  Predicted polypeptide sequence is orthologous to G129
atctccatgattggtgccgttgaagcttagaggagggttgtacaagtgagagacggtagatcacagaatgtgtgtaggattacccttacagattacaaagctgtcctgttgtaaactgaagtgagttttgtggtctttgtcaatttagttttgttaataaaatcttcctgtgatcttgttcaaattattttgtcaaataatttctccaaaatgtgggatttccctttggaagaaatctgaaaacgagagggaagagcagcagcatacacacatgatgccgggaacttcctacgatcagtcaatgccttcgcattcttatgacaggaacttcctcccagcggtgatcttggagtccaacaataaccattaccctcaccaagtccagacagctctccaacttgtttgaaatgctggactgccgtctgatgttcttctatccatatcatctgatctgttttcttaaatctatgagataattggttgtagtttttatgtatatgggagaaccagtttgttgttcatgttctctataatatcagaattttctgtattaactagctactctttcaactatgatgacaagtaaatttgatttctcaacctaattaaagtttccatctcaaaaaaaaaaaaaaaaaatgc

SEQ ID NO: 16210 - DNA, 605 bp, Malus x domestica
  Predicted polypeptide sequence is orthologous to G131, G135, G155
cgcattttttttttttttttttggcaaagaaatattcctttttatcatcgtttatatggatagaaacttatgcataacgtcgatccacaacatcatacaatgtacattaatttccacgaacttcatatagttcgtacacaagaaattagaaacacacaacagcaaaagctatgatcgcagtccctcacaacagcaaaagctggagccactaattatatgtaagcagctttttcaaattaattgggcagcagctggtgttgctgcgagaacataacccttggaaatgcactcatgcatgcatttgctcccaaagtagttgtcgaggtcgacgaagtgacatcagcaaaatgaaactcctgcaacttaactcttttttgcagacgcttgttttcttctcgcaattctttatgctttcttttcagcaagttgacgttctccgaaatgatctgtctcgatttagagcggatgcgttcaaccccagtttttaactggctttccaattgctttaattcttgcataccaagcgttgatagctcctctccagccaagtgcttcagccgcatttcgagggtttggattgatcttcttaactcttcgggttcaat

SEQ ID NO: 16211 - DNA, 831 bp, Malus x domestica
  Predicted polypeptide sequence is orthologous to G131, G135, G155
tctgggggtttcggttgtttggtttttttgagaaagaaaatcaaagaacaagcagttgaaagagtgagtggtaactcagagtccataaatatttaatcatggggagaggtagagttcagctgaagcgcatagagaacaagatcaacaggcaggtgactttttccaaaagaagcactgggctgctgaagaaggctcatgagatctctgtcttgtgtgatgctcaggttgctttgattgtcttctccaacaaggggaagctccttgagtacgccacagattcatgtatggagcaaatccttgaacgctatgaaagatactcttacgcagaaagacagctagttgaaccagattttgagtcacagggtaactggacctttgaatattccagactaaaggctaaagttgaggttttgcaaagaaaccataggcactatttgggagaagacctggattccttgactctcaaggaaatccaaagtttggagcaacagcttgacaccgctcataaacaaattcgattaagaaaaaatcaactcatgcatgaatccatcactgagcttcagagaaaggaaaaggcgatacaggagcaaaataacttgctagcaaagaagataaaggagaaggagaaggctgcagctcagccccaggttcaaaactgggagcagcagaaccatgaccttgacctgcttccacagccccttccatgtcttaacattggggggacgcagcaagatgaattccttcaagtgaggaggaaccagctggaccttacactggaaccattttattcatgccatctcggatgctttgctgcttgatcatcaatgggta

SEQ ID NO: 16212 - DNA, 1096 bp, Malus x domestica
  Predicted polypeptide sequence is orthologous to G131, G135, G155
cttcctcatcctgcttttgcttttcatcatcattcagctccctttcctttcttgtatgaaccaaattagggttttctctcaaatttggtatattttccatctcttgggtttctaagcattaaaaaagaaagtgctatttcttccgcttctcccctttctagttttagcaatatataagaaaaaacaagagagggaaaagaagaagaaatgggaagaggtaaggtgcagatgaagcggatcgagaacaagataagcaggcaagtaacgttttcaaagaggaggagtggattgctcaaaaaagctcatgagatctctgttctgtgtgatgctgaggtggcagttattgtcttctccaccgtagggaagctctttgagtattctactgatttcagcatggtgaggattctggatcgatacgaccaatattcctatgcagaacggcaacgcaccggagctgattctgaatcacaggaaaactggccggtggaataccccaagcttgcggcaaggattgaagtcttacaaaggaaactaaggaatttggtgggagaagatttagaccccttaagcttgagagagcttcaagatttggagcaacagcttgatacagctcttaagcgcatacgaacaagaaagaaccaactcgtgcatgaatccatttcagagatggacaagaagcgaaaggctctacgggaactaaacaagtcgctagcaaagaaggtgaaggagaataaaacgatgcttgaggaagaacatgaccaggtgcaggtagtagggcagcagcaaactaaccaaggccgccacaactcatccaccctcatgctcatgccgccgccgccccaacccccatcaacaccaacactacctacttttcgaaccaccaggtacgatctctctctctctctctctctcagcgatgtttctgttaagcaatatgcagaaggagaatagagaagttgcagaggaagaagaataagaaaacagagaaggttgagagagagagagagagagagaaagtgtgtgaattgcatttgtattttcttctttccttcaatgattacaatgatacagctatatagaagattacttgaatcta

SEQ ID NO: 16213 - DNA, 1176 bp, Malus x domestica
  Predicted polypeptide sequence is orthologous to G131, G135, G155
cttcctcatcctgcttttgcttttcatcatcattcagctccctttcctttcttgtatgaaccaaattagggttttctctcaaatttggtatattttccatctcttgggtttctaagcattaaaaaagaaagtgctatttcttccgcttctcccctttctagttttagcaatatataagaaaaaacaagagagggaaaagaagaagaaatgggaagaggtaaggtgcagatgaagcggatcgagaacaagataagcaggcaagtaacgttttcaaagaggaggagtggattgctcaaaaaagctcatgagatctctgttctgtgtgatgctgaggtggcagttattgtcttctccaccgtagggaagctctttgagtattctactgatttcagcatggtgaggattctggatcgatacgaccaatattcctatgcagaacggcaacgcaccggagctgattctgaatcacaggaaaactggccggtggaataccccaagcttgcggcaaggattgaagtcttacaaaggaaactaaggaatttggtgggagaagatttagaccccttaagcttgagagagcttcaagatttggagcaacagcttgatacagctcttaagcgcatacgagcaagaaagaaccaactcgtgcatgaatccatttcagagatggacaagaagcgaaaggctctacgggaactaaacaagtcgctagcaaagaaggtgaaggagaataaaacgatgcttgaggaagaacatgaccaggtgcaggtagtagggcagcagcaaactaaccaaggccgccacaactcatccaccctcatgctcatgccgccgccgccccaacccccatcaacaccaacactacctacttttcgaaccaccagaaaatcatgcagtgggggagtccaggcaagaggagcagtggatgacaatgattctgataaaggcggaagacctccacctcgaccggctgctgctacaaacacacgcatgccactgtggatgctttcgccatttgaatgaaatataagcttcgccggaagacgaccacctcgaccggcggaataccttctaatgctttcgccatttgaatgaaatataagctttcgccatttgaataaaatataagctttgctattgtaattaaagaataatattaaaaacaatgtttctgca

SEQ ID NO: 16214 - DNA, 1055 bp, Malus x domestica
  Predicted polypeptide sequence is orthologous to G131, G135, G155
cagtttctgggttgtctttcttttttggttgtttgggttttttgagaaagaaaaacagagaacaagcagttgaaagagttgagtggcaactgagagtccataagtatttaatcatggggagaggtagagttcagcttaagcgcatagagaacaagatcaacaggcaggtgactttttccaaaagaagaactgggctgctgaagaaggctcatgagatctctgtcttgtgtgatgctcaggttgctttgattgtcttctccaacaagggcaagctctttgagtacgccacagattcatgcatggagcaaatcctcgaacgctatgaaagatactcttacgccgaaagacagctagtcgaaccagattttgagtcacagggtaactggacctttgaatattccagactaaaggctaaggctgaggttttgcaaagaaaccataggcactatttgggagaagacctggattccttgactctcaaggaaatccaaaatttggagcaacagcttgacaccgctcttaaacaaattcgattaagaaaaaaccaactcatgaatgaatccatctctgagcttcagagaaagagaaaggcgatacaggaggaaaataacttgctagcaaagaagataaaggagaaggagaaggctgcagctcagccccaggttcaaaactgggagcagcagaaccatggccttgacctgcttccacagccacttccatgtctaaacaatggggggacgcagcaagatgaattccttcaagtgaggaggaaccagctggacctgactctggaaccattatatgaatgccatctcggatgctttgctgcttgatcatcaatcgttagaaaaaggtggaagaattaaatggaaagaaaacaaaactacatatgtgtgctatttctgtattaaatttctggtttcttggtaaatttggaccaaccctgaacgtagtagcaatccatatatgaggaattgaactttgaaagtggtctgtaaatctatttatattcatgccaaaaacctgagaaatattgagtataaaaaaaaaaaaaa

SEQ ID NO: 16215 - DNA, 1230 bp, Malus x domestica
  Predicted polypeptide sequence is orthologous to G131, G135, G155
gtcactcatatatagacagagaaggagagagaccagacccctaccttagagagagagagagagcagaagccatctgtgtgtcaactggttctttctctcccatttttcttggtttcttggtgggatttctggtttctctaaactaagagatcagttcagcaggaacaaccgtatatatattactaggattattaattatttatttataataataaataattgttagagagattatggggaggggaagggtgcagctgaagagaattgagaacaagatcaacaggcaggtgaccttctcaaagagaaggtcggggctgatgaagaaagctcatgagatttctgtgctttgtgatgctgaggttgctttgattatcttctccaccaagggcaagctctttgagtactccaatgattcctgcatggaaaggatcctggaaaggtacgaaagatactcatatacagagaggcagcttcttgcaaatgataatgaatccactggaagctggactctggaacatgcaaagctcaaggctagggtggaggttttacaaagaaatcaaagacactatatgggagaagatctccaatccttaagtctcaaagagcttcaaaatttagagcaacagcttgattctgcactgaagcacataaggtcaagaaagaaccaagttatgtacgaatcgatttctgagctccagaagaaggataaggcattgcaggagcaaaacaacttgctggcaaagaaggtgaaggagaaggagaacgcagtagctcaacaggcccaattggagcatgtgcaggagcagaggttgaactcctcttcctcccttcttccacgggcattgcagtccttgaatttcggcagcgggtccaattaccaggccattagatcaagtgaaggaataccaggagataatcagcagtatggagatgaaaccccaactccacatagacctaacatgctgctgcccgcttggatcgtccgccaccttaatgaatagaagaattcatcaccatgaaataatattatctccaaagggaataatattatgtgacatcaattaatcaagtaaacatattatacttatatatatatatatatatatatctatatatctataccaagaaattaattggtaatgtgcatgatgaaaaccctagactcgatctatctctaaatgtgtatcgtatgttggaattcattaatatatcttaagggcttgtttggta

SEQ ID NO: 16216 - DNA, 665 bp, Malus x domestica
  Predicted polypeptide sequence is orthologous to G131, G135, G155
caacagcttgattctgcactaaggcgcataaggtcaagaaagaaccaagtcatgtacgaatcgatttctgagctccagaagaaggataaggcattgcaggagcaaaacaacttgctggcaaagaatgtaaaggagaaggagaaagcagtaacttcacaggcacaattggagcatgcgcagaagcagagcttggactcctcctccacccttctaccacaggaattgcagtacttgaatttcagcaggtccaattaccaccaggctattagatcaagtaatggaatatcaggagataatcagcaggatggagatgaaaccgcgactccacatagacctaacacgctgctgcctccttggatgctccgccaccttaatgaatagaagcatttcatcaccatgaaataatatatccaaataatattaaaacaccaattaatcaagcaaacatactacacttatatatgtatacctagaaattaattggtatgtgcctgatcaaaaccctagcctcgatctagctccagatgtgtatcgtatattggaattcaattactagaattaatagcccaaaaactgtgttaggggttgtctacctcttgtaattaatgtactattttcaaattaacttaggaaacgtgcatgtgcgcactttgtccaaaaaaaaa

SEQ ID NO: 16217 - DNA, 1043 bp, Malus x domestica
  Predicted polypeptide sequence is orthologous to G133
atatcaactaaaacaagatctgaaaattactagaaaaaagtaagaaaattgagagagagattatgggtcgtggaaagattgagatcaagctgatcgaaaaccagaccaacaggcaggtgacctactccaagagaagaaatgggatcttcaagaaggctcaggagctcaccgttctctgtgatgccaaggtctccctcatcatgctctccaacactagtaaaatgcacgagtatatcagccctaccactacgaccaagagtatgtatgatgactatcagaaaactatggggatcgatctatggaggacacactacgagtctatgaaagacaccttgtggaagttgaaagagatcaacaataagctgaggagagagatcaggcagaggttgggccatgatctaaatggtctgagctatgacgatctccgttctcttgaggataagatgcaatcttccttagatgccatacgtgaaagaaagtaccatgtgatcaaaactcaaacggagaccaccaagaagaaggttaagaacttggaggaaagaagaggaaacatgctgcatggctatgaagctgccagtgagaatccacaatattgttatgtggacaatgagggagactatgaatctgcacttgtgttggcaaatggggcaaataacttgtacactttccagctccaccgcaactccgaccagctccaccaccctaacctccaccaccacagaggaagttcgctcggctcctccatcactcatctacatgatctccgccttgcttgatcgtgatccgagagatgattaatcgccactaagttttatattaaggtcacttataattttatatatattcctcagagacttaactgcttatgttctaaagtgtttttttagtgatgatctttaggcacttggattacctctaaaaacatatgcataaatatatctgggatgttttatttaatgataacactaacacaagaatctatggcctgaaagtaataatattatgaacacttccgtgcccaaaaaaaaaaaaaaaaaaaaaaa

SEQ ID NO: 16218 - DNA, 1102 bp, Malus x domestica
  Predicted polypeptide sequence is orthologous to G133
atatatcaagtaaaacaagatcagaaaattgctaggaaaaggtaagaaatttgagagagagagagaaattatgggtcgtgggaagattgaaatcaagctgatcgaaaaccagaccaacaggcaggtgacctactccaagagaagaaatgggatcttcaagaaggctcaggagctcaccgttctctgtgatgccaaggtctccctcattatgctctccaacactaataaaatgcacgagtatatcagccctaccactacgaccaagagtatgtatgatgactatcagaaaactatggggatcgatctgtggaggacacacgaggagtcgatgaaagacaccttgtggaagttgaaagagatcaacaataagctgaggagagagatcaggcagaggttgggccatgatctaaatggcctgagctttgacgagctggcttctcttgacgatgagatgcagtcttccttggatgccatacgtcaaaggaagtaccatgtgatcaaaactcagacggagaccaccaagaagaaggttaagaacttggagcaaagaagaggaaacatgctgcatggctattttgaccaggaagcagccggcgaggatccacagtatggttatgaggacaatgagggagactacgaatctgcacttgcattgtcaaatggggcgaataacttgtacactttccacctccaccaccgtaacctccaccacggaggaagttcgctcggctcctccattactcatctgcacgatctccgccttgcttgatcgtgatctgagatatgattaatcatcactaagttatatattaaggtcacttataactgcttttgttctaaagtgtttgcttggtgactatctttaggcaaggagttagacttggactacctctgaaaacagatgcataaatatgtgtgtggtgttttaatcaatgatagcactaaaaaaatccgcgcccttgttgcttgtgggtttgtttgtataattaatacttctattctatatatatcatggcagacattgcttttgatattttggtttgtttgtcttggatgtcttgtattggctttagggacttgtttggaaaagacaataactgcc

SEQ ID NO: 16219 - DNA, 890 bp, Malus x domestica
  Predicted polypeptide sequence is orthologous to G134
gaatgggattatcaagaaagcaaaggagatcactgttctatgtgatgctaaagtatctcttatcatttattctagctctgggaagatggttgaatactgcagcccttcaactacgctgacagaaatcttggacaaataccatggacaatctgggaagaagttgtgggatgctaagcatgagaacctcagcaatgaagtggatagagtcaagaaagacaatgacagcatgcaagtagagctcaggcatctgaagggagaggatatcacatcattgaaccatgtagagctgatggccttagaggaagcacttgaaaatggccttacaagtatccgggacaagcagtccaagttcgtcgacatgatgagagacaatggaaaggcactggaagatgagaataagcgcctcacttatgagctgcaaaaacaacaggagatgaaaatagaagagaatgtgagaaacatggaaaatgggtatcatcagaggcagctggggaactacaacaacaaccagcagcagataccttttgccttccgcgtgcagcctattcagccaaatctccaggagagaatctaattagatatatcttgcatttgcatgctctttctaactagttatattatctctccacctctctctctcttttcatctgtcaaggagttcttaagtttatgtcagatttccaatggtttgtaatggaattagcttcgttatgaggctttgttgtgaaccttgtaataattaaggcgtgcatgaactcggtatgtgggaaaatcactataatgtatgccccagtgcaacatgtacttgtgtgtgtatacctaactttatgtgcttagctatacatatctatctcttccaaaccggtaaaaaaaagaaaaaaaaaaaaaaa

SEQ ID NO: 16220 - DNA, 1055 bp, Malus x domestica
  Predicted polypeptide sequence is orthologous to G137, G145
taacttagcataccctagagaacacgaatatcaaaaagggaaaacaaaacctagtaacataatataataatttgatatgtatgcaatcactgaaatatatttttataatataataagttaaaaagaggaatgggaagagggaaggtggagttgaagaggatcgagaataagataaatcgacaggtaacatttgcaaaaagaaggaatgggctgctaaagaaggcgtacgaactctcagttctctgtgatgctgaggttgctctcatcgtcttctccaccagcggaaagctctatgagttctgcagcggccctagcatagcgaagacgcttgagaggcatcaaagatgcacttatggagaactgggagcaagtcaatctgctgaggacgaacagagcagataccaagaatacttgaagctaaaaacgaaagtagaggccctacaacgcacgcagagacatcttcttggggaagatttggttcatttaggcacgaaggagcttcagcagcttgagaatcaactagatgtgtcgatgaagaaaatcaggtcaacgaagacccaatttatgcatgttcagatttctgagcttcaaaggaaagaagaaatgctactggaagcaaacactggactgagaaggaagttggaagaaattactgctggccatcaacgatcatggaatggcaatcaccaggctgctcaattagaaggattccctgagcatttgcaatacaacaatgcattgcagatcggtactccagtagtaacaaatgatgaggcgaatgtagcaacgtcctcagcacaaaatggtacgggattcttccccggttggatgctctgaatttcgaatcatgcatggtaaccaatcaaagagtagtggtgaccacatgtgttgtttcactgtccaaaagaataagaacgttaataatttgctgcctagtatcttttaatgttatagaagggttcattcattcatgagactaatgcccaagaattcatcacgattgttgtgccctaaaatatttcatttggattttaactttaccagtgagtagtata

SEQ ID NO: 16221 - DNA, 964 bp, Malus x domestica
  Predicted polypeptide sequence is orthologous to G137, G145
gaagagtggagctgaagaggatagagaacaagataaacaggcaagtcacatttgcaaagagaagaaatgggcttctgaagaaagcttatgagctctccgttctctgtgatgctgaggttgctctcatcgtcttttccaaccgtggcaagctctatgagttttgtagcagccctagcattctccaaaccgtagacaggtaccaaaagtgcagttatggtgcggtggatcaagtcaacatacctgcaaaggaacttgagagcagctatcgtgagtacatgaaactcaaaggtagatgtgagtccctacaacgaactcagagaaatcttcttggtgaggaattgggtccattaaacacaaaggagcttgagcagcttgagcgccaacttgaggcctccttgaagcaagttaggtccactaagacccagtatatgctggaccaactttctgcccttcagaacaaggaacaactgttaatcgaagccaacagggatttgacaatgaagttggatgaaattggttcaagaaatcaacttagacagtcatgggaaggaggtgaccagggcatggcatatggaacccagcatcaccatgctcaatcccaagggttcttccagcctttagattgcaatcccactttgcaaatagggtaccctgcagaggggtcagagcagatgggtgccacaactcatgcccaacaagtgaactgtttcatccccggatggatgctttgagtttgtgctgctgatgaatctgatcagtgcctctaatcagccataaaaaaacatatacccaagtttatgcttttttttttctttttttctggcaatatataaactgcatgtaaccttaatttcacataaaatcagcagtgactgcatttcaaggggacctttcaaaggcctaaagtccttttaacttttgttagagggcttaagtttacaatattgcgaacttatttcttgct

SEQ ID NO: 16222 - DNA, 1291 bp, Malus x domestica
  Predicted polypeptide sequence is orthologous to G137, G145
ttggaacctgaggttattgacccaaaagaaaaatcaggattggaacctgaggttaagaagataagccatcactcaagagacagaactacaagacaatcagctctaatctttctctctcttccactctctctctctctctctctctctctctctctctctctctctctctctctgtgtagggttttccaactgagtgagtatctaactttctcttgtgtttcacaaatttggttacagtttggtactgacctagaaaaggaggatcagtttgtaccaaagagagagagaagaacaagaaagggaaagaaaatattgtcaagatcaaaacttttggagattagatacacaaaataatatttttagtaactaaggacatggggagaggaagagtggagctgaagaggatagagaacaagataaacaggcaagtcacatttgcaaagagaagaaatgggcttctgaagaaagcttatgagctctccgttctctgtgatgctgaggttgctctcatcatcttctccaaccgtggcaagctctatgagttttgcagcagctctagcattctcaaaacactagacaggtaccaaaaatgcagttatggtgcagtggatcaagttaatagacctgcaaaggaacttgagagcagctatcgtgagtacatgaaactcaaaggtagatatgagtccctacaacgaactcagagaaaccttcttggtgaggacttgggtccattaaacacaaaggaacttgagcagcttgagcgtcaacttgagggctccttgaagcaagttaggtccactaagacccagtatatgctggaccaactttctgaccttcagaacaaggaacaactgttaatagaagccaacagggatttgacaatgaagttggatgaaattagttcaagaaatcaacttagacaatcatgggaaggtggtgaccagggtatggcatatgcaacccagcatcaccatgctcaatcccaaggattcttccagcctttagattgcaatcccactttgcaaatggggtactctgcagtggggtcagagcagatgagtgctacaactaatgcccagcaagtgaactgtttcatccctggatggatgctttgagcatgtgctgatgaatctgatcagtgcctctaatcactcataagaaagcatgcccaattatgctttttttttcctggcaatattatataaaatgcatgtaacttattttcacataaactcagcagtgactgaatttcaaggggacctttcaaaggcctaaagtccttttagaactc

SEQ ID NO: 16223 - DNA, 1177 bp, Malus x domestica
  Predicted polypeptide sequence is orthologous to G137, G145
attttcttcatgttaccctcatctttttatcccttttggtataccctaaacacacagcctcctgaaagaaagtttgtctacctctgatcttaaccaagtagagagagagagagagagagagagatgggcagaggcagagttgagctgaagaggatagagaataaaattaacaggcaagtgacctttgccaaaagaagaaatgggctgctcaagaaagcttatgagctctcagttctctgcgatgctgaggttgccctcattattttctctagccgtggcaagctctatgaattctgtagcagtttcagcatgatgaaaacgcttgaaaagtaccaaagttgcagttatggttccctggaagccaacctaccagccaacgagacccagaacagctatcaggactatttgatgttgaaggcaagagttgaggtcctccaacaatctcaaagaaaccttcttggggaagatttgtcccacctgaacacaaaggagcttgagcatcttgagcatcaattggagacctctttgaagcaaattaggtcaagaaagactcagtttattctcgatcagctttctgatcttcaaaacagggaacagatgctagttgaagctaacaaagccttgaagaggaagctggaagaaacaagtgtgcatgctccagaaggaatggcatgggaagctgctggccatggccccaacaacattcagcaaactcggcttccttcccactcagaagccttcttccatcccttggaaggaaacaactccagttcccaaattggatacacccatatgggttcagataatgaaatgaatgttggaaatccgggccagtatgttaatggatatattcctgggtggatgctttgactttgattatgcatataatatccatcgtgacatataatatacatatacatatatatatgtatatgtatggaataaaattagcaatggatcatgttgatcaagcttttataatattttctgttatgatcttataattctatgcaacttgtaatgattcttgaaacaataagaataatatatatatatatatatatatatatataaatatatatatatgttttgtaagttgaattaatgtcattgaaaaacttctatgaaatgtatgagaccaatttgtatatataaaggtttacaatccttctttctt

SEQ ID NO: 16224 - DNA, 958 bp, Malus x domestica
  Predicted polypeptide sequence is orthologous to G137, G145
aggtaaagttgagctgaagaggatagagaataaaagtaacaggcaagtgactttttccaagagaagaaatgggctgctcaagaaagcttttgaactctcagttctctgcgatgctgaggttgccctcattattttctctggccgtggcaagctctatgaattctctagcagtttaagcatgatgaaaacgcttgaaaggtaccaaagatgcagttatagttccctggacgccaaccgacctgccaacgagactcagaacagctatcaggagtatttgcagctggagacaagagttgaggccctccaacaatctcaaagaaaccttcttggggaagatttggccaccctgaacacaaagaagcttgaggagcttgagcatcaactagagacctccttgaacaaaattaggtcaacaaagactcaatttatgcttgatcagctttctgatcttcaaaacagggaacaaatgctagttgaagctaataaagccttgaggaggaagctggaagaaacaagtgtgcaagctccacaatttatggcatgggaagctgctggcgatggccacaacaatattcagcaaacttggcttccttccaactcagaagctttcttccatccctttggaggaaacaactccacttcccaaattggatacgcccatttgggttcacataatggaatggatgttggaaatccgggccagcatgttaatggatacattcctgggtggatgctttgactttgtttctgcctaataataatatccatcgagatatatatgtggagaatgaaatttgcaagggatcattgatcaagcttctattttattttttgttgtgatctgttatttctctgcaacttgaaacaataagaatatatacatgttttgtaagttgaattgacgtcactgaaaaacttctatgaaatatatgaaacttaaaaaaaaaaaaaaaaaaaa

SEQ ID NO: 16225 - DNA, 993 bp, Malus x domestica
  Predicted polypeptide sequence is orthologous to G137, G145
acaaaataatatttttagtaactaaggacatggggagaggaagagtggagctgaagaggatagagaacaagataaacaggcaagtcacatttgcaaagagaagaaatgggcttctgaagaaagcttatgagctctccgttctctgtgatgctgaggttgctctcatcatcttctccaaccgtggcaagctctatgagttttgcagcagctctagcatgctcaaaacactagacaggtaccaaaaatgcagttatggtgcagtggatcaagttaatagacctgcaaaggaacttgagagcagctatcgtgagtacatgaaactcaaaggtagatatgagtccctacaacgaactcagagaaaccttcttggtgaggacttgggtccattaaacacaaaggaacttgagcagcttgagcgtcaacttgagggctccttgaagcaagttaggtccactaagacccagtatatgctggaccaactttctgaccttcagaacaaggaacaactgttaatagaagccaacagggatttgacaatgaagttggatgaaattagttcaagaaatcaacttagacaatcatgggaaggtggtgaccagggtatggcatatgcaacccagcatcaccatgctcaatcccaaggattcttccagcctttagattgcaatcccactttgcaaatggggtactctgcagtggggtcagagcagatgagtgctacaactaatgcccagcaagtgaactgtttcatccctggatggatgctttgagcatgtgctgatgaatctgatcagtgcctctaatcactcataagaaagcatgcccaattatgctttttttttcctggcaatattatataaaatgcatgtaacttattttcacgtaaactcagcagtgactgaatttcaaggggacctttcaaaggcctaaagtccttttagaactcatttcttgctttgagactacggttataaaatgttttcctctttttca

SEQ ID NO: 16226 - DNA, 633 bp, Malus x domestica
  Predicted polypeptide sequence is orthologous to G137, G145
gagagagagagagagagagagatgggaagagggagggtggaattgaagaggatagagaacaagatcaacagacaggtgacctttgcgaagagaaggaacggactattgaagaaagcctacgagctttccgttctttgcgatgccgaggttgctctcatcatcttctccaatagaggaaagctgtacgagttttgcagtagttcaagcacgctcaaaactcttgagaggtaccagaagtgcaactatggagcaccggagacaaatatatcaacaagggaggccttggagttgagtagccagcaggagtatttgaagctcaaggcacgttttgaagccctacaacgaaaccaaaggaatctccttggagaagatcttggccctctaagcagcaaagatcttgaatcacttgaaaggcagctggatatgtcgctgaagcagatcagatccacacggacccaatgtatgctggatcagctcacagatcttcagcgaaaggagcacatgctaaacgaagcaaataagaccctgaaagaaaggttgttcgagggataccatgcactcccactgaatgcaaatgccgacgagtacagccgcccacaaccccggcggcgcgggggaggtttctcctcccct

SEQ ID NO: 16227 - DNA, 1256 bp, Malus x domestica
  Predicted polypeptide sequence is orthologous to G142, G148
actagttctctccacagacagttcaccaaaccacccatttttgtgtaaccccaaatcctagagaagaggaatatctctctctctctctctctctgtctctatgcatatgggataacaaatacagagacaaaaagcacaatatagatttcatatttaatttgcaaaaggaaggggaaattgaagaggtgagaatatggggagggggagagtggagctgaagagaatagagaacaagattaacaggcaggtgactttctcaaagaggagaaatggtttattgaagaaagcctatgaactctctgtgctttgtgatgctgaggttggccttatcatcttctctagccgtggcaagctctatgagtttgccagcgctggtatgagcaaaacccttgaacgataccaacgttgctccttcactccacctgagaatagcattgaacgtgaaacacagagctggtaccaagaagtcacaaaactgaaagctaaatatgaatcccttcagcgaactcaaaggcatttgcttggtgaagatcttggaccactgagtgtgaaggagttgcaaaatcttgaaaaacaacttgaaggagctcttgcacaaaccagacaaaggaagacacagcttatgattgaacaaatggaggacctgcgcaaaaaggagcgtcaccttggagacctcaacaagcagctgagggtcaagcttgaggcagaagggcagaatctgaatgtcattcaaaacatgtggagctcagatgcagcggctggaagtagcaacttttctttgcattcttcacaaaccaaccccatggactgtacacctgaacctgtcatacaaatgggataccatcagtatcatcctgctgagggatcatctattccaaggagcttgactggtgagaccaacttcatccaaggatgggttctctgaaaaccttcaataccaaaaatgaaggatatatatttcatattttatctattattgcagcatcataaattatattttctaatatctatactttgcaagaatatatgactttaagaattggaatactgccaacatatatttacttcaagtatgactgacaagagatgtttgtaaatttgtaattatacttctagattcctgtgtttccttattcttatttggttttctttttacttttatttattgataattgcttgtatttttgggccctgacggttggattgtcaaggaccattcaattgagccttggtttacattaaaaaaaaaaaaaaaa

SEQ ID NO: 16228 - DNA, 698 bp, Malus x domestica
  misc_feature (617)..(617): n is a, c, g, or t
  Predicted polypeptide sequence is orthologous to G154, G627, G1011, G1797, G1798
gagagagagacaaagtgtggcctgaggataaagagagtgggcatccacaatcagataaaaatatccttctctgcgtttcccttctctgtgaatactattctagggtttctgatctagtttccatatttggattccttccaatccaataccgctgtgtccttgctgctcatttttaaggcaaagctaggacatggtgagaagtaaggttgagattaaaagaattgagaataacacaagccggcaagtgaccttctcgaaacgtcgaaaggggttgttaaagaaagcttatgagctttcggttctttgcgatgctgaagttgcagtcatcgtcttctcgcaaaaaggcaggatctatgagttctccagttctgacatgcaacggactataaatcgataccataaacatgaaaatggatcagggccaaccaacaaggttgaagtggaacaatatgtgcagcacttgaagcatgaatcagctattatggccaagaagatagagatcctagaagcttcccagcggtttatggcctagtttgatcatcatctcctgtatttttttctcatctgacattttattggattaggttttcctaaactctgaaatttgtatgtcttangaagcttttgggaaatgatctggattcttgccctgttgaagaactccaagagatcagtagccagctggagcgaagcttacg

SEQ ID NO: 16229 - DNA, 678 bp, Malus x domestica
  Predicted polypeptide sequence is orthologous to G184, G186, G916
gtccgagccagatcagaagcccctatgattactgatggatgtcaatggagaaagtatggacagaagatggcaaaaggaaacccatgtcctcgtgcatattataggtgcacaatggctgtaggctgtcctgttcgcaaacaagtacaacgttgtgctgaggacagaaccatactgatcacaacatatgaaggcaaccataaccacccactgccacccgctgcaatggccatggcatccaccaccacggcagccgccagcatgctgctttcggggtccatggcaagtgcggacgggatgaatatgaaccctaataatttgctagccagagcaattcttccttgctcatcgagtgttgccacaatttcagcctcagctccattcccaactgtcacattggacctcaccacatctccattacaattccaaagaccaaacaccccatttcaaatccctaatttcccagggcaaccccagagttttggggcagcttcacaacaactgcctcaaggttttgggcaggccctctacaaccagtctaagttttcaggacttcaattatcccaggatttaatggggtctactagttcacaacaacaacaaatgcagcaaactcagtcttcctcgtttgctgacacagtgagtgccatcacggctgatccgagctttactgctgctctc

SEQ ID NO: 16230 - DNA, 622 bp, Malus x domestica
  Predicted polypeptide sequence is orthologous to G184, G186, G916
ctgaatttgacgcaaagccagaaggctgatcagaacagtagcggtgccgaaggccatcgagtgacagtggaagaaaagaagcttatgaatggcaatggatcatcactagtggtgccgaggcagttcatggatcttgggttagctgctaaaaatggtgacgctgatgagcattcatagtcttcgtctgatgaacgaagtcatggcgaacggtttggatcgcttggagataatgtgaaggctgcagggcacagtgatgaccaaaggatcggttttgatcacgaaaagaaggatttcgggagacgaattgggagagaggagagcccagatcagccgtcacagagttgggggcttaacaaagttccgaggctcaattctccgaaagaggttggtcaaactgaggctacaatgaggaagtttttgtttgatgctttggaaacagtttggttgttttaagcttatgattagttaatcgttttaagtcaatgttatgttgctttcctataagatcgatttatgttttggtctttttgaaaagtgggagcatattatgtgattgactgtttaatatcagtttatgttatgagtcatatttgcagtctggaaaaaaaaaaaaaaaaaatcg

SEQ ID NO: 16231 - DNA, 618 bp, Malus x domestica
  Predicted polypeptide sequence is orthologous to G184, G186, G916
ttcgtatcgtcaaaagattaattaaattttatggacaaaggatgggggctcactcttgattctgactccttcggctacctcctcaacaagccgcccaccgccgcggttaagctcgaccaccacaacaacaagagaagcagtttttttggtggggaaaggatgttccagggaatggaattccccgtcaaacttggccgccgggaagagcaggatgcatcacagccgtccaatgacaacaaccggatggttgtggatgaggtggacttcttttccgatcgtaagaacaagctcaataccaatagtactgatgaccatcatcaggattcgaaatccaatggtgcagtcagtgtcaagaaggagaattggactggtttggatgttaatactggattgcagcttgttactgcgaacaccggaagtgatcagtcgatggttgacgatgggatttcttctgatcatggggttaacaaaagagcaaagaatcatgagctggcacagttgcaagtggaggtgcaacgtatgaatgctgaaaaccagaggctgaaagaaatgcttggtcaagtgaccaacaactacagtgcactgcagatgcatcttgctgcagtttgtcaacgacaa

SEQ ID NO: 16232 - DNA, 622 bp, Malus x domestica
  Predicted polypeptide sequence is orthologous to G189
caggtagaattagcaactataagaacaagagaaagtccttatggaagatagatttaccagtcgtagcctatgccttcgtctttcgatgatcagacctaagaaaggcggcctaattccgatcaaaaaaagagagaaattcccccagaaagggtagagccttagttacccgcaggtcataagctggtaaccagtggaagagcaagaactttcaggtgaaagaccctcactcgaactcagtaggaagccaagcacgcacgaaagaagcttcccgagctgctgcctttaccttcttcctggggaggggtctctagcacattataatgcgagctcggatgcggattcccttaaattagatttcgtgagattagatgggctgggctatgtcttcggtctggatgaatgcgagtgcacgaaaggtctgatcggctcataggtggaagacactaccttgaattagctcttttcctctttctttttcacaagcatgagtaggacttatagtcttggaaaagtcacccgactaagcaaagaaggaggacctagttaaggaagaatcgaccgaagtcagagaaagtgagccagccttccggaaacggtgaattcataatataatgtccttctt

SEQ ID NO: 16233 - DNA, 630 bp, Malus x domestica
  Predicted polypeptide sequence is orthologous to G192
atctcttagcttatcctcctcctttgctttccctttcctctctctcactctgtttctctctcctgtctctctctcttaatcaattggacaactcttctgtctcatcttgatccatttcttcctcctttttagtgtcatttgcttctgcagcttccttttctccatccccagaagaaaaaaaaaaaggaaaaaagaagatagaacatcaccaaggaggaggagcatggatgaaaccctttctccagaaccagactcagatgtttcaagaaatctcaggccagaaactcagccatccaaaagaaggaaggtggctcatgagaagactgttgtgacagtgaagataggagctaatgttgggaagctaaagaatgaagggccgccttccgatctttggtcatggaggaaatatggccaaaaacccatcaagggatctccttatccaagggggtactaccgttgcagtacatcgaagggttgctcggcgaaaaaacaagtggaaagaagcaaaaccgatgcttcagttctcataattacctacacttccagccacaatcatccaggtcctcctgatgtgaatgtgatctccactacccaacaagaacaagaagatgaacagacccaacaagaaca

SEQ ID NO: 16234 - DNA, 704 bp, Malus x domestica
  Predicted polypeptide sequence is orthologous to G194
agcaatgaagaagaagaacatcatgagcaacaaaagaccaagaaagagttgaaagcaaagaagacgagtcagaaaaggccgagagaacccagatttgcattcatgacaaagagcgaagttgatcatctggaagatggctacagatggagaaagtacggccaaaaagctgtcaaaaatagcccctttcccaggagttactatcggtgcacaagtgcatcatgtaatgtgaagaagcgagtggagcgatctttcgacgatccgagcattgttgtaactacttatgaaggccaacacactcatcgcagcccactcctgcctcgcccaactctccctgcggcttctgcttttccagctaataactttgagatgccattaatccccacaagaaccctatttactcatgactatcaacaagtacaaccatttgcagataacaactcctcttcgccttcatcggcaccaattaattttggtgattattatgtgaatggctcttcattgtttacaaatgctactagtaccacgggctttcttcatcccgaaaggcggttttgctctccggcaaccggttctgctttgttagctgaccatggccttcttcaagacatagtcccctctcatatgctgaagcaagagtagaagatatatacccttatatatatatatgatcatcatcagatagtgagatcattccaatccatcag
